United States Patent 11,931,406 (FLAVIVIRUS VACCINE) - sequence listing, part 37

SEQ ID NO: 14324 - RNA, 9876 nt, Artificial Sequence
  derived and/or modified CDS sequence (opt3) from DENV-2__KX380829__SS-prME
accgcaggcgugaucauuaugcugauacccacugcuauggcauuccaccucacuacgagaaacggggaaccucauaugaucgucagcaggcaggaaaagggaaaaucccuucuguuuaagaccgaggacgguguuaauaugugcacauugauggccauggauuuaggcgaacugugugaggacacuauuaccuacaacugcccacuacuccggcaaaaugaaccggaggauaucgacuguuggugcaacucuacaucaaccugggugacuuaugggacauguaccgcgacgggagagcaccgccgagaaaaacguaguguugcucuggugccccaugucggcaugggucuugagacuagaaccgaaacauggaugagcuccgagggggccuggaagcacgcacagaggauugagacuuggauccugcggcauccuggauucaccauaauggccgcuaucuuggcauacacaauuggcaccacguauuuucagcgcgugcucaucuucauucugcugacugccguugcuccaucuaugacaaugagaugcaucggcauaucgaauagggauuuuguggaaggggucucaggagguagcuggguggacauuguacucgagcacggcaguuguguuaccacuauggccaaaaacaagcccacauuagauuucgaacugaucaagaccgaggcgaaacagccugcaacgcuucggaaguacugcauugaagccaaauugaccaauacaacuaccgcuucccgcuguccaacacaaggggagcccucucugaacgaggaacaggacaagcgauuugugugcaaacacagcauggucgauagaggauggggcaaugguugugggcuauucggaaagggcggcaucgugacuugcgccauguuuaccugcaagaaaaacauggaggggaagaucgugcagccugaaaaucucgaguauacaauugucguuaccccacauuccggagaagagaacgcaguggguaaugacacuggcaaacacgggaaggagauaaaaguaacgccgcagucaaguaucacagaagcugagcugaccggauacggcacugugaccauggaauguagccccaggacaggucuugauuucaacgagaugguccuguugcaaauggaaaauaaggccuggcucgugcaucggcagugguuucuggacuuaccucugccauggcuccccggggcggauacccagggcucuaacuggauucagaaagagaugcuuguuacuuucaagaacccucacgccaagaaacaagacguggucgugcugggaucccaggagggcgcaaugcacacagcuuugacgggggccaccgaaauccagaugucaagcggaaaucuacuguuuacuggucaucucaagugccgucugcgcauggacaaacuucaacugaagggcaugaguuauucuauguguacagggaaauucaagguaguuaaggagauagcugaaacccagcacggaacaauuguggucagagugcaguacgagggcgaugguuccccaugcaaaauccccuucgagaucauggacuuggaaaagaggcauguccucgggcggcugauuacugugaacccgaucguuaccgagaaagauagcccugugaauauugaagccgagcccccauuuggcgacucguacauaaucauuggaguagaaccuggccaguuaaagcugucuugguucaaaaagggguccucaaucggacaaauguuugagacgaccaugcgaggugcaaagcgcauggccauccuaggcgauacagcuugggacuucgggagucucggaggcgucuuuacuagcauugguaaagcgcugcaccagguguucggggcaauauauggcgccgcuuuuuccggaguuucuuggaccaugaagauccuuauuggcguggucaucacauggauugggaugaacagcagaucaacaaguuuguccgugagccugguacucgugggaguugucacccuguaccuuggcgugauggugcaggccgauucugguugugucguuucauggaaaaauaaggagcugaaaugcgggaguggaaucuucauaacggacaacgugcauacauggaccgaacaguauaaguuucaacccgagagcccauccaaguuggcaucugccauccagaaagcucacgaagagggcauuugugguaucaggucggugacucggcucgaaaaucugauguggaagcagauuacacccgaguuaaaccacauccugagcgagaaugaaguaaaacuaaccauaaugacuggcgauauuaaggggaucaugcaggccggaaaacgcucccucagaccucaaccaaccgagcugaaguacucauggaaaacauggggcaaggcaaagaugcuuaguacggaaccgcauaaccagaccuucuugauugacgggcccgagacugcggaaugcccuaauacaaacagggcuuggaacucucuggaggucgaggauuauggauuuggcguguucaccacaaacaucuggcucaaacugaaggaacgucaggacguauuuugugacagcaaauuaauguccgccgcaauaaaggauaaucgggccgugcacgcugacauggguuacuggaucgagucagcccugaacgauacuuggaaaauugaaaaggccagcuucaucgaggucaagucuugccauuggccaaaaucccacacccuuuggaguaacgggguguuggagagcgaaaugauuauccccaagaauuucgcuggaccuguuucucagcacaacuaucgaccaggcuaccauacgcaaacagccggucccuggcaccucggcaaacuggagauggacuuugauuucugugaagggaccacugugguagucaccgaggacugcggaaauagaggcccgucccuaaggacaacuaccgcgucagggaagcugauaacagaauggugcugucgcaguugcacgcucccuccacugcgguacaaaggagaggauggcuguugguaugguauggagauuagaccccuuaaggaaaaggaggaaaacuuggugaauagccuggugaccgccgggcauggacagaucgacaacuuuucguuaggcguccucgguauggcucuguuccuugaggaaaugcugaggacucgcguuggcacaaaacacgcaguguugcucguagccguguccuuuaugacccugaucacugggaauaugucuuuccgagaucuaggacgggucauggugaugguuggcgcugccaugacagacgauauugggaugggagugaccuaccuggcacuccuggcggccuuuaagguccguccuacguucgcugccggccuuuugcugagaaaauuaacuagcaaggagcucaugaugaccacaaucgguauugugcugcuuucacagaguaccauacccgagacuauccuggaacuaacagacgcacucgcucuggggaugaugauuuugaaaaucguuaggaacauggagaaguaucaacuggccgugaccauuauggcaaucuuaugcgccccaaaugcugucauacuccagaacgcguggaagguauccuguacaauccuggccgugguuucugugagcccucuucuguugacuuccucacagcagaaagcagauuggauuccccucgcucugaccaucaagggacuaaauccaacggccauuuuucugacaacccuuagccgcacuaacaaaaagcggaguuggccgcucaaugaagccaucauggcugucggcauggugucuauacuggcauccagcuugcugaaaaacgacauuccuaugaccggccccuuaguagccgggggacuccugacagugugcuacguccuuacugguagaucggcggaccuggaguuggaaagggcugccgauguucgaugggaggaccaagcagagaucucaggcucuaguccaauccucuccauuaccauaagcgaagaugggucuaugagcaucaagaaugaggaagaggagcagacgcugacaauucuaauccgcaccggacugcuugugauuuccggccucuuccccgugucaaucccuauaacugccgcugcaugguaucugugggaagucaaaaagcagcgggccgguguguugugggacguuccaagucccccuccgguagggaaggcggaguuagaagauggagcuuacagaaucaaacagaagggcauucugggcuauagccaaaucggggccggaguguacaaagaggguacauuucauaccauguggcacgucacuaggggcgcagugcucaugcacaaggggaaacguauugaaccaucuugggccgacguucgcaaggaucugaucuccuacggaggcgguuggaaacuugagggggaguggaaagaaggagaggaagugcagguccuggcuuuggagcccggcaagaacccucgggccgugcagacaaaaccaggccuauucaagaccaacacggggacuauaggagcaguaucacuggacuuuagucccgguaccagcggcuccccuauugucgauaaaaaggggaaggugguuggacucuauggcaaugguguggucacaagaucugggaccuacgugucggcuaucgcccagacagaaaagagcaucgaggacaacccggagauugaagaugacaucuucaggaagaaacgacugacuauaauggaucuucaucccggagcgggcaagaccaaacgguauuuaccagccauuguucgcgaggcaaucaagagaggccugaggacgcucauuuuggcuccuacacggguggucgccgcugaaauggaggaagcacugcgagggcuccccaucagauaccaaacuccagccauacgcgccgagcacaccggaagggagauuguggaccugaugugucaugcuacauucaccaugcgucuucugucaccuguacgggugcccaauuauaacuugaucaucauggacgaagcgcacuuuacugauccagcauccauugccgcuagagguuacaucaguaccaggguugagaugggcgaagccgcagggauuuucaugacagccacgccgccuggaucucgcgaccccuuuccacagagcaaugcucccauaauggaugaggagcgagaaaucccugagagauccuggaacucaggccaugaaugggucacugacuucaaggguaaaaccgugugguuugugccaucuauuaaggcggggaaugauaucgccgcaugccuacggaaaaacggaaagaaagucauccagcugagcaggaagacauucgacagugaguauauuaagacccgcacuaaugauugggacuuuguagugacaaccgauauauccgaaaugggcgcuaacuucaaagccgagcguguuaucgaccccagacgguguaugaagccugugauucucacggauggcgaggaaagggucaucuuagcagggccgaugccagugacucacagcucugccgcucaacgccgaggaagaauuggucggaaucccaaaaacgagaaugaccaguacaucuacaugggcgaaccucuggagaacgacgaagauugcgcccacuggaaggaggcgaaaaugcuucuggacaauauaaacacacccgaggggaucauuccaucaauguuugaaccugagagggaaaagguugaugcaaucgacggagaguaucgccucagaggcgaagccaggaaaaccuucguggaguugaugcggcguggugaucugcccgucuggcucgcuuaccgcguggccgcugaggggauuaacuaugcagaccgaagaugguguuuugauggcaucaagaauaaccagauacuggaagagaauguagaaguggagauuuggaccaaggagggagagaaaaagaaacuuaaaccaagguggcuagacgcccggaucuacuccgauccucuggcuuugaaagaguucaaggaguucgccgcaggccgcaagaguuuaacuaugaaccugauuacagagauggggagacucccgaccuuuaugacacagaaagcgaggaaugcccuggacaaccuugcuguucugcauacugccgaagcaggaggucgggcuuauaaucacgcccucagcgaguugcccgagacgcuggaaacccuacugcuccuuacacuguuagcaacugucaccggcgggaucuucuuguuucugaugucgggaaagggcauagguaaaaugacacucgggaugugcugcaucauuaccgccucuauccugcuuugguacgcucaaauucagccacauuggaucgcggccuccauaauucuggaguucuuucucaucguguugcugaucccugaacccgagaagcagcgaacuccacaggauaaccaauuaacguauguggucauugcaauccuaaccguuguggcugccacaauggccaaugaaaugggcuuccuggagaaaacuaagaaggacuuuggacucggcagcauaguagcacagcagccugagucaaacauucuugauaucgaccugagacccgcuagugccuggaccuuguacgcgguggcuacaaccuucauuacuccgaugcugcgccacucuaucgaaaauuccagcgucaacgugucacucacagccauagcaaaucaggccacgguucugauggggcuuggaaaagguuggccacucaguaagauggacaucggcgugccucuguuggcuauuggguguuacagccaagucaaccccaucacccugacugcagccuuacuacugcucguagcgcacuaugcuauuaucggaccaggccuucaggccaaagcaacaagggaggcccagaagcgggcugccgcagguauuaugaaaaaucccaccguggaugggaugaccguuaucgaccuggauccuauaccguacgaccccaaguuugaaaagcaguugggccaagugaugcugcucguccugugcgugacacagguccuuaugaugcguacuacgugggcuuuaugugaggcccugacccucgcgacaggaccaauuuccacuuugugggaaggcaacccugggagauucuggaauaccacaaucgccgugucuauggcaaacaucuuuaggggaagcuaucuggcuggcgccggucuacuguucuccauuaugaaaaacaccacuaauacgcgccgggggacaggaaacaccggcgagacucucggugagaaguggaaaaaucgacuuaacucacugggcaagucugaauuucagauauacaaaagaagugggauccaagagguugauaggaccuuggcaaaggaaggaauuaaacgcggcgagacagaccaucacgcugugucgcgggggagcgccaagcugagaugguucguagagcguaaucucgugacucccgaaggaaaggucauggaucugggcugcgguaggggagggugguccuauuacuguggcgguuuaaagaauguucgggaggugaagggccuuaccaaagggggaccuggccaugaagaaccaauccccaugucuacauauggguggaaucugguccgccuccagucaggaguggacguauucuuuacgccuccagaaaagugcgauacccuacugugugacauuggcgagagcucccccaacccgacuguggaggccggucgaacauugagaguucugaaucucguggaaaacuggcuuaauaacaauacccaguucugcaucaaaguccugaacccuuacaugccaagugugauagagaagauggaaacuuugcagaggaaguacgggggagcgcugguccggaauccccucucucgcaacagcacacacgagauguauugggugucaaacgcuuccggcaauaucguuaguagcguaaacaugauuucuagaauguuaaucaauagguuuaccaugcgacauaaaaaggcaacguacgaaccugauguggaccugggcuccgggacccggaacauuggaaucgagucagagacaccaaaucuugauauaauugguaaacguaucgaaaagaucaaacaagagcacgaaacuagcuggcacuaugaccaggaccaucccuacaagaccugggccuaucacggcucguacgagacaaagcagacugggucugcuaguuccauggucaacggagugguuagacugcuaaccaaaccgugggaugugauuccuauggucacacagauggccaugaccgacacuacgcccuucggccaacagcgcguguuuaaggaaaaaguagauacaaggacccaggagccaaaggaggguacuaaaaagcucaugaagauaaccgcagaauggcuguggaaagaguuggggaagaaaaagacaccucggauguguacgagagaagaguucacccgcaaagugaggagcaaugccgcucugggagcgaucuuuacugacgagaacaaguggaaaucagcccgagaagcaguugaggauucccgguucugggaacucgucgacaaggagagaaaucuucaucuggaaggcaagugcgagacauguguguauaacaugaugggcaaaagggagaagaaaauuggggaauuuggacgcgcuaaggguucucgugccaucugguacaugugguuaggcgcacgguuccuggaguuugaagccuugggguuccucaaugaggaucacugguuuagcagagaaaacagucuguccggaguggagggcgagggucuacacaaacuuggguacauucugagggaagucagcaagaaggagggaggcgcuauguaugccgacgauaccgcgggcugggacacucgcaucacacucgaagaucugaaaaaugaggaaaugguuaccaaccauauggagggggagcacaagaaauuggcagaagccauauucaagcugacauaccagaauaaagugguacgagugcaacggcccacuccaagaggaaccgucauggacaucauuucuaggcgcgaccagagagguucaggccagguggggacguauggacucaacaccuucacaaacaugggcgcucaacuuauccggcagauggagggugaagggguuuuuaagaguauucagcaucugacuaccacagaggagguggccguccaggauugguuagcaagggugggacgugaacgacugucccgcauggcuaucagcggcgacgauugcguaguuaagcccuuggacgauagauucgccucugcucucacugcccugaaugacaugggcaaagugcggaaggauauucaacagugggagccuucgaaaggguggaacgacuggacccaggucccauuuugcucacaccauuuccacgaacuaauaaugaaggauggaagggugcuuguggucccgugucgcaaucaggacgagcugaucgguagagcacggauuagccaaggcgcgggguggucccucagggaaacggccugccugggaaaaaguuacgcucagauguggucuuugauguauuuucaccgacgugauuuaagacuggccgcaaacgcuaucuguagcgccguucccucccauugggugccuacaucacgcaccacuuggaguauccacgcacggcaugaguggaugacaaccgaggacaugcucacuguauggaauaggguguggauucaggaaaacccauggauggaggauaagacccccgucgaaucuugggaggaaauaccuuaccuuggcaagagagaggaccaguggugcgguagccugaucgggcuaacaucccgcgccacgugggcgaaaaauauucaaaccgcuaucaaccaggugcggucacugauuggaagcgaggaauauacugacuacaugccaucuaugaagagguuccgaagagaggaagaggaagccggcguucucugguga

SEQ ID NO: 14325 - RNA, 9876 nt, Artificial Sequence
  derived and/or modified CDS sequence (opt3) from DENV-2__KX380830__SS-prME
accgccggaaucauuauaaugaugauccccacggugauggcuuuccaccugacuacgagaaacggggaaccucauaugauuguaagcaggcaggaaaagggaaaaucccuccuuuuuaagaccgagaaugguguuaacaugugcacccugauggcaauggacuugggcgaauuaugugaggauacuaucaccuacaauugcccacugcugcggcaaaacgaaccggaggacauugauuguuggugcaauucuacaucaaccugggugacuuaugggacauguaccgccacgggagagcaccgccgagaaaaacguaguguagcgcucgugccccaugucggcaugggucuggagacucggaccgaaacauggaugagcuccgagggggcuuggaagcacgcccagaggaucgagacuugggugcuucggcauccuggauucaccguuauggcagccauacuggcuuacacaaucggcaccacguauuuucagcgcguguugauuuucauccuccugacugcagucgccccaucuaugacaaugagaugcauuggcaucucgaacagggacuuuguggaagggguaucaggagguagcuggguugauauagugcuggagcacggcaguugugucaccacuauggcuaaaaauaagcccacacucgacuucgaauuaauuaagaccgaggccaaacacccugcgacgcugcggaaguacugcaucgaagcaaaacuuaccaacacaacuaccgccucccgcuguccaacacagggggagcccucuuugaaugaggaacaagauaagcgauuugugugcaaacauagcaugguggacagaggauggggcaacgguugugggcuguucggaaagggcggcauugucacuugcgcuauguuuaccugcaagaaaaauauggaggggaagaucguucagccugaaaaccuagaguauacaaucgugauuaccccacacuccggagaagagaaugccguagguaacgauacuggcaaacaugggaaggagauaaaagugacgccgcagucaaguaucacagaagcagagcucaccggauacggcacugcuaccauggaauguagccccaggacaggucuggacuucaaugagaugguccuucugcagauggaaaacaaggccugguuggugcaccggcaaugguuucucgaucugccuuuaccauggcugcccggggcggacacccagggcucuaacuggauucagaaagagacucucguuacauucaagaauccucacgccaagaaacaggauguggucgugcuuggaucccaagagggcgcaaugcauacggcucugaccggggccacugaaauccagaugucaagcggaaacuugcuauuuacaggucaccugaagugccgucuccgcauggacaaacugcagcuuaagggcaugaguuauucuauguguaccgggaaauucaagguaguuaaggagauagcugaaacacaacauggaacuauugugaucagaguccaguacgagggcgacgguuccccaugcaaaauccccuucgagauuauggaucuggaaaagaggcacguguuggggcggcucaucaccgucaauccgauugugacggagaaagacagcccuguuaacauagaagccgagcccccauuuggcgauucguacaucauuaucggaguggaaccuggccagcugaaguuaucuugguucaaaaagggguccucaaucggacagauguuugagaccacaaugcgaggugcaaagcgcauggccauucugggcgacacugcuugggauuucgggagucuaggaggcguauuuaccagcauagguaaagcgcuccaucaagucuucggggcaaucuauggcgccgcuuuuuccggagugucuuggacaaugaagauucugaucggcguugugauuacuuggaucgggaugaauagcagaucaaccagucuuuccgucagcuuggugcugguaggaauagugacgcucuaccugggcguuaugguccaggccgacucugguuguguggugucauggaaaaacaaggagcuuaaaugcgggaguggaaucuucauuacagauaauguccacaccuggacugaacaguauaaguuucagcccgagagcccauccaagcuggcaucugccauccaaaaagcucacgaagagggcauuugugguaucaggucgguuacacgguuggaaaaccucauguggaagcagauaacccccgagcugaaucauauuuuaagcgagaacgaagugaaacugacuaucaugaccggcgacauuaaggggaucaugcaggccggaaaacgcucccuaagaccucagccaacagagcucaaguacucauggaaagcauggggcaaggcgaagaugcugaguacggaacuucacaaucauaccuucuugauagaugggccggagacugcugaaugccccaacacaaauagggccuggaacucucuggagguggaggacuauggauuuggcguauucaccacaaauaucuggcucaaacugaaggaacgucaagaugucuuuugugacagcaaauuaauguccgcagccauuaaggacaaccgggcugugcacgccgauauggguuacuggaucgagucagcacugaacgacacuuggaaaauugaaaaggcuagcuucaucgagguuaagucuugccacuggccuaaaucccauacccuuuggaguaaugggguguuggagagcgaaaugauaauuccaaagaacuucgccggacccgucucucagcacaauuaucgaccuggcuaccauacgcagacagcggguccauggcaccucggcagacuggagauggauuuugacuucugugaagggaccacugugguugugaccgaggauugcggaaacaggggccccucccuacgcacaacuaccgccucagggaaacugaucacagaauggugcugucggaguugcacgcucccgccucugagauacaggggagaggacggcuguugguaugguauggagauccgcccacuuaaggaaaaagaggaaaauuugguaaacagccuggucaccgcugggcauggacagauugauaauuuuucguuaggcgugcucgguauggcacuguuccuugaggaaaugcugcgaacucgggugggcacaaagcacgccaucuugcucgucgcuguuuccuuugugacccugauuacugggaacaugucuuuccgugaccuaggaagaguaauggugauggucggcgccacaaugaccgaugacauagggaugggagugacguaccuggcacuccuggcggccuuuaagguuaggcccacuuucgcugccggccuuuugcugcgcaaauuaaccagcaaggagcucaugaugacaaccaucgguauugugcugcuuucacaaaguacuaucccugagacaauucuggaacuaaccgaugcacucgcucuggggaugauggucuugaaaaucgugcggaauauggagaaguaucagcuggccguuacaauaauggcaaucuuaugcgugcccaacgccgucauucuccagaaugcuuggaaaguauccuguacuauccuggcggugguuucugugagcccacuucuguugaccuccucacaacagaaggccgacuggauuccucucgcacugacgaucaagggacuaaaccccacagcuauauuucugaccacucuuagcagaaccaguaaaaagaggucuuggccacucaaugaagccauuauggccgucggcaugguguccauccuggcuagcucguugcugaaaaacgauaucccgaugacaggcccuuuaguagcagggggacuccugacugugugcuacguccuuaccggucgaucagccgaccuggaguuggaacgcgcggcugacguucggugggaggagcaggccgaaauuucuggcaguucccccauacucagcaucacgauuucugaggaugggagcauguccaucaagaaugaagaggaggaacagacacugaccauucuaaucagaacuggacugcuugugauaucaggccucuucccagugaguauccccauuacagcagccgcuugguaucugugggaggucaaaaagcaaagggccgguguguugugggacguuccuagcccacccccuguagggaaagccgaauuagaggauggagcguaccguaucaagcagaagggcauucugggcuauucucagaucggggcuggaguguacaaagaagguaccuuucacacuauguggcaugucacacgcggcgccgugcucaugcacaaggggaaacggauagagccguccugggcagacguuaagaaagaucugauuucauacggaggcgguuggaaacuugagggggaauggaaggagggagaagaggugcagguccuggccuuggaaccaggcaaaaaccccagagcugugcaaaccaagccuggccuauucaaaacgaacacugggaccaucggagccguaagucuggacuuuagcccagguacauccggcucucccaucgucgauaagaaagggaaggugguuggacucuauggcaaugguguggucaccaggucggggacauacgugagcgcaauugcucagacugagaagucaaucgaggacaacccugaaauagaggaugacauuuucagaaagaaacggcugaccaucauggaucuucauccgggagccggcaaaacgaagcgcuauuuacccgcgauuguuagagaagccaucaaaaggggccugcggacacucauauuggcaccaacucgaguggucgcugccgagauggaagaggcucugagagggcucccuauucgcuaccagacccccgcaaucagggccgagcacacaggacgugaaaucguggaccugaugugucaugccaccuucacuaugcggcuucuguccccaauuagaguaccuaauuauaacuugaucauuauggaugaggcucacuuuaccgaccccgcgaguauagcagccagggguuacaucucuacacgcguggaaaugggcgaggcugccgggauuuucaugacggcaacuccaccgggaagccgagacccuuuuccccaguccaaugccccaaucauggaugaggaaagagagauccccgaacggucauggaacucuggccacgaguggguuaccgacuucaaggguaagacagucugguuugugccuagcauuaaagcugggaaugauauagcggccugccuaaggaagaacggcaaaaaggugauccaacugagucgcaaaaccuucgacuccgaauauauuaagacucguacaaaugauugggacuuugucguaaccacggauaucagcgagaugggcgcaaacuucaaggcugagagagugauugacccacggagguguaugaaacccguuauccucacugauggcgaagaacgcgugauauuagccgggccuaugccggucacacauucuucagcagcccagcgaagaggacggguggguaggaauccaaagaacgaaaaugaccaguacaucuacaugggcgagccccuggaaaacgaugaggacugcgcucacuggaaagaggccaagaugcuucuggacaauauuaacaccccugaagggaucauucccuccauguuugagccagaacgcgagaaaguugaugcgaucgacggagaauauagacucaggggcgaggcacggaagaccuucguggauuugaugcgucgcggugaccugccugucuggcucgccuaccgaguggcugccgaggggauaaacuaugcugauagaaggugguguuuugacggcgucaaaaauaaccaaauucuggaagagaauguggaaguugagaucuggacuaaggagggagaacggaagaaacuuaagccccgcuggcuagaugcaagaauuuacagugacccacuggccuugaaagaguucaaggaguucgcugccggcaggaagucguuaacacugaaccucaucaccgagauggggcggcugccuacauuuaugacucagaaggcacgaaaugcgcuugauaaccuggccguccuccauacggcugaagccggagguagagcauauaaucacgcuuugagcgagcugccggagacccuagaaacacugcuccuucugacuuuauuggccaccgugacaggcgggauauuccuguuucucaugucuggaaagggcaucgguaaaaugacccuggggaugugcugcauuaucacugcauccauucuucugugguacgcccagauccagccccacuggauagcugcgagcauuauccucgaguucuuuuugaucgugcuguuaauuccagaaccugagaagcaacgcacgccccaggacaaccagcuaaccuaugucguuaucgccauacugacagugguagcagcuacuauggccaaugaaaugggcuuccucgagaaaaccaagaaagauuuuggacuuggcucaauuacaacccagcaaccagacaguaacauccuggauauugacuugaggccugccucugcauggacucuguacgcuguggccacaacguucaucacccccaugcuccggcauuccauagagaauagcucagucaacgugagucugacugcgaucgcuaaucaggccacaguucuuauggggcucggaaaggguuggccgcugagcaagauggacauuggcgugccauugcuggcaaucggguguuacucccaggucaacccuauuaccuuaaccgccgcucuacugcuccuuguagcacacuaugccaucauuggacccggccugcaggcgaaagcuacacgugaagcccaaaagagagcagccgcugguaucaugaaaauaccagccgcagaugggaugacugugauugacuuggaucccaucccuuacgacccgaaguuugagaaacagcugggccagguuaugcuccuggugcuuugcgucacacagguguuaaugaugaggaccacaugggcucugugugaagcccucacuuuggcgaccggacccaucucuacacugugggagggcaauccagggcgcuucuggaacaccacuauugccgucagcauggcaaauauauuucggggauccuaucuagcuggcgccggucuacucuucucaaucaugaagaacacggcaaacacacgaagagggaccggaaauacuggcgaaacccuuggugagaaguggaaaaacaggcugaaugcuuugggcaagucugaguuucaaauuuacaaaaagagugggauccaggaaguggaucgcacacuggccaaagagggaauuaagcggggcgaaacugaccaucacgccguuucgagagggagcgcgaaacuccguugguucguggagaggaaccugguaaccccugagggaaagguggucgauuuaggcugcgguagagggggaugguccuauuacuguggcggucuuaagaauguuaaagaagugaagggccugacaaaagggggacccggccaugaggaaccuaucccaaugucuacguauggguggaaccucguccgccuacagucaggaguggacguauucuuuacacccccugagaagugcgauacucuguugugugacauaggcgaaagcuccccaaaucccacaguggaggcuggucgaacccugagaguucucaaccuuguggagaauuggcugaacaauaacacucaauucugcaucaaagucuugaauccguacaugccuagugugauugaaaagauggaggcacugcagaggaaguacgggggagcccucguccggaacccauuaucucgcaauagcacacacgaaauguauugggugucaaacgcuuccggcaacaucguuaguagcguaaauaugauuucuagaaugcugaucaacagguuuaccaugaaacacaagaaagccacguacgagcccgauguggaccuuggcuccgggacccgaaauauaggaauugaaucagagacaccuaaccuggauaucaucgguaagcggauugagaaaauaaagcaggaacaugagacuagcuggcacuaugaccaggaccauccauacaagaccugggcauaucacggcucguacgaaacaaaacaaacugggucugccaguuccauggucaauggagugguucgucuacucaccaagcccugggaugugaucccgauggucacacagauggcuaugaccgacacuacgccuuucggccagcagagaguguuuaaagagaagguagauacacgcacccaagaacccaaagaggguacuaagaagcugaugaaaauuaccgcggagugguuguggaaggaacuggggaaaaagaaaacaccaaggauguguacgcgggaggaguucaccagaaaggugcgcagcaacgccgcacucggagcuaucuuuacugacgagaauaaauggaagucagccagggaggcaguugaagauuccggcuucugggagcuugucgacaaggaacgaaaccugcacuuagagggcaaaugcgaaacauguguguauaauaugauggggaagcgggagaaaaagcugggagaguuugguaaagccaagggcucuagagcuauuugguacaugugguugggggccagguuccucgaauuugaggcgcugggauuccuaaacgaagaucauugguuuagccgcgagaauagucuuuccggcguggaaggugaggggcugcacaagcucggauacauccugcgugacgucagcaaaaaggagggcggcgcaauguaugccgaugacaccgcugggugggauacucggauaacauuggaagaccugaaaaacgaggaaaugguuaccaaucauauggagggagaacacagaaagcucgccgaggcaaucuucaggcuuacauaccagaacaaagugguacgcgugcagcgaccuacuccccgggguaccgucauggacauuaucucuagaagggaucagcgcggcucagggcaagugguuacguauggacugaauaccuucacaaacauggaggcucaguuaauuagacagauggaaggcgaggguguguuuaagaguauccaacaucugacugucaccgaagagauugccgugaagaacugguuggagcggguagggagggaacgucucucccgaauggcuauaagcggagacgauugcguugugaaaccacuggacgaucgcuucgccucugcacuaacagcgcuuaaugacaugggcaaggucagaaaagauauccagcagugggagcccucgcggggcuggaacgacuggacucaggugccuuuuugcucacaccacuuccaugaacugauuaugaaggaugggagggugcucgucguuccaugucgcaaucaagacgagcugaucggacgagcacggaucagccagggugcuggcugguccuugagggaaaccgccugcuuagggaaaaguuacgcacagauguggucucugauguauuuucaccgacgugaucucagacuugcugccaacgcaauuuguagcgccgugccgucccauuggguacccauaucacgcacgacauggaguauccacgcgacccacgaguggaugacuacagaggacaugcugaccguguggaaucgggucuggauucaggaaaacccuuggauggaggauaagacuccaguggaaucuugggaggaaauccccuaccuaggaaagagggaggaccaauggugcggcagccugauuggucucaccuccagagcuacaugggccaaaaauauccagacggcaauaaaccagguucgcucauugaucgggaaugaggaauauaccgacuacaugccuagcaugaagcgguucaggcgagaggaagaggaagccggagugcugugguga

SEQ ID NO: 14326 - RNA, 9876 nt, Artificial Sequence
  derived and/or modified CDS sequence (opt3) from DENV-2__KX380831__SS-prME
accgccggcaucauuauaaugaugauccccaccgugauggcuuuccaccugacuacgaggaauggggagccucauaugauugucagcaggcaggaaaagggaaagucccuccuuuuuaagaccgagaaugguguuaacaugugcacacugauggcaauggacuugggcgaauuaugugaggauacuaucaccuacaauugcccacugcuacggcaaaacgaaccggaggacauugauuguuggugcaauucuacaucaaccugggugacuuaugggacauguaccgccacgggagagcaccgccgagaaaaacguaguguugcgcucgugccccaugucggcaugggucuggagacuaggaccgaaacauggaugagcuccgagggggcuuggaagcacgcccagaggaucgagacuuggauacuucggcauccuggauucaccaucauggcagccauucuggcuuacacaaucggcaccacguauuuucagcgcguguugauuuucauccuccugacugcaguuacaccaucuauggccaugagaugcauaggcauuucgaacagggacuuuguggaaggggucucaggagguagcuggguggauaucguacuggagcacggcaguuguguuaccacuauggcuaaaaauaagcccacacucgacuucgaauuaauuaagaccgaggccaaacaccuggcgacgcuucggaaguacugcguggaagcaaaauugaccaacacaacuaccgccucccgcuguccuacacagggggagccaucucugaaugaggaacaagauaagcgauuugucugcaaacauagcaugguggacagaggauggggcaacgguugugggcuauucggaaagggcggcaucgugacuugcgcuauguuuaccugcaagaaaaauauggaggggaaggucguucagcccgaaaaccucgaguauacaaucgugauuaccccucacuccggagaagagaaugccguagguaacgauacuggcaaacaugggaaggagauaaaagugacgccacagucaaguaucacagaagcagagcugaccggauacggcacugucaccauggaauguagcccgaggacaggucuugacuucaaugagauggugcuguugcagauggaaaacaaggcuuggcucguucaccggcaaugguuucuggauuuaccccugccuuggcucccaggggccgacacccagggcucuaacuggauucagaaagagacucuugugacauucaagaauccccacgcgaagaaacaggaugucgugguacugggaucccaagagggcgccaugcauacggcauugaccggggcuacugaaauccagaugucaagcggaaaccuacuguuuacaggucaccucaagugccgucugcgcauggacaaacuucagcugaagggcaugaguuauucuauguguaccgggaaauucaagguugugaaggagauagccgaaacacaacauggaacuauugucaucagagugcaguacgagggcgacgguuccccuugcaaaaucccauucgagauuauggauuuggaaaagaggcacguccucgggcggcugaucaccgugaaucccauuguuacggagaaagacagcccggugaacauagaagcugagccucccuuuggcgauucguacaucauuaucggaguagaaccaggccaguuaaagcugucuugguucaaaaagggguccucaaucggacagauguuugagaccacaaugcgaggugccaagcgcauggcaauucuaggcgacacugccugggauuucgggagucucggaggcgucuuuaccagcauagguaaagcucugcaucaaguguucggggcgaucuauggcgcagccuuuuccggaguuucuuggacaaugaagauucuuaucggcguggucauuacuuggaucgggaugaauagcagaucaaccaguuuguccgugagccugguacucgugggaguugucacgcuguaccuuggcgugauggugcaggcugacucugguugugucguuucauggaaaaacaaggagcugaaaugcgggaguggaauauucaucacagauaaugugcacaccuggacugaacaguauaaguuucagccugagagccccuccaaguuggccucugcaauucaaaaagcccacgaagagggcaucugugguauuaggucggugacacggcucgaaaaccugauguggaagcagaucaccccagaguuaaaucauauacugacugagaacgaaguaaaacuaaccauuaugacaggcgacaucaaggggauuaugcaggcuggaaaacgcagccucagaccccagccuacggagcugaaguacuccuggaaagccuggggcaaggcaaagaugcuuucaaccgaauugcacaaucauacuuuccugaucgaugggccagagacagcggaaugcccgaacaccaauagggcuuggaacagucucgaggucgaggacuauggauuuggcguguucacaacuaauauauggcugaaauuaaaggaacgucaagauguauuuugugacucuaaccugaugagcgccgcaaucaaagacaaccgggccgugcacgcugauauggguuacuggauugaguccgcccuuaaugacaccuggaagaucgaaaaagcaucauucauugaggucaagagcugccacuggcccaagucucauacguugugguccaacggggugcucgagagugaaaugaucauaccuaaaaauuucgcuggaccaguuagccagcacaacuaucgacccggcuaccauacacagaccgccgguccuuggcaccugggcagacuagagauggauuuugacuucugugaagggacuaccgugguagucacagaggauugcggaaauaggggcccaucucugcgcacuaccacagcguccgggaagcucauuacggaauggugcugucggucaugcacccugcccccgcuuagauacaggggagaggacggcuguugguaugguauggagauccgcccuuugaaagaaaaggaggaaaaccuggugaauaguuuagugacugccgggcauggacagaucgauaacuuuagccucggcguccuggguauggcucuuuuccuggaggaaauguugcgaacacggguuggcaccaaacacgcaauucuccugguggccguaucguuugugacucuaaucacagggaauauguccuuccgugaccugggaagagucauggugaugguuggcgcuaccaugacggaugacauugggaugggagugacuuaccucgcccugcuugcagcguuuaaggucaggccaaccuucgccgcuggcuugcuguuacgcaagcucacaucuaaagagcugaugaugaccacuauagguaucgugcuucugagccaaucaacaauucccgagaguauccuagaacucaccgaugcccuggcauuggggaugaugguucugaagauugugcggaacauggagaaauaucaguuagcugucacaaucauggccauacucugcguaccuaaugcagugauccugcagaacgccuggaagguuuccuguacuacccuugcuguggucucugugagcccccuguugcucacguccucacaacagaaagcggacuggauuccacuggcccuaacaaucaagggacugaauccuaccgcaauuuuucuuacuacccucagcagaacaaguaagaaaaggucuuggccccugaacgaagcuaucauggccguaggcaugguguccauauuggccagcucgcuguuaaagaaugauauuccaaugacuggcccgcucgucgcugggggacugcuuaccguuugcuacgugcugacgggucgaucagcagacuuggagcucgaacgcgccgcggacgugcggugggaggagcaggcugaaaucucuggcaguuccccuauccugagcauuacaauaucugaggaugggagcauguccaucaaaaacgaagaggaggaacagacccuaacuauucugaucagaacaggacuucucgucauuucaggccuguuccccgugaguaucccaauaaccgccgcagccugguauuugugggagguuaagaaacaaagggcugguguauuaugggacgugcccagcccuccacccgucgggaaggcagaacuggaggauggagccuaccguaucaaacagaagggcauucucggcuauucucagaucggggcgggaguguacaaggaagguacuuuucacacaauguggcauguuacccgcggcgcugugcugaugcacaaagggaagcggauugagccuuccugggccgacgucaaaaaggaucuuaucucauacggaggcgguuggaaacuggagggggaauggaaggagggagaagaggugcagguauuggcacuagaaccgggcaagaacccaagagccguccaaacgaaacccggccuguucaagacuaauaccgggacaauaggagcugugagucucgacuuuagcccugguaccuccggcucuccaauuguugauaaaaaggggaaaguggucggacuguauggcaacggugugguuacaaggucggggacuuacgugagcgccaucgcacagaccgagaagucaaucgaggacaaucccgaaauugaggaugacaucuuccgaaagaaacggcuuacgauaauggauuuacauccuggagcuggcaagacaaaacgcuaucugccggccauugucagagaagcgaucaagaggggccuccggacuuugauucuggcccccacccgagugguagcagcugagauggaagaggcccucagagggcugccaauccgcuaccagaccccugcuauaagggcagagcacacaggacgugaaauuguggaccuuaugugucaugccacuuucaccaugcggcuguugucccccaucagaguuccaaacuauaaucuaaucauuauggaugaggcccacuuuacagacccugcuaguaucgcggcaagggguuacauuucuacgcgcgucgaaaugggcgaggccgcugggauauucaugacugccacacccccaggaagccgagacccguuuccucaguccaacgcacccaucauggaugaggaaagagagauuccagaacggucauggaacucuggccacgagugggugacagacuucaaagguaagaccgugugguuuguccccagcaucaaggccgggaacgauaucgcugcgugccugaggaaaaauggaaagaaaguaauucaacucagucgcaagacuuucgacuccgaauauauaaaaacacguaccaacgauugggacuuugugguuacgacugauaucagcgagaugggcgccaauuucaaggcagagagagugauugacccucggagguguaugaagccagucaucuuaacagauggcgaagaacgcgugauucuggcugggcccaugccuguuacccauucuucagccgcacagcgaagaggacggguggguaggaacccgaaaaaugaaaacgaccaguacaucuacaugggcgagccacuugaaaaugaugaggacugcgcccacuggaaggaggcuaaaaugcugcucgacaacauaaacacccccgaagggaucauuccuuccauguuugagcccgaacgcgagaaggucgaugccaucgacggagaauauagauugaggggcgaggcgcggaaaacuuucguggaucugaugcgucgcggugaccucccaguauggcuggcauaccgaguggccgcugaggggauuaauuaugccgauagaaggugguguuuugacggcguuaagaacaaucaaauccuugaagagaacgucgaaguggagauauggacaaaagagggagaacggaagaagcuaaaaccucgcuggcuggaugcuagaauuuacagugaccccuuggcauuaaaggaguucaaagaguucgccgcuggcagaaagagccugacccucaaucugaucacagagauggggcggcuuccaacuuuuaugacgcagaaagccaagaacgcacuggauaaucucgcgguguugcauaccgccgaagcuggaggucgagccuauaaccacgcacugucggagcuaccugagacacuggaaacucuccuucuguuaaccuugcuggcuacagucaccggcgggauuuuccucuuucugaugucuggaaagggcaucgguaaaaugacucuugggaugugcugcauaaucacggccuccauucugcucugguacgcacagauccagccgcacuggauugccgcuagcaucauauuggaguucuuucugauuguuuuacuaauccccgaaccagagaagcaaagaaccccucaggacaaucagcugacauaugugguaaucgcgauucucacuguggucgccgcaaccauggcuaacgaaaugggcuuccuugagaaaacaaagaaagauuuuggacugggcucaaucaccacucagcaacccgagaguaauauauuggacauugaucugcgcccagccucugccuggacacucuacgcaguggcuacgaccuucaucacuccuaugcugaggcauuccauugaaaacagcucaguuaaugugagucuuacagccaucgcgaaccaggcuaccguccucauggggcugggaaaggguuggcccuugagcaagauggacauaggcguaccgcuguuagccaucggguguuacucccaggugaauccaauuacccuaacagcagcccugcuccuucugguugcucacuaugcaaucauuggaccuggcuugcaggccaaagcgacucgggaggcucaaaagcgugccgcagccgguaucaugaaaaaccccacgguggacgggaugaccgucauugaucuggacccaauccccuacgauccuaaguuugaaaaacagcucggccaggugaugcugcuugucuuaugcgugacacagguucugaugaugagaacuaccugggcucucugugaggccuugacacuggcaaccggaccgauaucuacucuaugggaaggcaaucccgggagguucuggaacacgacaauugcugugagcauggccaacaucuuucgcggauccuaucuggcgggcgccggucuccuuuucucaaucaugaagaauaccgcaaacacucggcgagggaccggaaauacaggcgagacucugggugagaaguggaaaaacagauugaaugcucugggcaagucugaauuucaaauuuacaaaaagagugggauacaggagguagacaggacccucgccaaagaaggaaucaagcgcggcgagacagaucaucacgcagugucgcgggggagcgcuaaacugagaugguucgucgagcguaacuuaguuacgccagaaggaaagguggucgaccuuggcugcgguagagggggaugguccuauuacuguggcggucugaagaaugugaaagagguaaagggccucaccaaagggggaccuggccaugaggaacccauuccuaugucuacuuauggguggaaccuagugcggcugcagucaggaguugauguguucuuuacaccacccgaaaagugcgacaccuugcugugugauaucggcgagagcuccccuaauccaacugucgaggccggucgcacacuccgagugcuuaaccuggucgaaaauugguugaacaauaacacccaauucugcauuaaagugcugaaucccuacaugccgaguguuaucgagaagauggaagcccuccagagaaaguacgggggagcguuaguaaggaacccucugucucggaacagcacgcacgagauguauugggugucaaaugcuuccggcaacauagucaguagcgugaauaccaucucucgcaugcuuauuaacagauuuacaaugaggcacaaaaaggcaacuuacgaaccagacguugaucugggcuccgggacccgaaauaucggaauugagucagagacacccaaccuagacaucauagguaaacggauugaaaagaucaaacaggagcaugaaacuagcuggcacuaugaucaggaccauccuuacaagaccugggccuaucacggcucguacgagacaaagcaaaccgggucugcuaguuccauggugaauggagucgugcgucuccugacuaaaccaugggacguaauccccauggugacgcagauggccaugacagauaccacuccguucggccagcagagaguuuuuaaggaaaaagucgacacccgcacacaagagccuaaggaggguacgaaaaaguugaugaagauuaccgcagaauggcuguggaaagagcucgggaagaaaaagacucccaggauguguacacgggaagaguucaccagaaaagugcgcagcaacgccgcucuuggagcgauauuuacugaugagaauaaguggaaaucagccagggaagcaguggaggacuccggcuucugggaacuggucgauaaggagcgaaacuuacaccuggaaggcaagugcgagacauguguuuauaauaugauggggaaacgggagaagaaauugggagaauuugguaaggcuaaaggcucuagagccaucugguacauguggcucggggcaagguuccuggaguuugaagcccuaggauuccuuaacgaggaccauugguuuagccgcgaaaauagucuguccggcguggagggugaggggcuccacaagcugggauacauuuugcgugauguaagcaagaaagaaggcggcgcuauguaugccgacgauaccgcggggugggacacacggaucacucuggaggaucucaagaacgaagagauggugaccaaucauauggaaggagagcacaagaaacuugcagaggccauuuucaaacugacguaccagaacaaagucgugagaguucagaggccaaccccucgcgguacagugauggacaucauaucucgacgggaccagagaggcucagggcaagucgugacuuauggauuaaacaccuucacaaauauggaagcucagcugaucaggcagauggagggcgaagguguauuuaagaguauucaacaguugacuguuaaagaggagaucgccgugaagaacuggcucauucgcgucgggagagaacggcuguccaggauggcaaucagcggagaugacugcguggugaaaccccuagaugaccguuucgcuucugcccuuaccgcucugaaugauaugggcaagguccgaaaagacauucagcagugggagccaucgcgcggcuggaacgauuggacgcaaguucccuuuugcucacaucacuuccacgaacucauaaugaaggacgggagagugcugguagugccuugucggaaucaggaugaguugaucggaagggcccgcauuagccagggugcaggcugguccuuaagagaaacagcgugccuggggaagaguuacgcccagauguggucucucauguauuuucaucggagggaccuucgacuggcugccaacgcaaucuguagcgcugucccaucccacuggaucccgaccucacguacuacauggaguauucaugccacccacgaguggaugacuaccgaggauaugcuaacaguguggaauagaguuuggauacaagaaaaccccuggauggaggacaaaacgccuguggaaucuugggaggaaaucccauaccugggaaagcgcgaggaucaguggugcggcagccucauugguuugaccucccgggcaacuugggccaaaaauauccagacagcgauuaaccaggucaggucacugaucgggaaugaggaauauaccgacuacaugcccagcaugaagagauuccgccgggaggaagaggaagcuggagugcuuugguga

SEQ ID NO: 14327 - RNA, 9876 nt, Artificial Sequence
  derived and/or modified CDS sequence (opt3) from DENV-2__KX380808__SS-prME
accgcaggcaucauuauaaugaugaucccaacagugauggcuuuccaccugacuacgaggaacggggaaccucauaugauugucagcaggcaggaaaagggaaagucccuccuuuuuaagaccgagaaugguguuaacaugugcacacugauggcaauggacuugggcgaauuaugugaggauacuaucaccuacaauugcccacugcugaaacaaaacgaaccggaggacauugauuguuggugcaauucuacaucaaccugggugacuuaugggacauguaccgccacgggagagcaccggcgcgaaaagcgaaguguagcgcucgugccacaugucggcaugggucuggagacucguaccgaaacauggaugagcuccgagggggcuuggaaacacgcccagagaaucgagacuugggugcuuaggcauccuggauucaccauaauggcagccauccuggcuuacacaauuggcaccacguauuuucagcggguuuugaucuucauucuccugacugcaaucgccccaucuaugacaaugcgcugcauaggcauuucgaacagagacuuuguggaaggggucucaggagguagcuggguggauaucguacuggagcacggcaguuguguuaccacuauggcuaagaauaagcccacacucgacuucgaauuaauuaaaaccgaggccaagcacccugcgacgcugaggaaauacugcaucgaagcaaaacuuaccaacacaacuaccgccucccgguguccaacacagggggagcccucuuugaaugaggaacaagauaaacgcuuugugugcaagcauagcauggucgaccgaggauggggcaacgguugugggcuguucggaaagggcggcaucgugacuugcgcuauguuuaccugcaaaaagaauauggaggggaaaauugugcagccugaaaaccuagaguauacaauagucaucaccccacacuccggagaagagaaugccguugguaacgauacuggcaagcaugggaaagagauuaaggugacgccgcagucaaguaucacagaagcagagcucaccggauacggcacuguaaccauggaauguagccccagaacaggucuggacuucaaugagauggugcuucugcagauggaaaacaaggcuugguugguccacaggcaaugguuucucgaucugccuuuaccauggcugcccggggccgacacccagggcucuaacuggauacagaaggagacucucgugacauucaagaauccucacgcgaaaaagcaggauguugugguccuuggaucccaagagggcgccaugcauacggcacugaccggggcuacugaaauucagaugucaagcggaaacuugcuauuuacaggucaccugaaaugccggcuccguauggacaagcugcagcuuaaaggcaugaguuauucuauguguaccgggaaguucaaggugguaaaagagaucgccgaaacacaacauggaacuaucguuauucgcgugcaguacgagggcgacgguuccccaugcaagauccccuucgagauuauggaucuggagaagcggcacgucuuggggaggcucauaaccgugaauccgaucgucacggagaaggacagcccugugaacauugaagcugagcccccauuuggcgauucguacaucaucauuggaguugaaccuggccagcugaaauuaucuugguucaagaagggguccucaauaggacagauguuugagaccacaaugcggggugccaaacgaauggcaauccugggcgacacugccugggauuucgggagucuaggaggcguguuuaccagcauugguaaggcucuccaucaaguauucggggcgaucuauggcgcagccuuuuccggagucucuuggacaaugaaaauucugaucggcgugguuauaacuuggaucgggaugaauagccgcucaaccagucuuuccgugagcuugguccuggugggaguagugacgcucuaccugggcguuaugguccaggcugacucugguuguguggugucauggaagaacaaagagcuuaagugcgggaguggaauuuucaucacagauaauguccacaccuggacugaacaguauaaguuucagcccgagagcccauccaaacuggccucugcaauucaaaaggcccacgaagagggcaucugugguauaagaucgguuacaagguuggaaaaccucauguggaaacagauuacccccgagcugaaucauaucuuaagcgagaacgaagugaagcugacuauuaugaccggcgacaucaaagggauaaugcaggcuggaaagcggucccuacgcccucagccaacagagcucaaauacucauggaaggccuggggcaaggcaaaaaugcugaguacggaacuucacaaucauaccuucuugaucgaugggccggagacugcggaaugccccaacacaaauagagcuuggaacucucuggagguggaggacuauggauuuggcguauucaccacaaauauuuggcucaagcugaaagaaaggcaagaugucuuuugugacagcaaguuaauguccgccgcaaucaaagacaaccgugccgugcacgcugauauggguuacuggauugagucagcccugaacgacacuuggaagaucgaaaaggccagcuucauagagauuaaaucuugccacuggccuaagucccauacccuuuggaguaaugggguuuuggagagcgaaaugaucauccccaagaacuucgcuggacccgugucucagcacaauuaucggccuggcuaccauacgcagacagccgguccauggcaccucggccgacuggagauggauuuugacuucugugaagggaccacugucgugguuaccgaggauugcggaaacagaggccccucccuaaggacaacuaccgcgucagggaagcugauuacagaauggugcugucgcaguugcacgcucccgccucugcgguacagaggagaggacggcuguugguaugguauggagaucaggccacuuaaagaaaaggaggaaaauuuggugaacagccugguaaccgccgggcauggacagauugauaauuuuucguuaggcguccucgguauggcucuguuccuugaggaaaugcugcgcacucgagugggcacaaagcacgcaauauugcucguggccgucuccuuuguuacccugaucacugggaacaugucuuuccgggaccuaggacgugugaugguaauggugggcgcuacaaugaccgaugacauugggaugggagucacguaccuggcccuccuggcagcguuuaaagugagacccacuuucgccgcuggccuuuugcugaggaaguuaaccagcaaagagcucaugaugacaaccaucgguauuguucugcuuucacaaaguacuaucccugagacaauacuggaacuaaccgaugcccucgcacuggggaugaugguguugaagaucguccgcaauauggagaaauaucagcuggcugugacaauuauggccaucuuaugcguucccaacgcagugauucuccagaaugccuggaaggucuccuguacuacccuggcuguagugucuguuagcccacuucuguugacguccucacaacagaaggcggacuggaucccucucgcccugacaauaaaaggacuaaaccccaccgcaauuuuucugacuacccuuagccggacaaguaagaaaagaucuuggccacucaaugaagcuaucauggccgugggcauggucuccauccuggccagcucguugcugaagaacgauauuccgaugacuggcccuuuaguggcugggggacuccugaccguaugcuacgugcuuacggguaggucagcagaccuggaguuggaacgagccgcggacguccgcugggaggagcaggcugaaauaucuggcaguucccccauccucagcauuacaaucucugaggaugggagcauguccauuaaaaaugaagaggaggaacagacccugacuauccuaauacggacaggacugcuuguuaucucaggccucuucccagugaguauucccaucaccgccgcagccugguaucugugggaggugaagaaacaaagagcuggugucuugugggacgugccuagcccacccccuguugggaaggcagaauuagaggauggagccuacaggauuaagcagaaaggcauccugggcuauucucagauaggggcgggaguauacaaggaagguacuuuucacacaauguggcaugugacccguggcgcuguccucaugcacaaagggaagcgcauugagccguccugggccgacgugaaaaaggaucugaucucauacggaggcgguuggaaacuugagggggaauggaaagagggagaagagguucaggugcuggcauuggaaccaggcaagaacccccgggccguccaaacgaaaccuggccuauucaagacuaacaccgggacaaucggagcugugagucuggacuuuagcccagguaccuccggcucucccauuguagauaaaaaggggaaggucgugggacucuauggcaaugguguugugacaagaucggggacuuacgucagcgccaucgcacagaccgagaaaucaauagaggacaacccugaaauugaggaugacaucuucaggaagaaacgacugacgauuauggaucuucauccgggagcuggcaagacaaaacgguauuuacccgccaucgugcgcgaagcgauaaagagaggccugaggacucucauuuuggccccaacccggguuguggcagcugagauggaagaggcccugcgagggcucccuaucagauaccagacacccgcuauccgcgcagagcacaccggaagggaaauugucgaccugaugugucaugccacuuucaccaugcgucuucuguccccaauccgggugccuaauuauaacuugauuauaauggaugaggcccacuuuacagaccccgcuaguaucgcggcaagagguuacauuucuacgaggguagaaaugggcgaggccgcugggaucuucaugacugccaccccaccgggaagccgcgacccuuuuccccaguccaaugcaccaaucauggaugaggaacgagagauucccgaaagaucauggaacucuggccacgagugggugacagacuucaaggguaaaaccguuugguuugucccuagcauaaaggccgggaaugauaucgcugcgugccuacggaaaaacggaaagaaagugauucaacugaguaggaagacuuucgacacagaauauaucaagacccgcacgaaugauugggacuuuguggucacuacagauauuuccgagaugggcgccaacuucaaagcagagcguguaaucgacccaagacgguguaugaagcccgugauacucaccgauggcgaagagaggguuaucuuagcugggccuaugccggugacccauagcucugccgcacagcgccgaggaagagucggucggaaucccaagaacgaaaaugaccaguacauuuacaugggcgagccccuggaaaacgaugaggacugcgcccacuggaaggaggcuaaaaugcuucuggacaauaucaacacuccugaagggauuauccccucaauguuugagccagaaagggagaagguggaugccauagacggagaauaucgccucagaggcgaggcgaggaaaacauucguugauuugaugcggcguggugaccugccuguguggcucgcauaccgcgucgccgcugaggggauuaacuaugccgaucgaagaugguguuuugacggcgugaagaauaaccaaauccuggaagagaauguagaaguggagauuuggaccaaggagggagaaaggaagaaacuuaaaccccgguggcuagaugcucgcaucuacuccgacccacuggcauugaaagaguucaaagaguucgccgcuggcagaaagaguuuaacacugaaccucauaacugagauggggaggcugccuacguuuaugacccagaaggcccggaaugcacuugauaaccuggcgguucuccauacagccgaagcuggaggucgagccuauaaucacgcauugagcgagcugccggagacucuagaaacccugcuccuucugacauuauuggcuaccgucacuggcgggaucuuccuguuucucaugucgggaaaaggcauugguaagaugacgcuggggaugugcugcaucauuaccgccucuauccuucugugguacgcacagauacagccccacuggauugccgcuuccaucauccucgaguucuuuuugauugugcuguuaaucccagaaccugagaaacaaagaacaccccaggacaaccagcuaacuuauguggucauagcgauucugaccguuguggccgcaacaauggcuaaugaaaugggcuuccucgagaagaccaaaaaggauuuuggacuuggcagcaucacuacacagcaaccagagucaaacauucuggacaucgauuugcgcccugccagugccuggacgcuguacgcaguagcuaccacuuucauaacacccaugcucaggcauucuaucgaaaauuccagcgugaacgucucacugaccgccauugcgaaucaggcuaccgugcuuauggggcucggaaaggguuggccgcugaguaaaauggacaucggcguuccauugcuggccauuggguguuacagccaggugaacccuaucacauuaacugcagcccuacugcuccuugucacgcacuaugcuauuaucggacccggccugcaggcaaaggccacccgggaggcgcaaaaacgugcugccgcagguauaaugaagauuccaacaguagacgggaucacugugaucgauuuggaccccauuccuuacgauccgaaauuugaaaagcagcugggccagguuaugcuccuggugcuuugcgucacccagguguuaaugaugagaacaaccugggcccugugugaggcucucacuuuggccacgggacccauauccacacugugggaaggcaauccagggagguucuggaacaccacuaucgcagucucuauggcuaauauuuuucgcggaagcuaucuagccggcgcgggucuacucuucuccaucaugaagaacaccgccaacacacggcgagggacuggaaauaccggcgagacacuuggugagaaauggaagaacagacugaaugcauugggcaaaucagaauuucaaauuuacaagaaaucugggauccaggagguggacaggacgcuggcuaaggaaggaauaaaacgcggcgagaccgaucaucacgccguuagucgggggucggcaaagcucagaugguucguggagcguaaccugguaacuccugaaggaaagguggucgacuuaggcugcgguagagggggauggagcuauuacuguggcggucuuaaaaauguuaaggaggugaaaggccugacaaaagggggacccggccaugaagaaccuaucccaauguccaccuauggguggaaccucguccggcuacagucuggaguggauguauucuuuacucccccugaaaaaugcgacacacuguugugugauauuggcgagucaagcccaaaucccaccguggaggcuggucgcacgcugcgaguucucaaccuuguggaaaauuggcugaacaauaacacccaauucugcaucaaggucuugaauccguacaugccuuccgugauugagaagauggaagcccugcagagaaaauacgggggagcccucgucaggaacccauuaaguagaaauucuacacacgagauguauugggugagcaacgcgucaggcaacaucguuuccaguguaaauaugauaagccgcaugcugauuaacagauuuacuaugaggcacaagaaagcuaccuacgaacccgacguggaucuuggcucugggacacgaaauaucggaaucgaguccgagacuccuaaccuggacauuauagguaagcggaucgagaaaauuaagcaggaacaugaaaccucauggcacuaugaucaggaccauccauacaagacaugggcauaucacggcagcuacgagaccaaacaaacugggucggccucuaguauggucaauggagugguucgucuacucacgaagcccugggacgugaucccgauggucacacagauggcuaugaccgauacuaccccuuucggccagcagagaguguuuaaagaaaagguagacacacgcacgcaagagcccaaagaggguaccaagaagcugaugaaaauuacugccgaaugguuguggaaggagcuggggaaaaagaaaacaccaaggauguguacccgggaagaguucacuagaaaggugcgcuccaacgcagcccucggagcuaucuuuacagaugagaauaaauggaaaagcgcgagggaagccguugaggacucaggcuucugggaacuugucgauaaggagcgaaaccugcacuuagaaggcaaaugcgagaccuguguguauaauaugauggggaagcgggagaaaaagcugggagaauuugguaaagcaaagggcuccagagcuauaugguacaugugguugggggccagguuccucgaguuugaagcacugggauuccuaaacgaggaccauugguuuucucgcgaaaauagccuuaguggcguggagggugaggggcugcacaagcucggauacauccugcgugaugucuccaaaaaggaaggcggcgccauguaugcugacgauacagccgggugggacacucggauuaccuuggaggaucugaaaaacgaagagaugguuacgaaucauauggaaggagagcacaagaaacucgcggaggcaaucuucagacuuaccuaccagaacaaggugguaagggugcagcgcccuacaccccgagguacugucauggacauuaucagccggagagaccagaggggcucugggcaagugguuaccuauggacugaauacauucacuaacauggaagcccaguuaauucgccagauggagggcgaaggucuguuuaagucaauacaacauuugaccgugacggaggagaucgcugucaaaaacuggcucgugagaguagggcgggaaaggcugagucguauggccauuuccggagaugacugcguugugaagccacuagaugaccgauucgcaagcgcucuuacagcccugaaugauaugggcaaaguccgcaaggacauccagcagugggagcccucuagaggcuggaacgauuggacccaggugccuuuuugcucgcaccacuuccaugaacucaucaugaaagacgggcgggugcuggucguuccauguaggaaucaagaugaguugauuggacgcgcuagaauaucacagggugccggcuggagcuuacgggaaacugcaugccuggggaaguccuacgcgcagauguggagucucauguauuuucacaggcgagaccuucgucuggccgcuaacgccaucuguucugcagugccgagccauuggguacccacauccagaaccacuuggucaauucacgcuacccacgaguggaugacaacggaggauaugcuaaccguguggaaucgcgucuggauccaggaaaacccuuggauggaggacaagacuccaguggaaaguugggaggaaauucccuaccugggaaaacgggaggaucaauggugcggcucucucaucgguuugacaagcagggccaccugggcaaagaauauacagacugccaucaaccagguuagaucccugauugggaaugaggaauauacagacuacaugccuucaaugaaacgcuuccggagggaggaagaggaagcgggagugcuuugguga

SEQ ID NO: 14328 - RNA, 9876 nt, Artificial Sequence
  derived and/or modified CDS sequence (opt3) from DENV-2__KX380832__SS-prME
accgccggaaucauuauaaugaugauccccacggugauggcuuuccaccugacuacgagaaacggggaaccucauaugauuguaagcaggcaggaaaagggaaaaucccuccuuuuuaagaccgagaaugguguuaacaugugcacacugauggcaauggacuugggcgaauuaugugaggauacuaucaccuacaauugcccacugcugcggcaaaacgaaccggaggacauugauuguuggugcaauucuacaucaaccugggugacuuaugggacauguaccgccacgggagagcaccgccgagaaaaacguaguguagcgcucgugccccaugucggcaugggucuggagacucggaccgaaacauggaugagcuccgagggggcuuggaagcacgcccagaggaucgagacuugggugcuucggcauccuggauucaccguuauggcagccauacuggcuuacacaaucggcaccacguauuuucagcgcguguugauuuucauccuccugacugcagucgccccaucuaugacaaugagaugcauuggcaucucgaacagggacuuuguggaagggguaucaggagguagcuggguugauauagugcuggagcacggcaguugugucaccacuauggcuaaaaauaagcccacacucgacuucgaauuaauuaagaccgaggccaaacacccugcgacgcugcggaaguacugcaucgaagcaaaacuuaccaacacaacuaccgccucccgcuguccaacacagggggagcccucuuugaaugaggaacaagauaagcgauuugugugcaaacauagcaugguggacagaggauggggcaacgguugugggcuguucggaaagggcggcauugucacuugcgcuauguuuaccugcaagaaaaauauggaggggaagaucguucagccugaaaaccuagaguauacaaucgugauuaccccacacuccggagaagagaaugccguagguaacgauacuggcaaacaugggaaggagauaaaagugacgccgcagucaaguaucacagaagcagagcucaccggauacggcacugcuaccauggaauguagccccaggacaggucuggacuucaaugagaugguccuucugcagauggaaaacaaggccugguuggugcaccggcaaugguuucucgaucugccuuuaccauggcugcccggggcggacacccagggcucuaacuggauucagaaagagacucucguuacauucaagaauccucacgccaagaaacaggauguggucgugcuuggaucccaagagggcgcaaugcauacggcucugaccggggccacugaaauccagaugucaagcggaaacuugcuauuuacaggucaccugaagugccgucuccgcauggacaaacugcagcuuaagggcaugaguuauucuauguguaccgggaaauucaagguaguuaaggagauagcugaaacacaacauggaacuauugugaucagaguccaguacgagggcgacgguuccccaugcaaaauccccuucgagauuauggaucuggaaaagaggcacguguuggggcggcucaucaccgucaauccgauugugacggagaaagacagcccuguuaacauagaagccgagcccccauuuggcgauucguacaucauuaucggaguggaaccuggccagcugaaguuaucuugguucaaaaagggguccucaaucggacagauguuugagaccacaaugcgaggugcaaagcgcauggccauucugggcgacacugcuugggauuucgggagucuaggaggcguauuuaccagcauagguaaagcgcuccaucaagucuucggggcaaucuauggcgccgcuuuuuccggagugucuuggacaaugaagauucugaucggcguugugauuacuuggaucgggaugaauagcagaucaaccagucuuuccgucagcuuggugcugguaggaauagugacgcucuaccugggcguuaugguccaggccgacucugguuguguggugucauggaaaaacaaggagcuuaaaugcgggaguggaaucuucauuacagauaauguccacaccuggacugaacaguauaaguuucagcccgagagcccauccaagcuggcaucugccauccaaaaagcucacgaagagggcauuugugguaucaggucgguuacacgguuggaaaaccucauguggaagcagauaacccccgagcugaaucauauuuuaagcgagaacgaagugaaacugacuaucaugaccggcgacauuaaggggaucaugcaggccggaaaacgcucccuaagaccucagccaacagagcucaaguacucauggaaagcauggggcaaggcgaagaugcugaguacggaacuucacaaucauaccuucuugauagaugggccggagacugcugaaugccccaacacaaauagggccuggaacucucuggagguggaggacuauggauuuggcguauucaccacaaauaucuggcucaaacugaaggaacgucaagaugucuuuugugacagcaaauuaauguccgcagccauuaaggacaaccgggcugugcacgccgauauggguuacuggaucgagucagcacugaacgacacuuggaaaauugaaaaggcuagcuucaucgagguuaagucuugccacuggccuaaaucccauacccuuuggaguaaugggguguuggagagcgaaaugauaauuccaaagaacuucgccggacccgucucucagcacaauuaucgaccuggcuaccauacgcagacagcggguccauggcaccucggcagacuggagauggauuuugacuucugugaagggaccacugugguugugaccgaggauugcggaaacaggggccccucccuacgcacaacuaccgccucagggaaacugaucacagaauggugcugucggaguugcacgcucccgccucugagauacaggggagaggacggcuguugguaugguauggagauccgcccacuuaaggaaaaagaggaaaauuugguaaacagccuggucaccgcugggcauggacagauugauaauuuuucguuaggcgugcucgguauggcacuguuccuugaggaaaugcugcgaacucgggugggcacaaagcacgccaucuugcucgucgcuguuuccuuugugacccugauuacugggaacaugucuuuccgugaccuaggaagaguaauggugauggucggcgccacaaugaccgaugacauagggaugggagugacguaccuggcacuccuggcggccuuuaagguuaggcccacuuucgcugccggccuuuugcugcgcaaauuaaccagcaaggagcucaugaugacaaccaucgguauugugcugcuuucacaaaguacuaucccugagacaauucuggaacuaaccgaugcacucgcucuggggaugauggucuugaaaaucgugcggaauauggagaaguaucagcuggccguuacaauaaugacuaucuuaugcgugcccaacgcagucauucuccagaaugccuggaaaguauccuguaccauccuggcugugguuucugugagcccacuucuguugacguccucacaacagaaggcggacuggauuccucucgcccugacaaucaagggacuaaaccccaccgcaauauuucugacuacccuuagcagaacaaguaaaaagaggucuuggccacucaaugaagcuauuauggccgucggcaugguguccauccuggccagcucguugcugaaaaacgauaucccgaugacuggcccuuuaguagcugggggacuccugaccgugugcuacguccuuacgggucgaucagcagaccuggaguuggaacgcgccgcggacguucggugggaggagcaggcugaaauuucuggcaguucccccauacucagcaucacaauuucugaggaugggagcauguccaucaagaaugaagaggaggaacagacccugacuauucuaaucagaacaggacugcuugugauaucaggccucuucccagugaguauccccauuaccgccgcagccugguaucugugggaggucaaaaagcaaagggcugguguguugugggacguuccuagcccacccccuguagggaaagcagaauuagaggauggagccuaccguaucaagcagaagggcauucugggcuauucucagaucggggcgggaguguacaaagaagguacuuuucacacaauguggcaugucacccgcggcgcugugcucaugcacaaggggaaacggauagagccguccugggccgacguuaagaaagaucugauuucauacggaggcgguuggaaacuugagggggaauggaaggagggagaagaggugcagguccuggcauuggaaccaggcaaaaaccccagagccgugcaaacgaagccuggccuauucaaaacuaacaccgggacaaucggagcuguaagucuggacuuuagcccagguaccuccggcucucccaucgucgauaagaaagggaaggugguuggacucuauggcaaugguguggucacaaggucggggacuuacgugagcgccauugcacagaccgagaagucaaucgaggacaacccugaaauagaggaugacauuuucagaaagaaacggcugacgaucauggaucuucauccgggagcuggcaaaacaaagcgcuauuuacccgccauuguuagagaagcgaucaaaaggggccugcggacucucauauuggccccaacccgaguggucgcagcugagauggaagaggcccugagagggcucccuauucgcuaccagacacccgcuaucagggcagagcacaccggacgugaaaucguggaccugaugugucaugccacuuucaccaugcggcuucuguccccaauuagaguaccuaauuauaacuugaucauuauggaugaggcccacuuuacagaccccgcuaguauagcggcaagggguuacaucucuacgcgcguggaaaugggcgaggccgcugggauuuucaugacugccaccccaccgggaagccgagacccuuuuccccaguccaaugcaccaaucauggaugaggaaagagagauccccgaacggucauggaacucuggccacgaguggguuacagacuucaaggguaagaccgucugguuugugccuagcauuaaagccgggaaugauauaacugcuugccuaaggaagaacggcaaaaaggugauccaacugagucgcaaaacauucgacuccgaauauauuaagacccguacgaaugauugggacuuugucguaacuacagauaucagcgagaugggcgcgaacuucaaggccgagagagugauugacccacggagguguaugaaacccguuauccucaccgauggcgaagaacgcgugauauuagcagggccuaugccggucacccauucuucagcugcccagcgaagaggacggguggguaggaauccaaagaacgaaaaugaccaguacaucuacaugggcgagccccuggaaaacgaugaggacugcgcacacuggaaagaggccaagaugcuucuggacaauauuaacacuccugaagggaucauucccuccauguuugagccagaacgcgagaaaguugaugcuaucgacggagaauauagacucaggggcgaggcccggaagacauucguggauuugaugcgucgcggugaccugccugucuggcucgcguaccgaguggcagccgaggggauaaacuaugcugauagaaggugguguuuugacggcgucaaaaauaaccaaauucuggaagagaauguggaaguugagaucuggaccaaggagggagaacggaagaaacuuaagccccgcuggcuagaugccagaauuuacagugacccacuggcuuugaaagaguucaaggaguucgcagccggcaggaagucguuaacacugaaccucaucacugagauggggcggcugccuacguuuaugacccagaaggcucgaaaugcccuugauaaccuggcaguccuccauacagcggaagccggagguagagcuuauaaucacgccuugagcgagcugccggagacucuagaaacccugcuccuucugacauuauuggcaaccgugacuggcgggauauuccuguuucucaugucuggaaagggcaucgguaaaaugacgcuggggaugugcugcauuaucaccgcuuccauucuucugugguacgcccagauccagccccacuggauagcagccagcauuauccucgaguucuuuuugaucgugcuguuaauuccagaaccugagaagcaacgcacaccccaggacaaccagcuaacuuaugucguuaucgcuauacugaccgugguagcggccacaauggcaaaugaaaugggcuuccucgagaaaaccaagaaagauuuuggacuuggcucaauuacuacacagcaaccagacaguaacauccuggauauugacuugaggccugcuucugccuggacgcuguacgccguggcaaccacuuucaucacacccaugcuccggcauuccauagagaauagcucagucaacgugagucugaccgcuaucgccaaucaggcgaccguucuuauggggcucggaaaggguuggccgcugagcaagauggacauuggcgugccauugcuggcuaucggguguuacucccaggucaacccuauuacauuaacugccgcacuacugcuccuuguagcccacuaugcuaucauuggacccggccugcaggcaaaagccacgcgugaagcgcaaaagagagcugccgcagguaucaugaaaauaccagccgcugaugggauuaccgugaucgacuuggaucccaucccuuacgacccgaaguuugagaaacagcugggccagguuaugcuccuggugcuuugcgucacacagguguuaaugaugaggacuaccugggcccugugugaagcacucacauuggcuaccggacccauuucuacucugugggagggcaauccagggcgcuucuggaacacgacaauagccgucagcauggcgaauaucuuucggggauccuaucuagccggcgcaggucuacucuucucaauuaugaagaacaccgcuaacacucgaagagggaccggaaauacaggcgaaacucuuggugagaaguggaaaaacaggcugaaugccuugggcaagucugaguuucaaaucuacaaaaagagugggauucaggaaguggaucgcacccuggcaaaagagggaaucaagcggggcgaaacagaccaucacgcuguuucgagagggagcgccaaacuccguugguucguggagaggaaccugguaacgccugagggaaagguggucgauuuaggcugcgguagagggggaugguccuauuacuguggcggucuuaagaauguuaaagaagugaagggccugaccaaagggggacccggccaugaggaaccuauaccaaugucuacuuauggguggaaccucguccgccuacagucaggaguggacguauucuuuacacccccugagaagugcgauacccuguugugugacaucggcgaaagcuccccaaaucccacuguggaggccggucgaacacugagaguucucaaccuuguggagaauuggcugaacaauaacacccaauucugcauuaaagucuugaauccguacaugccuagugugaucgaaaagauggaggcgcugcagaggaaguacgggggagcucucguccggaacccauuaucucgcaauagcacgcacgaaauguauugggugucaaacgcauccggcaacauuguuaguagcguaaauaugaucucuagaaugcugauaaacagguuuaccaugaaacacaagaaagccacauacgagcccgauguggaccuuggcuccgggacucgaaauauuggaaucgaaucagagaccccuaaccuggauaucauugguaagcggauagagaaaaucaagcaggaacaugagacaagcuggcacuaugaccaggaccauccauacaagacuugggcuuaucacggcucguacgaaaccaaacaaacagggucugccaguuccauggucaauggagugguucgucuacucaccaagcccugggaugugauuccgauggucacucagauggcaaugacggacacaaccccuuucggccagcagagaguguuuaaagagaagguagauacucgcacccaagaacccaaagaggguacaaagaagcugaugaaaaucacggccgagugguuguggaaggaacuggggaaaaagaaaaccccaaggauguguacucgggaggaguucacaagaaaggugcgcagcaacgcugcgcucggagccauuuuuaccgacgagaauaaauggaagucagcaagggaggcuguugaagauuccggcuucugggagcuugucgacaaggaacgaaaccugcacuuagagggcaaaugcgaaacuuguguguauaauaugauggggaagcgggagaaaaagcugggagaguuugguaaagccaagggcucuagagcaaucugguacaugugguugggggccagguuccucgaauuugaggcucugggauuccuaaacgaagaucauugguuuagccgcgagaauagucuuuccggcguggaaggugaggggcugcacaagcucggauacauacugcgugacgucagcaaaaaggagggcggcgccauguaugcggaugacacagcagggugggauacccggaucacauuggaagaccugaaaaacgaggaaaugguuacuaaucauauggagggagaacacagaaagcucgccgaggcuauuuucaggcuuaccuaccagaacaaagugguacgcgugcagcgaccuacgccccgggguaccgucauggacaucauuucuagaagggaucagcgcggcucagggcaagugguuacauauggacugaauacuuucaccaacauggaggcccaguuaaucagacagauggaaggcgaggguguguuuaagaguauucaacaucugacagucacugaagagauagcagugaagaacugguuggagcggguagggagggaacgucucucccgaauggcuaucagcggagacgauugcguugugaaaccacuggacgaucgcuucgccucugcucuaaccgcccuuaaugacaugggcaaggucagaaaagauauucagcagugggagcccucgcggggcuggaacgacuggacacaggugccuuuuugcucacaccacuuccaugaacugaucaugaaggaugggagggugcucgucguuccaugucgcaaucaagacgagcugaucggacgagcacggauuagccagggugcgggcugguccuugagggaaacagccugcuuagggaaaaguuacgcucagauguggucucugauguauuuucaccgacgugaucucagacuugccgcaaacgcuauauguagcgccgugccgucccauuggguacccaccucacgcacuacauggaguauccacgcaacccacgaguggaugacuaccgaggacaugcugacaguguggaaucgggucuggauucaggaaaacccuuggauggaggauaagacgccaguggaaucuugggaggaaauccccuaccuaggaaagagggaggaccaauggugcggcagccugauuggucucaccuccagagccacuugggcgaaaaauauccagacagcuauaaaccagguucgcucauugaucgggaaugaggaauauaccgacuacaugccuagcaugaagcgguucaggcgagaggaagaggaagccggagugcugugguga

SEQ ID NO: 14329 - RNA, 9876 nt, Artificial Sequence
  derived and/or modified CDS sequence (opt3) from DENV-2__KX380833__SS-prME
accgccggaaucauuauaaugaugauccccacggugauggcuuuccaccugacuacgagaaacggggaaccucauaugauuguaagcaggcaggaaaagggaaaaucccuccuuuuuaagaccgagaaugguguuaacaugugcacccugauggcaauggacuugggcgaauuaugugaggauacuaucaccuacaauugcccacugcugcggcaaaacgaaccggaggacauugauuguuggugcaauucuacaucaaccugggugacuuaugggacauguaccgccacgggagagcaccgccgagaaaaacguaguguagcgcucgugccccaugucggcaugggucuggagacucggaccgaaacauggaugagcuccgagggggcuuggaagcacgcccagaggaucgagacuugggugcuucggcauccuggauucaccguuauggcagccauacuggcuuacacaaucggcaccacguauuuucagcgcguguugauuuucauccuccugacugcagucgccccaucuaugacaaugagaugcauuggcaucucgaacagggacuuuguggaagggguaucaggagguagcuggguugauauagugcuggagcacggcaguugugucaccacuauggcuaaaaauaagcccacacucgacuucgaauuaauuaagaccgaggccaaacacccugcgacgcugcggaaguacugcaucgaagcaaaacuuaccaacacaacuaccgccucccgcuguccaacacagggggagcccucuuugaaugaggaacaagauaagcgauuugugugcaaacauagcaugguggacagaggauggggcaacgguugugggcuguucggaaagggcggcauugucacuugcgcuauguuuaccugcaagaaaaauauggaggggaagaucguucagccugaaaaccuagaguauacaaucgugauuaccccacacuccggagaagagaaugccguagguaacgauacuggcaaacaugggaaggagauaaaagugacgccgcagucaaguaucacagaagcagagcucaccggauacggcacugcuaccauggaauguagccccaggacaggucuggacuucaaugagaugguccuucugcagauggaaaacaaggccugguuggugcaccggcaaugguuucucgaucugccuuuaccauggcugcccggggcggacacccagggcucuaacuggauucagaaagagacucucguuacauucaagaauccucacgccaagaaacaggauguggucgugcuuggaucccaagagggcgcaaugcauacggcucugaccggggccacugaaauccagaugucaagcggaaacuugcuauuuacaggucaccugaagugccgucuccgcauggacaaacugcagcuuaagggcaugaguuauucuauguguaccgggaaauucaagguaguuaaggagauagcugaaacacaacauggaacuauugugaucagaguccaguacgagggcgacgguuccccaugcaaaauccccuucgagauuauggaucuggaaaagaggcacguguuggggcggcucaucaccgucaauccgauugugacggagaaagacagcccuguuaacauagaagccgagcccccauuuggcgauucguacaucauuaucggaguggaaccuggccagcugaaguuaucuugguucaaaaagggguccucaaucggacagauguuugagaccacaaugcgaggugcaaagcgcauggccauucugggcgacacugcuugggauuucgggagucuaggaggcguauuuaccagcauagguaaagcgcuccaucaagucuucggggcaaucuauggcgccgcuuuuuccggagugucuuggacaaugaagauucugaucggcguugugauuacuuggaucgggaugaauagcagaucaaccagucuuuccgucagcuuggugcugguaggaauagugacgcucuaccugggcguuaugguccaggccgacucugguuguguggugucauggaaaaacaaggagcuuaaaugcgggaguggaaucuucauuacagauaauguccacaccuggacugaacaguauaaguuucagcccgagagcccauccaagcuggcaucugccauccaaaaagcucacgaagagggcauuugugguaucaggucgguuacacgguuggaaaaccucauguggaagcagauaacccccgagcugaaucauauuuuaagcgagaacgaagugaaacugacuaucaugaccggcgacauuaaggggaucaugcaggccggaaaacgcucccuaagaccucagccaacagagcucaaguacucauggaaagcauggggcaaggcgaagaugcugaguacggaacuucacaaucauaccuucuugauagaugggccggagacugcugaaugccccaacacaaauagggccuggaacucucuggagguggaggacuauggauuuggcguauucaccacaaauaucuggcucaaacugaaggaacgucaagaugucuuuugugacagcaaauuaauguccgcagccauuaaggacaaccgggcugugcacgccgauauggguuacuggaucgagucagcacugaacgacacuuggaaaauugaaaaggcuagcuucaucgagguuaagucuugccacuggccuaaaucccauacccuuuggaguaaugggguguuggagagcgaaaugauaauuccaaagaacuucgccggacccgucucucagcacaauuaucgaccuggcuaccauacgcagacagcggguccauggcaccucggcagacuggagauggauuuugacuucugugaagggaccacugugguugugaccgaggauugcggaaacaggggccccucccuacgcacaacuaccgccucagggaaacugaucacagaauggugcugucggaguugcacgcucccgccucugagauacaggggagaggacggcuguugguaugguauggagauccgcccacuuaaggaaaaagaggaaaauuugguaaacagccuggucaccgcugggcauggacagauugauaauuuuucguuaggcgugcucgguauggcacuguuccuugaggaaaugcugcgaacucgggugggcacaaagcacgccaucuugcucgucgcuguuuccuuugugacccugauuacugggaacaugucuuuccgugaccuaggaagaguaauggugauggucggcgccacaaugaccgaugacauagggaugggagugacguaccuggcacuccuggcggccuuuaagguuaggcccacuuucgcugccggccuuuugcugcgcaaauuaaccagcaaggagcucaugaugacaaccaucgguauugugcugcuuucacaaaguacuaucccugagacaauucuggaacuaaccgaugcacucgcucuggggaugauggucuugaaaaucgugcggaauauggagaaguaucagcuggccguuacaauaauggcaaucuuaugcgugcccaacgccgucauucuccagaaugcuuggaaaguauccuguacuauccuggcggugguuucugugagcccacuucuguugaccuccucacaacagaaggccgacuggauuccucucgcacugacgaucaagggacuaaaccccacagcuauauuucugaccacucuuagcagaaccaguaaaaagaggucuuggccacucaaugaagccauuauggccgucggcaugguguccauccuggcuagcucguugcugaaaaacgauaucccgaugacaggcccuuuaguagcagggggacuccugacugugugcuacguccuuaccggucgaucagccgaccuggaguuggaacgcgcggcugacguucggugggaggagcaggccgaaauuucuggcaguucccccauacucagcaucacgauuucugaggaugggagcauguccaucaagaaugaagaggaggaacagacacugaccauucuaaucagaacuggacugcuugugauaucaggccucuucccagugaguauccccauuacagcagccgcuugguaucugugggaggucaaaaagcaaagggccgguguguugugggacguuccuagcccacccccuguagggaaagccgaauuagaggauggagcguaccguaucaagcagaagggcauucugggcuauucucagaucggggcuggaguguacaaagaagguaccuuucacacuauguggcaugucacacgcggcgccgugcucaugcacaaggggaaacggauagagccguccugggcagacguuaagaaagaucugauuucauacggaggcgguuggaaacuugagggggaauggaaggagggagaagaggugcagguccuggccuuggaaccaggcaaaaaccccagagcugugcaaaccaagccuggccuauucaaaacgaacacugggaccaucggagccguaagucuggacuuuagcccagguacauccggcucucccaucgucgauaagaaagggaaggugguuggacucuauggcaaugguguggucaccaggucggggacauacgugagcgcaauugcucagacugagaagucaaucgaggacaacccugaaauagaggaugacauuuucagaaagaaacggcugaccaucauggaucuucauccgggagccggcaaaacgaagcgcuauuuacccgcgauuguuagagaagccaucaaaaggggccugcggacacucauauuggcaccaacucgaguggucgcugccgagauggaagaggcucugagagggcucccuauucgcuaccagacccccgcaaucagggccgagcacacaggacgugaaaucguggaccugaugugucaugccaccuucacuaugcggcuucuguccccaauuagaguaccuaauuauaacuugaucauuauggaugaggcucacuuuaccgaccccgcgaguauagcagccagggguuacaucucuacacgcguggaaaugggcgaggcugccgggauuuucaugacggcaacuccaccgggaagccgagacccuuuuccccaguccaaugccccaaucauggaugaggaaagagagauccccgaacggucauggaacucuggccacgaguggguuaccgacuucaaggguaagacagucugguuugugccuagcauuaaagcugggaaugauauagcggccugccuaaggaagaacggcaaaaaggugauccaacugagucgcaaaaccuucgacuccgaauauauuaagacucguacaaaugauugggacuuugucguaaccacggauaucagcgagaugggcgcaaacuucaaggcugagagagugauugacccacggagguguaugaaacccguuauccucacugauggcgaagaacgcgugauauuagccgggccuaugccggucacacauucuucagcagcccagcgaagaggacggguggguaggaauccaaagaacgaaaaugaccaguacaucuacaugggcgagccccuggaaaacgaugaggacugcgcucacuggaaagaggccaagaugcuucuggacaauauuaacaccccugaagggaucauucccuccauguuugagccagaacgcgagaaaguugaugcgaucgacggagaauauagacucaggggcgaggcacggaagaccuucguggauuugaugcgucgcggugaccugccugucuggcucgccuaccgaguggcugccgaggggauaaacuaugcugauagaaggugguguuuugacggcgucaaaaauaaccaaauucuggaagagaauguggaaguugagaucuggacuaaggagggagaacggaagaaacuuaagccccgcuggcuagaugcaagaauuuacagugacccacuggccuugaaagaguucaaggaguucgcugccggcaggaagucguuaacacugaaccucaucaccgagauggggcggcugccuacauuuaugacucagaaggcacgaaaugcgcuugauaaccuggccguccuccauacggcugaagccggagguagagcauauaaucacgcuuugagcgagcugccggagacccuagaaacacugcuccuucugacuuuauuggccaccgugacaggcgggauauuccuguuucucaugucuggaaagggcaucgguaaaaugacccuggggaugugcugcauuaucacugcauccauucuucugugguacgcccagauccagccccacuggauagcugcgagcauuauccucgaguucuuuuugaucgugcuguuaauuccagaaccugagaagcaacgcacgccccaggacaaccagcuaaccuaugucguuaucgccauacugacagugguagcagcuacuauggccaaugaaaugggcuuccucgagaaaaccaagaaagauuuuggacuuggcucaauuacaacccagcaaccagacaguaacauccuggauauugacuugaggccugccucugcauggacucuguacgcuguggccacaacguucaucacccccaugcuccggcauuccauagagaauagcucagucaacgugagucugacugcgaucgcuaaucaggccacaguucuuauggggcucggaaaggguuggccgcugagcaagauggacauuggcgugccauugcuggcaaucggguguuacucccaggucaacccuauuaccuuaaccgccgcucuacugcuccuuguagcacacuaugccaucauuggacccggccugcaggcgaaagcuacacgugaagcccaaaagagagcagccgcugguaucaugaaaauaccagccgcagaugggauuacugugaucgacuuggaucccaucccuuacgacccgaaguuugagaaacagcugggccagguuaugcuccuggugcuuugcgucacacagguguuaaugaugaggaccacaugggcucugugugaagcccucacuuuggcgaccggacccauuucuacacugugggagggcaauccagggcgcuucuggaacaccacuauagccgucagcauggcaaauaucuuucggggauccuaucuagcuggcgccggucuacucuucucaauuaugaagaacacggcaaacacacgaagagggaccggaaauacuggcgaaacccuuggugagaaguggaaaaacaggcugaaugcuuugggcaagucugaguuucaaaucuacaaaaagagugggauucaggaaguggaucgcacacuggccaaagagggaaucaagcggggcgaaacugaccaucacgccguuucgagagggagcgcgaaacuccguugguucguggagaggaaccugguaaccccugagggaaagguggucgauuuaggcugcgguagagggggaugguccuauuacuguggcggucuuaagaauguuaaagaagugaagggccugacaaaagggggacccggccaugaggaaccuauaccaaugucuacguauggguggaaccucguccgccuacagucaggaguggacguauucuuuacacccccugagaagugcgauacucuguugugugacaucggcgaaagcuccccaaaucccacaguggaggcuggucgaacccugagaguucucaaccuuguggagaauuggcugaacaauaacacucaauucugcauuaaagucuugaauccguacaugccuagugugaucgaaaagauggaggcacugcagaggaaguacgggggagcccucguccggaacccauuaucucgcaauagcacacacgaaauguauugggugucaaacgcuuccggcaacauuguuaguagcguaaauaugaucucuagaaugcugauaaacagguuuaccaugaaacacaagaaagccacguacgagcccgauguggaccuuggcuccgggacccgaaauauuggaaucgaaucagagacaccuaaccuggauaucauugguaagcggauagagaaaaucaagcaggaacaugagacuagcuggcacuaugaccaggaccauccauacaagaccugggcauaucacggcucguacgaaacaaaacaaacugggucugccaguuccauggucaauggagugguucgucuacucaccaagcccugggaugugauuccgauggucacacagauggcuaugaccgacacuacgccuuucggccagcagagaguguuuaaagagaagguagauacacgcacccaagaacccaaagaggguacuaagaagcugaugaaaaucaccgcggagugguuguggaaggaacuggggaaaaagaaaacaccaaggauguguacgcgggaggaguucaccagaaaggugcgcagcaacgccgcacucggagcuauuuuuacugacgagaauaaauggaagucagccagggaggcaguugaagauuccggcuucugggagcuugucgacaaggaacgaaaccugcacuuagagggcaaaugcgaaacauguguguauaauaugauggggaagcgggagaaaaagcugggagaguuugguaaagccaagggcucuagagcuaucugguacaugugguugggggccagguuccucgaauuugaggcgcugggauuccuaaacgaagaucauugguuuagccgcgagaauagucuuuccggcguggaaggugaggggcugcacaagcucggauacauacugcgugacgucagcaaaaaggagggcggcgcaauguaugccgaugacaccgcugggugggauacucggaucacauuggaagaccugaaaaacgaggaaaugguuaccaaucauauggagggagaacacagaaagcucgccgaggcaauuuucaggcuuacauaccagaacaaagugguacgcgugcagcgaccuacuccccgggguaccgucauggacaucauuucuagaagggaucagcgcggcucagggcaagugguuacguauggacugaauaccuucacaaacauggaggcucaguuaaucagacagauggaaggcgaggguguguuuaagaguauucaacaucugacugucaccgaagagauagccgugaagaacugguuggagcggguagggagggaacgucucucccgaauggcuaucagcggagacgauugcguugugaaaccacuggacgaucgcuucgccucugcacuaacagcgcuuaaugacaugggcaaggucagaaaagauauucagcagugggagcccucgcggggcuggaacgacuggacucaggugccuuuuugcucacaccacuuccaugaacugaucaugaaggaugggagggugcucgucguuccaugucgcaaucaagacgagcugaucggacgagcacggauuagccagggugcuggcugguccuugagggaaaccgccugcuuagggaaaaguuacgcacagauguggucucugauguauuuucaccgacgugaucucagacuugcugccaacgcaauauguagcgccgugccgucccauuggguacccaucucacgcacgacauggaguauucacgcgacccacgaguggaugacuacagaggacaugcugaccguguggaaucgggucuggauccaggaaaacccuuggauggaggauaagacuccaguggaaucuugggaggaaauucccuaccuaggaaagagggaggaccaauggugcggcagccugaucggucucaccuccagagcuacaugggccaaaaauauacagacggcaaucaaccagguucgcucauugauugggaaugaggaauauaccgacuacaugccuagcaugaagcgguucaggcgagaggaagaggaagccggagugcugugguga

SEQ ID NO: 14330 - RNA, 9876 nt, Artificial Sequence
  derived and/or modified CDS sequence (opt3) from DENV-2__KX380834__SS-prME
accgccggcaucauuauaaugaugauccccacagugauggcuuuccaccugacuacgaggaauggggagccucauaugauugucagcaggcaggaaaagggaaaaucccuccuuuuuaagaccgagaaugguguuaacaugugcacacugauggcaauggacuugggcgaauuaugugaggauacuaucaccuacaauugcccacugcuacggcaaaacgaaccggaggacauugauuguuggugcaauucuacaucaaccugggugacuuaugggacauguaccgccacgggagagcaccgccgagaaaaacguaguguugcgcucgugccccaugucggcaugggucuggagacuaggaccgaaacauggaugagcuccgagggggcuuggaagcacgcccagaggaucgagacuuggauacuucggcauccuggauucaccaucauggcagccauucuggcuuacacaaucggcaccacguauuuucagcgcguguugauuuucauccuccugacugcaguuacaccaucuauggccaugagaugcauaggcauuucgaacagggacuuuguggaaggggucucaggagguagcuggguggauaucguacuggagcacggcaguuguguuaccacuauggcuaaaaauaagcccacacucgacuucgaauuaauuaagaccgaggccaaacaccuggcgacgcuucggaaguacugcguggaagcaaaauugaccaacacaacuaccgccucccgcuguccuacacagggggagccaucucugaaugaggaacaagauaagcgauuugucugcaaacauagcaugguggacagaggauggggcaacgguugugggcuauucggaaagggcggcaucgugacuugcgcuauguuuaccugcaagaaaaauauggaggggaaggucguucagcccgaaaaccucgaguauacaaucgugauuaccccucacuccggagaagagaaugccguagguaacgauacuggcaaacaugggaaggagauaaaagugacgccacagucaaguaucacagaagcagagcugaccggauacggcacugucaccauggaauguagcccgaggacaggucuugacuucaaugagauggugcuguugcagauggaaaacaaggcuuggcucguucaccggcaaugguuucuggauuuaccccugccuuggcucccaggggccgacacccagggcucuaacuggauucagaaagagacucuugugacauucaagaauccccacgcgaagaaacaggaugucgugguacugggaucccaagagggcgccaugcauacggcauugaccggggcuacugaaauccagaugucaagcggaaaccuacuguuuacaggucaccucaagugccgucugcgcauggacaaacuucagcugaagggcaugaguuauucuauguguaccgggaaauucaagguugugaaggagauagccgaaacacaacauggaacuauugucaucagagugcaguacgagggcgacgguuccccuugcaaaaucccauucgagauuauggauuuggaaaagaggcacguccucgggcggcugaucaccgugaaucccauuguuacggagaaagacagcccggugaacauagaagcugagccucccuuuggcgauucguacaucauuaucggaguagaaccaggccaguuaaagcugucuugguucaaaaagggguccucaaucggacagauguuugagaccacaaugcgaggugccaagcgcauggcaauucuaggcgacacugccugggauuucgggagucucggaggcgucuuuaccagcauagguaaagcucugcaucaaguguucggggcgaucuauggcgcagccuuuuccggaguuucuuggacaaugaagauucuuaucggcguggucauuacuuggaucgggaugaauagcagaucaaccaguuuguccgugagccugguacucgugggaguugucacgcuguaccuuggcgugauggugcaggcugacucugguugugucguuucauggaaaaacaaggagcugaaaugcgggaguggaauauucaucacagauaaugugcacaccuggacugaacaguauaaguuucagccugagagccccuccaaguuggccucugcaauucaaaaagcccacgaagagggcaucugugguauuaggucggugacacggcucgaaaaccugauguggaagcagaucaccccagaguuaaaucauauacugacugagaacgaaguaaaacuaaccauuaugacaggcgacaucaaggggauuaugcaggcuggaaaacgcagccucagaccccagccuacggagcugaaguacuccuggaaagccuggggcaaggcaaagaugcuuucaaccgaauugcacaaucauacuuuccugaucgaugggccagagacagcggaaugcccgaacaccaauagggcuuggaacagucucgaggucgaggacuauggauuuggcguguucacaacuaauauauggcugaaauuaaaggaacgucaagauguauuuugugacucuaaccugaugagcgccgcaaucaaagacaaccgggccgugcacgcugauauggguuacuggauugaguccgcccuuaaugacaccuggaagaucgaaaaagcaucauucauugaggucaagagcugccacuggcccaagucucauacguugugguccaacggggugcucgagagugaaaugaucauaccuaaaaauuucgcuggaccaguuagccagcacaacuaucgacccggcuaccauacacagaccgccgguccuuggcaccugggcagacuagagauggauuuugacuucugugaagggacuaccgugguagucacagaggauugcggaaauaggggcccaucucugcgcacuaccacagcguccgggaagcucauuacggaauggugcugucggucaugcacccugcccccgcuuagauacaggggagaggacggcuguugguaugguauggagauccgcccuuugaaagaaaaggaggaaaaccuggugaauaguuuagugacugccgggcauggacagaucgauaacuuuagccucggcguccuggguauggcucuuuuccuggaggaaauguugcgaacacggguuggcaccaaacacgcaauucuccugguggccguaucguuugugacucuaaucacagggaauauguccuuccgugaccugggaagagucauggugaugguuggcgcuaccaugacggaugacauugggaugggagugacuuaccucgcccugcuugcagcguuuaaggucaggccaaccuucgccgcuggcuugcuguuacgcaagcucacaucuaaagagcugaugaugaccacuauagguaucgugcuucugagccaaucaacaauucccgagaguauccuagaacucaccgaugcccuggcauuggggaugaugguucugaagauugugcggaacauggagaaauaucaguuagcugucacaaucauggccauacucugcguaccuaaugcagugauccugcagaacgccuggaagguuuccuguacuacccuugcuguggucucugugagcccccuguugcucacguccucacaacagaaagcggacuggauuccacuggcccuaacaaucaagggacugaauccuaccgcaauuuuucuuacuacccucagcagaacaaguaagaaaaggucuuggccccugaacgaagcuaucauggccguaggcaugguguccauauuggccagcucgcuguuaaagaaugauauuccaaugacuggcccgcucgucgcugggggacugcuuaccguuugcuacgugcugacgggucgaucagcagacuuggagcucgaacgcgccgcggacgugcggugggaggagcaggcugaaaucucuggcaguuccccuauccugagcauuacaauaucugaggaugggagcauguccaucaaaaacgaagaggaggaacagacccuaacuauucugaucagaacaggacuucucgucauuucaggccuguuccccgugaguaucccaauaaccgccgcagccugguauuugugggagguuaagaaacaaagggcugguguauuaugggacgugcccagcccuccacccgucgggaaggcagaacuggaggauggagccuaccguaucaaacagaagggcauucucggcuauucucagaucggggcgggaguguacaaggaagguacuuuucacacaauguggcauguuacccgcggcgcugugcugaugcacaaagggaagcggauugagccuuccugggccgacgucaaaaaggaucuuaucucauacggaggcgguuggaaacuggagggggaauggaaggagggagaagaggugcagguauuggcacuagaaccgggcaagaacccaagagccguccaaacgaaacccggccuguucaagacuaauaccgggacaauaggagcugugagucucgacuuuagcccugguaccuccggcucuccaauuguugauaaaaaggggaaaguggucggacuguauggcaacggugugguuacaaggucggggacuuacgugagcgccaucgcacagaccgagaagucaaucgaggacaaucccgaaauugaggaugacaucuuccgaaagaaacggcuuacgauaauggauuuacauccuggagcuggcaagacaaaacgcuaucugccggccauugucagagaagcgaucaagaggggccuccggacuuugauucuggcccccacccgagugguagcagcugagauggaagaggcccucagagggcugccaauccgcuaccagaccccugcuauaagggcagagcacaccggacgugaaauuguggaccuuaugugucaugccacuuucaccaugcggcuguugucccccaucagaguuccaaacuauaaucuaaucauuauggaugaggcccacuuuacagacccugcuaguaucgcggcaagggguuacauuucuacgcgcgucgaaaugggcgaggccgcugggauauucaugacugccacacccccaggaagccgagacccguuuccucaguccaacgcacccaucauggaugaggaaagagagauuccagaacggucauggaacucuggccacgagugggugacagacuucaaagguaagaccgugugguuuguccccagcaucaaggccgggaacgauaucgcugcgugccugaggaaaaauggaaagaaaguaauucaacucagucgcaagacuuucgacuccgaauauauaaaaacacguaccaacgauugggacuuugugguuacgacugauaucagcgagaugggcgccaauuucaaggcagagagagugauugacccucggagguguaugaagccagucaucuuaacagauggcgaagaacgcgugauucuggcugggcccaugccuguuacccauucuucagccgcacagcgaagaggacggguggguaggaacccgaaaaaugaaaacgaccaguacaucuacaugggcgagccacuugaaaaugaugaggacugcgcccacuggaaggaggcuaaaaugcugcucgacaacauaaacacccccgaagggaucauuccuuccauguuugagcccgaacgcgagaaggucgaugccaucgacggagaauauagauugaggggcgaggcgcggaaaacuuucguggaucugaugcgucgcggugaccucccaguauggcuggcauaccgaguggccgcugaggggauuaauuaugccgauagaaggugguguuuugacggcguuaagaacaaucaaauccuugaagagaacgucgaaguggagauauggacaaaagagggagaacggaagaagcuaaaaccucgcuggcuggaugcuagaauuuacagugaccccuuggcauuaaaggaguucaaagaguucgccgcuggcagaaagagccugacccucaaucugaucacagagauggggcggcuuccaacuuuuaugacgcagaaagccaagaacgcacuggauaaucucgcgguguugcauaccgccgaagcuggaggucgagccuauaaccacgcacugucggagcuaccugagacacuggaaacucuccuucuguuaaccuugcuggcuacagucaccggcgggauuuuccucuuucugaugucuggaaagggcaucgguaaaaugacucuugggaugugcugcauaaucacggccuccauucugcucugguacgcacagauccagccgcacuggauugccgcuagcaucauauuggaguucuuucugauuguuuuacuaauccccgaaccagagaagcaaagaaccccucaggacaaucagcugacauaugugguaaucgcgauucucacuguggucgccgcaaccauggcuaacgaaaugggcuuccuugagaaaacaaagaaagauuuuggacugggcucaaucaccacucagcaacccgagaguaauauauuggacauugaucugcgcccagccucugccuggacacucuacgcaguggcuacgaccuucaucacuccuaugcugaggcauuccauugaaaacagcucaguuaaugugagucuuacagccaucgcgaaccaggcuaccguccucauggggcugggaaaggguuggcccuugagcaagauggacauaggcguaccgcuguuagccaucggguguuacucccaggugaauccaauuacccuaacagcagcccugcuccuucugguugcucacuaugcaaucauuggaccuggcuugcaggccaaagcgacucgggaggcucaaaagcgugccgcagccgguaucaugaaaaaccccacgguggacgggaugaccgucauugaucuggacccaauccccuacgauccuaaguuugaaaaacagcucggccaggugaugcugcuugucuuaugcgugacacagguucugaugaugagaacuaccugggcucucugugaggccuugacacuggcaaccggaccgauaucuacucuaugggaaggcaaucccgggagguucuggaacacgacaauugcugugagcauggccaacaucuuucgcggauccuaucuggcgggcgccggucuccuuuucucaaucaugaagaauaccgcaaacacucggcgagggaccggaaauacaggcgagacucugggugagaaguggaaaaacagauugaaugcucugggcaagucugaauuucaaauuuacaaaaagagugggauacaggagguagacaggacccucgccaaagaaggaaucaagcgcggcgagacagaucaucacgcagugucgcgggggagcgcuaaacugagaugguucgucgagcguaacuuaguuacgccagaaggaaagguggucgaccuuggcugcgguagagggggaugguccuauuacuguggcggucugaagaaugugaaagagguaaagggccucaccaaagggggaccuggccaugaggaacccauuccuaugucuacuuauggguggaaccuagugcggcugcagucaggaguugauguguucuuuacaccacccgaaaagugcgacaccuugcugugugauaucggcgagagcuccccuaauccaacugucgaggccggucgcacacuccgagugcuuaaccuggucgaaaauugguugaacaauaacacccaauucugcauuaaagugcugaaucccuacaugccgaguguuaucgagaagauggaagcccuccagagaaaguacgggggagcguuaguaaggaacccucugucucggaacagcacgcacgagauguauugggugucaaaugcuuccggcaacauagucaguagcgugaauaugaucucucgcaugcuuauuaacagauuuaccaugaggcacaaaaaggcaacauacgaaccagacguugaucugggcuccgggacucgaaauaucggaauugagucagagacccccaaccuagacaucauagguaaacggauugaaaagaucaaacaggagcaugaaacaagcuggcacuaugaucaggaccauccuuacaagacuugggccuaucacggcucguacgagaccaagcaaacagggucugcuaguuccauggugaauggagucgugcgucuccugaccaaaccaugggacguaauccccauggugacucagauggccaugacggauacaaccccguucggccagcagagaguuuuuaaggaaaaagucgacacucgcacccaagagccuaaggaggguaccaagaaguugaugaagauuacggcagaauggcuguggaaagagcucgggaagaaaaagacccccaggauguguacucgggaagaguucacaagaaaagugcgcagcaacgccgcucuuggagcgauauuuaccgaugagaauaaguggaaaucagccagggaagcaguggaggacuccggcuucugggaacuggucgauaaggagcgaaacuuacaccuggaaggcaagugcgagacuuguguuuauaauaugauggggaaacgggagaagaaauugggagaauuugguaaggcuaaaggcucuagagccaucugguacauguggcucggggcaagguuccuggaguuugaagcccuaggauuccuuaacgaggaccauugguuuagccgcgaaaauagucuguccggcguggagggugaggggcuccacaagcugggauacauuuugcgugauguaagcaagaaagaaggcggcgcuauguaugccgacgauacagcggggugggacacccggaucacacuggaggaucucaagaacgaagagauggugacuaaucauauggaaggagagcacaagaaacuugcagaggccauuuucaaacugaccuaccagaacaaagucgugagaguucagaggccaacgccucgcgguaccgugauggacaucauaucucgacgggaccagagaggcucagggcaagucgugacauauggauuaaacacuuucaccaauauggaagcucagcugaucaggcagauggagggcgaagguguauuuaagaguauucaacaguugacaguuaaagaggagaucgccgugaagaacuggcucauucgcgucgggagagaacggcuguccaggauggcaaucagcggagaugacugcguggugaaaccccuagaugaccguuucgcuucugcccuuacugcucugaaugauaugggcaagguccgaaaagacauucagcagugggagccaucgcgcggcuggaacgauuggacccaaguucccuuuugcucacaucacuuccacgaacucauaaugaaggacgggagagugcugguagugccuugucggaaucaggaugaguugaucggaagggcccgcauuagccagggugcaggcugguccuuaagagaaacggcgugccuggggaagaguuacgcccagauguggucucucauguauuuucaucggagggaccuucgacuggcugccaacgcaaucuguagcgcugucccaucccacuggaucccgacaucacguaccacuuggaguauucaugccacacacgaguggaugaccacugaggauaugcuaaccguguggaauagaguuuggauacaagaaaaccccuggauggaggacaaaacaccuguggaaucuugggaggaaaucccauaccugggaaagcgcgaggaucaguggugcggcagccucauugguuugacgucccgggcaaccugggccaaaaauauccagacugcgauuaaccaggucaggucacugaucgggaaugaggaauauacagacuacaugcccagcaugaagagauuccgccgggaggaagaggaagcuggagugcuuugguga

SEQ ID NO: 14331 - RNA, 9876 nt, Artificial Sequence
  derived and/or modified CDS sequence (opt3) from DENV-2__KX380835__SS-prME
accgcaggaaucauuauaaugaugauccccaccgugauggcuuuccaccugacuacgagaaacggggaaccucauaugauuguaagcaggcaggaaaagggaaaaucccuccuuuuuaagaccgagaaugguguuaacaugugcacacugauggcaauggacuugggcgaauuaugugaggauacuaucaccuacaauugcccacugcugcggcaaaacgaaccggaggacauugauuguuggugcaauucuacaucaaccugggugacuuaugggacauguaccgccacgggagagcaccgccgagaaaaacguaguguagcgcucgugccccaugucggcaugggucuggagacucggaccgaaacauggaugagcuccgagggggcuuggaagcacgcccagaggaucgagacuugggugcuucggcauccuggauucaccguuauggcagccauacuggcuuacacaaucggcaccacguauuuucagcgcguguugauuuucauccuccugacugcagucgccccaucuaugacaaugagaugcauuggcaucucgaacagggacuuuguggaagggguaucaggagguagcuggguugauauagugcuggagcacggcaguugugucaccacuauggcuaaaaauaagcccacacucgacuucgaauuaauuaagaccgaggccaaacacccugcgacgcugcggaaguacugcaucgaagcaaaacuuaccaacacaacuaccgccucccgcuguccaacacagggggagcccucuuugaaugaggaacaagauaagcgauuugugugcaaacauagcaugguggacagaggauggggcaacgguugugggcuguucggaaagggcggcauugucacuugcgcuauguuuaccugcaagaaaaauauggaggggaagaucguucagccugaaaaccuagaguauacaaucgugauuaccccacacuccggagaagagaaugccguagguaacgauacuggcaaacaugggaaggagauaaaagugacgccgcagucaaguaucacagaagcagagcucaccggauacggcacugcuaccauggaauguagccccaggacaggucuggacuucaaugagaugguccuucugcagauggaaaacaaggccugguuggugcaccggcaaugguuucucgaucugccuuuaccauggcugcccggggcggacacccagggcucuaacuggauucagaaagagacucucguuacauucaagaauccucacgccaagaaacaggauguggucgugcuuggaucccaagagggcgcaaugcauacggcucugaccggggccacugaaauccagaugucaagcggaaacuugcuauuuacaggucaccugaagugccgucuccgcauggacaaacugcagcuuaagggcaugaguuauucuauguguaccgggaaauucaagguaguuaaggagauagcugaaacacaacauggaacuauugugaucagaguccaguacgagggcgacgguuccccaugcaaaauccccuucgagauuauggaucuggaaaagaggcacguguuggggcggcucaucaccgucaauccgauugugacggagaaagacagcccuguuaacauagaagccgagcccccauuuggcgauucguacaucauuaucggaguggaaccuggccagcugaaguuaucuugguucaaaaagggguccucaaucggacagauguuugagaccacaaugcgaggugcaaagcgcauggccauucugggcgacacugcuugggauuucgggagucuaggaggcguauuuaccagcauagguaaagcgcuccaucaagucuucggggcaaucuauggcgccgcuuuuuccggagugucuuggacaaugaagauucugaucggcguugugauuacuuggaucgggaugaauagcagaucaaccagucuuuccgucagcuuggugcugguaggaauagugacgcucuaccugggcguuaugguccaggccgacucugguuguguggugucauggaaaaacaaggagcuuaaaugcgggaguggaaucuucauuacagauaauguccacaccuggacugaacaguauaaguuucagcccgagagcccauccaagcuggcaucugccauccaaaaagcucacgaagagggcauuugugguaucaggucgguuacacgguuggaaaaccucauguggaagcagauaacccccgagcugaaucauauuuuaagcgagaacgaagugaaacugacuaucaugaccggcgacauuaaggggaucaugcaggccggaaaacgcucccuaagaccucagccaacagagcucaaguacucauggaaagcauggggcaaggcgaagaugcugaguacggaacuucacaaucauaccuucuugauagaugggccggagacugcugaaugccccaacacaaauagggccuggaacucucuggagguggaggacuauggauuuggcguauucaccacaaauaucuggcucaaacugaaggaacgucaagaugucuuuugugacagcaaauuaauguccgcagccauuaaggacaaccgggcugugcacgccgauauggguuacuggaucgagucagcacugaacgacacuuggaaaauugaaaaggcuagcuucaucgagguuaagucuugccacuggccuaaaucccauacccuuuggaguaaugggguguuggagagcgaaaugauaauuccaaagaacuucgccggacccgucucucagcacaauuaucgaccuggcuaccauacgcagacagcggguccauggcaccucggcagacuggagauggauuuugacuucugugaagggaccacugugguugugaccgaggauugcggaaacaggggccccucccuacgcacaacuaccgccucagggaaacugaucacagaauggugcugucggaguugcacgcucccgccucugagauacaggggagaggacggcuguugguaugguauggagauccgcccacuuaaggaaaaagaggaaaauuugguaaacagccuggucaccgcugggcauggacagauugauaauuuuucguuaggcgugcucgguauggcacuguuccuugaggaaaugcugcgaacucgggugggcacaaagcacgccaucuugcucgucgcuguuuccuuugugacccugauuacugggaacaugucuuuccgugaccuaggaagaguaauggugauggucggcgccacaaugaccgaugacauagggaugggagugacguaccuggcacuccuggcggccuuuaagguuaggcccacuuucgcugccggccuuuugcugcgcaaauuaaccagcaaggagcucaugaugacaaccaucgguauugugcugcuuucacaaaguacuaucccugagacaauucuggaacuaaccgaugcacucgcucuggggaugauggucuugaaaaucgugcggaauauggagaaguaucagcuggccguuacaauaauggcaaucuuaugcgugcccaacgccgucauucuccagaaugcuuggaaaguauccuguacuauccuggcggugguuucugugagcccacuucuguugaccuccucacaacagaaggccgacuggauuccucucgcacugacgaucaagggacuaaaccccacagcuauauuucugaccacucuuagcagaaccaguaaaaagaggucuuggccacucaaugaagccauuauggccgucggcaugguguccauccuggcuagcucguugcugaaaaacgauaucccgaugacaggcccuuuaguagcagggggacuccugacugugugcuacguccuuaccggucgaucagccgaccuggaguuggaacgcgcggcugacguucggugggaggagcaggccgaaauuucuggcaguucccccauacucagcaucacgauuucugaggaugggagcauguccaucaagaaugaagaggaggaacagacacugaccauucuaaucagaacuggacugcuugugauaucaggccucuucccagugaguauccccauuacagcagccgcuugguaucugugggaggucaaaaagcaaagggccgguguguugugggacguuccuagcccacccccuguagggaaagccgaauuagaggauggagcguaccguaucaagcagaagggcauucugggcuauucucagaucggggcuggaguguacaaagaagguaccuuucacacuauguggcaugucacacgcggcgccgugcucaugcacaaggggaaacggauagagccguccugggcagacguuaagaaagaucugauuucauacggaggcgguuggaaacuugagggggaauggaaggagggagaagaggugcagguccuggccuuggaaccaggcaaaaaccccagagcugugcaaaccaagccuggccuauucaaaacgaacacugggaccaucggagccguaagucuggacuuuagcccagguacauccggcucucccaucgucgauaagaaagggaaggugguuggacucuauggcaaugguguggucaccaggucggggacauacgugagcgcaauugcucagacugagaagucaaucgaggacaacccugaaauagaggaugacauuuucagaaagaaacggcugaccaucauggaucuucauccgggagccggcaaaacgaagcgcuauuuacccgcgauuguuagagaagccaucaaaaggggccugcggacacucauauuggcaccaacucgaguggucgcugccgagauggaagaggcucugagagggcucccuauucgcuaccagacccccgcaaucagggccgagcacacaggacgugaaaucguggaccugaugugucaugccaccuucacuaugcggcuucuguccccaauuagaguaccuaauuauaacuugaucauuauggaugaggcucacuuuaccgaccccgcgaguauagcagccagggguuacaucucuacacgcguggaaaugggcgaggcugccgggauuuucaugacggcaacuccaccgggaagccgagacccuuuuccccaguccaaugccccaaucauggaugaggaaagagagauccccgaacggucauggaacucuggccacgaguggguuaccgacuucaaggguaagacagucugguuugugccuagcauuaaagcugggaaugauauagcggccugccuaaggaagaacggcaaaaaggugauccaacugagucgcaaaaccuucgacuccgaauauauuaagacucguacaaaugauugggacuuugucguaaccacggauaucagcgagaugggcgcaaacuucaaggcugagagagugauugacccacggagguguaugaaacccguuauccucacugauggcgaagaacgcgugauauuagccgggccuaugccggucacacauucuucagcagcccagcgaagaggacggguggguaggaauccaaagaacgaaaaugaccaguacaucuacaugggcgagccccuggaaaacgaugaggacugcgcucacuggaaagaggccaagaugcuucuggacaauauuaacaccccugaagggaucauucccuccauguuugagccagaacgcgagaaaguugaugcgaucgacggagaauauagacucaggggcgaggcacggaagaccuucguggauuugaugcgucgcggugaccugccugucuggcucgccuaccgaguggcugccgaggggauaaacuaugcugauagaaggugguguuuugacggcgucaaaaauaaccaaauucuggaagagaauguggaaguugagaucuggacuaaggagggagaacggaagaaacuuaagccccgcuggcuagaugcaagaauuuacagugacccacuggccuugaaagaguucaaggaguucgcugccggcaggaagucguuaacacugaaccucaucaccgagauggggcggcugccuacauuuaugacucagaaggcacgaaaugcgcuugauaaccuggccguccuccauacggcugaagccggagguagagcauauaaucacgcuuugagcgagcugccggagacccuagaaacacugcuccuucugacuuuauuggccaccgugacaggcgggauauuccuguuucucaugucuggaaagggcaucgguaaaaugacccuggggaugugcugcauuaucacugcauccauucuucugugguacgcccagauccagccccacuggauagcugcgagcauuauccucgaguucuuuuugaucgugcuguuaauuccagaaccugagaagcaacgcacgccccaggacaaccagcuaaccuaugucguuaucgccauacugacagugguagcagcuacuauggccaaugaaaugggcuuccucgagaaaaccaagaaagauuuuggacuuggcucaauuacaacccagcaaccagacaguaacauccuggauauugacuugaggccugccucugcauggacucuguacgcuguggccacaacguucaucacccccaugcuccggcauuccauagagaauagcucagucaacgugagucugacugcgaucgcuaaucaggccacaguucuuauggggcucggaaaggguuggccgcugagcaagauggacauuggcgugccauugcuggcaaucggguguuacucccaggucaacccuauuaccuuaaccgccgcucuacugcuccuuguagcacacuaugccaucauuggacccggccugcaggcgaaagcuacacgugaagcccaaaagagagcagccgcugguaucaugaaaaauccaacuguggaugggaugacgguuauagacuuggaucccauuccuuacgacccgaaguuugagaaacagcugggccaggugaugcuccugguccuuugcgugacccaggucuuaaugaugaggacaacuugggcccugugugaagcacucaccuuggcuacaggacccaucucuacccugugggagggcaacccagggcgcuucuggaauacuacgaucgccgugagcauggcgaacauuuuucggggauccuaucuagccggcgcaggucuacucuucucaauaaugaagaacacagcuaauacccgaagagggacuggaaacaccggcgaaacacuuggugagaaguggaaaaauaggcugaacgccuugggcaagucugaguuucaaaucuacaaaaagagugggauucaggaaguugaucgcacucuggcaaaagagggaaucaagcggggcgaaaccgaccaucacgcugugucgagagggagcgccaaacuccguugguucguagagaggaaucuggugacaccugagggaaaggucguugauuuaggcugcgguagagggggaugguccuauuacuguggcggucuuaagaacgugaaagaagucaagggccugacgaaagggggacccggccaugaggaaccuauuccaaugucuaccuauggguggaaucucgugcgccuacagucaggaguagacguguucuuuacucccccugagaagugcgauacacuguugugugacaucggcgaaagcuccccaaaccccaccguugaggccggucgaacucugagagugcucaaucuugucgagaacuggcugaauaacaauacacaauucugcauaaaaguguugaacccguacaugccuagugucaucgaaaagauggaggcgcugcagaggaaguacgggggagcucucgugcggaauccauuaucucgcaacagcacccacgaaauguauuggguuucaaacgcauccggcaauauuguaaguagcgugaacaugaucucuagaaugcugauuaauagguuuacgaugaaacacaagaaagccaccuacgagcccgaugucgaccuuggcuccgggacacgaaacaucggaauagaaucagagacuccuaaucuggauauuaucgguaagcggaucgagaaaauuaagcaggaacaugagaccagcuggcacuaugaccaggaccauccauacaagacaugggcuuaucacggcucguacgaaacuaaacaaaccgggucugccaguuccauggugaacggaguugugcgucuacucacaaagcccugggaugucauaccgauggugacccagauggcaaugacugacacgacaccuuucggccagcagagaguauuuaaagagaagguggauacccgcacucaagaacccaaagaggguaccaagaagcugaugaaaaucacagccgagugguuguggaaggaacuggggaaaaagaaaacgccaaggauguguacccgggaggaguucacuagaaagguucgcagcaaugcugcgcucggagccauuuuuacagacgagaacaaauggaagucagcaagggaggcugucgaagauuccggcuucugggagcuuguggacaaggaacgaaaucugcacuuagagggcaaaugcgaaaccuguguguauaacaugauggggaagcgggagaaaaagcugggagaguuugguaaagccaagggcucuagagcaaucugguacaugugguugggggccagguuccucgaauuugaggcucugggauuccuaaaugaagaucauugguuuagccgcgagaacagucuuuccggcgucgaaggugaggggcugcacaagcucggauacauucugcgugacguuagcaaaaaggagggcggcgccauguaugcggaugacacugcagggugggauacacggaucaccuuggaagaccugaaaaaugaggaaauggugacaaaccauauggagggagaacacagaaagcucgccgaggcuauauucaggcuuacuuaccagaauaaaguagugcgcguccagcgaccuacaccccgggguacggugauggacaucauuucuagaagggaucagcgcggcucagggcaaguugugaccuauggacugaacacauucacuaacauggaggcccaguuaaucagacagauggaaggcgagggugucuuuaagaguauucaacaucugaccgugacagaagagaucgcaguaaagaauugguuggagcggguugggagggaacgucucucccgaauggcuauuagcggagacgauugcguggucaaaccacuggacgaucgcuucgccucugcucuaacugcccuuaacgacaugggcaaggugagaaaagauauacagcagugggagcccucgcggggcuggaaugacuggacccaggugccuuuuugcucacaccacuuccaugaacugaucaugaaggaugggaggguccucguugugccaugucgcaaccaagacgagcugauuggacgagcacggaucagccagggugcgggcugguccuugagggaaacggccugcuuagggaaaaguuacgcucagauguggucucugauguauuuucaccgacgugaucucagacuugccgcaaaugcuaucuguagcgccguaccgucccauugggugcccauuucacgcacaaccuggaguauacacgcaacucacgaguggaugacaaccgaggacaugcugacugucuggaaccggguguggauccaggaaaauccuuggauggaggauaagaccccaguugaaucuugggaggaaauucccuaccuaggaaagagggaggaccaauggugcggcagccugaucggucucacauccagagccacgugggcgaaaaacauucagaccgcuaucaaucaggugcgcucauugauagggaacgaggaauauacugacuacaugccuagcaugaagcgguucaggcgagaggaagaggaagccggaguccugugguga

SEQ ID NO: 14332 - RNA, 9876 nt, Artificial Sequence
  derived and/or modified CDS sequence (opt3) from DENV-2__KX380836__SS-prME
accgcaggaaucauuauaaugaugauccccaccgugauggcuuuccaccugacuacgcgaaacggggagccucauaugauuguaagcaggcaggaaaagggaaaaucccuccuuuuuaagaccgagaaugguguuaacaugugcacacugauggcaauggacuugggcgaauuaugugaggauacuaucaccuacaauugcccacugcugcggcaaaacgaaccggaggacauugauuguuggugcaauucuacaucaaccugggugacuuaugggacauguaccgccacgggagagcaccgccgagaaaaacguaguguagcgcucgugccccauguaggcaugggucuggagacuagaaccgaaacauggaugagcuccgagggggcuuggaagcacgcccagaggaucgagacuugggugcuucggcauccuggauucaccguuauggcagccauacuggcuuacacaaucggcaccacguauuuucagcgcguguugauuuucauccuccugacugcagucgccccaucuaugacaaugaggugcauuggcaucucgaacagggacuuuguggaagggguaucaggagguagcuggguugauauagugcuggagcacggcaguugugucaccacuauggcuaaaaauaagcccacacucgacuucgaauuaauuaagaccgaggccaaacacccugcgacgcugcggaaguacugcaucgaagcaaaacuuaccaacacaacuaccgccucccgcuguccaacacagggggagcccucuuugaaugaggaacaagauaagcgauuugugugcaaacauagcaugguggacagaggauggggcaacgguugugggcuguucggaaagggcggcauugucacuugcgcuauguuuaccugcaagaaaaauauggaggggaagaucguucagccugaaaaccuagaguauacaaucgugauuaccccacacuccggagaagagaaugccguagguaacgauacuggcaaacaugggaaggagauaaaagugacgccgcagucaaguaucacagaagcagagcucaccggauacggcacugcuaccauggaauguagccccaggacaggucuggacuucaaugagaugguccuucugcagauggaaaacaaggccugguuggugcaccggcaaugguuucucgaucugccuuuaccauggcugcccggggcggacacccagggcucuaacuggauucagaaagagacucucguuacauucaagaauccucacgccaagaaacaggauguggucgugcuuggaucccaagagggcgcaaugcauacggcucugaccggggccacugaaauccagaugucaagcggaaacuugcuauuuacaggucaccugaagugccgucuccgcauggacaaacugcagcuuaagggcaugaguuauucuauguguaccgggaaauucaagguaguuaaggagauagcugaaacacaacauggaacuauugugaucagaguccaguacgagggcgacgguuccccaugcaaaauccccuucgagauuauggaucuggaaaagaggcacguguuggggcggcucaucaccgucaauccgauugugacggagaaagacagcccuguuaacauagaagccgagcccccauuuggcgauucguacaucauuaucggaguggaaccuggccagcugaaguuaucuugguucaaaaagggguccucaaucggacagauguuugagaccacaaugcgaggugcaaagcgcauggccauucugggcgacacugcuugggauuucgggagucuaggaggcguauuuaccagcauagguaaagcgcuccaucaagucuucggggcaaucuauggcgccgcuuuuuccggagugucuuggacaaugaagauucugaucggcguugugauuacuuggaucgggaugaauagcagaucaaccagucuuuccgucagcuuggugcugguaggaauagugacgcucuaccugggcguuaugguccaggccgacucugguuguguggugucauggaaaaacaaggagcuuaaaugcgggaguggaaucuucauuacagauaauguccacaccuggacugaacaguauaaguuucagcccgagagcccauccaagcuggcaucugccauccaaaaagcucacgaagagggcauuugugguaucaggucgguuacacgguuggaaaaccucauguggaagcagauaacccccgagcugaaucauauuuuaagcgagaacgaagugaaacugacuaucaugaccggcgacauuaaggggaucaugcaggccggaaaacgcucccuaagaccucagccaacagagcucaaguacucauggaaagcauggggcaaggcgaagaugcugaguacggaacuucacaaucauaccuucuugauagaugggccggagacugcugaaugccccaacacaaauagggccuggaacucucuggagguggaggacuauggauuuggcguauucaccacaaauaucuggcucaaacugaaggaacgucaagaugucuuuugugacagcaaauuaauguccgcagccauuaaggacaaccgggcugugcacgccgauauggguuacuggaucgagucagcacugaacgacacuuggaaaauugaaaaggcuagcuucaucgagguuaagucuugccacuggccuaaaucccauacccuuuggaguaaugggguguuggagagcgaaaugauaauuccaaagaacuucgccggacccgucucucagcacaauuaucgaccuggcuaccauacgcagacagcggguccauggcaccucggcagacuggagauggauuuugacuucugugaagggaccacugugguugugaccgaggauugcggaaacaggggccccucccuacgcacaacuaccgccucagggaaacugaucacagaauggugcugucggaguugcacgcucccgccucugagauacaggggagaggacggcuguugguaugguauggagauccgcccacuuaaggaaaaagaggaaaauuugguaaacagccuggucaccgcugggcauggacagauugauaauuuuucguuaggcgugcucgguauggcacuguuccuugaggaaaugcugcgaacucgggugggcacaaagcacgccaucuugcucgucgcuguuuccuuugugacccugauuacugggaacaugucuuuccgugaccuaggaagaguaauggugauggucggcgccacaaugaccgaugacauagggaugggagugacguaccuggcacuccuggcggccuuuaagguuaggcccacuuucgcugccggccuuuugcugcgcaaauuaaccagcaaggagcucaugaugacaaccaucgguauugugcugcuuucacaaaguacuaucccugagacaauucuggaacuaaccgaugcacucgcucuggggaugauggucuugaaaaucgugcggaauauggagaaguaucagcuggccguuacaauaauggcaaucuuaugcgugcccaacgccgucauucuccagaaugcuuggaaaguauccuguacuauccuggcggugguuucugugagcccacuucuguugaccuccucacaacagaaggccgacuggauuccucucgcacugacgaucaagggacuaaaccccacagcuauauuucugaccacucuuagcagaaccaguaaaaagaggucuuggccacucaaugaagccauuauggccgucggcaugguguccauccuggcuagcucguugcugaaaaacgauaucccgaugacaggcccuuuaguagcagggggacuccugacugugugcuacguccuuaccggucgaucagccgaccuggaguuggaacgcgcggcugacguucggugggaggagcaggccgaaauuucuggcaguucccccauacucagcaucacgauuucugaggaugggagcauguccaucaagaaugaagaggaggaacagacacugaccauucuaaucagaacuggacugcuugugauaucaggccucuucccagugaguauccccauuacagcagccgcuugguaucugugggaggucaaaaagcaaagggccgguguguugugggacguuccuagcccacccccuguagggaaagccgaauuagaggauggagcguaccguaucaagcagaagggcauucugggcuauucucagaucggggcuggaguguacaaagaagguaccuuucacacuauguggcaugucacacgcggcgccgugcucaugcacaaggggaaacggauagagccguccugggcagacguuaagaaagaucugauuucauacggaggcgguuggaaacuugagggggaauggaaggagggagaagaggugcagguccuggccuuggaaccaggcaaaaaccccagagcugugcaaaccaagccuggccuauucaaaacgaacacugggaccaucggagccguaagucuggacuuuagcccagguacauccggcucucccaucgucgauaagaaagggaaggugguuggacucuauggcaaugguguggucaccaggucggggacauacgugagcgcaauugcucagacugagaagucaaucgaggacaacccugaaauagaggaugacauuuucagaaagaaacggcugaccaucauggaucuucauccgggagccggcaaaacgaagcgcuauuuacccgcgauuguuagagaagccaucaaaaggggccugcggacacucauauuggcaccaacucgaguggucgcugccgagauggaagaggcucugagagggcucccuauucgcuaccagacccccgcaaucagggccgagcacacaggacgugaaaucguggaccugaugugucaugccaccuucacuaugcggcuucuguccccaauuagaguaccuaauuauaacuugaucauuauggaugaggcucacuuuaccgaccccgcgaguauagcagccagggguuacaucucuacacgcguggaaaugggcgaggcugccgggauuuucaugacggcaacuccaccgggaagccgagacccuuuuccccaguccaaugccccaaucauggaugaggaaagagagauccccgaacggucauggaacucuggccacgaguggguuaccgacuucaaggguaagacagucugguuugugccuagcauuaaagcugggaaugauauagcggccugccuaaggaagaacggcaagaaggugauccaacugagucgcaaaaccuucgacuccgaauauauuaagacucguacaaaugauugggacuuugucguaaccacggauaucagcgagaugggcgcaaacuucaaggcugagagagugauugacccacggagguguaugaaacccguuauccucacugauggcgaagaacgcgugauauuagccgggccuaugccggucacacauucuucagcagcccagcgaagaggacggguggguaggaauccaaagaacgaaaaugaccaguacaucuacaugggcgagccccuggaaaacgaugaggacugcgcucacuggaaagaggccaagaugcuucuggacaauauuaacaccccugaagggaucauucccuccauguuugagccagaacgcgagaaaguugaugcgaucgacggagaauauagacucaggggcgaggcacggaagaccuucguggauuugaugcgucgcggugaccugccugucuggcucgccuaccgaguggcugccgaggggauaaacuaugcugauagaaggugguguuuugacggcgucaaaaauaaccaaauucuggaagagaauguggaaguugagaucuggacuaaggagggagaacggaagaaacuuaagccccgcuggcuagaugcaagaauuuacagugacccacuggccuugaaagaguucaaggaguucgcugccggcaggaagucguuaacacugaaccucaucaccgagauggggcggcugccuacauuuaugacucagaaggcaaagaaugcgcuugauaaccuggccguccuccauacggcugaagccggaggucgagcauauaaucacgcuuugagcgagcugccggagacccuagaaacacugcuccuucugacuuuauuggccaccgugacaggcgggauauuccuguuucucaugucuggaaaaggcaucgguaagaugacccuggggaugugcugcauuaucacugcauccauucuucugugguacgcccagauccagccccacuggauagcugcgagcauuauccucgaguucuuuuugaucgugcuguuaauuccagaaccugagaaacaaagaacgccccaggacaaccagcuaaccuaugucguuaucgccauacugacagugguagcagcuacuauggccaaugaaaugggcuuccucgagaagaccaaaaaggauuuuggacuuggcucaauuacaacccagcaaccagagaguaacauccuggacauugauuugcgcccugccucugcauggacucuguacgcuguggccacaacguucaucacccccaugcucaggcauuccauagaaaauagcucagucaacgugagucugacugcgaucgcuaaucaggccacaguucuuauggggcucggaaaggguuggccgcugagcaaaauggacauuggcgugccauugcuggcaaucggguguuacucccaggucaacccuauuaccuuaaccgccgcucuacugcuccuuguagcacacuaugccaucauuggacccggccugcaggcgaaggcuacacgggaggcccaaaaacgugcagccgcugguaucaugaagaauccaacuguggacgggaugacgguuauagauuuggaccccauuccuuacgauccgaaauuugaaaagcagcugggccaggugaugcuccugguccuuugcgugacccaggucuuaaugaugagaacaacuugggcccugugugaggcacucaccuuggcuacaggacccaucucuacccugugggaaggcaacccagggagguucuggaauacuacgaucgccgugagcauggcgaacauuuuucgcggauccuaucuagccggcgcaggucuacucuucucaauaaugaagaacacagcuaauacccggcgagggacuggaaacaccggcgagacacuuggugagaaauggaagaauagacugaacgccuugggcaaaucugaauuucaaaucuacaagaaaagugggauucaggagguugacaggacucuggcaaaggaaggaaucaaacgcggcgagaccgaucaucacgcugugucgcgggggagcgccaagcucagaugguucguagagcguaaucuggugacaccugaaggaaaggucguugacuuaggcugcgguagagggggaugguccuauuacuguggcggucuuaaaaacgugaaggaggucaaaggccugacgaaagggggacccggccaugaggaaccuauuccaaugucuaccuauggguggaaucucgugcggcuacagucaggaguagauguguucuuuacucccccugaaaaaugcgacacacuguugugugauaucggcgagagcuccccaaaccccaccguugaggccggucgcacucugcgagugcucaaucuugucgaaaacuggcugaauaacaauacacaauucugcauaaagguguugaacccguacaugccuagugucaucgagaagauggaagcgcugcagagaaaauacgggggagcucucgugaggaauccauuaucucggaacagcacccacgagauguauuggguuucaaacgcauccggcaauauuguaaguagcgugaacaugaucucucgcaugcugauuaauagauuuacgaugaagcacaaaaaggccaccuacgaacccgacgucgaucuuggcuccgggacaaggaacaucggaauagagucagagacuccuaaucuggacauuaucgguaaacgaaucgaaaagauuaagcaggagcaugaaaccagcuggcacuaugaucaggaccauccauacaaaacaugggcuuaucacggcucguacgagacuaagcaaaccgggucugccaguuccauggugaacggaguugugcggcuacucacaaaacccugggacgucauaccgauggugacccagauggcaaugacugauacgacaccuuucggccagcagcguguauuuaaggaaaaaguggacaccagaacucaagagcccaaggaggguaccaagaaacugaugaagaucacagccgaaugguuguggaaagagcuggggaagaaaaagacgccacgcauguguaccagggaagaguucacucggaaaguuagaagcaaugcugcgcucggagccauuuuuacagaugagaacaaguggaagucagcacgcgaagcugucgaggacuccggcuucugggaacuuguggauaaagagaggaaucugcacuuagaaggcaagugcgagaccuguguguauaacaugauggggaaacgagagaagaaacugggagaauuugguaaggccaagggcucucgggcaaucugguacaugugguugggggccagauuccucgaguuugaagcucugggauuccuaaaugaggaccauugguuuagcagggaaaacagucuuuccggcgucgagggugaggggcugcacaaacucggauacauucugcgcgauguuagcaagaaagaaggcggcgccauguaugcggacgauacugcagggugggacacacguaucaccuuggaggaucugaagaaugaagagauggugacaaaccauauggaaggagagcaccggaaacucgccgaggcuauauucagacuuacuuaccagaauaagguagugaggguccagcgcccuacaccccgagguacggugauggacaucauuucucggagagaccagaggggcucagggcaaguugugaccuauggacugaacacauucacuaacauggaagcccaguuaauccgccagauggagggcgaaggugucuuuaagaguauucaacaucugaccgugacagaggagaucgcagucaaaaauugguuggaaagaguugggcgggagaggcucucccguauggcuauuagcggagaugacugcguggucaagccacuggaugaccgauucgccucugcucuaacugcccuuaacgauaugggcaaagugcgcaaggacauacagcagugggaacccucgagaggcuggaaugauuggacccaggugccuuuuugcucacaccacuuccaugagcugaucaugaaagacgggcggguccucguugugccauguaggaaccaagaugaacugauuggacgcgcaagaaucagccagggugcgggcugguccuugcgggagacggccugcuuagggaagaguuacgcucagauguggucucugauguauuuucacaggcgagaccuccgucuugccgcaaaugcuaucuguagcgccguaccgucccauugggugcccauuucaagaacaaccuggaguauacacgcaacucacgaguggaugacaaccgaagauaugcugacugucuggaaccgcguguggauccaggagaauccuuggauggaagacaagaccccaguugagucuugggaagagauucccuaccuaggaaaacgggaggaucaauggugcggcagccugaucggucucacauccagggccacgugggcgaagaacauucagaccgcuaucaaucaggugagaucauugauagggaacgaagaguauacugacuacaugccuagcaugaaacgcuuccggagggaagaggaagaggccggaguccugugguga

SEQ ID NO: 14333 - RNA, 9876 nt, Artificial Sequence
  derived and/or modified CDS sequence (opt3) from DENV-2__KX380838__SS-prME
accgccggaaucauuauaaugaugauccccaccgugauggcuuuccaccugacuacgagaaacggggaaccucauaugauuguaagcaggcaggaaaagggaaaaucccuccuuuuuaagaccgagaaugguguuaacaugugcacccugauggcaauggacuugggcgaauuaugugaggauacuaucaccuacaauugcccacugcugcggcaaaacgaaccggaggacauugauuguuggugcaauucuacaucaaccugggugacuuaugggacauguaccgccacgggagagcaccgccgagaaaaacguaguguagcgcucgugccccaugucggcaugggucuggagacucggaccgaaacauggaugagcuccgagggggcuuggaagcacgcccagaggaucgagacuugggugcuucggcauccuggauucaccguuauggcagccauacuggcuuacacaaucggcaccacguauuuucagcgcguguugauuuucauccuccugacugcagucgccccaucuaugacaaugagaugcauuggcaucucgaacagggacuuuguggaagggguaucaggagguagcuggguugauauagugcuggagcacggcaguugugucaccacuauggcuaaaaauaagcccacacucgacuucgaauuaauuaagaccgaggccaaacacccugcgacgcugcggaaguacugcaucgaagcaaaacuuaccaacacaacuaccgccucccgcuguccaacacagggggagcccucuuugaaugaggaacaagauaagcgauuugugugcaaacauagcaugguggacagaggauggggcaacgguugugggcuguucggaaagggcggcauugucacuugcgcuauguuuaccugcaagaaaaauauggaggggaagaucguucagccugaaaaccuagaguauacaaucgugauuaccccacacuccggagaagagaaugccguagguaacgauacuggcaaacaugggaaggagauaaaagugacgccgcagucaaguaucacagaagcagagcucaccggauacggcacugcuaccauggaauguagccccaggacaggucuggacuucaaugagaugguccuucugcagauggaaaacaaggccugguuggugcaccggcaaugguuucucgaucugccuuuaccauggcugcccggggcggacacccagggcucuaacuggauucagaaagagacucucguuacauucaagaauccucacgccaagaaacaggauguggucgugcuuggaucccaagagggcgcaaugcauacggcucugaccggggccacugaaauccagaugucaagcggaaacuugcuauuuacaggucaccugaagugccgucuccgcauggacaaacugcagcuuaagggcaugaguuauucuauguguaccgggaaauucaagguaguuaaggagauagcugaaacacaacauggaacuauugugaucagaguccaguacgagggcgacgguuccccaugcaaaauccccuucgagauuauggaucuggaaaagaggcacguguuggggcggcucaucaccgucaauccgauugugacggagaaagacagcccuguuaacauagaagccgagcccccauuuggcgauucguacaucauuaucggaguggaaccuggccagcugaaguuaucuugguucaaaaagggguccucaaucggacagauguuugagaccacaaugcgaggugcaaagcgcauggccauucugggcgacacugcuugggauuucgggagucuaggaggcguauuuaccagcauagguaaagcgcuccaucaagucuucggggcaaucuauggcgccgcuuuuuccggagugucuuggacaaugaagauucugaucggcguugugauuacuuggaucgggaugaauagcagaucaaccagucuuuccgucagcuuggugcugguaggaauagugacgcucuaccugggcguuaugguccaggccgacucugguuguguggugucauggaaaaacaaggagcuuaaaugcgggaguggaaucuucauuacagauaauguccacaccuggacugaacaguauaaguuucagcccgagagcccauccaagcuggcaucugccauccaaaaagcucacgaagagggcauuugugguaucaggucgguuacacgguuggaaaaccucauguggaagcagauaacccccgagcugaaucauauuuuaagcgagaacgaagugaaacugacuaucaugaccggcgacauuaaggggaucaugcaggccggaaaacgcucccuaagaccucagccaacagagcucaaguacucauggaaagcauggggcaaggcgaagaugcugaguacggaacuucacaaucauaccuucuugauagaugggccggagacugcugaaugccccaacacaaauagggccuggaacucucuggagguggaggacuauggauuuggcguauucaccacaaauaucuggcucaaacugaaggaacgucaagaugucuuuugugacagcaaauuaauguccgcagccauuaaggacaaccgggcugugcacgccgauauggguuacuggaucgagucagcacugaacgacacuuggaaaauugaaaaggcuagcuucaucgagguuaagucuugccacuggccuaaaucccauacccuuuggaguaaugggguguuggagagcgaaaugauaauuccaaagaacuucgccggacccgucucucagcacaauuaucgaccuggcuaccauacgcagacagcggguccauggcaccucggcagacuggagauggauuuugacuucugugaagggaccacugugguugugaccgaggauugcggaaacaggggccccucccuacgcacaacuaccgccucagggaaacugaucacagaauggugcugucggaguugcacgcucccgccucugagauacaggggagaggacggcuguugguaugguauggagauccgcccacuuaaggaaaaagaggaaaauuugguaaacagccuggucaccgcugggcauggacagauugauaauuuuucguuaggcgugcucgguauggcacuguuccuugaggaaaugcugcgaacucgggugggcacaaagcacgccaucuugcucgucgcuguuuccuuugugacccugauuacugggaacaugucuuuccgugaccuaggaagaguaauggugauggucggcgccacaaugaccgaugacauagggaugggagugacguaccuggcacuccuggcggccuuuaagguuaggcccacuuucgcugccggccuuuugcugcgcaaauuaaccagcaaggagcucaugaugacaaccaucgguauugugcugcuuucacaaaguacuaucccugagacaauucuggaacuaaccgaugcacucgcucuggggaugauggucuugaaaaucgugcggaauauggagaaguaucagcuggccguuacaauaauggcaacuuuaugcgugcccaacgccgucauccuccagaaugcuuggaaaguauccuguaccauucuggcggugguuucugugagcccacuucuguugacguccucacaacagaaggccgacuggaucccucucgcacugacaauuaagggacuaaaccccaccgcuaucuuucugacuacccuuagcagaacaaguaaaaagaggucuuggccacucaaugaagccauaauggccgucggcaugguguccauucuggcuagcucguugcugaaaaacgauaucccgaugacuggcccuuuaguagcagggggacuccugaccgugugcuacguccuuacgggucgaucagccgaccuggaguuggaacgcgcggcugacguucggugggaggagcaggccgaaaucucuggcaguucccccauucucagcauaacaaucucugaggaugggagcauguccauuaagaaugaagaggaggaacagacccugacuauccuaauuagaacaggacugcuugugaucucaggccucuucccagugaguauacccaucaccgcagccgcuugguaucugugggaggucaaaaagcaaagggccgguguguugugggacguuccuagcccacccccuguagggaaagccgaauuagaggauggagcguaccguauuaagcagaagggcauccugggcuauucucagauuggggcuggaguguacaaagaagguacuuuucacacaauguggcaugucacccgcggcgccgugcucaugcacaaggggaaacggaucgagccguccugggcagacguuaagaaagaucugauaucauacggaggcgguuggaaacuugagggggaauggaaggagggagaagaggugcagguccuggccuuggaaccaggcaaaaaccccagagcugugcaaacgaagccuggccuauucaaaacuaacaccgggacaauuggagccguaagucuggacuuuagcccagguaccuccggcucucccaucgucgauaagaaagggaaggugguuggacucuauggcaaugguguggucacaaggucggggacuuacgugagcgcaaucgcucagaccgagaagucaauugaggacaacccugaaaucgaggaugacauauucagaaagaaacggcugacgauuauggaucuucauccgggagccggcaaaacaaagcgcuauuuacccgcgaucguuagagaagccauuaaaaggggccugcggacucucaucuuggcaccaacccgaguggucgcugccgagauggaagaggcucugagagggcucccuauacgcuaccagacacccgcaauuagggccgagcacaccggacgugaaaucguggaccugaugugucaugccacuuucaccaugcggcuucuguccccaaucagaguaccuaauuauaacuugauuaucauggaugaggcucacuuuacagaccccgcgaguauugcagccagggguuacauaucuacgcgcguggaaaugggcgaggcugccgggaucuucaugacugcaaccccaccgggaagccgagacccuuuuccccaguccaaugccccaauuauggaugaggaaagagagauccccgaacggucauggaacucuggccacgaguggguuacagacuucaaggguaagaccgucugguuugugccuagcaucaaagcugggaaugauauugcggccugccuaaggaagaacggcaaaaaggugauacaacugagucgcaaaacuuucgacuccgaauauaucaagacacguaccaaugauugggacuuugucguaacgacugauauuagcgagaugggcgcaaacuucaaggcugagagagugaucgacccacggagguguaugaaacccguuauucucacagauggcgaagaacgcgugaucuuagccgggccuaugccggucacccauucuucagcagcccagcgaagaggacggguggguaggaauccaaagaacgaaaaugaccaguacauauacaugggcgagccccuggaaaacgaugaggacugcgcucacuggaaagaggccaagaugcuucuggacaauaucaacaccccugaagggauuauccccuccauguuugagccagaacgcgagaaaguugaugcgauugacggagaauauagacucaggggcgaggcacggaagacuuucguggauuugaugcgucgcggugaccugccugucuggcucgccuaccgaguggcugccgaggggaucaacuaugcugauagaaggugguguuuugacggcgucaaaaauaaccaaauacuggaagagaauguggaaguugagauuuggacaaaggagggagaacggaagaaacuuaagccccgcuggcuagaugcaagaaucuacagugacccacuggccuugaaagaguucaaggaguucgcugccggcaggaagucguuaacccugaaccucauuacagagauggggcggcugccuacuuuuaugacgcagaaggcacgaaaugcgcuugauaaccuggccguccuccauaccgcugaagccggagguagagcauauaaucacgcuuugagcgagcugccggagacacuagaaacucugcuccuucugaccuuauuggccacagugaccggcgggaucuuccuguuucucaugucuggaaagggcauagguaaaaugacucuggggaugugcugcaucauuacggcauccauccuucugugguacgcccagauucagccccacuggaucgcugcgagcauaauucucgaguucuuuuugaucgugcuguuaaucccagaaccugagaagcaacgcacaccccaggacaaccagcuaacauaugucguuauugccauccugacugugguagcagcuaccauggccaaugaaaugggcuuccucgagaaaacaaagaaagauuuuggacuuggcucaauaaccacucagcaaccagacaguaacauucuggauaucgacuugaggccugccucugcauggacacuguacgcuguggccacgaccuucauuacucccaugcuccggcauuccaucgagaauagcucagucaacgugagucugacagcgauagcuaaucaggccaccguucuuauggggcucggaaaggguuggccgcugagcaagauggacaucggcgugccauugcuggcaauuggguguuacucccaggucaacccuaucaccuuaacagccgcucuacugcuccuuguagcacacuaugccauuaucggacccggccugcaggcgaaagcuacucgugaagcccaaaagagagcagccgcugguauuaugaaaaucccagccgcagaugggauaacggugauugacuuggaucccaucccuuacgacccgaaguuugagaaacagcugggccagguuaugcuccuggugcuuugcgucacccagguguuaaugaugaggacaacuugggcucugugugaagcccucaccuuggcgacaggacccaucucuacccugugggagggcaauccagggcgcuucuggaacacuacgauugccgucagcauggcaaauauauuucggggauccuaucuagcuggcgccggucuacucuucucaaucaugaagaacacagcaaacacccgaagagggacuggaaauaccggcgaaacacuuggugagaaguggaaaaacaggcugaaugcuuugggcaagucugaguuucaaauuuacaaaaagagugggauccaggaaguggaucgcacucuggccaaagagggaauuaagcggggcgaaaccgaccaucacgccguuucgagagggagcgcgaaacuccguugguucguggagaggaaccugguaacaccugagggaaagguggucgauuuaggcugcgguagagggggaugguccuauuacuguggcggucuuaagaauguuaaagaagugaagggccugacgaaagggggacccggccaugaggaaccuaucccaaugucuaccuauggguggaaccucguccgccuacagucaggaguggacguauucuuuacucccccugagaagugcgauacacuguugugugacauaggcgaaagcuccccaaaucccaccguggaggcuggucgaacucugagaguucucaaccuuguggagaauuggcugaacaauaacacacaauucugcaucaaagucuugaauccguacaugccuagugugauugaaaagauggaggcacugcagaggaaguacgggggagcccucguccggaacccauuaucucgcaauagcacccacgaaauguauugggugucaaacgcuuccggcaacaucguuaguagcguaaauaugauuucuagaaugcugaucaacagguuuacgaugaaacacaagaaagccaccuacgagcccgauguggaccuuggcuccgggacacgaaauauaggaauugaaucagagacuccuaaccuggauaucaucgguaagcggauugagaaaauaaagcaggaacaugagaccagcuggcacuaugaccaggaccauccauacaagacaugggcauaucacggcucguacgaaacuaaacaaaccgggucugccaguuccauggucaauggagugguucgucuacucacaaagcccugggaugugaucccgauggucacccagauggcuaugacugacacgacaccuuucggccagcagagaguguuuaaagagaagguagauacccgcacucaagaacccaaagaggguaccaagaagcugaugaaaauuacagcggagugguuguggaaggaacuggggaaaaagaaaacgccaaggauguguacccgggaggaguucacuagaaaggugcgcagcaacgccgcacucggagcuaucuuuacagacgagaauaaauggaagucagccagggaggcaguugaagauuccggcuucugggagcuugucgacaaggaacgaaaccugcacuuagagggcaaaugcgaaaccuguguguauaauaugauggggaagcgggagaaaaagcugggagaguuugguaaagccaagggcucuagagcuauuugguacaugugguugggggccagguuccucgaauuugaggcgcugggauuccuaaacgaagaucauugguuuagccgcgagaauagucuuuccggcguggaaggugaggggcugcacaagcucggauacauccugcgugacgucagcaaaaaggagggcggcgcaauguaugccgaugacacugcugggugggauacacggauaaccuuggaagaccugaaaaacgaggaaaugguuacaaaucauauggagggagaacacagaaagcucgccgaggcaaucuucaggcuuacuuaccagaacaaagugguacgcgugcagcgaccuacaccccgggguacggucauggacauuaucucuagaagggaucagcgcggcucagggcaagugguuaccuauggacugaauacauucacuaacauggaggcucaguuaauuagacagauggaaggcgaggguguguuuaagaguauccaacaucugaccgucacagaagagauugccgugaagaacugguuggagcggguagggagggaacgucucucccgaauggcuauaagcggagacgauugcguugugaaaccacuggacgaucgcuucgccucugcacuaacugcgcuuaaugacaugggcaaggucagaaaagauauccagcagugggagcccucgcggggcuggaacgacuggacccaggugccuuuuugcucacaccacuuccaugaacugauuaugaaggaugggagggugcucgucguuccaugucgcaaucaagacgagcugaucggacgagcacggaucagccagggugcuggcugguccuugagggaaacggccugcuuagggaaaaguuacgcacagauguggucucugauguauuuucaccgacgugaucucagacuugcugccaacgcaauuuguagcgccgugccgucccauuggguacccauaucacgcacaaccuggaguauccacgcgacucacgaguggaugacaaccgaggacaugcugacuguguggaaucgggucuggauucaggaaaacccuuggauggaggauaagaccccaguggaaucuugggaggaaauccccuaccuaggaaagagggaggaccaauggugcggcagccugauuggucucacauccagagcuacgugggccaaaaauauccagaccgcaauaaaccagguucgcucauugaucgggaaugaggaauauacugacuacaugccuagcaugaagcgguucaggcgagaggaagaggaagccggagugcugugguga

SEQ ID NO: 14334 - RNA, 9876 nt, Artificial Sequence
  derived and/or modified CDS sequence (opt3) from DENV-2__KM279515__SS-prME
accgcaggaaucauuauaaugaugauccccacagugauggcuuuccaccugacuacgcgaaacggggagccucauaugauugucagcaggcaggaaaagggaaaaucccuccuuuuuaagaccgagaaugguguuaacaugugcacacugauggcaauggacuugggcgaauuaugugaggauacuaucaccuacaauugcccacuguuacggcaaaacgaaccggaggacauugauuguuggugcaauucuacaucaaccugggugacuuaugggacauguaccgccacgggagagcaccgccgagaaaaacguaguguggcgcucgugccccaugucggcaugggucuggagacuagaaccgaaacauggaugagcuccgagggggcuuggaagcacgcccagaggaucgagacuuggauacuucggcauccuggauucaccaucauggcagccauucuggcuuacacaaucggcaccacguauuuucagcgcguguugauuuucauccuccugacugcaguuacaccaucuauggccaugaggugcauaggcauuucgaacagggacuuuguggaaggggucucaggagguagcuggguggauaucguacuggagcacggcaguuguguuaccacuauggcuaaaaauaagcccacacucgacuucgaauuaauuaagaccgaggccaaacaccuggcgacgcuucggaaguacugcguggaagcaaaauugaccaacacaacuaccgccucccgcuguccuacacagggggagccaucucugaaugaggaacaagauaagcgauuugucugcaaacauagcaugguggacagaggauggggcaacgguugugggcuauucggaaagggcggcaucgugacuugcgcuauguuuaccugcaagaaaaauauggaggggaaggucguucagcccgaaaaccucgaguauacaaucgugauuaccccucacuccggagaagagaaugccguagguaacgauacuggcaaacaugggaaggagauaaaagugacgccacagucaaguaucacagaagcagagcugaccggauacggcacugucaccauggaauguagcccgaggacaggucuugacuucaaugagauggugcuguugcagauggaaaacaaggcuuggcucguucaccggcaaugguuucuggauuuaccccugccuuggcucccaggggccgacacccagggcucuaacuggauucagaaagagacucuugugacauucaagaauccccacgcgaagaaacaggaugucgugguacugggaucccaagagggcgccaugcauacggcauugaccggggcuacugaaauccagaugucaagcggaaaccuacuguuuacaggucaccucaagugccgucugcgcauggacaaacuucagcugaagggcaugaguuauucuauguguaccgggaaauucaagguugugaaggagauagccgaaacacaacauggaacuauugucaucagagugcaguacgagggcgacgguuccccuugcaaaaucccauucgagauuauggauuuggaaaagaggcacgcucucgggcggcugaucaccgucaaucccauugugacggagaaagacagcccgguuaacauagaagccgagccucccuuuggcgauucguacaucauuaucggaguggaaccaggccaguuaaagcugucuugguucaaaaagggguccucaaucggacagauguuugagaccacaaugcgaggugcaaagcgcauggccauucuaggcgacacugcuugggauuucgggagucucggaggcguauuuaccagcauagguaaagcgcugcaucaagucuucggggcaaucuauggcgccgcuuuuuccggagugucuuggacaaugaagauucuuaucggcguugugauuacuuggaucgggaugaauagcagaucaaccaguuuguccgucagccuggugcucguaggagugguuacgcuguaccuuggcgucauggugcaggccgacucugguuguguggucucauggaaaaacaaggagcugaaaugcgggaguggaauauucaucacagauaauguucacaccuggacugaacaguauaaguuucagccugagagccccuccaaguuggcaucugccauucaaaaagcucacgaagagggcaucugugguauuaggucggugacacggcucgaaaaccugauguggaagcagaucaccccagaguuaaaucauauacugacugagaacgaagugaaacuaaccauuaugacaggcgacaucaaggggauuaugcaggccggaaaacgcagccucagaccccagccuacggagcugaaguacuccuggaaagcauggggcaaggcgaagaugcuuucaaccgaauugcacaaucauacuuuccugaucgaugggccagagacagcugaaugcccgaacaccaauagggccuggaacagucucgagguagaggacuauggauuuggcgucuucacaacuaauauauggcugaaauuaaaggaacgucaagauguguuuugugacucuaaacugaugagcgcagccaucaaggacaaccgggcuguucacgccgauauggguuacuggauugaguccgcacuuaacgacaccuggaaaaucgaaaaggcuucauucauugagguaaagagcugccacuggcccaaaucucauacguugugguccaaugggguccucgagagugaaaugaucauaccuaagaacuucgccggaccagugagccagcacaauuaucgacccggcuaccauacacagaccgcggguccuuggcaccugggcagacuagagauggauuuugacuucugugaagggacuaccguugugguaacagaggauugcggaaacaggggcccaucucugcgcacuaccacagccuccgggaaacucauuacggaauggugcugucggucaugcacccugcccccgcuuagauacaggggagaggacggcuguugguaugguauggagauccgcccuuugaaggaaaaagaggaaaaucuggucaacaguuuagugacugcugggcauggacagaucgauaauuuuagccucggcgugcuggguauggcacuuuuccuggaggaaauguugcgaacacgggucggcaccaagcacgccauucuccugguugcugugucguuuguaacucuaaucacagggaacauguccuuccgugaccugggaagagugauggucauggugggcgccaccaugacggaugacauugggaugggaguuacuuaccucgcacugcuugcggccuuuaaggugaggccaaccuucgcugccggcuugcuguuacgcaaacucacaucuaaggagcugaugaugaccacuauagguaucguccuucugagccaaucaacaauucccgagaguauccuagaacucaccgaugcacuggcuuuggggaugauggugcugaaaauuguucggaauauggagaaguaucaguuagccgugacaaucauggcaauacucugcgucccuaacgccguaauccugcagaaugcuuggaaaguguccuguacuacccuugcgguugugucugucagcccccuguugcucacguccucacaacagaaggccgacuggauuccacuggcacuaacaaucaagggacugaacccuaccgcuauuuuucuuacuacccucagcagaacaaguaaaaagaggucuuggccccugaaugaagccaucauggccgugggcaugguauccauauuggcuagcucgcugcuaaagaacgauauuccaaugacuggcccgcucguggcagggggacugcuuaccgucugcuacguucugacgggucgaucagccgacuuggagcucgaacgcgcggcugacgugcggugggaggagcaggccgaaaucucuggcaguuccccuauccugagcauuacaauaucugaggaugggagcauguccaucaagaaugaagaggaggaacagacccuaacuauucugaucagaacaggacuucucgugauuucaggccuguuccccgucaguaucccaauaaccgcagccgcuugguauuugugggaggugaaaaagcaaagggccgguguuuuaugggacguacccagcccuccacccguggggaaagccgaacuggaggauggagcguaccguaucaagcagaagggcauucucggcuauucucagaucggggcuggagucuacaaagaagguacuuuucacacaauguggcaugugacccgcggcgccguucugaugcacaaggggaaacggauugagccuuccugggcagacgugaagaaagaucuuaucucauacggaggcgguuggaagcuggagggggaauggaaggagggagaagagguccagguguuggcccuagaaccgggcaaaaacccaagagcuguacaaacgaagcccggccuguucaaaacuaacaccgggacaauaggagccgucagucucgacuuuagcccugguaccuccggcucuccaauuguggauaagaaagggaagguugugggacuguauggcaauggugucgugacaaggucggggacuuacguuagcgcaaucgcucagaccgagaagucaaucgaggacaaccccgaaauugaggaugacaucuuccggaaaaagagacuuacgauaauggauuuacauccuggagccggcaaaacaaagcgcuaucugccggcgauugugagagaagccaucaaaaggggccuccggacuuugauucuggcacccacccgagucguggcugccgagauggaagaggcucucagagggcugccaauccgcuaccagaccccugcaauaagggccgagcacaccggacgugaaauuguagaccuuaugugucaugccacuuucaccaugcggcuguugucccccaucagagugccaaauuauaaccuaaucauuauggaugaggcucacuuuacagacccugcgaguaucgcagccagggguuacauuucuacgcgcguugaaaugggcgaggcugccgggauauucaugacugcaacacccccaggaagccgagacccguuuccucaguccaaugcccccaucauggaugaggaaagagagauuccagaacggucauggaacucuggccacgagugggucacagacuucaaggguaagaccgugugguuugugcccagcaucaaagcugggaaugauaucgcggccugccugaggaagaacggcaaaaaggucauucaacucagucgcaaaacuuucgacuccgaauauauaaagacacguaccaaugauugggacuuuguagugacgacugauaucagcgagaugggcgcaaacuucaaggcugagagaguuauugacccucggagguguaugaaaccagugaucuuaacagauggcgaagaacgcgucauucuggccgggcccaugccugugacccauucuucagcagcccagcgaagaggacggguugguaggaauccgaagaacgaaaaugaccaguacaucuacaugggcgagccacuugaaaacgaugaggacugcgcucacuggaaagaggccaagaugcugcucgacaauauaaacacccccgaagggaucauuccuuccauguuugagcccgaacgcgagaaaguggaugcgaucgacggagaauauagauugaggggcgaggcacggaagacuuucgucgaucugaugcgucgcggugaccucccaguguggcuggccuaccgaguagcugccgaggggauuaacuaugcugauagaaggugguguuuugacggcgugaaaaauaaccaaauccuugaagagaauguugaagucgagauauggacaaaggagggagaacggaagaaacuaaagccucgcuggcuggaugcaagaauuuacagugaccccuuggccuuaaaagaguucaaggaguucgcugccggcaggaaaagccugacccucaaccugaucacagagauggggcggcuuccaacuuuuaugacgcagaaggcaaagaaugcgcuggauaaccucgccguguugcauaccgcugaagccggaggucgagcauauaaucacgcucugucggagcuaccugagacacuggaaacucuccuucuguuaaccuugcuggccacagugaccggcgggauuuuccucuuucugaugucuggaaaaggcaucgguaagaugacucuugggaugugcugcauaaucacggcauccauucugcucugguacgcccagauccagccgcacuggauugcugcgagcaucauauuggaguucuuucugauugucuuacuaauccccgaaccagagaaacaaagaaccccucaggacaaccagcugacauauguugugaucgccauucucacuguaguggcagcuaccauggccaaugaaaugggcuuccuugagaagaccaaaaaggauuuuggacugggcucaaucaccacucagcaacccgagaguaacauauuggacauugaucugcgcccagccucugcauggacacucuacgcugucgccacgaccuucaucacuccuaugcugaggcauuccauugaaaauagcucagugaacguuagucuuacagcgaucgcuaaucaggccaccgugcucauggggcugggaaaggguuggcccuugagcaaaauggacauaggcgucccgcuguuagcaaucggguguuacucccagguaaacccaauuacccuaacagccgcucugcuccuucugguggcacacuaugccaucauuggaccuggcuugcaggcgaaggcuacucgggaggcccaaaaacgugcagccgcugguaucaugaagaaucccacgguugacgggaugaccgugauugaucuggacccaauccccuacgauccuaaauuugaaaagcagcucggccaggucaugcugcuuguguuaugcgucacacaggugcugaugaugagaacuaccugggcccucugugaggcauugacacuggcuaccggaccgauaucuacucuaugggaaggcaaccccgggagguucuggaauacgacaauugccguuagcauggcgaacaucuuucgcggauccuaucuggccggcgcaggucuccuuuucucaaucaugaagaacaccgcuaauacucggcgagggaccggaaacacaggcgagacucugggugagaaauggaagaauagauugaacgcccugggcaaaucugaauuucaaauuuacaagaaaagugggauacaggagguggacaggacccucgcaaaggaaggaaucaaacgcggcgagacagaucaucacgcuguaucgcgggggagcgccaagcugagaugguucguggagcguaauuuagucacgccagaaggaaagguuguggaccuuggcugcgguagagggggaugguccuauuacuguggcggucugaaaaacgucaaggaggugaaaggccucaccaaagggggaccuggccaugaagaacccauuccuaugucuacuuauggguggaaucuaguacggcugcagucaggaguggauguuuucuuuacaccacccgaaaaaugcgacaccuugcugugugauaucggcgagagcuccccuaacccaacuguggaggccggucgcacacuccgaguccuuaaucugguggaaaacugguugaauaacaauacccaauucugcauuaagguccugaaccccuacaugccgagugugaucgagaagauggaagcgcuccagagaaaauacgggggagcuuuaguuaggaauccucugucucggaacagcacgcacgagauguauuggguaucaaacgcauccggcaauauagugaguagcgucaacaugaucucucgcaugcuuauuaauagauuuaccaugaggcacaagaaagccacauacgaaccagacguggaucugggcuccgggacucgaaacaucggaauugagucagagacccccaaucuagacaucauagguaagcggauugagaaaaucaagcaggagcaugaaacaagcuggcacuaugaucaggaccauccuuacaagacuugggcuuaucacggcucguacgagaccaaacaaacagggucugccaguuccaugguuaacggagugguccgucuccugaccaagccaugggacgugauccccaugguaacucagauggcaaugacggauacaaccccguucggccagcagagaguguuuaaagaaaagguugacacucgcacccaagagccuaaagaggguacaaagaaguugaugaaaauuacggccgaauggcuguggaaggagcucgggaaaaagaaaacccccaggauguguacucgggaagaguucacaagaaagguccgcagcaaugcugcgcuuggagccauauuuaccgaugagaacaaauggaagucagcaagggaagcuguggaggacuccggcuucugggaacugguggauaaggagcgaaauuuacaccuggaaggcaaaugcgagacuugugucuauaacaugauggggaagcgggagaaaaaguugggagaauuugguaaagccaagggcucuagagcaaucugguacauguggcucggggccagguuccuggaguuugaagcucuaggauuccuuaaugaggaccauugguuuagccgcgaaaacagucuguccggcguugagggugaggggcuccacaagcugggauacauuuugcgugaugugagcaaaaaggaaggcggcgccauguaugcggacgauacagcagggugggacacccggaucacacuggaggaucucaaaaaugaagagaugguaacuaaccauauggaaggagagcacaagaaacuugccgaggcuauuuucaagcugaccuaccagaauaagguggucagagugcagaggccaacgccucgcgguaccguuauggacaucauaucucgacgggaccagagaggcucagggcaaguggucacauauggauuaaacacuuucaccaacauggaagcccagcugaucaggcagauggagggcgaagguguguuuaaaaguauucaacaguugacaguaaaggaggagaucgcaguuaaaaauuggcucauucgcguggggagagaacggcuguccaggauggcuaucagcggagaugacugcgucgugaagccccuagaugaccguuucgccucugcucuuacugcccugaacgauaugggcaaagugcgaaaggacauucagcagugggagccaucgcgcggcuggaaugauuggacccaaguccccuuuugcucacaucacuuccacgaacucauaaugaaggacgggagaguucuggugguaccuugucggaaccaggaugaguugaucggaagggcacgcauuagccagggugcgggcugguccuuaagagaaacggccugccuggggaaaaguuacgcucagauguggucucucauguauuuucaucggagggaccuucgacuggccgcaaaugcuaucuguagcgccgugccaucccacuggaucccgacaucacguaccacuuggaguauucaugcaacacacgaguggaugaccacugaggauaugcuaaccgucuggaacagaguguggauacaagaaaaucccuggauggaggacaagacaccuguugaaacgugggaggaaaucccauaccugggaaaacgcgaggaucaguggugcggcucucucauugguuugaccagccgggccacuugggcgaagaacauccagacagcuauuaaucaggugaggucccugaucgggaacgaggaauauaccgacuacaugcccucaaugaaaagauuccgccgggaggaagaggaagccggaguccuuugguga

SEQ ID NO: 14335 - RNA, 9876 nt, Artificial Sequence
  derived and/or modified CDS sequence (opt3) from DENV-2__KM279516__SS-prME
accgccggcaucauuauaaugaugauccccacagugauggcuuuccaccugacuacgagaaacggggagccucauaugauugucagcaggcaggaaaagggaaaaucccuccuuuuuaagaccgagaaugguguuaacaugugcacacugauggcaauggacuugggcgaauuaugugaggauacuaucaccuacaauugcccacugcuacggcaaaacgaaccggaggacauugauuguuggugcaauucuacaucaaccugggugacuuaugggacauguaccgccacgggagagcaccgccgagaaaaacguaguguagcgcucgugccccaugucggcaugggucuggagacuagaaccgaaacauggaugagcuccgagggggcuuggaagcacgcccagaggaucgagacuuggauacuucggcauccuggauucaccaucauggcagccauucuggcuuacacaaucggcaccacguauuuucagcgcguguugauuuucauccuccugacugcaguuacaccaucuauggccaugagaugcauaggcauuucgaacagggacuuuguggaaggggucucaggagguagcuggguggauaucguacuggagcacggcaguuguguuaccacuauggcuaaaaauaagcccacacucgacuucgaauuaauuaagaccgaggccaaacaccuggcgacgcuucggaaguacugcguggaagcaaaauugaccaacacaacuaccgccucccgcuguccuacacagggggagccaucucugaaugaggaacaagauaagcgauuugucugcaaacauagcaugguggacagaggauggggcaacgguugugggcuauucggaaagggcggcaucgugacuugcgcuauguuuaccugcaagaaaaauauggaggggaaggucguucagcccgaaaaccucgaguauacaaucgugauuaccccucacuccggagaagagaaugccguagguaacgauacuggcaaacaugggaaggagauaaaagugacgccacagucaaguaucacagaagcagagcugaccggauacggcacugucaccauggaauguagcccgaggacaggucuugacuucaaugagauggugcuguugcagauggaaaacaaggcuuggcucguucaccggcaaugguuucuggauuuaccccugccuuggcucccaggggccgacacccagggcucuaacuggauucagaaagagacucuugugacauucaagaauccccacgcgaagaaacaggaugucgugguacugggaucccaagagggcgccaugcauacggcauugaccggggcuacugaaauccagaugucaagcggaaaccuacuguuuacaggucaccucaagugccgucugcgcauggacaaacuucagcugaagggcaugaguuauucuauguguaccgggaaauucaagguugugaaggagauagccgaaacacaacauggaacuauugucaucagagugcaguacgagggcgacgguuccccuugcaaaaucccauucgagauuauggauuuggaaaagaggcacguccucgggcggcugaucaccgugaaucccauuguuacggagaaagacagcccggugaacauagaagcugagccucccuuuggcgauucguacaucauuaucggaguagaaccaggccaguuaaagcugucuugguucaaaaagggguccucaaucggacagauguuugagaccacaaugcgaggugccaagcgcauggcaauucuaggcgacacugccugggauuucgggagucucggaggcgucuuuaccagcauagguaaagcucugcaucaaguguucggggcgaucuauggcgcagccuuuuccggaguuucuuggacaaugaagauucuuaucggcguggucauuacuuggaucgggaugaauagcagaucaaccaguuuguccgugagccugguacucgugggaguugucacgcuguaccuuggcgugauggugcaggcugacucugguugugucguuucauggaaaaacaaggagcugaaaugcgggaguggaauauucaucacagauaaugugcacaccuggacugaacaguauaaguuucagccugagagccccuccaaguuggccucugcaauucaaaaagcccacgaagagggcaucugugguauuaggucggugacacggcucgaaaaccugauguggaagcagaucaccccagaguuaaaucauauacugacugagaacgaaguaaaacuaaccauuaugacaggcgacaucaaggggauuaugcaggcuggaaaacgcagccucagaccccagccuacggagcugaaguacuccuggaaagccuggggcaaggcaaagaugcuuucaaccgaauugcacaaucauacuuuccugaucgaugggccagagacagcggaaugcccgaacaccaauagggcuuggaacagucucgaggucgaggacuauggauuuggcguguucacaacuaauauauggcugaaauuaaaggaacgucaagauguuuuuugugacucuaaacugaugagcgccgcaaucaaggacaaccgggccgugcacgcugauauggguuacuggauugaguccgcccuuaacgacaccuggaaaaucgaaaaggcaucauucauugaggucaagagcugccacuggcccaaaucucauacguugugguccaauggggugcucgagagugaaaugaucauaccuaagaacuucgcuggaccaguuagccagcacaauuaucgacccggcuaccauacacagaccgccgguccuuggcaccugggcagacuagagauggauuuugacuucugugaagggacuaccgugguagucacagaggauugcggaaacaggggcccaucucugcgcacuaccacagcguccgggaaacucauuacggaauggugcugucggucaugcacccugcccccgcuuagauacaggggagaggacggcuguugguaugguauggagauccgcccuuugaaggaaaaagaggaaaaucuggugaacaguuuagugacugccgggcauggacagaucgauaauuuuagccucggcguccuggguauggcucuuuuccuggaggaaauguugcgaacacggguuggcaccaagcacgcaauucuccugguggccguaucguuugugacucuaaucacagggaacauguccuuccgugaccugggaagagucauggugaugguuggcgcuaccaugacggaugacauugggaugggagugacuuaccucgcccugcuugcagcguuuaaggucaggccaaccuucgccgcuggcuugcuguuacgcaaacucacaucuaaggagcugaugaugaccacuauagguaucgugcuucugagccaaucaacaauucccgagaauauccuagaacucaccgaugcccuggcauuggggaugaugguucugaaaauugugcggaacauggagaaguaucaguuagcugucacaaucauggccauacucugcguaccuaaugcagugauccugcagaacgccuggaaaguuaguuguacuacccuugcuguggucuccgugucuccccuguugcucacgagcucccaacagaaggcggacuggauuccacuggcccuaacaaucaagggacugaauccuaccgcaauuuuucuuacuacccucucaagaacaagcaaaaagaggaguuggccccugaacgaagcuaucauggccguaggcauggugucuauauuggccuccagccuguuaaaaaaugauauuccaaugacuggcccgcucgucgcugggggacugcuuaccguuugcuacgugcugacgggucgaucggcagacuuggagcucgaacgcgccgcggacgugcggugggaggagcaggcugaaaucucaggcucuaguccuauccuguccauuacaauaagcgaggaugggucuaugagcaucaagaacgaagaggaggaacagacccuaacuauucugaucagaacaggacuucucgucauuuccggccuguuccccgugucaaucccaauaaccgccgcagccugguauuugugggagguuaaaaagcaaagggcugguguauuaugggacgugcccaguccuccacccgucgggaaagcagaacuggaggauggagccuaccguaucaagcagaagggcauucucggcuauagccagaucggggcgggaguguacaaagaagguacuuuucacacaauguggcauguuacccgcggcgcugugcugaugcacaaggggaaacggauugagccuucuugggccgacgucaagaaagaucuuaucuccuacggaggcgguuggaagcuggagggggaauggaaggagggagaagaggugcagguauuggcacuagaaccgggcaaaaacccaagagccguccaaacgaagcccggccuguucaaaacuaauaccgggacaauaggagcugugucacucgacuuuaguccugguaccagcggcuccccaauuguugauaagaaagggaagguggucggacuguauggcaacggugugguuacaaggucugggacuuacgugucggccaucgcacagaccgagaagagcaucgaggacaaucccgaaauugaggaugacaucuuccgaaaaaagcggcuuacgauaauggauuuacauccuggagcuggcaaaacaaagcgcuaucugccggccauugucagagaagcgaucaaaaggggccuccggacuuugauucuggcccccacccgagugguagcagcugagauggaagaggcccucagagggcugccaauccgcuaccagacaccugcuauaagggcagagcacaccggacgugaaauuguggaccuuaugugucaugccacuuucaccaugcggcuguugucacccaucagaguuccaaacuauaaucuaaucauuauggaugaggcccacuuuacagacccugcuuccaucgcggcaagggguuacauuaguacgcgcgucgaaaugggcgaggccgcugggauauucaugacugccacccccccaggaucucgagacccguuuccucagagcaacgcacccaucauggaugaggaaagagagauuccagaacgguccuggaauucaggccacgagugggugacagacuucaaggguaagaccgugugguuuguccccucuaucaaagccgggaacgauaucgcugcgugccugaggaagaauggaaaaaagguaauucaacucagccgcaaaacuuucgacagugaauauauaaagacacguaccaacgauugggacuuugugguuacgacugauaucuccgagaugggcgccaauuucaaggcagagagagugauugacccucggagguguaugaaaccagucaucuuaacagauggcgaagagcgcgugauucuggcugggcccaugccuguuacccauagcucugccgcacagcgaagaggacggguggguaggaacccgaagaaugaaaacgaccaguacaucuacaugggcgagccacuugaaaaugaugaggacugcgcccacuggaaagaggcuaagaugcugcucgacaacauaaacacccccgaagggaucauuccuucaauguuugagcccgaacgcgagaaagucgaugccaucgacggagaauauagauugaggggcgaggcgcggaagacuuucguggaucugaugcgucgcggugaccucccaguauggcuggcauaccgaguggccgcugaggggauuaauuaugccgauagaaggugguguuuugacggcguuaaaaacaaucaaauccuugaagagaacgucgaaguggagauauggacaaaggagggagaacggaagaaacuaaagccucgcuggcuggaugcuagaauuuacuccgaccccuuggcauuaaaagaguucaaggaauucgccgcuggcaggaaaagucugacccucaaucugaucacagagauggggcggcuuccaacuuuuaugacgcagaaggccaagaacgcacuggauaaucucgcgguguugcauaccgccgaagcuggaggucgagccuauaaccacgcacugagcgagcuaccugagacacuggaaacucuccuucuguuaaccuugcuggcuacagucaccggcgggauuuuccucuuucugaugucgggaaaaggcaucgguaagaugacucuugggaugugcugcauaaucacggccucuauucugcucugguacgcacagauccagccgcacuggauugccgcuuccaucauauuggaguucuuucugauuguuuuacuaauccccgaaccagagaaacaaagaaccccucaggacaaucagcugacauaugugguaaucgcgauucucacuguggucgccgcaaccauggcuaacgaaaugggcuuccuugagaagacaaaaaaggauuuuggacugggcagcaucaccacucagcaacccgagucaaauauauuggacauugaucugcgcccagccagugccuggacacucuacgcaguggcuacgaccuucaucacuccuaugcugaggcauucuauugaaaacuccagcguuaaugugucacuuacagccaucgcgaaccaggcuaccguccucauggggcugggaaaggguuggcccuugaguaaaauggacauaggcguaccgcuguuagccaucggguguuacagccaggugaauccaauuacccuaacagcagcccugcuccuucugguugcucacuaugcaaucauuggaccuggcuugcaggccaaggcgacucgggaggcucaaaaacgugccgcagccgguaucaugaagaaccccacgguggacgggaugaccgucauugaucuggacccaauccccuacgauccuaaauuugaaaagcagcucggccaggugaugcugcuugucuuaugcgugacacagguucugaugaugagaacuaccugggcucucugugaggccuugacacuggcaaccggaccgauauccacucuaugggaaggcaaucccgggagguucuggaacacgacaauugcugugucuauggccaacaucuuucgcggaagcuaucuggcgggcgccggucuccuuuucuccaucaugaagaauaccgcaaacacucggcgagggaccggaaauacaggcgagacucugggugagaaauggaagaacagauugaaugcucugggcaaaucagaauuucaaauuuacaagaaaucugggauacaggagguagacaggacccucgccaaggaaggaaucaaacgcggcgagacagaucaucacgcagugagucgggggucggcuaagcugagaugguucgucgagcguaacuuaguuacgccagaaggaaagguggucgaccuuggcugcgguagggggggauggagcuauuacuguggcggucugaaaaaugugaaggagguaaaaggccucaccaaggggggaccuggccaugaagagcccauuccuauguccacuuauggguggaaccuagugcggcugcagucuggaguugauguguucuuuacaccacccgaaaaaugcgacaccuugcugugugauaucggcgagucaagcccuaauccaacugucgaggccggucgcacacuccgagugcuuaaccuggucgaaaauugguugaacaauaacacccaauucugcauuaaggugcugaaucccuacaugccguccguuaucgagaagauggaagcccuccagagaaaauacgggggagcguuaguaaggaacccucugagucggaacucuacgcacgagauguauugggugagcaaugcuucaggcaacauagucuccagugugaauaugaucagccgcaugcuuauuaacagauuuaccaugaggcacaagaaagcaacauacgaaccagacguugaucugggcucugggacucgaaauaucggaauugaguccgagacccccaaccuagacaucauagguaagcggauugaaaaaaucaagcaggagcaugaaacaucauggcacuaugaucaggaccauccuuacaagacuugggccuaucacggcagcuacgagaccaaacaaacagggucggcuucuaguauggugaauggagucgugcgucuccugaccaagccaugggacguaauccccauggugacucagauggccaugacggauacaaccccguucggccagcagagaguuuuuaaagaaaaggucgacacucgcacccaagagccuaaagaggguacaaagaaguugaugaaaauuacggcagaauggcuguggaaggagcucgggaaaaagaaaacccccaggauguguacucgggaagaguucacaagaaaggugcgcuccaacgccgcucuuggagcgauauuuaccgaugagaauaaauggaagagcgccagggaagcaguggaggacucaggcuucugggaacuggucgauaaggagcgaaacuuacaccuggaaggcaaaugcgagacuuguguuuauaauaugauggggaagcgggagaaaaaguugggagaauuugguaaagcuaagggcuccagagccaucugguacauguggcucggggcaagguuccuggaguuugaagcccuaggauuccuuaacgaggaccauugguuuucucgcgaaaauagccugaguggcguggagggugaggggcuccacaagcugggauacauuuugcgugauguauccaaaaaggaaggcggcgcuauguaugccgacgauacagcggggugggacacccggaucacacuggaggaucucaaaaacgaagagauggugacuaaucauauggaaggagagcacaagaaacuugcagaggccauuuucaagcugaccuaccagaacaaggucgugagaguucagaggccaacgccucgcgguaccgugauggacaucauaagccgacgggaccagagaggcucugggcaagucgugacauauggauuaaacacuuucaccaauauggaagcucagcugaucaggcagauggagggcgaagguguauuuaaaucaauucaacaguugacaguuaaggaggagaucgccgugaaaaacuggcucauucgcgucgggagagaacggcugaguaggauggcaaucuccggagaugacugcguggugaagccccuagaugaccguuucgcuagcgcccuuacugcucugaaugauaugggcaaaguccgaaaggacauucagcagugggagccaucucgcggcuggaacgauuggacccaaguucccuuuugcucgcaucacuuccacgaacucauaaugaaggacgggagagugcugguagugccuugucggaaucaggaugaguugaucggaagggcccgcauuucacagggugcaggcuggagcuuaagagaaacggcgugccuggggaaauccuacgcccagauguggagucucauguauuuucaucggagggaccuucgacuggcugccaacgcaaucuguucugcugucccaagccacuggaucccgacaucccguaccacuuggucaauucaugccacacacgaguggaugaccacugaggauaugcuaaccguguggaauagaguuuggauacaagaaaaccccuggauggaggacaagacaccuguggaaaguugggaggaaaucccauaccugggaaaacgcgaggaucaguggugcggcucucucauugguuugacgagccgggcaaccugggccaagaauauccagacugcgauuaaccaggucaggucccugaucgggaaugaggaauauacagacuacaugcccucaaugaaaagauuccgccgggaggaagaggaagcuggagugcuuugguga

SEQ ID NO: 14336 - RNA, 9876 nt, Artificial Sequence
  derived and/or modified CDS sequence (opt3) from DENV-2__KM279517__SS-prME
accgccggcaucauuauaaugaugauccccacagugauggcuuuccaccugacuacgagaaacggggagccucauaugauugucagcaggcaggaaaagggaaaaucccuccuuuuuaagaccgagaaugguguuaacaugugcacacugauggcaauggacuugggcgaauuaugugaggauacuaucaccuacaauugcccacugcuacggcaaaacgaaccggaggacauugauuguuggugcaauucuacaucaaccugggugacuuaugggacauguaccgccacgggagagcaccgccgagaaaaacguaguguagcgcucgugccccaugucggcaugggucuggagacuagaaccgaaacauggaugagcuccgagggggcuuggaagcacgcccagaggaucgagacuuggauacuucggcauccuggauucaccaucauggcagccauucuggcuuacacaaucggcaccacguauuuucagcgcguguugauuuucauccuccugacugcaguuacaccaucuauggccaugagaugcauaggcauuucgaacagggacuuuguggaaggggucucaggagguagcuggguggauaucguacuggagcacggcaguuguguuaccacuauggcuaaaaauaagcccacacucgacuucgaauuaauuaagaccgaggccaaacaccuggcgacgcuucggaaguacugcguggaagcaaaauugaccaacacaacuaccgccucccgcuguccuacacagggggagccaucucugaaugaggaacaagauaagcgauuugucugcaaacauagcaugguggacagaggauggggcaacgguugugggcuauucggaaagggcggcaucgugacuugcgcuauguuuaccugcaagaaaaauauggaggggaaggucguucagcccgaaaaccucgaguauacaaucgugauuaccccucacuccggagaagagaaugccguagguaacgauacuggcaaacaugggaaggagauaaaagugacgccacagucaaguaucacagaagcagagcugaccggauacggcacugucaccauggaauguagcccgaggacaggucuugacuucaaugagauggugcuguugcagauggaaaacaaggcuuggcucguucaccggcaaugguuucuggauuuaccccugccuuggcucccaggggccgacacccagggcucuaacuggauucagaaagagacucuugugacauucaagaauccccacgcgaagaaacaggaugucgugguacugggaucccaagagggcgccaugcauacggcauugaccggggcuacugaaauccagaugucaagcggaaaccuacuguuuacaggucaccucaagugccgucugcgcauggacaaacuucagcugaagggcaugaguuauucuauguguaccgggaaauucaagguugugaaggagauagccgaaacacaacauggaacuauugucaucagagugcaguacgagggcgacgguuccccuugcaaaaucccauucgagauuauggauuuggaaaagaggcacguccucgggcggcugaucaccgugaaucccauuguuacggagaaagacagcccggugaacauagaagcugagccucccuuuggcgauucguacaucauuaucggaguagaaccaggccaguuaaagcugucuugguucaaaaagggguccucaaucggacagauguuugagaccacaaugcgaggugccaagcgcauggcaauucuaggcgacacugccugggauuucgggagucucggaggcgucuuuaccagcauagguaaagcucugcaucaaguguucggggcgaucuauggcgcagccuuuuccggaguuucuuggacaaugaagauucuuaucggcguggucauuacuuggaucgggaugaauagcagaucaaccaguuuguccgugagccugguacucgugggaguugucacgcuguaccuuggcgugauggugcaggcugacucugguugugucguuucauggaaaaacaaggagcugaaaugcgggaguggaauauucaucacagauaaugugcacaccuggacugaacaguauaaguuucagccugagagccccccaaaguuggccuccgcaauucaaaaagcccacgaagagggcaucugugguauuaggucugugacacggcucgaaaaccugauguggaagcagaucacccccgaguuaaaucauauacugacugagaacgaaguaaaacuaaccauuaugacaggcgacaucaaggggauuaugcaggcuggaaaacgcucgcucagaccucagccaacggagcugaaguacagcuggaaagccuggggcaaggcaaagaugcuuuccaccgaauugcacaaucauacuuuccugaucgaugggccggagacagcggaaugccccaacaccaauagggcuuggaacucacucgaggucgaggacuauggauuuggcguguucacaacuaauauauggcugaaauuaaaggaacgucaagauguuuuuugugacaguaaacugaugucugccgcaaucaaggacaaccgggccgugcacgcugauauggguuacuggauugagagcgcccuuaacgacaccuggaaaaucgaaaaggcauccuucauugaggucaagucaugccacuggccuaaaagccauacguuguggucuaauggggugcucgaguccgaaaugaucauaccaaagaacuucgcuggacccguuagucagcacaauuaucgaccuggcuaccauacacagaccgccgguccauggcaccugggcagacuagagauggauuuugacuucugugaagggacuaccgugguagucacagaggauugcggaaacaggggccccagccugcgcacuaccacagcgucugggaaacucauuacggaauggugcugucgguccugcacccugccgccucuuagauacaggggagaggacggcuguugguaugguauggagauccgcccauugaaggaaaaagaggaaaaucuggugaacucauuagugacugccgggcauggacagaucgauaauuuuagucucggcguccuggguauggcucuuuuccuggaggaaauguugcgaacacggguuggcaccaagcacgcaauucuccugguggccguaagcuuugugacucuaaucacagggaacaugucguuccgugaccugggaagagucauggugaugguuggcgcuaccaugacggaugacauugggaugggagugacuuaccucgcccugcuugcagcguuuaaggucaggcccaccuucgccgcuggcuugcuguuacgcaaacucacauccaaggagcugaugaugaccacuauagguaucgugcuucugucucaaagcacaauuccugagucaauccuagaacucaccgaugcccuggcauuggggaugaugguucugaaaauugugcggaauauggagaaguaucaguuagcugucacaaucauggccauacucugcguacccaacgcagugauccugcagaaugccuggaaaguuaguuguacuacccuugcuguggucuccgugucuccacuguugcucacgagcucccaacagaaggcggacuggauuccucuggcccuaacaaucaagggacugaaccccaccgcaauuuuucuuacuacccucucaagaacaagcaaaaagaggaguuggccacugaaugaagcuaucauggccguaggcauggugucuauauuggccuccagccuguuaaaaaacgauauuccgaugacuggcccucucgucgcugggggacugcuuaccguuugcuacgugcugacgggucgaucggcagacuuggagcucgaacgcgccgcggacgugcggugggaggagcaggcugaaaucucaggcucuagucccauccuguccauuacaauaagcgaggaugggucuaugagcaucaagaaugaagaggaggaacagacccuaacuauucugaucagaacaggacuucucgucauuuccggccuguucccagugucaauccccauaaccgccgcagccugguauuugugggagguuaaaaagcaaagggcugguguauuaugggacgugccuaguccacccccugucgggaaagcagaacuggaggauggagccuaccguaucaagcagaagggcauucucggcuauagccagaucggggcgggaguguacaaagaagguacuuuucacacaauguggcauguuacccgcggcgcugugcugaugcacaaggggaaacggauugagccgucuugggccgacgucaagaaagaucuuaucuccuacggaggcgguuggaagcuggagggggaauggaaggagggagaagaggugcagguauuggcacuagaaccaggcaaaaaccccagagccguccaaacgaagccuggccuguucaaaacuaacaccgggacaauaggagcugugucacucgacuuuaguccagguaccagcggcucccccauuguugauaagaaagggaagguggucggacuguauggcaauggugugguuacaaggucugggacuuacgugucggccaucgcacagaccgagaagagcaucgaggacaacccugaaauugaggaugacaucuuccgaaaaaagcggcuuacgauaauggauuuacauccgggagcuggcaaaacaaagcgcuaucugcccgccauugucagagaagcgaucaaaaggggccuccggacuuugauucuggccccaacccgagugguagcagcugagauggaagaggcccucagagggcugccuauccgcuaccagacacccgcuauaagggcagagcacaccggacgugaaauuguggaccuuaugugucaugccacuuucaccaugcggcuguugucaccaaucagaguuccuaauuauaaccuaaucauuauggaugaggcccacuuuacagaccccgcuuccaucgcggcaagggguuacauuaguacgcgcgucgaaaugggcgaggccgcugggauauucaugacugccaccccaccgggaucucgagacccuuuuccccagagcaaugcaccaaucauggaugaggaaagagagauucccgaacgguccuggaacucaggccacgagugggugacagacuucaaggguaagaccgugugguuugucccuucuaucaaagccgggaaugauaucgcugcgugccugaggaagaacggaaaaaagguaauucaacucagccgcaaaacuuucgacagugaauauauaaagacacguaccaaugauugggacuuugugguuacgacugauaucuccgagaugggcgccaacuucaaggcagagagagugauugacccacggagguguaugaaacccgucaucuuaacagauggcgaagagcgcgugauucuggcugggccuaugccgguuacccauagcucugccgcacagcgaagaggacggguggguaggaauccaaagaacgaaaaugaccaguacaucuacaugggcgagccccuugaaaacgaugaggacugcgcccacuggaaagaggcuaagaugcugcucgacaauauaaacaccccugaagggaucauucccucaauguuugagccagaacgcgagaaagucgaugccaucgacggagaauauagauugaggggcgaggcgcggaagacuuucguggaucugaugcgucgcggugaccucccuguauggcuggcauaccgaguggccgcugaggggauuaacuaugccgauagaaggugguguuuugacggcguuaaaaauaaccaaauccuugaagagaaugucgaaguggagauauggacaaaggagggagaacggaagaaacuaaagccccgcuggcuggaugcuagaauuuacuccgacccauuggcauuaaaagaguucaaggaauucgccgcuggcaggaaaagucugacccucaaccugaucacagagauggggcggcuuccuacuuuuaugacgcagaaggccaagaaugcacuggauaaccucgcgguguugcauaccgccgaagcuggaggucgagccuauaaucacgcacugagcgagcuaccggagacacuggaaacucuccuucuguuaaccuugcuggcuacagucaccggcgggauuuuccucuuucugaugucgggaaaaggcaucgguaagaugacucuugggaugugcugcauaaucacggccucuauucugcucugguacgcacagauccagccccacuggauugccgcuuccaucauauuggaguucuuucugauuguuuuacuaaucccagaaccugagaaacaaagaaccccccaggacaaccagcugacauaugugguaaucgcgauucucacuguggucgccgcaaccauggcuaaugaaaugggcuuccuugagaagacaaaaaaggauuuuggacugggcagcaucaccacucagcaaccagagucaaacauauuggacauugaucugcgcccugccagugccuggacacucuacgcaguggcuacgaccuucaucacucccaugcugaggcauucuauugaaaauuccagcguuaacgugucacuuacagccaucgcgaaucaggcuaccguccucauggggcugggaaaggguuggccguugaguaaaauggacauaggcguaccacuguuagccaucggguguuacagccaggugaacccuauuacccuaacagcagcccugcuccuucugguugcucacuaugcaaucauuggacccggcuugcaggccaaggcgacucgggaggcucaaaaacgugccgcagccgguaucaugaagaauccaacgguggacgggaugaccgucauugaucuggaccccaucccuuacgauccgaaauuugaaaagcagcucggccaggugaugcugcuugucuuaugcgugacacagguucugaugaugagaacuaccugggcucucugugaggccuugacacuggcaaccggacccauauccacucuaugggaaggcaacccagggagguucuggaauacgacaauugcugugucuauggccaacaucuuucgcggaagcuaucuggcgggcgccggucuccuuuucuccaucaugaagaacaccgcaaauacucggcgagggaccggaaacacaggcgagacucugggugagaaauggaagaauagauugaacgcucugggcaaaucagaauuucaaauuuacaagaaaucugggauacaggagguagacaggacccucgccaaggaaggaaucaaacgcggcgagacagaucaucacgcagugagucgggggucggcuaagcugagaugguucgucgagcguaauuuaguuacgccugaaggaaagguggucgaccuuggcugcgguagggggggauggagcuauuacuguggcggucugaaaaacgugaaggagguaaaaggccucaccaaggggggacccggccaugaagagccuauuccaauguccacuuauggguggaaucuagugcggcugcagucuggaguugauguguucuuuacacccccugaaaaaugcgacaccuugcugugugauaucggcgagucaagcccaaaccccacugucgaggccggucgcacacuccgagugcuuaaucuggucgaaaacugguugaauaacaauacccaauucugcauuaaggugcugaacccguacaugccuuccguuaucgagaagauggaaacgcuccagagaaaauacgggggagccuuaguaaggaauccacugagucggaacucuacccacgagauguauugggugagcaacgcgucaggcaauauagucuccagugugaacaugaucagccgcaugcuuauuaauagauuuacaaugaggcacaagaaagcuacuuacgaacccgacguugaucugggcucugggacccgaaacaucggaauugaguccgagacaccuaaucuagacaucauagguaagcggauugaaaaaaucaagcaggagcaugaaacuucauggcacuaugaucaggaccauccauacaagaccugggcauaucacggcagcuacgagacaaaacaaaccgggucggccucuaguauggugaacggagucgugcgucuccugacuaagcccugggacguaaucccgauggugacgcagauggcuaugacagauaccacuccuuucggccagcagagaguuuuuaaagaaaaggucgacacccgcacacaagagcccaaagaggguacgaagaaguugaugaaaauuaccgccgaauggcuguggaaggagcucgggaaaaagaaaacuccaaggauguguacacgggaagaguucaccagaaaggugcgcuccaaugcagcccuuggagcuauauuuacugaugagaacaaauggaagagcgcgagggaagccguggaggacucaggcuucugggaacuggucgauaaggagcgaaauuuacaccuggaaggcaaaugcgagacauguguuuauaacaugauggggaagcgggagaaaaaguugggagaauuugguaaagcaaagggcuccagagcuaucugguacauguggcucggggccagguuccuggaguuugaagcacuaggauuccuuaaugaggaccauugguuuucucgcgaaaacagccugaguggcguggagggugaggggcuccacaagcugggauacauuuugcgugauguauccaaaaaggaaggcggcgccauguaugcugacgauaccgccgggugggacacacggaucacucuggaggaucucaaaaaugaagagauggugaccaaccauauggaaggagagcacaagaaacuugcggaggcaauuuucaagcugacguaccagaauaaggucgugagaguucagaggccuaccccccgcgguacagugauggacaucauaagccgacgggaccagagaggcucugggcaagucgugacuuauggauuaaacaccuucacaaacauggaagcccagcugaucaggcagauggagggcgaagguguauuuaaaucaauucaacaguugacuguuaaggaggagaucgcugugaaaaauuggcucauucgcgucgggagagaacggcugaguaggauggccaucuccggagaugacugcguggugaagccacuagaugaccguuucgcaagcgcucuuaccgcccugaacgauaugggcaaaguccgaaaggacauucagcagugggagcccucucgcggcuggaaugauuggacgcaaguuccuuuuugcucgcaucacuuccacgaacucauaaugaaggacgggagagugcugguagugccaugucggaaccaggaugaguugaucggaagggcucgcauuucacagggugccggcuggagcuuaagagaaacagcaugccuggggaaauccuacgcgcagauguggagucucauguauuuucaucggagggaccuucgacuggccgcuaaugccaucuguucugcagucccgagccacuggauccccaccucccguacuacauggucaauucaugcuacccacgaguggaugacuaccgaggauaugcuaacaguguggaacagaguuuggauacaagaaaauccuuggauggaggacaagacgccaguggaaaguugggaggaaauccccuaccugggaaaacgcgaggaucaguggugcggcucucucauugguuugaccagccgggccacuugggcaaagaacauccagacagccauuaaucaggucaggucccugaucgggaacgaggaauauaccgacuacaugccuucaaugaaaagauuccgccgggaggaagaggaagcgggagugcuuugguga

SEQ ID NO: 14337 - RNA, 9876 nt, Artificial Sequence
  derived and/or modified CDS sequence (opt3) from DENV-2__KM279518__SS-prME
accgccggaaucauuauaaugaugauccccacagugauggcuuuccaccugacuacgcgaaacggggagccucauaugauugucagcaggcaggaaaagggaaaaucccuccuuuuuaagaccgagaaugguguuaacaugugcacacugauggcaauggacuugggcgaauuaugugaggauacuaucaccuacaauugcccacuguuacggcaaaacgaaccggaggacauugauuguuggugcaauucuacaucaaccugggugacuuaugggacauguaccgccacgggagagcaccgccgagaaaaacguaguguugcgcucgugccccaugucggcaugggucuggagacuagaaccgaaacauggaugagcuccgagggggcuuggaagcacgcccagaggaucgagacuuggauacuucggcauccuggauucaccaucauggcagccauucuggcuuacacaaucggcaccacguauuuucagcgcguguugauuuucauccuccugacugcaguuacaccaucuauggccaugaggugcauaggcauuucgaacagggacuuuguggaaggggucucaggagguagcuggguggauaucguacuggagcacggcaguuguguuaccacuauggcuaaaaauaagcccacacucgacuucgaauuaauuaagaccgaggccaaacaccuggcgacgcuucggaaguacugcguggaagcaaaauugaccaacacaacuaccgccucccgcuguccuacacagggggagccaucucugaaugaggaacaagauaagcgauuugucugcaaacauagcaugguggacagaggauggggcaacgguugugggcuauucggaaagggcggcaucgugacuugcgcuauguuuaccugcaagaaaaauauggaggggaaggucguucagcccgaaaaccucgaguauacaaucgugauuaccccucacuccggagaagagaaugccguagguaacgauacuggcaaacaugggaaggagauaaaagugacgccacagucaaguaucacagaagcagagcugaccggauacggcacugucaccauggaauguagcccgaggacaggucuugacuucaaugagauggugcuguugcagauggaaaacaaggcuuggcucguucaccggcaaugguuucuggauuuaccccugccuuggcucccaggggccgacacccagggcucuaacuggauucagaaagagacucuugugacauucaagaauccccacgcgaagaaacaggaugucgugguacugggaucccaagagggcgccaugcauacggcauugaccggggcuacugaaauccagaugucaagcggaaaccuacuguuuacaggucaccucaagugccgucugcgcauggacaaacuucagcugaagggcaugaguuauucuauguguaccgggaaauucaagguugugaaggagauagccgaaacacaacauggaacuauugucaucagagugcaguacgagggcgacgguuccccuugcaaaaucccauucgagauuauggauuuggaaaagaggcacguccucgggcggcugaucaccgugaaucccauuguuacggagaaagacagcccggugaacauagaagcugagccucccuuuggcgauucguacaucauuaucggaguagaaccaggccaguuaaagcugucuugguucaaaaagggguccucaaucggacagauguuugagaccacaaugcgaggugccaagcgcauggcaauucuaggcgacacugccugggauuucgggagucucggaggcgucuuuaccagcauagguaaagcucugcaucaaguguucggggcgaucuauggcgcagccuuuuccggaguuucuuggacaaugaagauucuuaucggcguggucauuacuuggaucgggaugaauagcagaucaaccaguuuguccgugagccugguacucgugggaguugucacgcuguaccuuggcgugauggugcaggcugacucugguugugucguuucauggaaaaacaaggagcugaaaugcgggaguggaauauucaucacagauaaugugcacaccuggacugaacaguauaaguuucagccugagagccccuccaaguuggccucugcaauucaaaaagcccacgaagagggcaucugugguauuaggucggugacacggcucgaaaaccugauguggaagcagaucaccccagaguuaaaucauauacugacugagaacgaaguaaaacuaaccauuaugacaggcgacaucaaggggauuaugcaggcuggaaaacgcagccucagaccccagccuacggagcugaaguacuccuggaaagccuggggcaaggcaaagaugcuuucaaccgaauugcacaaucauacuuuccugaucgaugggccagagacagcggaaugcccgaacaccaauagggcuuggaacagucucgaggucgaggacuauggauuuggcguguucacaacuaauauauggcugaaauuaaaggaacgucaagauguauuuugugacucuaaacugaugagcgccgcaaucaaggacaaccgggccgugcacgcugauauggguuacuggauugaguccgcccuuaacgacaccuggaaaaucgaaaaggcaucauucauugaggucaagagcugccacuggcccaaaucucauacguugugguccaauggggugcucgagagugaaaugaucauaccuaagaacuucgcuggaccaguuagccagcacaauuaucgacccggcuaccauacacagaccgccgguccuuggcaccugggcagacuagagauggauuuugacuucugugaagggacuaccgugguagucacagaggauugcggaaacaggggcccaucucugcgcacuaccacagcguccgggaaacucauuacggaauggugcugucggucaugcacccugcccccgcuuagauacaggggagaggacggcuguugguaugguauggagauccgcccuuugaaggaaaaagaggaaaaucuggugaacaguuuagugacugccgggcauggacagaucgauaauuuuagccucggcguccuggguauggcucuuuuccuggaggaaauguugcgaacacggguuggcaccaagcacgcaauucuccugguggccguaucguuugugacucuaaucacagggaacauguccuuccgugaccugggaagagucauggugaugguuggcgcuaccaugacggaugacauugggaugggagugacuuaccucgcccugcuugcagcguuuaaggucaggccaaccuucgccgcuggcuugcuguuacgcaaacucacaucuaaggagcugaugaugaccacuauagguaucgugcuucugagccaaucaacaauucccgagaguauccuagaacucaccgaugcccuggcauuggggaugaugguucugaaaauugugcggaauauggagaaguaucaguuagcugucacaaucauggccauacucugcguaccuaacgcagugauccugcagaaugccuggaaaguuuccuguacuacccuugcuguggucucugugagcccccuguugcucacguccucacaacagaaggcggacuggauuccacuggcccuaacaaucaagggacugaacccuaccgcaauuuuucuuacuacccucagcagaacaaguaaaaagaggucuuggccccugaaugaagcuaucauggccguaggcaugguguccauauuggccagcucgcugcuaaagaacgauauuccaaugacuggcccgcucgucgcugggggacugcuuaccguuugcuacgugcugacgggucgaucagcagacuuggagcucgaacgcgccgcggacgugcggugggaggagcaggcugaaaucucuggcaguuccccuauccugagcauuacaauaucugaggaugggagcauguccaucaagaaugaagaggaggaacagacccuaacuauucugaucagaacaggacuucucgucauuucaggccuguuccccgugaguaucccaauaaccgccgcagccugguauuugugggagguuaaaaagcaaagggcugguguauuaugggacgugcccagcccuccacccgucgggaaagcagaacuggaggauggagccuaccguaucaagcagaagggcauucucggcuauucucagaucggggcgggaguguacaaagaagguacuuuucacacaauguggcauguuacccgcggcgcugugcugaugcacaaggggaaacggauugagccuuccugggccgacgucaagaaagaucuuaucucauacggaggcgguuggaagcuggagggggaauggaaggagggagaagaggugcagguauuggcacuagaaccgggcaaaaacccaagagccguccaaacgaagcccggccuguucaaaacuaacaccgggacaauaggagcugugagucucgacuuuagcccugguaccuccggcucuccaauuguugauaagaaagggaagguggucggacuguauggcaauggugugguuacaaggucggggacuuacgugagcgccaucgcacagaccgagaagucaaucgaggacaaccccgaaauugaggaugacaucuuccggaaaaagagacuuacgauaauggauuuacauccuggagcuggcaaaacaaagcgcuaucugccggccauugucagagaagcgaucaaaaggggccuccggacuuugauucuggcccccacccgagugguagcagcugagauggaagaggcccucagagggcugccaauccgcuaccagaccccugcuauaagggcagagcacaccggacgugaaauuguggaccuuaugugucaugccacuuucaccaugcggcuguugucccccaucagaguuccaaauuauaaccuaaucauuauggaugaggcccacuuuacagacccugcuaguaucgcggcaagggguuacauuucuacgcgcgucgaaaugggcgaggccgcugggauauucaugacugccacacccccaggaagccgagacccguuuccucaguccaaugcacccaucauggaugaggaaagagagauuccagaacggucauggaacucuggccacgagugggugacagacuucaaggguaagaccgugugguuuguccccagcaucaaagccgggaaugauaucgcugcgugccugaggaagaacggcaaaaagguaauucaacucagucgcaaaacuuucgacuccgaauauauaaagacacguaccaaugauugggacuuugugguuacgacugauaucagcgagaugggcgccaacuucaaggcagagagagugauugacccucggagguguaugaaaccagucaucuuaacagauggcgaagaacgcgugauucuggcugggcccaugccuguuacccauucuucagccgcacagcgaagaggacggguggguaggaauccgaagaacgaaaaugaccaguacaucuacaugggcgagccacuugaaaacgaugaggacugcgcccacuggaaagaggcuaagaugcugcucgacaauauaaacacccccgaagggaucauuccuuccauguuugagcccgaacgcgagaaagucgaugccaucgacggagaauauagauugaggggcgaggcgcggaagacuuucguggaucugaugcgucgcggugaccucccaguauggcuggcauaccgaguggccgcugaggggauuaacuaugccgauagaaggugguguuuugacggcguuaaaaauaaccaaauccuugaagagaaugucgaaguggagauauggacaaaggagggagaacggaagaaacuaaagccucgcuggcuggaugcuagaauuuacagugaccccuuggcauuaaaagaguucaaggaguucgccgcuggcaggaaaagccugacccucaaccugaucacagagauggggcggcuuccaacuuuuaugacgcagaaggccaagaaugcacuggauaaccucgcgguguugcauaccgccgaagcuggaggucgagccuauaaucacgcacugucggagcuaccugagacacuggaaacucuccuucuguuaaccuugcuggcuacagucaccggcgggauuuuccucuuucugaugucuggaaaaggcaucgguaagaugacucuugggaugugcugcauaaucacggccuccauucugcucugguacgcacagauccagccgcacuggauugccgcuagcaucauauuggaguucuuucugauuguuuuacuaauccccgaaccagagaaacaaagaaccccucaggacaaccagcugacauaugugguaaucgcgauucucacuguggucgccgcaaccauggcuaaugaaaugggcuuccuugagaagaccaaaaaggauuuuggacugggcucaaucaccacucagcaacccgagaguaacauauuggacauugaucugcgcccagccucugccuggacacucuacgcaguggcuacgaccuucaucacuccuaugcugaggcauuccauugaaaauagcucaguuaacgugagucuuacagccaucgcgaaucaggcuaccguccucauggggcugggaaaggguuggcccuugagcaaaauggacauaggcguaccgcuguuagccaucggguguuacucccaggugaacccaauuacccuaacagcagcccugcuccuucugguugcucacuaugcaaucauuggaccuggcuugcaggccaaggcgacucgggaggcucaaaaacgugccgcagccgguaucaugaagaaucccacgguggacgggaugaccgucauugaucuggacccaauccccuacgauccuaaauuugaaaagcagcucggccaggugaugcugcuugucuuaugcgugacacagguucugaugaugagaacuaccugggcucucugugaggccuugacacuggcaaccggaccgauaucuacucuaugggaaggcaaccccgggagguucuggaauacgacaauugcugugagcauggccaacaucuuucgcggauccuaucuggcgggcgccggucuccuuuucucaaucaugaagaacaccgcaaauacucggcgagggaccggaaacacaggcgagacucugggugagaaauggaagaauagauugaacgcucugggcaaaucugaauuucaaauuuacaagaaaagugggauacaggagguagacaggacccucgccaaggaaggaaucaaacgcggcgagacagaucaucacgcagugucgcgggggagcgcuaagcugagaugguucgucgagcguaauuuaguuacgccagaaggaaagguggucgaccuuggcugcgguagagggggaugguccuauuacuguggcggucugaaaaacgugaaggagguaaaaggccucaccaaagggggaccuggccaugaagaacccauuccuaugucuacuuauggguggaaucuagugcggcugcagucaggaguugauguguucuuuacaccacccgaaaaaugcgacaccuugcugugugauaucggcgagagcuccccuaacccaacugucgaggccggucgcacacuccgagugcuuaaucuggucgaaaacugguugaauaacaauacccaauucugcauuaaggugcugaaccccuacaugccgaguguuaucgagaagauggaagcccuccagagaaaauacgggggagcguuaguaaggaauccucugucucggaacagcacgcacgagauguauugggugucaaacgcuuccggcaauauagucaguagcgugaacaugaucucucgcaugcuuauuaauagauuuaccaugaggcacaagaaagcaacauacgaaccagacguugaucugggcuccgggacucgaaacaucggaauugagucagagacccccaaucuagacaucauagguaagcggauugagaaaaucaagcaggagcaugaaacaagcuggcacuaugaucaggaccauccuuacaagacuugggccuaucacggcucguacgagaccaaacaaacagggucugcuaguuccauggugaacggagucgugcgucuccugaccaagccaugggacguaauccccauggugacucagauggccaugacggauacaaccccguucggccagcagagaguuuuuaaagaaaaggucgacacucgcacccaagagccuaaagaggguacaaagaaguugaugaaaauuacggcagaauggcuguggaaggagcucgggaaaaagaaaacccccaggauguguacucgggaagaguucacaagaaaggugcgcagcaaugccgcucuuggagcgauauuuaccgaugagaacaaauggaagucagccagggaagcaguggaggacuccggcuucugggaacuggucgauaaggagcgaaauuuacaccuggaaggcaaaugcgagacuuguguuuauaacaugauggggaagcgggagaaaaaguugggagaauuugguaaagcuaagggcucuagagccaucugguacauguggcucggggcaagguuccuggaguuugaagcccuaggauuccuuaaugaggaccauugguuuagccgcgaaaacagucuguccggcguggagggugaggggcuccacaagcugggauacauuuugcgugauguaagcaaaaaggaaggcggcgcuauguaugccgacgauacagcggggugggacacccggaucacacuggaggaucucaaaaaugaagagauggugacuaaccauauggaaggagagcacaagaaacuugcagaggccauuuucaagcugaccuaccagaauaaggucgugagaguucagaggcagacgccacgcgguaccgugauggacaucauaucucgacgggaccaaagaggcucagggcaggucgugacauauggauuaaacacuuucaccaacauggaagcucagcugaucaggcaaauggagggcgaagguguauuuaaaaguauucagcaguugacaguuaaggaggagaucgccgugaaaaauuggcucauucgcgucgggagagaacggcuguccaggauggcaaucagcggagaugacugcguggugaagccucuagaugaccguuucgcuucugcccuuacugcucugaacgauaugggcaaaguccgaaaggacauucagcaaugggagcccucgcgcggcuggaaugauuggacccagguuccauuuugcucacaucacuuccacgaacucauaaugaaggacgggagagugcugguagugcccugucggaaccaggaugaguugaucggaagggcccgcauuagccagggugcaggcugguccuuaagagaaacggcgugccuggggaaaaguuacgcccaaauguggucucucauguauuuucaucggagggaccuucgacuggcugccaaugcaaucuguagcgcugucccuucccacuggaucccaacaucacguaccacuuggaguauucaugccacacacgaguggaugaccacugaggauaugcuaaccguguggaacagaguuuggauacaggaaaauccguggauggaggacaagacacccguggaaucuugggaggaaaucccuuaccugggaaaacgcgaggaucaguggugcggcagccucauugguuugacgucccgggcaaccugggccaagaacauccagacugcgauuaaucaagucaggucacugaucgggaacgaggaauauacagacuacaugccaagcaugaaaagauuccgccgggaggaagaggaagcuggagugcuuugguga

SEQ ID NO: 14338 - RNA, 9876 nt, Artificial Sequence
  derived and/or modified CDS sequence (opt3) from DENV-2__KM279519__SS-prME
accgccggcaucauuauaaugaugauccccaccgugauggcuuuccaccugacuacgcgaaacggggagccucauaugauugucagcaggcaggaaaagggaaaaucccuccuuuuuaagaccgagaaugguguuaacaugugcacacugauggcaauggacuugggcgaauuaugugaggauacuaucaccuacaauugcccacuguuacggcaaaacgaaccggaggacauugauuguuggugcaauucuacaucaaccugggugacuuaugggacauguaccgccacgggagagcaccgccgagaaaaacguaguguugcgcucgugccccaugucggcaugggucuggagacuagaaccgaaacauggaugagcuccgagggggcuuggaagcacgcccagaggaucgagacuuggauacuucggcauccuggauucaccaucauggcagccauucuggcuuacacaaucggcaccacguauuuucagcgcguguugauuuucauccuccugacugcaguuacaccaucuauggccaugagaugcauaggcauuucgaacagggacuuuguggaaggggucucaggagguagcuggguggauaucguacuggagcacggcaguuguguuaccacuauggcuaaaaauaagcccacacucgacuucgaauuaauuaagaccgaggccaaacaccuggcgacgcuucggaaguacugcguggaagcaaaauugaccaacacaacuaccgccucccgcuguccuacacagggggagccaucucugaaugaggaacaagauaagcgauuugucugcaaacauagcaugguggacagaggauggggcaacgguugugggcuauucggaaagggcggcaucgugacuugcgcuauguuuaccugcaagaaaaauauggaggggaaggucguucagcccgaaaaccucgaguauacaaucgugauuaccccucacuccggagaagagaaugccguagguaacgauacuggcaaacaugggaaggagauaaaagugacgccacagucaaguaucacagaagcagagcugaccggauacggcacugucaccauggaauguagcccgaggacaggucuugacuucaaugagauggugcuguugcagauggaaaacaaggcuuggcucguucaccggcaaugguuucuggauuuaccccugccuuggcucccaggggccgacacccagggcucuaacuggauucagaaagagacucuugugacauucaagaauccccacgcgaagaaacaggaugucgugguacugggaucccaagagggcgccaugcauacggcauugaccggggcuacugaaauccagaugucaagcggaaaccuacuguuuacaggucaccucaagugccgucugcgcauggacaaacuucagcugaagggcaugaguuauucuauguguaccgggaaauucaagguugugaaggagauagccgaaacacaacauggaacuauugucaucagagugcaguacgagggcgacgguuccccuugcaaaaucccauucgagauuauggauuuggaaaagaggcacguccucgggcggcugaucaccgugaaucccauuguuacggagaaagacagcccggugaacauagaagcugagccucccuuuggcgauucguacaucauuaucggaguagaaccaggccaguuaaagcugucuugguucaaaaagggguccucaaucggacagauguuugagaccacaaugcgaggugccaagcgcauggcaauucuaggcgacacugccugggauuucgggagucucggaggcgucuuuaccagcauagguaaagcucugcaucaaguguucggggcgaucuauggcgcagccuuuuccggaguuucuuggacaaugaagauucuuaucggcguggucauuacuuggaucgggaugaauagcagaucaaccaguuuguccgugagccugguacucgugggaguugucacgcuguaccuuggcgugauggugcaggcugacucugguugugucguuucauggaaaaacaaggagcugaaaugcgggaguggaauauucaucacagauaaugugcacaccuggacugaacaguauaaguuucagccugagagccccuccaaguuggccucugcaauucaaaaagcccacgaagagggcaucugugguauuaggucggugacacggcucgaaaaccugauguggaagcagaucaccccagaguuaaaucauauacugacugagaacgaaguaaaacuaaccauuaugacaggcgacaucaaggggauuaugcaggcuggaaaacgcagccucagaccccagccuacggagcugaaguacuccuggaaagccuggggcaaggcaaagaugcuuucaaccgaauugcacaaucauacuuuccugaucgaugggccagagacagcggaaugcccgaacaccaauagggcuuggaacagucucgaggucgaggacuauggauuuggcguguucacaacuaauauauggcugaaauuaaaggaacgucaagauguauuuugugacucuaaacugaugagcgccgcaaucaaggacaaccgggccgugcacgcugauauggguuacuggauugaguccgcccuuaacgacaccuggaaaaucgaaaaggcaucauucauugaggucaagagcugccacuggcccaaaucucauacguugugguccaauggggugcucgagagugaaaugaucauaccuaagaacuucgcuggaccaguuagccagcacaauuaucgacccggcuaccauacacagaccgccgguccuuggcaccugggcagacuagagauggauuuugacuucugugaagggacuaccgugguagucacagaggauugcggaaacaggggcccaucucugcgcacuaccacagcguccgggaaacucauuacggaauggugcugucggucaugcacccugcccccgcuuagauacaggggagaggacggcuguugguaugguauggagauccgcccuuugaaggaaaaagaggaaaaucuggugaacaguuuagugacugccgggcauggacagaucgauaauuuuagccucggcguccuggguauggcucuuuuccuggaggaaauguugcgaacacggguuggcaccaagcacgcaauucuccugguggccguaucguuugugacucuaaucacagggaacauguccuuccgugaccugggaagagucauggugaugguuggcgcuaccaugacggaugacauugggaugggagugacuuaccucgcccugcuugcagcguuuaaggucaggccaaccuucgccgcuggcuugcuguuacgcaaacucacaucuaaggagcugaugaugaccacuauagguaucgugcuucugagccaaucaacaauucccgagaguauccuagaacucaccgaugcccuggcauuggggaugaugguucugaaaauugugcggaauauggagaaguaucaguuagcugucacaaucauggccauacucugcguaccuaacgcagugauccugcagaaugccuggaaaguuuccuguacuacccuugcuguggucucugugagcccccuguugcucacguccucacaacagaaggcggacuggauuccacuggcccuaacaaucaagggacugaacccuaccgcaauuuuucuuacuacccucagcagaacaaguaaaaagaggucuuggccccugaaugaagcuaucauggccguaggcaugguguccauauuggccagcucgcugcuaaagaacgauauuccaaugacuggcccgcucgucgcugggggacugcuuaccguuugcuacgugcugacgggucgaucagcagacuuggagcucgaacgcgccgcggacgugcggugggaggagcaggcugaaaucucuggcaguuccccuauccugagcauuacaauaucugaggaugggagcauguccaucaagaaugaagaggaggaacagacccuaacuauucugaucagaacaggacuucucgucauuucaggccuguuccccgugaguaucccaauaaccgccgcagccugguauuugugggagguuaaaaagcaaagggcugguguauuaugggacgugcccagcccuccacccgucgggaaagcagaacuggaggauggagccuaccguaucaagcagaagggcauucucggcuauucucagaucggggcgggaguguacaaagaagguacuuuucacacaauguggcauguuacccgcggcgcugugcugaugcacaaggggaaacggauugagccuuccugggccgacgucaagaaagaucuuaucucauacggaggcgguuggaagcuggagggggaauggaaggagggagaagaggugcagguauuggcacuagaaccgggcaaaaacccaagagccguccaaacgaagcccggccuguucaaaacuaacaccgggacaauaggagcugugagucucgacuuuagcccugguaccuccggcucuccaauuguugauaagaaagggaagguggucggacuguauggcaauggugugguuacaaggucggggacuuacgugagcgccaucgcacagaccgagaagucaaucgaggacaaccccgaaauugaggaugacaucuuccggaaaaagagacuuacgauaauggauuuacauccuggagcuggcaaaacaaagcgcuaucugccggccauugucagagaagcgaucaaaaggggccuccggacuuugauucuggcccccacccgagugguagcagcugagauggaagaggcccucagagggcugccaauccgcuaccagaccccugcuauaagggcagagcacaccggacgugaaauuguggaccuuaugugucaugccacuuucaccaugcggcuguugucccccaucagaguuccaaauuauaaccuaaucauuauggaugaggcccacuuuacagacccugcuaguaucgcggcaagggguuacauuucuacgcgcgucgaaaugggcgaggccgcugggauauucaugacugccacacccccaggaagccgagacccguuuccucaguccaaugcacccaucauggaugaggaaaaggagauuccagaaagaucauggaacucuggccacgagugggugacagacuucaaggguaaaaccgugugguuuguccccagcaucaaggccgggaaugauaucgcugcgugccugcggaaaaacggaaagaaaguaauucaacucaguaggaagacuuucgacuccgaauauauaaagacacgcaccaaugauugggacuuugugguuacgacugauaucagcgagaugggcgccaacuucaaagcagagcgugugauugacccuagacgguguaugaagccagucaucuuaacagauggcgaagagagggugauucuggcugggcccaugccuguuacccauucuucagccgcacagcgccgaggaagagugggucggaauccgaaaaacgaaaaugaccaguacaucuacaugggcgagccacuugaaaacgaugaggacugcgcccacuggaaggaggcuaaaaugcugcucgacaauauaaacacccccgaagggaucauuccuuccauguuugagcccgaaagggagaaggucgaugccaucgacggagaauaucgcuugagaggcgaggcgaggaaaacuuucguggaucugaugcggcguggugaccucccaguauggcuggcauaccgcguggccgcugaggggauuaacuaugccgaucgaagaugguguuuugacggcguuaagaauaaccaaauccuugaagagaaugucgaaguggagauauggacaaaggagggagaaaggaaaaagcuaaaaccucgguggcuggaugcucgcauuuacagugaccccuuggcauuaaaggaguucaaagaguucgccgcuggcagaaagagccugacccucaaccugaucacagagauggggaggcuuccaacuuuuaugacgcagaaggccaaaaaugcacuggauaaccucgcgguguugcauaccgccgaagcuggaggucgggccuauaaucacgcacugucggagcuaccugagacacuggaaacucuccuucuguuaaccuugcuggcuacagucaccggcgggauuuuccucuuucugaugucuggaaagggcaucgguaaaaugacucuugggaugugcugcauaaucacggccuccauucugcucugguacgcacagauccagccgcacuggauugccgcuagcaucauauuggaguucuuucugauuguuuuacuaauccccgaaccagagaagcaacgaaccccucaggacaaccagcugacauaugugguaaucgcgauucucacuguggucgccgcaaccauggcuaaugaaaugggcuuccuugagaaaacaaagaaggauuuuggacugggcucaaucaccacucagcaacccgagaguaacauauuggacauugaucugagaccagccucugccuggacacucuacgcaguggcuacgaccuucaucacuccuaugcugcgccauuccauugaaaauagcucaguuaacgugagucuuacagccaucgcgaaucaggcuaccguccucauggggcugggaaaagguuggcccuugagcaagauggacauaggcguaccgcuguuagccaucggguguuacucccaggugaacccaauuacccuaacagcagcccugcuccuucugguugcucacuaugcaaucauuggaccuggcuugcaggccaaagcgacuagggaggcucaaaagcgggccgcagccgguaucaugaaaaaucccacgguggacgggaugaccgucauugaucuggacccaauccccuacgauccuaaguuugaaaagcagcucggccaggugaugcugcuugucuuaugcgugacacagguucugaugaugcguacuaccugggcucucugugaggccuugacacuggcaaccggaccgauaucuacucuaugggaaggcaaccccgggagauucuggaauacgacaauugcugugagcauggccaacaucuuuaggggauccuaucuggcgggcgccggucuccuuuucucaaucaugaaaaacaccgcaaauacucgccgggggaccggaaacacaggcgagacucugggugagaaguggaaaaaucgauugaacgcucugggcaagucugaauuucaaauuuacaaaaagagugggauacaggagguagacagaacccucgccaaagaaggaaucaagaggggcgagacagaucaucacgcagugucgcgcgggagcgcuaagcugcggugguucgucgagagaaauuuaguuacgccagaaggaaaaguggucgaccuuggcugcggucgugggggaugguccuauuacuguggcggucugaagaacgugaaagagguaaagggccucaccaaagggggaccuggccaugaagaacccauuccuaugucuacuuauggguggaaucuagugaggcugcagucaggaguugauguguucuuuacaccacccgaaaagugcgacaccuugcugugugauaucggcgagagcuccccuaacccaacugucgaggccggucggacacuccgcgugcuuaaucuggucgaaaacugguugaauaacaauacccaauucugcauuaaggugcugaaccccuacaugccgaguguuaucgagaaaauggaagcccuccagcgaaaguacgggggagcguuaguaagaaauccucugucuaggaacagcacgcacgagauguauugggugucaaacgcuuccggcaauauagucaguagcgugaacaugaucucucggaugcuuauuaaucgcuuuaccaugagacacaaaaaggcaacauacgaaccagacguugaucugggcuccgggacuaggaacaucggaauugagucagagacccccaaucuagacaucauagguaaacgaauugaaaagaucaagcaggagcaugaaacaagcuggcacuaugaucaggaccauccuuacaaaacuugggccuaucacggcucguacgagaccaagcaaacagggucugcuaguuccauggugaacggagucgugcggcuccugaccaaaccaugggacguaauccccauggugacucagauggccaugacggauacaaccccguucggccagcagcguguuuuuaaggaaaaagucgacacuagaacccaagagccuaaggaggguacaaagaaauugaugaagauuacggcagaauggcuguggaaagagcucgggaagaaaaagacaccccgcauguguacuagggaagaguucacacggaaagugagaagcaaugccgcucuuggagcgauauuuaccgaugagaacaaguggaagucagcccgcgaagcaguggaggacuccggcuucugggaacuggucgauaaagagaggaauuuacaccuggaaggcaagugcgagacuuguguuuauaacaugauggggaaacgagagaagaaauugggagaauuugguaaggcuaagggcucucgggccaucugguacauguggcucggggcaagauuccuggaguuugaagcccuaggauuccuuaaugaggaccauugguuuagcagggaaaacagucuguccggcguggagggugaggggcuccacaaacugggauacauuuugcgcgauguaagcaagaaagaaggcggcgcuauguaugccgacgauacagcggggugggacacccguaucacacuggaggaucucaagaaugaagagauggugacuaaccauauggaaggagagcacaagaaacuugcagaggccauuuucaaacugaccuaccagaauaaagucgugcggguucagagaccaacgccuagggguaccgugauggacaucauaucucgccgagaccagcggggcucagggcaagucgugacauauggauuaaacacuuucaccaacauggaagcucagcugaucagacagauggagggcgaagguguauuuaagaguauucaacaguugacaguuaaagaggagaucgccgugaagaauuggcucauuagggucgggcgcgaaagacugucccggauggcaaucagcggagaugacugcguggugaaaccccuagaugacagguucgcuucugcccuuacugcucugaacgauaugggcaagguccguaaggacauucagcagugggagccaucgcgaggcuggaaugauuggacccaaguucccuuuugcucacaucacuuccacgaacucauaaugaaagacgggcgcgugcuggccguaccuuguagaaaccaggaugaguugaucggacgggcaaggauuagccagggugcgggcugguccuuacgcgaaacggccugccuggggaagaguuacgcucagauguggucucucauguauuuucauagacgggaccuuaggcuggccgcaaaugcuaucuguagcgccgugccaucccacuggaucccgacaucacgaaccacuuggaguauucaugcaacacacgaguggaugaccacugaggauaugcuaaccgucuggaaccguguguggauacaagaaaaucccuggauggaggacaaaacaccuguugaaucuugggaggaaaucccauaccugggaaagagagaggaucaguggugcggcagccucauugguuugacgucccgcgccaccugggcgaaaaacauccagacugcuauuaaucaggugcggucacugaucgggaacgaggaauauacagacuacaugcccagcaugaagagguucagacgcgaggaagaggaagccggaguccuuugguga

SEQ ID NO: 14339 - RNA, 9876 nt, Artificial Sequence
  derived and/or modified CDS sequence (opt3) from DENV-2__KM279520__SS-prME
accgcaggcaucauuauaaugaugauccccaccgugauggcuuuccaccugacuacgcggaacggggagccucauaugauugucagcaggcaggaaaagggaaaaucccuccuuuuuaagaccgagaaugguguuaacaugugcacacugauggcaauggacuugggcgaauuaugugaggauacuaucaccuacaauugcccacugcuacggcaaaacgaaccggaggacauugauuguuggugcaauucuacaucaaccugggugacuuaugggacauguaccgccacgggagagcaccgccgagaaaaacguaguguagcgcucgugccccaugucggcaugggucuggagacucggaccgaaacauggaugagcuccgagggggcuuggaagcacgcccagaggaucgagacuuggauacuucggcauccuggauucaccaucauggcagccauucuggcuuacacaaucggcaccacguauuuucagcgcguguugauuuucauccuccugacugcaguuacaccaucuauggccaugagaugcauaggcauuucgaacagggacuuuguggaaggggucucaggagguagcuggguggauaucguacuggagcacggcaguuguguuaccacuauggcucggaauaaacccacacucgacuucgaauuaauuaagaccgaggccaagcaccuggcgacgcuucgcaaauacugcguggaagcaaaguugaccaacacaacuaccgccucccgauguccuacacagggggagccaucucugaaugaggaacaagauaaaagauuugucugcaagcauagcaugguggacaggggauggggcaacgguugugggcuauucggaaaaggcggcaucgugacuugcgcuauguuuaccugcaagaagaauauggaggggaaagucguucagcccgaaaaccucgaguauacaaucgugauuaccccucacuccggagaagagaaugccguagguaacgauacuggcaagcaugggaaagagauaaaggugacgccacagucaaguaucacagaagcagagcugaccggauacggcacugucaccauggaauguagcccgcggacaggucuugacuucaaugagauggugcuguugcagauggaaaacaaggcuuggcucguucaccgucaaugguuucuggauuuaccccugccuuggcucccaggggccgacacccagggcucuaacuggauucagaaggagacucuugugacauucaaaaauccccacgcgaagaagcaggaugucgugguacugggaucccaagagggcgccaugcauacggcauugaccggggcuacugaaauccagaugucaagcggaaaccuacuguuuacaggucaccucaaaugccgccugagaauggacaaacuucagcugaaaggcaugaguuauucuauguguaccgggaaguucaaaguugugaaggagauagccgaaacacaacauggaacuauugucaucagggugcaguacgagggcgacgguuccccuugcaagaucccauucgagauuauggauuuggaaaaacggcacgcucucgggcgacugaucaccgucaaucccauugugacggagaaggacagcccgguuaacauagaagccgagccucccuuuggcgauucguacaucauuaucggaguggaaccaggccaguuaaaacugucuugguucaagaaaggguccucaaucggacagauguuugagaccacaaugcgcggugcaaagagaauggccauucuaggcgacacugcuugggauuucgggagucucggaggcguauuuaccagcauagguaaggcgcugcaucaagucuucggggcaaucuauggcgccgcuuuuuccggagugucuuggacaaugaaaauucuuaucggcguugugauuacuuggaucgggaugaauagcaggucaaccaguuuguccgucagccuggugcucguaggagugguuacgcuguaccuuggcgucauggugcaggccgacucugguuguguggucucauggaagaacaaagagcugaagugcgggaguggaauauucaucacagauaauguucacaccuggacugaacaguauaaauuucagccugagagccccuccaaguuggcaucugccauucaaaaggcucacgaagagggcaucugugguauucggucggugacacgccucgaaaaccugauguggaaacagaucaccccagaguuaaaucauauacugacugagaacgaagugaagcuaaccauuaugacaggcgacaucaaagggauuaugcaggccggaaagagaagccucaggccccagccuacggagcugaaauacuccuggaaggcauggggcaaagcgaagaugcuuucaaccgaauugcacaaucauacuuuccugaucgaugggccagagacagcugaaugcccgaacaccaaucgugccuggaacagucucgagguagaggacuauggauuuggcgucuucacaacuaauauauggcugaaguuaaaagaacggcaagauguguuuugugacucuaagcugaugagcgcagccaucaaagacaaccgagcuguucacgccgauauggguuacuggauugaguccgcacuuaacgacaccuggaagaucgaaaaggcuucauucauugaggugaaaagcugccacuggcccaagucucauacguugugguccaaugggguccucgagagugaaaugaucauaccuaaaaacuucgccggaccagugagccagcacaauuauagacccggcuaccauacacagaccgcggguccuuggcaccugggcaggcuagagauggauuuugacuucugugaagggacuaccguugugguaacagaggauugcggaaaccgcggcccaucucugcggacuaccacagccuccgggaagcucauuacggaauggugcuguagaucaugcacccugcccccgcuuagguaccgcggagaggacggcuguugguaugguauggagauccgaccuuugaaagaaaaggaggaaaaucuggucaacaguuuagugacugcugggcauggacagaucgauaauuuuagccucggcgugcuggguauggcacuuuuccuggaggaaauguugcggacacgugucggcaccaaacacgccauucuccugguugcugugucguuuguaacucuaaucacagggaacauguccuucagagaccugggaagggugauggucauggugggcgccaccaugacggaugacauugggaugggaguuacuuaccucgcacugcuugcggccuuuaaggugcgcccaaccuucgcugccggcuugcuguuacggaagcucacaucuaaagagcugaugaugaccacuauagguaucguccuucugagccaaucaacaauucccgagaguauccuagaacucaccgaugcacuggcuuuggggaugauggugcugaagauuguuagaaauauggagaaauaucaguuagccgugacaaucauggcaauacucugcgucccuaacgccguaauccugcagaaugcuuggaagguguccuguacuacccuugcgguugugucugucagcccccuguugcucacguccucacaacagaaagccgacuggauuccacuggcacuaacaaucaagggacugaacccuaccgcuauuuuucuuacuacccucagcaggacaaguaagaaacgaucuuggccccugaaugaagccaucauggccgugggcaugguauccauauuggcuagcucgcuguuaaagaacgauauuccaaugacuggcccgcucguggcagggggacugcuuaccgucugcuacguucugacgggucgcucagccgacuuggagcucgaacgggcggcugacgugagaugggaggagcaggccgaaaucucuggcaguuccccuauccugagcauuacaauaucugaggaugggagcauguccaucaaaaaugaagaggaggaacagacccuaacuauucugaucaggacaggacuucucgugauuucaggccuguuccccgucaguaucccaauaaccgcagccgcuugguauuugugggaggugaagaaacaacgugccgguguuuuaugggacguacccagcccuccacccguggggaaggccgaacuggaggauggagcguaccgcaucaaacagaagggcauucucggcuauucucagaucggggcuggagucuacaaggaagguacuuuucacacaauguggcaugugacccggggcgccguucugaugcacaaagggaagagaauugagccuuccugggcagacgugaaaaaggaucuuaucucauacggaggcgguuggaaacuggagggggaauggaaggagggagaagagguccagguguuggcccuagaaccgggcaagaacccaagggcuguacaaacgaaacccggccuguucaagacuaacaccgggacaauaggagccgucagucucgacuuuagcccugguaccuccggcucuccaauuguggauaaaaaggggaaaguugugggacuguauggcaauggugucgugacacgaucggggacuuacguuagcgcaaucgcucagaccgagaagucaaucgaggacaaccccgaaauugaggaugacaucuuccggaagaaacgccuuacgauaauggauuuacauccuggagccggcaagacaaaaagauaucugccggcgauugugagggaagccaucaagcggggccuccgaacuuugauucuggcacccaccagagucguggcugccgagauggaagaggcucuccgcgggcugccaaucagguaccagaccccugcaauacgugccgagcacaccggacgggaaauuguagaccuuaugugucaugccacuuucaccaugagacuguugucccccaucagggugccaaauuauaaccuaaucauuauggaugaggcucacuuuacagacccugcgaguaucgcagcccgcgguuacauuucuacgcgaguugaaaugggcgaggcugccgggauauucaugacugcaacacccccaggaagcagagacccguuuccucaguccaaugcccccaucauggaugaggaacgggagauuccagaaaggucauggaacucuggccacgagugggucacagacuucaaagguaagaccgugugguuugugcccagcaucaaggcugggaaugauaucgcggccugccugcgcaaaaacggaaagaaagucauucaacucagucguaagacuuucgacuccgaauauauaaaaacaagaaccaaugauugggacuuuguagugacgacugauaucagcgagaugggcgcaaacuucaaggcugagcggguuauugacccuaggcgcuguaugaagccagugaucuuaacagauggcgaagaacgagucauucuggccgggcccaugccugugacccauucuucagcagcccagagacggggaaggguuggucgcaauccgaaaaacgaaaaugaccaguacaucuacaugggcgagccacuugaaaacgaugaggacugcgcucacuggaaggaggccaaaaugcugcucgacaauauaaacacccccgaagggaucauuccuuccauguuugagcccgaaagagagaagguggaugcgaucgacggagaauauagguugcggggcgaggcacguaaaacuuucgucgaucugaugcgccgaggugaccucccaguguggcuggccuacagaguagcugccgaggggauuaacuaugcugauaggcggugguguuuugacggcgugaagaauaaccaaauccuugaagagaauguugaagucgagauauggacaaaagagggagaacgcaagaagcuaaaaccuagauggcuggaugcaaggauuuacagugaccccuuggccuuaaaggaguucaaagaguucgcugccggcagaaagagccugacccucaaccugaucacagagauggggcgacuuccaacuuuuaugacgcagaaagcaaagaaugcgcuggauaaccucgccguguugcauaccgcugaagccggagguagagcauauaaucacgcucugucggagcuaccugagacacuggaaacucuccuucuguuaaccuugcuggccacagugaccggcgggauuuuccucuuucugaugucuggaaagggcaucgguaaaaugacucuugggaugugcugcauaaucacggcauccauucugcucugguacgcccagauccagccgcacuggauugcugcgagcaucauauuggaguucuuucugauugucuuacuaauccccgaaccagagaagcaacgcaccccucaggacaaccagcugacauauguugugaucgccauucucacuguaguggcagcuaccauggccaaugaaaugggcuuccuugagaaaacaaagaaagauuuuggacugggcucaaucaccacucagcaacccgagaguaacauauuggacauugaucugaggccagccucugcauggacacucuacgcugucgccacgaccuucaucacuccuaugcugcggcauuccauugaaaauagcucagugaacguuagucuuacagcgaucgcuaaucaggccaccgugcucauggggcugggaaaggguuggcccuugagcaagauggacauaggcgucccgcuguuagcaaucggguguuacucccagguaaacccaauuacccuaacagccgcucugcuccuucugguggcacacuaugccaucauuggaccuggcuugcaggcgaaagcuacucgugaggcccaaaagagagcagccgcugguaucaugaaaaaucccacgguugacgggaugaccgugauugaucuggacccaauccccuacgauccuaaguuugaaaaacagcucggccaggucaugcugcuuguguuaugcgucacacaggugcugaugaugaggacuaccugggcccucugugaggcauugacacuggcuaccggaccgauaucuacucuaugggaaggcaaccccgggcgcuucuggaauacgacaauugccguuagcauggcgaacaucuuucggggauccuaucuggccggcgcaggucuccuuuucucaaucaugaagaacaccgcuaauacucgaagagggaccggaaacacaggcgagacucugggugagaaguggaaaaauagguugaacgcccugggcaagucugaauuucaaauuuacaaaaagagugggauacaggagguggaccgcacccucgcaaaagaaggaaucaagcggggcgagacagaucaucacgcuguaucgagagggagcgccaaacugcguugguucguggagaggaauuuagucacgccagaaggaaagguuguggaccuuggcugcgguagagggggaugguccuauuacuguggcggucugaagaacgucaaagaggugaagggccucaccaaagggggaccuggccaugaggaacccauuccuaugucuacuuauggguggaaucuaguacgccugcagucaggaguggauguuuucuuuacaccacccgaaaagugcgacaccuugcugugugauaucggcgagagcuccccuaacccaacuguggaggccggucgaacacucagaguccuuaaucugguggaaaacugguugaauaacaauacccaauucugcauuaaaguccugaaccccuacaugccgagugugaucgagaagauggaagcgcuccagaggaaguacgggggagcuuuaguucggaauccucugucucgcaacagcacgcacgagauguauuggguaucaaacgcauccggcaauauagugaguagcgucaacaugaucucuagaaugcuuauuaauagguuuaccaugcgacacaaaaaggccacauacgaaccagacguggaucugggcuccgggacucggaacaucggaauugagucagagacccccaaucuagacaucauagguaaacguauugaaaagaucaaacaggagcaugaaacaagcuggcacuaugaucaggaccauccuuacaagacuugggcuuaucacggcucguacgagaccaagcaaacagggucugccaguuccaugguuaacggaguggucagacuccugaccaaaccaugggacgugauccccaugguaacucagauggcaaugacggauacaaccccguucggccagcagcgcguguuuaaggaaaaaguugacacuaggacccaagagccuaaggaggguaccaagaaguugaugaagauuacggccgaauggcuguggaaagagcucgggaagaaaaagacaccccggauguguacuagagaagaguucacacgcaaagucaggagcaaugcugcgcuuggagccauauuuaccgaugagaacaaguggaaaucagcacgagaagcuguggaggacuccggcuucugggaacugguggauaaggagcggaauuuacaccuggaaggcaagugcgagacuugugucuauaacaugauggggaaaagagagaagaaauugggagaauuugguaaggccaaaggcucuagggcaaucugguacauguggcucggggcccgcuuccuggaguuugaagcucuaggauuccuuaaugaggaccauugguuuagccgugaaaacagucuguccggcguugagggugaggggcuccacaagcugggauacauuuugcgggaugugagcaagaaagaaggcggcgccauguaugcggacgauacagcagggugggacaccagaaucacacuggaggaucucaagaaugaagagaugguaacuaaccauauggaaggagagcacaagaaacuugccgaggcuauuuucaaacugaccuaccagaauaaaguggucagggugcagcgcccaacgccucgagguaccguuauggacaucauaucucggagagaccagaggggcucagggcaaguggucacauauggauuaaacacuuucaccaacauggaagcccagcugauccgccagauggagggcgaagguguguuuaagaguauucaacaguugacaguaaaagaggagaucgcaguuaagaauuggcucauuagaguggggcgggaaaggcugucccguauggcuaucagcggagaugacugcgucgugaaaccccuagaugaccgauucgccucugcucuuacugcccugaacgauaugggcaaggugcgcaaagacauucagcagugggagccaucgagaggcuggaaugauuggacccaaguccccuuuugcucacaucacuuccacgaacucauaaugaaggacgggcggguucuggugguaccuuguaggaaccaggaugaguugaucggacgcgcaagaauuagccagggugcgggcugguccuuacgggaaacggccugccuggggaagaguuacgcucagauguggucucucauguauuuucauaggcgagaccuucgucuggccgcaaaugcuaucuguagcgccgugccaucccacuggaucccgacaucaagaaccacuuggaguauucaugcaacacacgaguggaugaccacugaggauaugcuaaccgucuggaaccgcguguggauacaagaaaaucccuggauggaggacaaaacaccuguugaaacgugggaggaaaucccauaccugggaaagcgggaggaucaguggugcggcucucucauugguuugaccagcagggccacuugggcgaaaaacauccagacagcuauuaaucaggugagaucccugaucgggaacgaggaauauaccgacuacaugcccucaaugaagcgcuuccggagggaggaagaggaagccggaguccuuugguga

SEQ ID NO: 14340 - RNA, 9876 nt, Artificial Sequence
  derived and/or modified CDS sequence (opt3) from DENV-2__KM279521__SS-prME
accgccggaaucauuauaaugaugauccccacugugauggcuuuccaccugacuacgcgaaacggggagccucauaugauugucagcaggcaggaaaagggaaaaucccuccuuuuuaagaccgagaaugguguuaacaugugcacacugauggcaauggacuugggcgaauuaugugaggauacuaucaccuacaauugcccacuguuacggcaaaacgaaccggaggacauugauuguuggugcaauucuacaucaaccugggugacuuaugggacauguaccgccacgggagagcaccgccgagaaaaacguaguguugcgcucgugccccaugucggcaugggucuggagacuagaaccgaaacauggaugagcuccgagggggcuuggaagcacgcccagaggaucgagacuuggauacuucggcauccuggauucaccaucauggcagccauucuggcuuacacaaucggcaccacguauuuucagcgcguguugauuuucauccuccugacugcaguuacaccaucuauggccaugaggugcauaggcauuucgaacagggacuuuguggaaggggucucaggagguagcuggguggauaucguacuggagcacggcaguuguguuaccacuauggcuaaaaauaagcccacacucgacuucgaauuaauuaagaccgaggccaaacaccuggcgacgcuucggaaguacugcguggaagcaaaauugaccaacacaacuaccgccucccgcuguccuacacagggggagccaucucugaaugaggaacaagauaagcgauuugucugcaaacauagcaugguggacagaggauggggcaacgguugugggcuauucggaaagggcggcaucgugacuugcgcuauguuuaccugcaagaaaaauauggaggggaaggucguucagcccgaaaaccucgaguauacaaucgugauuaccccucacuccggagaagagaaugccguagguaacgauacuggcaaacaugggaaggagauaaaagugacgccacagucaaguaucacagaagcagagcugaccggauacggcacugucaccauggaauguagcccgaggacaggucuugacuucaaugagauggugcuguugcagauggaaaacaaggcuuggcucguucaccggcaaugguuucuggauuuaccccugccuuggcucccaggggccgacacccagggcucuaacuggauucagaaagagacucuugugacauucaagaauccccacgcgaagaaacaggaugucgugguacugggaucccaagagggcgccaugcauacggcauugaccggggcuacugaaauccagaugucaagcggaaaccuacuguuuacaggucaccucaagugccgucugcgcauggacaaacuucagcugaagggcaugaguuauucuauguguaccgggaaauucaagguugugaaggagauagccgaaacacaacauggaacuauugucaucagagugcaguacgagggcgacgguuccccuugcaaaaucccauucgagauuauggauuuggaaaagaggcacguccucgggcggcugaucaccgugaaucccauuguuacggagaaagacagcaccgugaacauagaagcugagccgccuuuuggcgauucguacaucauuaucggaguagaacccggccaguuaaagcugucuugguucaaaaagggguccucaaucggacagauguuugagacaacuaugcgaggugccaagcgcauggcaauucuaggcgacaccgccugggauuucgggagucucggaggcgucuuuacaagcauagguaaagcucugcaucaaguguucggggcgaucuauggcgcagccuuuuccggaguuucuuggacuaugaagauucuuaucggcguggucauuaccuggaucgggaugaauagcagaucaacgaguuuguccgugagccugguacucgugggaguugucacacuguaccuuggcgugauggugcaggcugacucugguugugucguuucauggaaaaacaaggagcugaaaugcgggaguggaauauucaucaccgauaaugugcacacuuggacagaacaguauaaguuucagccagagagcccuuccaaguuggccucugcaauucaaaaagcccacgaagagggcaucugugguauuaggucggugacccggcucgaaaaccugauguggaagcagaucacucccgaguuaaaucauauacugaccgagaacgaaguaaaacuaacaauuaugacgggcgacaucaaggggauuaugcaggcuggaaaacgcagccucagaccacagcccaccgagcugaaguacuccuggaaagccuggggcaaggcaaagaugcuuucaacugaauugcacaaucauacauuccugaucgaugggccugagaccgcggaaugcccaaacacaaauagggcuuggaacagucucgaggucgaggacuauggauuuggcguguucacuaccaauauauggcugaaauuaaaggaacgucaagauguauuuugugacucuaaacugaugagcgccgcaaucaaggacaaccgggccgugcacgcugauauggguuacuggauugaguccgcccuuaacgacacguggaaaaucgaaaaggcaucauucauugaggucaagagcugccacuggccgaaaucucauacauugugguccaauggggugcucgagagugaaaugaucauacccaagaacuucgcuggaccuguuagccagcacaauuaucgaccaggcuaccauacccagacugccggucccuggcaccugggcagacuagagauggauuuugacuucugugaagggaccacagugguagucacugaggauugcggaaacaggggcccuucucugcgcaccacaacggcguccgggaaacucauuaccgaauggugcugucggucaugcacucugccaccccuuagauacaggggagaggacggcuguugguaugguauggagauccgcccguugaaggaaaaagaggaaaaucuggugaacaguuuagugacagccgggcauggacagaucgauaauuuuagccucggcguccuggguauggcucuuuuccuggaggaaauguugcgaacccggguuggcacuaagcacgcaauucuccugguggccguaucguuugugacacuaaucaccgggaacauguccuuccgugaccugggaagagucauggugaugguuggcgcuacgaugacugaugacauugggaugggagugaccuaccucgcccugcuugcagcguuuaaggucaggccuacauucgccgcuggcuugcuguuacgcaaacucaccucuaaggagcugaugaugacuacaauagguaucgugcuucugagccaaucaaccauuccagagaguauccuagaacucacagaugcccuggcauuggggaugaugguucugaaaauugugcggaauauggagaaguaucaguuagcugucacuaucauggccauacucugcguacccaacgcagugauccugcagaaugccuggaaaguuuccuguaccacgcuugcuguggucucugugagcccucuguugcucacauccucacaacagaaggcggacuggauuccccuggcccuaaccaucaagggacugaacccaacugcaauuuuucuuaccacacucagcagaacaagcaaaaagaggucuuggccucugaaugaagcuaucauggccguaggcaugguguccauauuggccagcucgcugcuaaagaacgauauucccaugaccggcccacucgucgcugggggacugcuuacgguuugcuacgugcugacaggucgaucagcagacuuggagcucgaacgcgccgcggacgugcggugggaggagcaggcugaaaucucuggcaguuccccgauccugagcauuaccauaucugaggaugggagcauguccaucaagaaugaagaggaggaacagacucuaacaauucugaucagaaccggacuucucgucauuucaggccuguucccugugaguauccccauaacugccgcagccugguauuugugggagguuaaaaagcaaagggcugguguauuaugggacgugccaagucccccuccagucgggaaagcagaacuggaggauggagccuaccguaucaagcagaagggcauucucggcuauucucagaucggggcgggaguguacaaagaagguacauuucacaccauguggcauguuacgcgcggcgcugugcugaugcacaaggggaaacggauugagcccuccugggccgacgucaagaaagaucuuaucucauacggaggcgguuggaagcuggagggggaauggaaggagggagaagaggugcagguauuggcacuagaaccuggcaaaaacccgagagccguccaaacuaagccaggccuguucaaaaccaacacagggaccauaggagcugugagucucgacuuuagccccgguacauccggcucuccuauuguugauaagaaagggaagguggucggacuguauggcaauggugugguuacuaggucggggaccuacgugagcgccaucgcacagacggagaagucaaucgaggacaacccagaaauugaggaugacaucuuccggaaaaagagacuuacaauaauggauuuacaucccggagcuggcaaaacuaagcgcuaucugccugccauugucagagaagcgaucaaaaggggccuccggaccuugauucuggccccgacacgagugguagcagcugagauggaagaggcccucagagggcugcccauccgcuaccagaccccagcuauaagggcagagcacacuggacgugaaauuguggaccuuaugugucaugccaccuucacaaugcggcuguuguccccuaucagaguucccaauuauaaccuaaucauuauggaugaggcccacuuuacggacccagcuaguaucgcggcaagggguuacauuucuacucgcgucgaaaugggcgaggccgcugggauauucaugaccgccacaccucccggaagccgagacccauuuccgcaguccaaugcaccuaucauggaugaggaaagagagauucccgaacggucauggaacucuggccacgagugggugaccgacuucaaggguaagacugugugguuugucccaagcaucaaagccgggaaugauaucgcugcgugccugaggaagaacggcaaaaagguaauucaacucagucgcaaaacauucgacuccgaauauauaaagacccguacgaaugauugggacuuugugguuacuacagauaucagcgagaugggcgccaacuucaaggcagagagagugauugacccccggagguguaugaaaccugucaucuuaaccgauggcgaagaacgcgugauucuggcugggccaaugcccguuacccauucuucagccgcacagcgaagaggacggguggguaggaauccuaagaacgaaaaugaccaguacaucuacaugggcgagccgcuugaaaacgaugaggacugcgcccacuggaaagaggcuaagaugcugcucgacaauauaaacacuccagaagggaucauucccuccauguuugagccugaacgcgagaaagucgaugccaucgacggagaauauagauugaggggcgaggcgcggaagacauucguggaucugaugcgucgcggugaccuccccguauggcuggcauaccgaguggccgcugaggggauuaacuaugccgauagaaggugguguuuugacggcguuaaaaauaaccaaauccuugaagagaaugucgaaguggagauauggaccaaggagggagaacggaagaaacuaaagccacgcuggcuggaugcuagaauuuacagugacccuuuggcauuaaaagaguucaaggaguucgccgcuggcaggaaaagccugacacucaaccugaucacugagauggggcggcuucccacguuuaugacccagaaggccaagaaugcacuggauaaccucgcgguguugcauacagccgaagcuggaggucgagccuauaaucacgcacugucggagcuaccagagacucuggaaacccuccuucuguuaacauugcuggcuaccgucacuggcgggauuuuccucuuucugaugucuggaaaaggcaucgguaagaugacgcuugggaugugcugcauaaucaccgccuccauucugcucugguacgcacagauccagccucacuggauugccgcuagcaucauauuggaguucuuucugauuguuuuacuaaucccggaacccgagaaacaaagaacaccacaggacaaccagcugacuuaugugguaaucgcgauucucaccguggucgccgcaacaauggcuaaugaaaugggcuuccuugagaagaccaaaaaggauuuuggacugggcucaaucacuacacagcaaccugagaguaacauauuggacauugaucugcgccccgccucugccuggacgcucuacgcaguggcuaccacuuucaucacaccaaugcugaggcauuccauugaaaauagcucaguuaacgugagucuuaccgccaucgcgaaucaggcuaccguccucauggggcugggaaaggguuggccuuugagcaaaauggacauaggcguaccccuguuagccaucggguguuacucccaggugaacccgauuacacuaacugcagcccugcuccuucugguugcucacuaugcaaucauuggaccaggcuugcaggccaaggcgacgcgggaggcucaaaaacgugccgcagccgguaucaugaagaauccuaccguggacgggaugacagucauugaucuggaccccaucccauacgaucccaaauuugaaaagcagcucggccaggugaugcugcuugucuuaugcgugacucagguucugaugaugagaaccacaugggcucucugugaggccuugacccuggcaacuggaccuauaucuacgcuaugggaaggcaacccggggagguucuggaauacaaccauugcugugagcauggccaacaucuuucgcggauccuaucuggcgggcgccggucuccuuuucucaaucaugaagaacacugcaaauacccggcgagggacaggaaacacuggcgagacccugggugagaaauggaagaauagauugaacgcucugggcaaaucugaauuucaaauuuacaagaaaagugggauacaggagguagacaggacacucgccaaggaaggaaucaaacgcggcgagacggaucaucacgcagugucgcgggggagcgcuaagcugagaugguucgucgagcguaauuuaguuacccccgaaggaaagguggucgaccuuggcugcgguagagggggaugguccuauuacuguggcggucugaaaaacgugaaggagguaaaaggccucacuaaagggggaccaggccaugaagaaccuauucccaugucuacauauggguggaaucuagugcggcugcagucaggaguugauguguucuuuaccccuccagaaaaaugcgacacuuugcugugugauaucggcgagagcucccccaacccuacagucgaggccggucgcacccuccgagugcuuaaucuggucgaaaacugguugaauaacaauacgcaauucugcauuaaggugcugaacccauacaugcccaguguuaucgagaagauggaagcccuccagagaaaauacgggggagcguuaguaaggaauccgcugucucggaacagcacccacgagauguauugggugucaaacgcuuccggcaauauagucaguagcgugaacaugaucucucgcaugcuuauuaauagauuuacaaugaggcacaagaaagcaacuuacgaaccugacguugaucugggcuccgggacccgaaacaucggaauugagucagagacaccaaaucuagacaucauagguaagcggauugagaaaaucaagcaggagcaugaaacuagcuggcacuaugaucaggaccaucccuacaagaccugggccuaucacggcucguacgagacaaaacaaaccgggucugcuaguuccauggugaacggagucgugcgucuccugacuaagccuugggacguaaucccaauggugacgcagauggccaugacagauaccacucccuucggccagcagagaguuuuuaaagaaaaggucgacacccgcacacaagagccgaaagaggguacgaagaaguugaugaaaauuaccgcagaauggcuguggaaggagcucgggaaaaagaaaacuccuaggauguguacacgggaagaguucaccagaaaggugcgcagcaaugccgcucuuggagcgauauuuacugaugagaacaaauggaagucagccagggaagcaguggaggacuccggcuucugggaacuggucgauaaggagcgaaauuuacaccuggaaggcaaaugcgagacauguguuuauaacaugauggggaagcgggagaaaaaguugggagaauuugguaaagcuaagggcucuagagccaucugguacauguggcucggggcaagguuccuggaguuugaagcccuaggauuccuuaaugaggaccauugguuuagccgcgaaaacagucuguccggcguggagggugaggggcuccacaagcugggauacauuuugcgugauguaagcaaaaaggaaggcggcgcuauguaugccgacgauaccgcggggugggacacacggaucacucuggaggaucucaaaaaugaagagauggugaccaaccauauggaaggagagcacaagaaacuugcagaggccauuuucaagcugacguaccagaauaaggucgugagaguucagaggcccaccccacgcgguacagugauggacaucauaucucgacgggaccagagaggcucagggcaagucgugacuuauggauuaaacaccuucacaaacauggaagcucagcugaucaggcagauggagggcgaagguguauuuaaaaguauucaacaguugacuguuaaggaggagaucgccgugaaaaauuggcucauucgcgucgggagagaacggcuguccaggauggcaaucagcggagaugacugcguggugaagccucuagaugaccguuucgcuucugcccuuaccgcucugaacgauaugggcaaaguccgaaaggacauucagcagugggagcccucgcgcggcuggaaugauuggacgcaaguuccauuuugcucacaucacuuccacgaacucauaaugaaggacgggagagugcugguagugcccugucggaaccaggaugaguugaucggaagggcccgcauuagccagggugcaggcugguccuuaagagaaacagcgugccuggggaaaaguuacgcccagauguggucucucauguauuuucaucggagggaccuucgacuggcugccaaugcaaucuguagcgcugucccuucccacuggaucccaaccucacguacuacauggaguauucaugccacccacgaguggaugacuaccgaggauaugcuaacaguguggaacagaguuuggauacaagaaaauccguggauggaggacaagacgcccguggaaucuugggaggaaaucccuuaccugggaaaacgcgaggaucaguggugcggcagccucauugguuugaccucccgggcaacuugggccaagaacauccagacagcgauuaaucaggucaggucacugaucgggaacgaggaauauaccgacuacaugccaagcaugaaaagauuccgccgggaggaagaggaagcuggagugcuuugguga

SEQ ID NO: 14341 - RNA, 9876 nt, Artificial Sequence
  derived and/or modified CDS sequence (opt3) from DENV-2__KM279583__SS-prME
accgcaggaaucauuauaaugaugauccccacagugauggcuuuccaccugacuacgcgaaacggggagccucauaugauugucagcaggcaggaaaagggaaaaucccuccuuuuuaagaccgagaaugguguuaacaugugcacacugauggcaauggacuugggcgaauuaugugaggauacuaucaccuacaauugcccacuguuacggcaaaacgaaccggaggacauugauuguuggugcaauucuacaucaaccugggugacuuaugggacauguaccgccacgggagagcaccgccgagaaaaacguaguguggcgcucgugccccaugucggcaugggucuggagacuagaaccgaaacauggaugagcuccgagggggcuuggaagcacgcccagaggaucgagacuuggauacuucggcauccuggauucaccaucauggcagccauucuggcuuacacaaucggcaccacguauuuucagcgcguguugauuuucauccuccugacugcaguuacaccaucuauggccaugaggugcauaggcauuucgaacagggacuuuguggaaggggucucaggagguagcuggguggauaucguacuggagcacggcaguuguguuaccacuauggcuaaaaauaagcccacacucgacuucgaauuaauuaagaccgaggccaaacaccuggcgacgcuucggaaguacugcguggaagcaaaauugaccaacacaacuaccgccucccgcuguccuacacagggggagccaucucugaaugaggaacaagauaagcgauuugucugcaaacauagcaugguggacagaggauggggcaacgguugugggcuauucggaaagggcggcaucgugacuugcgcuauguuuaccugcaagaaaaauauggaggggaaggucguucagcccgaaaaccucgaguauacaaucgugauuaccccucacuccggagaagagaaugccguagguaacgauacuggcaaacaugggaaggagauaaaagugacgccacagucaaguaucacagaagcagagcugaccggauacggcacugucaccauggaauguagcccgaggacaggucuugacuucaaugagauggcucuguugcagauggaaaacaaggccuggcucgugcaccggcaaugguuucuggauuuaccccugccuuggcucccaggggcggacacccagggcucuaacuggauucagaaagagacucuuguuacauucaagaauccccacgccaagaaacaggauguggucgugcugggaucccaagagggcgcaaugcauacggcuuugaccggggccacugaaauccagaugucaagcggaaaccuacuguuuacaggucaccucaagugccgucugcgcauggacaaacuucagcugaagggcaugaguuauucuauguguaccgggaaauucaagguaguuaaggagauagcugaaacacaacauggaacuauugugaucagaguccaguacgagggcgacgguuccccuugcaaaaucccauucgagauuauggauuuggaaaagaggcacgugcucgggcggcugaucaccgucaaucccauugugacggagaaagacagcccgguuaacauagaagccgagccucccuuuggcgauucguacaucauuaucggaguggaaccaggccaguuaaagcugucuugguucaaaaagggguccucaaucggacagauguuugagaccacaaugcgaggugcaaagcgcauggccauucuaggcgacacugcuugggauuucgggagucucggaggcguauuuaccagcauagguaaagcgcugcaucaagucuucggggcaaucuauggcgccgcuuuuuccggagugucuuggacaaugaagauucuuaucggcguugugauuacuuggaucgggaugaauagcagaucaaccaguuuguccgucagccuggugcucguaggagugguuacgcuguaccuuggcgucauggugcaggccgacucugguuguguggucucauggaaaaacaaggagcugaaaugcgggaguggaauauucaucacagauaauguucacaccuggacugaacaguauaaguuucagccugagagccccuccaaguuggcaucugccauucaaaaagcucacgaagagggcaucugugguauuaggucggugacacggcucgaaaaccugauguggaagcagaucaccccagaguuaaaucauauacugacugagaacgaagugaaacuaaccauuaugacaggcgacaucaaggggauuaugcaggccggaaaacgcagccucagaccccagccuacggagcugaaguacuccuggaaagcauggggcaaggcgaagaugcuuucaaccgaauugcacaaucauacuuuccugaucgaugggccagagacagcugaaugcccgaacaccaauagggccuggaacagucucgagguagaggacuauggauuuggcgucuucacaacuaauauauggcugaaauuaaaggaacgucaagauguguuuugugacucuaaacugaugagcgcagccaucaaggacaaccgggcuguucacgccgauauggguuacuggauugaguccgcacuuaacgacaccuggaaaaucgaaaaggcuucauucauugagguaaagagcugccacuggcccaaaucucauacguugugguccaaugggguccucgagagugaaaugaucauaccuaagaacuucgccggaccagugagccagcacaauuaucgacccggcuaccauacacagaccgcggguccuuggcaccugggcagacuagagauggauuuugacuucugugaagggacuaccguugugguaacagaggauugcggaaacaggggcccaucucugcgcacuaccacagccuccgggaaacucauuacggaauggugcugucggucaugcacccugcccccgcuuagauacaggggagaggacggcuguugguaugguauggagauccgcccuuugaaggaaaaagaggaaaaucuggucaacaguuuagugacugcugggcauggacagaucgauaauuuuagccucggcgugcuggguauggcacuuuuccuggaggaaauguugcgaacacgggucggcaccaagcacgccauucuccugguugcugugucguuuguaacucuaaucacagggaacauguccuuccgugaccugggaagagugauggucauggugggcgccaccaugacggaugacauugggaugggaguuacuuaccucgcacugcuugcggccuuuaaggugaggccaaccuucgcugccggcuugcuguuacgcaaacucacaucuaaggagcugaugaugaccacuauagguaucguccuucugagccaaucaacaauucccgagaguauccuagaacucaccgaugcacuggcuuuggggaugauggugcugaaaauuguucggaauauggagaaguaucaguuagccgugacaaucauggcaauacucugcgucccuaacgccguaauccugcagaaugcuuggaaaguguccuguacuacccuugcgguugugucugucagcccccuguugcucacguccucacaacagaaggccgacuggauuccacuggcacuaacaaucaagggacugaacccuaccgcuauuuuucuuacuacccucagcagaacaaguaaaaagaggucuuggccccugaaugaagccaucauggccgugggcaugguauccauauuggcuagcucgcugcuaaagaacgauauuccaaugacuggcccgcucguggcagggggacugcuuaccgucugcuacguucugacgggucgaucagccgacuuggagcucgaacgcgcggcugacgugcggugggaggagcaggccgaaaucucuggcaguuccccuauccugagcauuacaauaucugaggaugggagcauguccaucaagaaugaagaggaggaacagacccuaacuauucugaucagaacaggacuucucgugauuucaggccuguuccccgucaguaucccaauaaccgcagccgcuugguauuugugggaggugaaaaagcaaagggccgguguuuuaugggacguacccagcccuccacccguggggaaagccgaacuggaggauggagcguaccguaucaagcagaagggcauucucggcuauucucagaucggggcuggagucuacaaagaagguacuuuucacacaauguggcaugugacccgcggcgccguucugaugcacaaggggaaacggauugagccuuccugggcagacgugaagaaagaucuuaucucauacggaggcgguuggaagcuggagggggaauggaaggagggagaagagguccagguguuggcccuagaaccgggcaaaaacccaagagcuguacaaacgaagcccggccuguucaaaacuaacaccgggacaauaggagccgucagucucgacuuuagcccugguaccuccggcucuccaauuguggauaagaaagggaagguugugggacuguauggcaauggugucgugacaaggucggggacuuacguuagcgcaaucgcucagaccgagaagucaaucgaggacaaccccgaaauugaggaugacaucuuccggaaaaagagacuuacgauaauggauuuacauccuggagccggcaaaacaaagcgcuaucugccggcgauugugagagaagccaucaaaaggggccuccggacuuugauucuggcacccacccgagucguggcugccgagauggaagaggcucucagagggcugccaauccgcuaccagaccccugcaauaagggccgagcacaccggacgugaaauuguagaccuuaugugucaugccacuuucaccaugcggcuguugucccccaucagagugccaaauuauaaccuaaucauuauggaugaggcucacuuuacagacccugcgaguaucgcagccagggguuacauuucuacgcgcguugaaaugggcgaggcugccgggauauucaugacugcaacacccccaggaagccgagacccguuuccucaguccaaugcccccaucauggaugaggaaagagagauuccagaacggucauggaacucuggccacgagugggucacagacuucaaggguaagaccgugugguuugugcccagcaucaaagcugggaaugauaucgcggccugccugaggaagaacggcaaaaaggucauucaacucagucgcaaaacuuucgacuccgaauauauaaagacacguaccaaugauugggacuuuguagugacgacugauaucagcgagaugggcgcaaacuucaaggcugagagaguuauugacccucggagguguaugaaaccagugaucuuaacagauggcgaagaacgcgucauucuggccgggcccaugccugugacccauucuucagcagcccagcgaagaggacggguugguaggaauccgaagaacgaaaaugaccaguacaucuacaugggcgagccacuugaaaacgaugaggacugcgcucacuggaaagaggccaagaugcugcucgacaauauaaacacccccgaagggaucauuccuuccauguuugagcccgaacgcgagaaaguggaugcgaucgacggagaauauagauugaggggcgaggcacggaagacuuucgucgaucugaugcgucgcggugaccucccaguguggcuggccuaccgaguagcugccgaggggauuaacuaugcugauagaaggugguguuuugacggcgugaaaaauaaccaaauccuugaagagaauguugaagucgagauauggacaaaggagggagaacggaagaaacuaaagccucgcuggcuggaugcaagaauuuacagugaccccuuggccuuaaaagaguucaaggaguucgcugccggcaggaaaagccugacccucaaccugaucacagagauggggcggcuuccaacuuuuaugacgcagaaggcaaagaaugcgcuggauaaccucgccguguugcauaccgcugaagccggaggucgagcauauaaucacgcucugucggagcuaccugagacacuggaaacucuccuucuguuaaccuugcuggccacagugaccggcgggauuuuccucuuucugaugucuggaaaaggcaucgguaagaugacucuugggaugugcugcauaaucacggcauccauucugcucugguacgcccagauccagccgcacuggauugcugcgagcaucauauuggaguucuuucugauugucuuacuaauccccgaaccagagaaacaaagaaccccucaggacaaccagcugacauauguugugaucgccauucucacuguaguggcagcuaccauggccaaugaaaugggcuuccuugagaagaccaaaaaggauuuuggacugggcucaaucaccacucagcaacccgagaguaacauauuggacauugaucugcgcccagccucugcauggacacucuacgcugucgccacgaccuucaucacuccuaugcugaggcauuccauugaaaauagcucagugaacguuagucuuacagcgaucgcuaaucaggccaccgugcucauggggcugggaaaggguuggcccuugagcaaaauggacauaggcgucccgcuguuagcaaucggguguuacucccagguaaacccaauuacccuaacagccgcucugcuccuucugguggcacacuaugccaucauuggaccuggcuugcaggcgaaggcuacucgggaggcccaaaaacgugcagccgcugguaucaugaagaaucccacgguugacgggaugaccgugauugaucuggacccaauccccuacgauccuaaauuugaaaagcagcucggccaggucaugcugcuuguguuaugcgucacacaggugcugaugaugagaacuaccugggcccucugugaggcauugacacuggcuaccggaccgauaucuacucuaugggaaggcaaccccgggagguucuggaauacgacaauugccguuagcauggcgaacaucuuucgcggauccuaucuggccggcgcaggucuccuuuucucaaucaugaagaacaccgcuaauacucggcgagggaccggaaacacaggcgagacucugggugagaaauggaagaauagauugaacgcccugggcaaaucugaauuucaaauuuacaagaaaagugggauacaggagguggacaggacccucgcaaaggaaggaaucaaacgcggcgagacagaucaucacgcuguaucgcgggggagcgccaagcugagaugguucguggagcguaauuuagucacgccagaaggaaagguuguggaccuuggcugcgguagagggggaugguccuauuacuguggcggucugaaaaacgucaaggaggugaaaggccucaccaaagggggaccuggccaugaagaacccauuccuaugucuacuuauggguggaaucuaguacggcugcagucaggaguggauguuuucuuuacaccacccgaaaaaugcgacaccuugcugugugauaucggcgagagcuccccuaacccaacuguggaggccggucgcacacuccgaguccuuaaucugguggaaaacugguugaauaacaauacccaauucugcauuaagguccugaaccccuacaugccgagugugaucgagaagauggaagcgcuccagagaaaauacgggggagcuuuaguuaggaauccucugucucggaacagcacgcacgagauguauuggguaucaaacgcauccggcaauauagugaguagcgucaacaugaucucucgcaugcuuauuaauagauuuaccaugaggcacaagaaagccacauacgaaccagacguggaucugggcuccgggacucgaaacaucggaauugagucagagacccccaaucuagacaucauagguaagcggauugagaaaaucaagcaggagcaugaaacaagcuggcacuaugaucaggaccauccuuacaagacuugggcuuaucacggcucguacgagaccaaacaaacagggucugccaguuccaugguuaacggagugguccgucuccugaccaagccaugggacgugauccccaugguaacucagauggcaaugacggauacaaccccguucggccagcagagaguguuuaaagaaaagguugacacucgcacccaagagccuaaagaggguacaaagaaguugaugaaaauuacggccgaauggcuguggaaggagcucgggaaaaagaaaacccccaggauguguacucgggaagaguucacaagaaagguccgcagcaaugcugcgcuuggagccauauuuaccgaugagaacaaauggaagucagcaagggaagcuguggaggacuccggcuucugggaacugguggauaaggagcgaaauuuacaccuggaaggcaaaugcgagacuugugucuauaacaugauggggaagcgggagaaaaaguugggagaauuugguaaagccaagggcucuagagcaaucugguacauguggcucggggccagguuccuggaguuugaagcucuaggauuccuuaaugaggaccauugguuuagccgcgaaaacagucuguccggcguugagggugaggggcuccacaagcugggauacauuuugcgugaugugagcaaaaaggaaggcggcgccauguaugcggacgauacagcagggugggacacccggaucacacuggaggaucucaaaaaugaagagaugguaacuaaccauauggaaggagagcacaagaaacuugccgaggcuauuuucaagcugaccuaccagaauaagguggucagagugcagaggccaacgccucgcgguaccguuauggacaucauaucucgacgggaccagagaggcucagggcaaguggucacauauggauuaaacacuuucaccaacauggaagcccagcugaucaggcagauggagggcgaagguguguuuaaaaguauucaacaguugacaguaaaggaggagaucgcaguuaaaaauuggcucauucgcguggggagagaacggcuguccaggauggcuaucagcggagaugacugcgucgugaagccccuagaugaccguuucgccucugcucuuacugcccugaacgauaugggcaaagugcgaaaggacauucagcagugggagccaucgcgcggcuggaaugauuggacccaaguccccuuuugcucacaucacuuccacgaacucauaaugaaggacgggagaguucuggugguaccuugucggaaccaggaugaguugaucggaagggcacgcauuagccagggugcgggcugguccuuaagagaaacggccugccuggggaaaaguuacgcucagauguggucucucauguauuuucaucggagggaccuucgacuggccgcaaaugcuaucuguagcgccgugccaucccacuggaucccgacaucacguaccacuuggaguauucaugcaacacacgaguggaugaccacugaggauaugcuaaccgucuggaacagaguguggauacaagaaaaucccuggauggaggacaagacaccuguugaaucuugggaggaaaucccauaccugggaaaacgcgaggaucaguggugcggcagccucauugguuugacgucccgggccaccugggcgaagaacauccagacugcuauuaaucaggugaggucacugaucgggaacgaggaauauacagacuacaugcccagcaugaaaagauuccgccgggaggaagaggaagccggaguccuuugguga

SEQ ID NO: 14342 - RNA, 9876 nt, Artificial Sequence
  derived and/or modified CDS sequence (opt3) from DENV-2__KM279585__SS-prME
accgccggaaucauuauaaugaugauccccacagugauggcuuuccaccugacuacgcgaaacggggagccucauaugauuguaagcaggcaggaaaagggaaaaucccuccuuuuuaagaccgagaaugguguuaacaugugcacacugauggcaauggacuugggcgaauuaugugaggauacuaucaccuacaauugcccacuguuacggcaaaacgaaccggaggacauugauuguuggugcaauucuacaucaaccugggugacuuaugggacauguaccgccacgggagagcaccgccgagaaaaacguaguguggcgcucgugccccaugucggcaugggucuggagacuagaaccgaaacauggaugagcuccgagggggcuuggaagcacgcccagaggaucgagacuuggauacuucggcauccuggauucaccaucauggcagccauucuggcuuacacaaucggcaccacguauuuucagcgcguguugauuuucauccuccugacugcaguuacaccaucuauggccaugaggugcauaggcauuucgaacagggacuuuguggaaggggucucaggagguagcuggguggauaucguacuggagcacggcaguuguguuaccacuauggcuaaaaauaagcccacacucgacuucgaauuaauuaagaccgaggccaaacaccuggcgacgcuucggaaguacugcguggaagcaaaauugaccaacacaacuaccgccucccgcuguccuacacagggggagccaucucugaaugaggaacaagauaagcgauuugucugcaaacauagcaugguggacagaggauggggcaacgguugugggcuauucggaaagggcggcaucgugacuugcgcuauguuuaccugcaagaaaaauauggaggggaaggucguucagcccgaaaaccucgaguauacaaucgugauuaccccucacuccggagaagagaaugccguagguaacgauacuggcaaacaugggaaggagauaaaagugacgccacagucaaguaucacagaagcagagcugaccggauacggcacugucaccauggaauguagcccgaggacaggucuugacuucaaugagauggugcuguugcagauggaaaacaaggcuuggcucguucaccggcaaugguuucuggauuuaccccugccuuggcucccaggggccgacacccagggcucuaacuggauucagaaagagacucuugugacauucaagaauccccacgcgaagaaacaggaugucgugguacugggaucccaagagggcgccaugcauacggcauugaccggggcuacugaaauccagaugucaagcggaaaccuacuguuuacaggucaccucaagugccgucugcgcauggacaaacuucagcugaagggcaugaguuauucuauguguaccgggaaauucaagguugugaaggagauagccgaaacacaacauggaacuauugucgugagaguccaguacgagggcgacgguuccccuugcaaaaucccauucgagaucauggauuuggaaaagaggcacgugcucgggcggcugauuaccguuaaucccaucgugacggagaaagacagcccgguaaacauugaagcugagccucccuuuggcgauucguacauaaucauuggagucgaaccaggccaguuaaagcugucuugguucaaaaagggguccucaaucggacagauguuugagaccacaaugcgaggugccaagcgcauggcaauccuaggcgacacugccugggauuucgggagucucggaggcguguuuaccagcauugguaaagcucugcaucaaguuuucggggcgauauauggcgcagccuuuuccggagugucuuggacaaugaagauccuuauuggcgucgugaucacuuggauugggaugaauagcagaucaaccaguuuguccguaagccuggugcucguuggagucgugacgcuguaccuuggcgugaugguccaggcugacucugguuguguugugucauggaaaaacaaggagcugaaaugcgggaguggaaucuucauaacagauaaugugcacaccuggacugaacaguauaaguuucagccugagagccccuccaaguuggccucugcaauccaaaaagcccacgaagagggcauuugugguaucaggucgguaacacggcucgaaaaccugauguggaagcagauuaccccagaguuaaaucauauccugacugagaacgaagucaaacuaaccauaaugacaggcgacauuaaggggaucaugcaggcuggaaaacgcagccucagaccccagccuacggagcugaaguacuccuggaaagccuggggcaaggcaaagaugcuuucaaccgaauugcacaaucauacuuuccugauugaugggccagagacagcggaaugcccgaacaccaauagggcuuggaacagucucgagguggaggacuauggauuuggcguuuucacaacuaauaucuggcugaaauuaaaggaacgucaagauguguuuugugacucuaaacugaugagcgccgcaauaaaggacaaccgggccguccacgcugauauggguuacuggaucgaguccgcccuuaacgacaccuggaaaauugaaaaggcaucauucaucgagguaaagagcugccacuggcccaaaucucauacguugugguccaaugggguucucgagagugaaaugauuaucccuaagaacuucgcuggaccagugagccagcacaauuaucgacccggcuaccauacacagaccgccgguccuuggcaccugggcagacuagagauggauuuugacuucugugaagggacuaccguagucgugacagaggauugcggaaacaggggcccaucucugcgcacuaccacagcguccgggaaacucauaacggaauggugcugucggucaugcacccugcccccgcuuagauacaggggagaggacggcuguugguaugguauggagauucgcccuuugaaggaaaaagaggaaaaucuggugaacaguuuagucacugccgggcauggacagaucgauaauuuuagccucggcguucuggguauggcucuuuuccuggaggaaauguugcgaacacgggugggcaccaagcacgcaauccuccugguagccgugucguuugucacucuaauuacagggaacauguccuuccgugaccugggaagagugaugguuauggugggcgcuaccaugacggaugacaucgggaugggagucacuuaccucgcccugcuugcagcguuuaaggugaggccaaccuucgccgcuggcuugcuguuacgcaaacucacaucuaaggagcugaugaugaccacuauugguauaguucuucugagccaaucaacaauccccgagaguauucuagaacucaccgaugcccuggcauuggggaugauggugcugaaaaucguccggaauauggagaaguaucaguuagcuguaacaauuauggccauccucugcgugccuaacgcaguuauacugcagaaugccuggaaaguguccuguacuacccuugcugucgugucuguaagcccccuguugcucacguccucacaacagaaggcggacuggaucccacuggcccuaacaauuaagggacugaacccuaccgcaaucuuucuuacuacccucagcagaacaaguaaaaagaggucuuggccccugaaugaagcuauuauggccgugggcauggucuccaucuuggccagcucgcugcuaaagaacgauauaccaaugacuggcccgcucguugcugggggacugcuuaccgugugcuacgugcugacgggucgaucagcagacuuggagcucgaacgcgccgcggacguccggugggaggagcaggcugaaauuucuggcaguuccccuauccugagcaucacaauuucugaggaugggagcauguccauaaagaaugaagaggaggaacagacccuaacuauccugauuagaacaggacuucucgugaucucaggccuguuccccguuaguauuccaaucaccgccgcagccugguauuugugggaggucaaaaagcaaagggcugguguguuaugggacguccccagcccuccacccguggggaaagcagaacuggaggauggagccuaccguauaaagcagaagggcauccucggcuauucucagauuggggcgggaguuuacaaagaagguacuuuucacacaauguggcaugugacccgcggcgcuguccugaugcacaaggggaaacggaucgagccuuccugggccgacgugaagaaagaucuuauuucauacggaggcgguuggaagcuggagggggaauggaaggagggagaagagguacaggucuuggcacuagaaccgggcaaaaacccaagagccgugcaaacgaagcccggccuguucaaaacuaacaccgggacaaucggagcuguuagucucgacuuuagcccugguaccuccggcucuccaauaguggauaagaaagggaaggucgugggacuguauggcaaugguguugugacaaggucggggacuuacgucagcgccauugcacagaccgagaagucaaucgaggacaaccccgaaaucgaggaugacauuuuccggaaaaagagacuuacgaucauggauuuacauccuggagcuggcaaaacaaagcgcuaucugccggccauagugagagaagcgauuaaaaggggccuccggacuuugauccuggcccccacccgaguaguggcagcugagauggaagaggcccucagagggcugccaauucgcuaccagaccccugcuaucagggcagagcacaccggacgugaaauaguugaccuuaugugucaugccacuuucaccaugcggcuguugucccccauuagagucccaaauuauaaccuaaucaucauggaugaggcccacuuuacagacccugcuaguauugcggcaagggguuacaucucuacgcgcguggaaaugggcgaggccgcugggauuuucaugacugccacacccccaggaagccgagacccguuuccucaguccaaugcacccauaauggaugaggaaagagagaucccagaacggucauggaacucuggccacgagugggugacagacuucaaggguaagaccgucugguuuguacccagcauuaaagccgggaaugauaucgcugcgugccugaggaagaacggcaaaaaggugauccaacucagucgcaaaacuuucgacuccgaauauauuaagacacguaccaaugauugggacuuuguugugacgacugauauaagcgagaugggcgccaacuucaaggcagagagagucaucgacccucggagguguaugaaaccagugauuuuaacagauggcgaagaacgcguuauccuggcugggcccaugccugugacccauucuucagccgcacagcgaagaggacgggucgguaggaauccgaagaacgaaaaugaccaguacauuuacaugggcgagccacuugaaaacgaugaggacugcgcccacuggaaagaggcuaagaugcugcucgacaauaucaacacccccgaagggauaaucccuuccauguuugagcccgaacgcgagaaaguggaugccauugacggagaauauagauugaggggcgaggcgcggaagacuuucguagaucugaugcgucgcggugaccucccaguguggcuggcauaccgaguugccgcugaggggaucaacuaugccgauagaaggugguguuuugacggcgucaaaaauaaccaaauucuugaagagaauguggaaguggagaucuggacaaaggagggagaacggaagaaacuaaagccucgcuggcuggaugcuagaauauacagugaccccuuggcauuaaaagaguucaaggaguucgccgcuggcaggaaaagccugacccucaaccugauuacagagauggggcggcuuccaacuuuuaugacgcagaaggccaagaaugcacuggauaaccucgcggucuugcauaccgccgaagcuggaggucgagccuauaaucacgcacugucggagcuaccugagacacuggaaacucuccuucuguuaaccuugcuggcuacaguuaccggcgggaucuuccucuuucugaugucuggaaaaggcauugguaagaugacucuugggaugugcugcaucauaacggccuccauccugcucugguacgcacagauucagccgcacuggaucgccgcuagcauuaucuuggaguucuuucugauaguguuacuaauucccgaaccagagaaacaaagaaccccucaggacaaccagcugacauauguagugaucgcgauccucacugucguggccgcaaccauggcuaaugaaaugggcuuccuugagaagaccaaaaaggauuuuggacugggcucaauuaccacucagcaacccgagaguaacaucuuggacauagaucugcgcccagccucugccuggacacucuacgcaguugcuacgaccuucauuacuccuaugcugaggcauuccaucgaaaauagcucagugaacgucagucuuacagccauugcgaaucaggcuaccguacucauggggcugggaaaggguuggcccuugagcaaaauggacaucggcgugccgcuguuagccauaggguguuacucccagguuaacccaaucacccuaacagcagcccugcuccuucugguggcucacuaugcaauuaucggaccuggcuugcaggccaaggcgacucgggaggcucaaaaacgugccgcagccgguauuaugaagaaucccacggucgacgggaugaccgugaucgaucuggacccaauucccuacgauccuaaauuugaaaagcagcucggccaggucaugcugcuuguguuaugcguuacacaggugcugaugaugagaacuaccugggcucucugugaggccuugacacuggcaaccggaccgaucucuacucuaugggaaggcaaccccgggagguucuggaauacgacaauagcuguaagcauggccaacauuuuucgcggauccuaucuggcgggcgccggucuccuuuucucaaucaugaagaacaccgcaaauacucggcgagggaccggaaacacaggcgagacucugggugagaaauggaagaauagauugaacgcucugggcaaaucugaauuucaaaucuacaagaaaagugggauucaggagguggacaggacccucgccaaggaaggaauaaaacgcggcgagacagaucaucacgcagucucgcgggggagcgcuaagcugagaugguucguugagcguaauuuagugacgccagaaggaaaggucguggaccuuggcugcgguagagggggaugguccuauuacuguggcggucugaaaaacguaaaggaggugaaaggccucaccaaagggggaccuggccaugaagaacccaucccuaugucuacuuauggguggaaucuaguucggcugcagucaggaguggaugucuucuuuacaccacccgaaaaaugcgacaccuugcugugugauauuggcgagagcuccccuaacccaacuguggaggccggucgcacacuccgaguccuuaaucugguggacaacugguugaauaacaauacccaauucugcaucaagguucugaaccccuacaugccgaguguaauugaaaagauggaggcccuccagagaaaauacgggggagcguuagugaggaauccucugucucggaacagcacgcacgaaauguauugggucucaaacgcuuccggcaauaucgugaguagcguuaacaugauaucucgcaugcuuaucaauagauuuaccaugaggcacaagaaagcaacauacgagccagauguggaccugggcuccgggacucgaaacauuggaaucgaaucagagacccccaaucuagauauuaucgguaagcggauagagaaaauuaagcaggaacaugagacaagcuggcacuaugaccaggaccauccuuacaagacuugggccuaucacggcucguacgaaaccaaacaaacagggucugcuaguuccauggucaacggagugguacgucuccugaccaagccaugggaugugauccccaugguuacucagauggccaugacggacacaaccccguucggccagcagagagucuuuaaagagaagguggauacucgcacccaagaaccuaaagaggguacaaagaaguugaugaaaaucacggcagaguggcuguggaaggaacucgggaaaaagaaaacccccaggauguguacucgggaggaguucacaagaaaggugcgcagcaaugccgcucuuggagcgauuuuuaccgacgagaacaaauggaagucagccagggaggcagucgaagauuccggcuucugggagcugguugacaaggaacgaaauuuacaccuggagggcaaaugcgaaacuuguguguauaacaugauggggaagcgggagaaaaaguugggagaguuugguaaagcuaagggcucuagagccauaugguacauguggcucggggcaagguuccuggaauuugaggcccuaggauuccuuaaugaagaucauugguuuagccgcgagaacagucuguccggcguagaaggugaggggcuccacaagcugggauacaucuugcgugacgugagcaaaaaggagggcggcgcuauguaugccgaugacacagcggggugggauacccggauuacacuggaagaccucaaaaaugaggaaauggucacuaaccauauggagggagaacacaagaaacuugcagaggccaucuucaagcugaccuaccagaauaaggugguuagagugcagaggccaacgccucgcgguaccgucauggacauuaucucucgacgggaucagagaggcucagggcaagugguaacauauggauuaaacacuuucaccaacauggaggcucagcugauaaggcagauggaaggcgaggguguuuuuaaaaguauccaacaguugacagugaaggaagagauugccgucaaaaauuggcucauccgcguggggagagagcggcuguccaggauggcaauuagcggagacgauugcguggucaagccccuagacgaucguuucgcuucugcccuuacugcucugaacgacaugggcaaaguucgaaaggauauccagcagugggaaccaucgcgcggcuggaaugacuggacccaagugcccuuuugcucacaucacuuccacgagcucauuaugaaggaugggagaguacugguggucccuugucggaaccaggacgaauugauaggaagggcccgcaucagccagggugcaggcugguccuuaagagagacggcgugccuggggaaaaguuacgcccagauguggaaucucauguauuuucaucggagggaucuucgacuggcugccaacgcaauuuguucugcugugccaagccacuggaucccgacaucccguaccacuuggucaauccaugccacacacgaauggaugaccacugaggacaugcuaaccguuuggaauagaguguggauucaagagaaccccuggauggaagauaagacaccugucgagaguugggaagagauaccauaccugggaaaacgcgaagaccaguggugcggcucucucaucgguuugacgagccgggcaaccugggccaagaauauucagacugcgaucaaccaggugaggucccugauugggaaugaggaguauacagacuacaugcccucaaugaaaagauuccgccgggaagaggaagaggcuggaguacuuugguga

SEQ ID NO: 14343 - RNA, 9876 nt, Artificial Sequence
  derived and/or modified CDS sequence (opt3) from DENV-2__KM279525__SS-prME
accgccggcaucauuauaaugaugauccccacagugauggcuuuccaccugacuacgagaaacggggagccucauaugauugucagcaggcaggaaaagggaaaaucccuccuuuuuaagaccgagaaugguguuaacaugugcacacugauggcaauggacuugggcgaauuaugugaggauacuaucaccuacaauugcccacugcuacggcaaaacgaaccggaggacauugauuguuggugcaauucuacaucaaccugggugacuuaugggacauguaccgccacgggagagcaccgccgagaaaaacguaguguagcgcucgugccccaugucggcaugggucuggagacuagaaccgaaacauggaugagcuccgagggggcuuggaagcacgcccagaggaucgagacuuggauacuucggcauccuggauucaccaucauggcagccauucuggcuuacacaaucggcaccacguauuuucagcgcguguugauuuucauccuccugacugcaguuacaccaucuauggccaugagaugcauaggcauuucgaacagggacuuuguggaaggggucucaggagguagcuggguggauaucguacuggagcacggcaguuguguuaccacuauggcuaaaaauaagcccacacucgacuucgaauuaauuaagaccgaggccaaacaccuggcgacgcuucggaaguacugcguggaagcaaaauugaccaacacaacuaccgccucccgcuguccuacacagggggagccaucucugaaugaggaacaagauaagcgauuugucugcaaacauagcaugguggacagaggauggggcaacgguugugggcuauucggaaagggcggcaucgugacuugcgcuauguuuaccugcaagaaaaauauggaggggaaggucguucagcccgaaaaccucgaguauacaaucgugauuaccccucacuccggagaagagaaugccguagguaacgauacuggcaaacaugggaaggagauaaaagugacgccacagucaaguaucacagaagcagagcugaccggauacggcacugucaccauggaauguagcccgaggacaggucuugacuucaaugagauggugcuguugcagauggaaaacaaggcuuggcucguucaccggcaaugguuucuggauuuaccccugccuuggcucccaggggccgacacccagggcucuaacuggauucagaaagagacucuugugacauucaagaauccccacgcgaagaaacaggaugucgugguacugggaucccaagagggcgccaugcauacggcauugaccggggcuacugaaauccagaugucaagcggaaaccuacuguuuacaggucaccucaagugccgucugcgcauggacaaacuucagcugaagggcaugaguuauucuauguguaccgggaaauucaagguugugaaggagauagccgaaacacaacauggaacuauugucaucagagugcaguacgagggcgacgguuccccuugcaaaaucccauucgagauuauggauuuggaaaagaggcacguccucgggcggcugaucaccgugaaucccauuguuacggagaaagacagcccggugaacauagaagcugagccucccuuuggcgauucguacaucauuaucggaguagaaccaggccaguuaaagcugucuugguucaaaaagggguccucaaucggacagauguuugagaccacaaugcgaggugccaagcgcauggcaauucuaggcgacacugccugggauuucgggagucucggaggcgucuuuaccagcauagguaaagcucugcaucaaguguucggggcgaucuauggcgcagccuuuuccggaguuucuuggacaaugaagauucuuaucggcguggucauuacuuggaucgggaugaauagcagaucaaccaguuuguccgugagccugguacucgugggaguugucacgcuguaccuuggcgugauggugcaggcugacucugguugugucguuucauggaaaaacaaggagcugaaaugcgggaguggaauauucaucacagauaaugugcacaccuggacugaacaguauaaguuucagccugagagccccuccaaguuggccucugcaauucaaaaagcccacgaagagggcaucugugguauuaggucggugacacggcucgaaaaccugauguggaagcagaucaccccagaguuaaaucauauacugacugagaacgaaguaaaacuaaccauuaugacaggcgacaucaaggggauuaugcaggcuggaaaacgcagccucagaccccagccuacggagcugaaguacuccuggaaagccuggggcaaggcaaagaugcuuucaaccgaauugcacaaucauacuuuccugaucgaugggccagagacagcggaaugcccgaacaccaauagggcuuggaacagucucgaggucgaggacuauggauuuggcguguucacaacuaauauauggcugaaauuaaaggaacgucaagauguuuuuugugacucuaaacugaugagcgccgcaaucaaggacaaccgggccgugcacgcugauauggguuacuggauugaguccgcccuuaacgacaccuggaaaaucgaaaaggcaucauucauugaggucaagagcugccacuggcccaaaucucauacguugugguccaauggggugcucgagagugaaaugaucauaccuaagaacuucgcuggaccaguuagccagcacaauuaucgacccggcuaccauacacagaccgccgguccuuggcaccugggcagacuagagauggauuuugacuucugugaagggacuaccgugguagucacagaggauugcggaaacaggggcccaucucugcgcacuaccacagcguccgggaaacucauuacggaauggugcugucggucaugcacccugcccccgcuuagauacaggggagaggacggcuguugguaugguauggagauccgcccuuugaaggaaaaagaggaaaaucuggugaacaguuuagugacugccgggcauggacagaucgauaauuuuagccucggcguccuggguauggcucuuuuccuggaggaaauguugcgaacacggguuggcaccaagcacgcaauucuccugguggccguaucguuugugauccuaauuacugggaacauguccuuccgugaccugggaagagucauggugaugguuggcgcuacaaugaccgaugacauagggaugggagugacguaccucgcccugcuugcagcguuuaaggucaggccaacuuucgccgcuggcuugcuguuacgcaaacucaccucuaaggagcugaugaugacaaccaucgguauugugcuucugagccaaucaacuauccccgagaauauucuagaacucacagaugcccuggcauuggggaugaugguucugaaaaucgugcggaacauggagaaguaucaguuagcugucaccauaauggccauccucugcguaccuaaugcagugauucugcagaacgccuggaaaguuaguuguacaacucuugcuguggucuccgugucuccccuguugcucaccagcucccaacagaaggcggacuggaucccacuggcccuaacgauuaagggacugaauccuacagcaaucuuucuuaccacucucucaagaaccagcaaaaagaggaguuggccccugaacgaagcuauaauggccguaggcauggugucuauuuuggccuccagccuguuaaaaaaugauaucccaaugacaggcccgcucgucgcugggggacugcuuacuguuugcuacgugcugaccggucgaucggcagacuuggagcucgaacgcgccgcggacgugcggugggaggagcaggcugaaaucucaggcucuaguccuauucuguccauaacgaucagcgaggaugggucuaugagcauuaagaacgaagaggaggaacagacacuaaccauccugauuagaacuggacuucucgucaucuccggccuguuccccgugucaauaccaaucacagccgcagccugguauuugugggagguuaaaaagcaaagggcugguguauuaugggacgugcccaguccuccacccgucgggaaagcagaacuggaggauggagccuaccguauuaagcagaagggcauccucggcuauagccagauuggggcgggaguguacaaagaagguaccuuucacacuauguggcauguuacacgcggcgcugugcugaugcacaaggggaaacggaucgagccuucuugggccgacgucaagaaagaucuuauauccuacggaggcgguuggaagcuggagggggaauggaaggagggagaagaggugcagguauuggcacuagaaccgggcaaaaacccaagagccguccaaaccaagcccggccuguucaaaacgaauacugggaccauuggagcugugucacucgacuuuaguccugguacaagcggcuccccaaucguugauaagaaagggaagguggucggacuguauggcaacggugugguuaccaggucugggacauacgugucggccaucgcacagacugagaagagcauugaggacaaucccgaaaucgaggaugacauauuccgaaaaaagcggcuuaccauuauggauuuacauccuggagcuggcaaaacgaagcgcuaucugccggccaucgucagagaagcgauuaaaaggggccuccggacauugauccuggcccccacucgagugguagcagcugagauggaagaggcccucagagggcugccaauacgcuaccagaccccugcuauuagggcagagcacacaggacgugaaaucguggaccuuaugugucaugccaccuucacuaugcggcuguugucacccaucagaguuccaaacuauaaucuaauuaucauggaugaggcccacuuuaccgacccugcuuccauugcggcaagggguuacauaaguacacgcgucgaaaugggcgaggccgcugggaucuucaugacggccacucccccaggaucucgagacccguuuccucagagcaacgcacccauuauggaugaggaaagagagaucccagaacgguccuggaauucaggccacgagugggugaccgacuucaaggguaagacagugugguuuguccccucuaucaaagccgggaacgauauugcugcgugccugaggaagaauggaaaaaagguaauacaacucagccgcaaaaccuucgacagugaauauaucaagacucguacaaacgauugggacuuugugguuaccacggauauuuccgagaugggcgccaauuucaaggcagagagagugaucgacccucggagguguaugaaaccagucauuuuaacugauggcgaagagcgcgugauccuggcugggcccaugccuguuacacauagcucugccgcacagcgaagaggacggguggguaggaacccgaagaaugaaaacgaccaguacauauacaugggcgagccacuugaaaaugaugaggacugcgcccacuggaaagaggcuaagaugcugcucgacaacaucaacacccccgaagggauuaucccuucaauguuugagcccgaacgcgagaaagucgaugccauugacggagaauauagauugaggggcgaggcgcggaagaccuucguggaucugaugcgucgcggugaccucccaguauggcuggcauaccgaguggccgcugaggggaucaauuaugccgauagaaggugguguuuugacggcguuaaaaacaaucaaauacuugaagagaacgucgaaguggagauuuggacuaaggagggagaacggaagaaacuaaagccucgcuggcuggaugcuagaaucuacuccgaccccuuggcauuaaaagaguucaaggaauucgccgcuggcaggaaaagucugacacucaaucugauuaccgagauggggcggcuuccaacauuuaugacucagaaggccaagaacgcacuggauaaucucgcgguguugcauacggccgaagcuggaggucgagccuauaaccacgcacugagcgagcuaccugagacccuggaaacacuccuucuguuaacuuugcuggcuaccgucacaggcgggaucuuccucuuucugaugucgggaaaaggcauagguaagaugacccuugggaugugcugcaucauuacugccucuauccugcucugguacgcacagauucagccgcacuggaucgccgcuuccauaauuuuggaguucuuucugaucguuuuacuaauccccgaaccagagaaacaaagaacgccucaggacaaucagcugaccuaugugguaauugcgauccucacaguggucgccgcaacuauggcuaacgaaaugggcuuccuugagaagaccaaaaaggauuuuggacugggcagcauaacaacccagcaacccgagucaaauauuuuggacaucgaucugcgcccagccagugccuggacucucuacgcaguggcuacaacguucauuaccccuaugcugaggcauucuaucgaaaacuccagcguuaaugugucacuuacugccauagcgaaccaggcuacaguccucauggggcugggaaaggguuggcccuugaguaaaauggacaucggcguaccgcuguuagccauuggguguuacagccaggugaauccaaucacccuaaccgcagcccugcuccuucugguugcucacuaugcaauuaucggaccuggcuugcaggccaaggcgacacgggaggcucaaaaacgugccgcagccgguauuaugaagaaccccacuguggacgggaugacggucaucgaucuggacccaauacccuacgauccuaaauuugaaaagcagcucggccaggugaugcugcuugucuuaugcgugacccagguucugaugaugagaacaacuugggcucucugugaggccuugacccuggcaacaggaccgauuuccacccuaugggaaggcaaucccgggagguucuggaacacuacgaucgcugugucuauggccaacaucuuucgcggaagcuaucuggcgggcgccggucuccuuuucuccauuaugaagaauacagcaaacacccggcgagggacuggaaauaccggcgagacacugggugagaaauggaagaacagauugaaugcucugggcaaaucagaauuucaaauauacaagaaaucugggauccaggagguagacaggacucucgccaaggaaggaauuaaacgcggcgagaccgaucaucacgcagugagucgggggucggcuaagcugagaugguucgucgagcguaacuuaguuacaccagaaggaaagguggucgaccuuggcugcgguagggggggauggagcuauuacuguggcggucugaaaaaugugaaggagguaaaaggccucacgaaggggggaccuggccaugaagagcccaucccuauguccaccuauggguggaaccuagugcggcugcagucuggaguugauguguucuuuacuccacccgaaaaaugcgacacauugcugugugauauuggcgagucaagcccuaauccaaccgucgaggccggucgcacucuccgagugcuuaaccuggucgaaaauugguugaacaauaacacacaauucugcaucaaggugcugaaucccuacaugccguccguuauagagaagauggaagcccuccagagaaaauacgggggagcguuaguaaggaacccucugagucggaacucuacccacgagauguauugggugagcaaugcuucaggcaacaucgucuccagugugaauaugauuagccgcaugcuuaucaacagauuuacgaugaggcacaagaaagcaaccuacgaaccagacguugaucugggcucugggacacgaaauauuggaaucgaguccgagacucccaaccuagacauaauugguaagcggaucgaaaaaaucaagcaggagcaugaaaccucauggcacuaugaucaggaccauccuuacaagacaugggccuaucacggcagcuacgagacuaaacaaaccgggucggcuucuaguauggugaauggagucgugcgucuccugacaaagccaugggacguaauucccauggugacccagauggccaugacugauacgacaccguucggccagcagagaguuuuuaaagaaaaggucgacacccgcacucaagagccuaaagaggguaccaagaaguugaugaaaauaacagcagaauggcuguggaaggagcucgggaaaaagaaaacgcccaggauguguacccgggaagaguucacuagaaaggugcgcuccaacgccgcucuuggagcgaucuuuacagaugagaauaaauggaagagcgccagggaagcaguggaggacucaggcuucugggaacuggucgauaaggagcgaaacuuacaccuggaaggcaaaugcgagaccuguguuuauaauaugauggggaagcgggagaaaaaguugggagaauuugguaaagcuaagggcuccagagccauuugguacauguggcucggggcaagguuccuggaguuugaagcccuaggauuccuuaacgaggaccauugguuuucucgcgaaaauagccugaguggcguggagggugaggggcuccacaagcugggauacaucuugcgugauguauccaaaaaggaaggcggcgcuauguaugccgacgauacugcggggugggacacacggauuacccuggaggaucucaaaaacgaagagauggugacaaaucauauggaaggagagcacaagaaacuugcagaggccaucuucaagcugacuuaccagaacaaggucgugagaguucagaggccaaccccucgcgguacggugauggacauaaucagccgacgggaccagagaggcucugggcaagucgugaccuauggauuaaacacauucacuaauauggaagcucagcugauuaggcagauggagggcgaagguguauuuaaaucaauccaacaguugaccguuaaggaggagauugccgugaaaaacuggcucauccgcgucgggagagaacggcugaguaggauggcaauuuccggagaugacugcguggugaagccccuagaugaccguuucgcuagcgcccuuacagcucugaaugauaugggcaaaguccgaaaggacauacagcagugggagccaucucgcggcuggaacgauuggacucaaguucccuuuugcucgcaucacuuccacgaacucaucaugaaggacgggagagugcugguagugccuugucggaaucaggaugaguugauuggaagggcccgcaucucacagggugcaggcuggagcuuaagagaaaccgcgugccuggggaaauccuacgcccagauguggagucucauguauuuucaucggagggaccuucgacuggcugccaacgcaaucuguucugcugucccaagccacuggauuccgacgucccguacaaccuggucaauacaugccacucacgaguggaugacaaccgaggauaugcuaacuguguggaauagaguuuggauccaagaaaaccccuggauggaggacaagaccccuguggaaaguugggaggaaauuccauaccugggaaaacgcgaggaucaguggugcggcucucucaucgguuugacaagccgggcaacgugggccaagaauauucagaccgcgaucaaccaggucaggucccugauagggaaugaggaauauacugacuacaugcccucaaugaaaagauuccgccgggaggaagaggaagcuggagugcuuugguga

SEQ ID NO: 14344 - RNA, 9876 nt, Artificial Sequence
  derived and/or modified CDS sequence (opt3) from DENV-2__KM279528__SS-prME
accgccggcaucauuauaaugaugauccccacagugauggcuuuccaccugacuacgaggaacggggaaccucauaugauugucagcaggcaggaaaagggaaaaucccuccuuuuuaagaccgaaaaugguguuaacaugugcacacugauggcaauggacuugggcgaauuaugugaagauacuaucaccuacaauugcccacugcuacggcaaaacgaaccggaagacauugauuguuggugcaauucuacaucaaccugggugacuuaugggacauguaccgccacgggagagcaccgccgagaaaaacguaguguugcgcucgugccccaugucggcaugggucuggagacuaggaccgaaacauggaugagcuccgagggggcuuggaagcacgcccagaggaucgagacuuggauacuucggcauccuggauucaccaucauggcagccauucuggcuuacacaaucggcaccacguauuuucagcgcguguugauuuucauccuccugacugcaguuacaccaucuauggccaugagaugcauaggcauuucgaacagggacuuuguggaaggggucucaggagguagcuggguggauaucguacuggagcacggcaguuguguuaccacuauggcuaaaaauaagcccacacucgacuucgaauuaauuaagaccgaggccaaacaccuggcgacgcuucggaaguacugcguggaagcaaaauugaccaacacaacuaccgccucccgcuguccuacacagggggagccaucucugaaugaggaacaagauaagcgauuugucugcaaacauagcaugguggacagaggauggggcaacgguugugggcuauucggaaagggcggcaucgugacuugcgcuauguuuaccugcaagaaaaauauggaggggaaggucguucagcccgaaaaccucgaguauacaaucgugauuaccccucacuccggagaagagaaugccguagguaacgauacuggcaaacaugggaaggagauaaaagugacgccacagucaaguaucacagaagcagagcugaccggauacggcacugucaccauggaauguagcccgaggacaggucuugacuucaaugagauggugcuguugcagauggaaaacaaggcuuggcucguucaccggcaaugguuucuggauuuaccccugccuuggcucccaggggccgacacccagggcucuaacuggauucagaaagagacucuugugacauucaagaauccccacgcgaagaaacaggaugucgugguacugggaucccaagagggcgccaugcauacggcauugaccggggcuacugaaauccagaugucaagcggaaaccuacuguuuacaggucaccucaagugccgucugcgcauggacaaacuucagcugaagggcaugaguuauucuauguguaccgggaaauucaagguugugaaggagauagccgaaacacaacauggaacuauugucaucagagugcaguacgagggcgacgguuccccuugcaaaaucccauucgagauuauggauuuggaaaagaggcacguccucgggcggcugaucaccgugaaucccauuguuacggagaaagacagcccggugaacauagaagcugagccucccuuuggcgauucguacaucauuaucggaguagaaccaggccaguuaaagcugucuugguucaaaaagggguccucaaucggacagauguuugagaccacaaugcgaggugccaagcgcauggcaauucuaggcgacacugccugggauuucgggagucucggaggcgucuuuaccagcauagguaaagcucugcaucaaguguucggggcgaucuauggcgcagccuuuuccggaguuucuuggacaaugaagauucuuaucggcguggucauuacuuggaucgggaugaauagcagaucaaccaguuuguccgugagccugguacucgugggaguugucacgcuguaccuuggcgugauggugcaggcugacucugguugugucguuucauggaaaaacaaggagcugaaaugcgggaguggaauauucaucacagauaaugugcacaccuggacugaacaguauaaguuucagccugagagccccuccaaguuggccucugcaauucaaaaagcccacgaagagggcaucugugguauuaggucggugacacggcucgaaaaccugauguggaagcagaucaccccagaguuaaaucauauacugacugagaacgaaguaaaacuaaccauuaugacaggcgacaucaaggggauuaugcaggcuggaaaacgcagccucagaccccagccuacggagcugaaguacuccuggaaagccuggggcaaggcaaagaugcuuucaaccgaauugcacaaucauacuuuccugaucgaugggccagagacagcggaaugcccgaacaccaauagggcuuggaacagucucgaggucgaggacuauggauuuggcguguucacaacuaauauauggcugaaauuaaaggaacgucaagauguauuuugugacucuaaacugaugagcgccgcaaucaaggacaaccgggccgugcacgcugauauggguuacuggauugaguccgcccuuaacgacaccuggaaaaucgaaaaggcaucauucauugaggucaagagcugccacuggcccaaaucucauacguugugguccaauggggugcucgagagugaaaugaucauaccuaagaacuucgcuggaccaguuagccagcacaauuaucgacccggcuaccauacacagaccgccgguccuuggcaccugggcagacuagagauggauuuugacuucugugaagggacuaccgugguagucacagaggauugcggaaacaggggcccaucucugcgcacuaccacagcguccgggaaacucauuacggaauggugcugucggucaugcacccugcccccgcuuagauacaggggagaggacggcuguugguaugguauggagauccgcccuuugaaggaaaaagaggaaaaucuggugaacaguuuagugacugccgggcauggacagaucgauaauuuuagccucggcguccuggguauggcucuuuuccuggaggaaauguugcgaacacggguuggcaccaagcacgcaauucuccugguggccguaucguuugugacucuaaucacagggaacauguccuuccgugaccugggaagagucauggugaugguuggcgcuaccaugacggaugacauugggaugggagugacuuaccucgcccugcuugcagcguuuaaggucaggccaaccuucgccgcuggcuugcuguuacgcaaacucacaucuaaggagcugaugaugaccacuauagguaucgugcuucugagccaaucaacaauucccaaaaguauccuagagcucaccgaugcccuggcauuggggaugaugguucugaagauugugcggaauauggaaaaauaucaguuagcugucacaaucauggccauacucugcguaccuaacgcagugauccugcagaaugccuggaagguuuccuguacuacccuugcuguggucucugugagcccccuguugcucacguccucacaacagaaggcggacuggauuccacuggcccuaacaaucaaaggacugaacccuaccgcaauuuuucuuacuacccucagcagaacaaguaagaaaaggucuuggccccugaaugaggcuaucauggccguaggcaugguguccauauuggccagcucgcuguuaaagaacgauauuccaaugacuggcccgcucgucgcugggggacugcuuaccguuugcuacgugcugacgggucgaucagcagacuuggaacucgagcgcgccgcggacgugcggugggaagaacaggcugagaucucuggcaguuccccuauccugagcauuacaauaucugaagaugggagcauguccaucaaaaaugaggaagaggagcagacccuaacuauucugaucagaacaggacuucucgucauuucaggccuguuccccgugaguaucccaauaaccgccgcagccugguauuugugggaaguuaagaaacaaagggcugguguauuaugggacgugcccagcccuccacccgucgggaaggcagagcuggaagauggagccuaccguaucaagcagaaaggcauucucggcuauucucagaucggggcgggaguguacaaggaggguacuuuucacacaauguggcauguuacccgcggcgcugugcugaugcacaaagggaagcggauugaaccuuccugggccgacgucaaaaaggaucuuaucucauacggaggcgguuggaagcuggagggggaguggaaagaaggagaggaagugcagguauuggcacuagagccgggcaagaacccaagagccguccaaacgaaacccggccuguucaagacuaacaccgggacaauaggagcugugagucucgacuuuagcccugguaccuccggcucuccaauuguugauaaaaaggggaagguggucggacuguauggcaauggugugguuacaaggucggggacuuacgugagcgccaucgcacagaccgaaaaaucaaucgaggacaaccccgagauugaagaugacaucuuccgaaagaaacggcuuacgauaauggauuuacauccuggagcuggcaagacaaaacgcuaucugccggccauugucagagaggcgaucaagaggggccuccggacuuugauucuggcccccacccgagugguagcagcugaaauggaggaagcccucagagggcugccaauccgcuaccagaccccugcuauaagggcagagcacacaggacgugagauuguggaccuuaugugucaugccacuuucaccaugcggcuguugucccccaucagaguuccaaauuauaaccuaaucauuauggaugaagcccacuuuacagacccugcuaguaucgcggcaagggguuacauuucuacgcgcgucgagaugggcgaagccgcugggauauucaugacugccacacccccaggaagccgagacccguuuccucaguccaaugcacccaucauggaugaggagagagaaauuccagagcggucauggaacucuggccacgaaugggugacagacuucaaggguaaaaccgugugguuuguccccagcaucaaggccgggaaugauaucgcugcgugccugaggaaaaacggaaagaaaguaauucaacucagucgcaagacuuucgacuccgaguauauaaagacacguaccaaugauugggacuuugugguuacgacugauaucagcgaaaugggcgccaacuucaaagcagagagagugauugacccucggagguguaugaagccagucaucuuaacagauggcgaggaacgcgugauucuggcugggcccaugccuguuacccauucuucagccgcacagcgaagaggacggguggguaggaauccgaaaaacgagaaugaccaguacaucuacaugggcgaaccacuugagaacgaugaagacugcgcccacuggaaggaggcuaaaaugcugcucgacaauauaaacacccccgaggggaucauuccuuccauguuugaacccgagcgcgaaaaggucgaugccaucgacggagaguauagauugaggggcgaagcgcggaaaacuuucguggaucugaugcgucgcggugaccucccaguauggcuggcauaccgaguggccgcugaggggauuaacuaugccgauagaaggugguguuuugacggcguuaagaauaaccaaauccuugaggaaaaugucgagguggaaauauggacaaaggagggagagcggaaaaagcuaaaaccucgcuggcuggaugcuagaauuuacagugaccccuuggcauuaaaggaguucaaagaguucgccgcuggcagaaagagccugacccucaaccugaucacagaaauggggcggcuuccaacuuuuaugacgcagaaggccaaaaaugcacuggauaaccucgcgguguugcauaccgccgaggcuggaggucgagccuauaaucacgcacugucggaacuaccugagacacuggagacucuccuucuguuaaccuugcuggcuacagucaccggcgggauuuuccucuuucugaugucuggaaagggcaucgguaaaaugacucuugggaugugcugcauaaucacggccuccauucugcucugguacgcacagauccagccgcacuggauugccgcuagcaucauauuggaguucuuucugauuguuuuacuaauccccgagccagaaaagcaaagaaccccucaggacaaccagcugacauaugugguaaucgcgauucucacuguggucgccgcaaccauggcuaaugagaugggcuuccuugagaagaccaagaaggauuuuggacugggcucaaucaccacucagcaacccgagaguaacauauuggacauugaucugcgcccagccucugccuggacacucuacgcaguggcuacgaccuucaucacuccuaugcugaggcauuccauugagaauagcucaguuaacgugagucuuacagccaucgcgaaucaggcuaccguccucauggggcugggaaaagguuggcccuugagcaagauggacauaggcguaccgcuguuagccaucggguguuacucccaggugaacccaauuacccuaacagcagcccugcuccuucugguugcucacuaugcaaucauuggaccuggcuugcaggccaaagcgacucgggaagcucaaaagcgugccgcagccgguaucaugaaaaaucccacgguggacgggaugaccgucauugaucuggacccaauccccuacgauccuaaguuugagaagcagcucggccaggugaugcugcuugucuuaugcgugacacagguucugaugaugagaacuaccugggcucucugugaagccuugacacuggcaaccggaccgauaucuacucuaugggagggcaaccccgggagguucuggaauacgacaauugcugugagcauggccaacaucuuucgcggauccuaucuggcgggcgccggucuccuuuucucaaucaugaaaaacaccgcaaauacucggcgagggaccggaaacacaggcgaaacucugggugagaaguggaaaaauagauugaacgcucugggcaagucugaguuucaaauuuacaaaaagagugggauacaggaaguagacaggacccucgccaaagagggaaucaagcgcggcgaaacagaucaucacgcagugucgcgggggagcgcuaagcugagaugguucgucgagcguaauuuaguuacgccagagggaaaaguggucgaccuuggcugcgguagagggggaugguccuauuacuguggcggucugaagaacgugaaagaaguaaagggccucaccaaagggggaccuggccaugaggaacccauuccuaugucuacuuauggguggaaucuagugcggcugcagucaggaguugauguguucuuuacaccacccgagaagugcgacaccuugcugugugauaucggcgaaagcuccccuaacccaacugucgaggccggucgcacacuccgagugcuuaaucuggucgagaacugguugaauaacaauacccaauucugcauuaaggugcugaaccccuacaugccgaguguuaucgagaaaauggaggcccuccagagaaaguacgggggagcguuaguaaggaauccucugucucggaacagcacgcacgaaauguauugggugucaaacgcuuccggcaauauagucaguagcgugaacaugaucucucgcaugcuuauuaauagauuuaccaugaggcacaaaaaggcaacauacgagccagacguugaucugggcuccgggacucgaaacaucggaauugaaucagagacccccaaucuagacaucauagguaaacggauugagaagaucaagcaggaacaugagacaagcuggcacuaugaucaggaccauccuuacaaaacuugggccuaucacggcucguacgaaaccaagcaaacagggucugcuaguuccauggugaacggagucgugcgucuccugaccaaaccaugggacguaauccccauggugacucagauggccaugacggauacaaccccguucggccagcagagaguuuuuaaggagaaagucgacacucgcacccaagaaccuaaggaggguacaaagaaauugaugaagauuacggcagaguggcuguggaaagaacucgggaagaaaaagacccccaggauguguacucgggaggaguucacaagaaaagugcgcagcaaugccgcucuuggagcgauauuuaccgaugagaacaaguggaagucagccagggaggcaguggaagacuccggcuucugggagcuggucgauaaagaacgaaauuuacaccuggagggcaagugcgaaacuuguguuuauaacaugauggggaaacgggagaagaaauugggagaguuugguaaggcuaagggcucuagagccaucugguacauguggcucggggcaagguuccuggaauuugaggcccuaggauuccuuaaugaagaccauugguuuagccgcgagaacagucuguccggcguggaaggugaggggcuccacaaacugggauacauuuugcgugauguaagcaagaaagagggcggcgcuauguaugccgacgauacagcggggugggacacccggaucacacuggaagaucucaagaaugaggaaauggugacuaaccauauggagggagaacacaagaaacuugcagaggccauuuucaaacugaccuaccagaauaaagucgugagaguucagaggccaacgccucgcgguaccgugauggacaucauaucucgacgggaccagagaggcucagggcaagucgugacauauggauuaaacacuuucaccaacauggaggcucagcugaucaggcagauggaaggcgaggguguauuuaagaguauucaacaguugacaguuaaagaagagaucgccgugaagaauuggcucauucgcgucgggagagagcggcuguccaggauggcaaucagcggagaugacugcguggugaaaccccuagaugaccguuucgcuucugcccuuacugcucugaacgauaugggcaagguccgaaaggacauucagcagugggaaccaucgcgcggcuggaaugauuggacccaaguucccuuuugcucacaucacuuccacgagcucauaaugaaagacgggagagugcugguagugccuugucggaaccaggaugaauugaucggaagggcccgcauuagccagggugcaggcugguccuuaagagagacggcgugccuggggaagaguuacgcccagauguggucucucauguauuuucaucggagggaccuucgacuggcugccaaugcaaucuguagcgcugucccaucccacuggaucccgacaucacguaccacuuggaguauucaugccacacacgaauggaugaccacugaggauaugcuaaccguguggaacagaguuuggauacaagagaaucccuggauggaagacaaaacaccuguggagucuugggaagagaucccauaccugggaaagcgcgaagaucaguggugcggcagccucauugguuugacgucccgggcaaccugggccaaaaacauccagacugcgauuaaucaggucaggucacugaucgggaacgaggaguauacagacuacaugcccagcaugaagagauuccgccgggaagaggaagaggcuggagugcuuugguga

SEQ ID NO: 14345 - RNA, 9876 nt, Artificial Sequence
  derived and/or modified CDS sequence (opt3) from DENV-2__KM279533__SS-prME
accgccggaaucauuauaaugaugauccccacagugauggcuuuccaccugacuacgcgaaacggggagccucauaugauugucagcaggcaggaaaagggaaaaucccuccuuuuuaagaccgagaaugguguuaacaugugcacacugauggcaauggacuugggcgaauuaugugaggauacuaucaccuacaauugcccacuguuacggcaaaacgaaccggaggacauugauuguuggugcaauucuacaucaaccugggugacuuaugggacauguaccgccacgggagagcaccgccgagaaaaacguaguguugcgcucgugccccaugucggcaugggucuggagacuagaaccgaaacauggaugagcuccgagggggcuuggaagcacgcccagaggaucgagacuuggauacuucggcauccuggauucaccaucauggcagccauucuggcuuacacaaucggcaccacguauuuucagcgcguguugauuuucauccuccugacugcaguuacaccaucuauggccaugaggugcauaggcauuucgaacagggacuuuguggaaggggucucaggagguagcuggguggauaucguacuggagcacggcaguuguguuaccacuauggcuaaaaauaagcccacacucgacuucgaauuaauuaagaccgaggccaaacaccuggcgacgcuucggaaguacugcguggaagcaaaauugaccaacacaacuaccgccucccgcuguccuacacagggggagccaucucugaaugaggaacaagauaagcgauuugucugcaaacauagcaugguggacagaggauggggcaacgguugugggcuauucggaaagggcggcaucgugacuugcgcuauguuuaccugcaagaaaaauauggaggggaaggucguucagcccgaaaaccucgaguauacaaucgugauuaccccucacuccggagaagagaaugccguagguaacgauacuggcaaacaugggaaggagauaaaagugacgccacagucaaguaucacagaagcagagcugaccggauacggcacugucaccauggaauguagcccgaggacaggucuugacuucaaugagauggugcuguugcagauggaaaacaaggcuuggcucguucaccggcaaugguuucuggauuuaccccugccuuggcucccaggggccgacacccagggcucuaacuggauucagaaagagacucuugugacauucaagaauccccacgcgaagaaacaggaugucgugguacugggaucccaagagggcgccaugcauacggcauugaccggggcuacugaaauccagaugucaagcggaaaccuacuguuuacaggucaccucaagugccgucugcgcauggacaaacuucagcugaagggcaugaguuauucuauguguaccgggaaauucaagguugugaaggagauagccgaaacacaacauggaacuauugucaucagagugcaguacgagggcgacgguuccccuugcaaaaucccauucgagauuauggauuuggaaaagaggcacguccucgggcggcugaucaccgugaaucccauuguuacggagaaagacagcccggugaacauagaagcugagccucccuuuggcgauucguacaucauuaucggaguagaaccaggccaguuaaagcugucuugguucaaaaagggguccucaaucggacagauguuugagaccacaaugcgaggugccaagcgcauggcaauucuaggcgacacugccugggauuucgggagucucggaggcgucuuuaccagcauagguaaagcucugcaucaaguguucggggcgaucuauggcgcagccuuuuccggaguuucuuggacaaugaagauucuuaucggcguggucauuacuuggaucgggaugaauagcagaucaaccaguuuguccgugagccugguacucgugggaguugucacgcuguaccuuggcgugauggugcaggcugacucugguugugucguuucauggaaaaacaaggagcugaaaugcgggaguggaauauucaucacagauaaugugcacaccuggacugaacaguauaaguuucagccugagagccccuccaaguuggccucugcaauucaaaaagcccacgaagagggcaucugugguauuaggucggugacacggcucgaaaaccugauguggaagcagaucaccccagaguuaaaucauauacugacugagaacgaaguaaaacuaaccauuaugacaggcgacaucaaggggauuaugcaggcuggaaaacgcagccucagaccccagccuacggagcugaaguacuccuggaaagccuggggcaaggcaaagaugcuuucaaccgaauugcacaaucauacuuuccugaucgaugggccagagacagcggaaugcccgaacaccaauagggcuuggaacagucucgaggucgaggacuauggauuuggcguguucacaacuaauauauggcugaaauuaaaggaacgucaagauguauuuugugacucuaaacugaugagcgccgcaaucaaggacaaccgggccgugcacgcugauauggguuacuggauugaguccgcccuuaacgacaccuggaaaaucgaaaaggcaucauucauugaggucaagagcugccacuggcccaaaucucauacguugugguccaauggggugcucgagagugaaaugaucauaccuaagaacuucgcuggaccaguuagccagcacaauuaucgacccggcuaccauacacagaccgccgguccuuggcaccugggcagacuagagauggauuuugacuucugugaagggacuaccgugguagucacagaggauugcggaaacaggggcccaucucugcgcacuaccacagcguccgggaaacucauuacggaauggugcugucggucaugcacccugcccccgcuuagauacaggggagaggacggcuguugguaugguauggagauccgcccuuugaaggaaaaagaggaaaaucuggugaacaguuuagugacugccgggcauggacagaucgauaauuuuagccucggcguccuggguauggcucuuuuccuggaggaaauguugcgaacacggguuggcaccaagcacgcaauucuccugguggccguaucguuugugacucuaaucacagggaacauguccuuccgugaccugggaagagucauggugaugguuggcgcuaccaugacggaugacauugggaugggagugacuuaccucgcccugcuugcagcguuuaaggucaggccaaccuucgccgcuggcuugcuguuacgcaaacucacaucuaaggagcugaugaugaccacuauagguaucgugcuucugagccaaucaacaauucccgagaguauccuagaacucaccgaugcccuggcauuggggaugaugguucugaaaauugugcggaauauggagaaguaucaguuagcugucacaaucauggccauacucugcguaccuaacgcagugauccugcagaaugccuggaaaguuuccuguacuacccuugcuguggucucugugagcccccuguugcucacguccucacaacagaaggcggacuggauuccacuggcccuaacaaucaagggacugaacccuaccgcaauuuuucuuacuacccucagcagaacaaguaaaaagaggucuuggccccugaaugaagcuaucauggccguaggcaugguguccauauuggccagcucgcugcuaaagaacgauauuccaaugacuggcccgcucgucgcugggggacugcuuaccguuugcuacgugcugacgggucgaucagcagacuuggagcucgaacgcgccgcggacgugcggugggaggagcaggcugaaaucucuggcaguuccccuauccugagcauuacaauaucugaggaugggagcauguccaucaagaaugaagaggaggaacagacccuaacuauucugaucagaacaggacuucucgucauuucaggccuguuccccgugaguaucccaauaaccgccgcagccugguauuugugggagguuaaaaagcaaagggcugguguauuaugggacgugcccagcccuccacccgucgggaaagcagaacuggaggauggagccuaccguaucaagcagaagggcauucucggcuauucucagaucggggcgggaguguacaaagaagguacuuuucacacaauguggcauguuacccgcggcgcugugcugaugcacaaggggaaacggauugagccuuccugggccgacgucaagaaagaucuuaucucauacggaggcgguuggaagcuggagggggaauggaaggagggagaagaggugcagguauuggcacuagaaccgggcaaaaacccaagagccguccaaacgaagcccggccuguucaaaacuaacaccgggacaauaggagcugugagucucgacuuuagcccugguaccuccggcucuccaauuguugauaagaaagggaagguggucggacuguauggcaauggugugguuacaaggucggggacuuacgugagcgccaucgcacagaccgagaagucaaucgaggacaaccccgaaauugaggaugacaucuuccggaaaaagagacuuacgauaauggauuuacauccuggagcuggcaaaacaaagcgcuaucugccggccauugucagagaagcgaucaaaaggggccuccggacuuugauucuggcccccacccgagugguagcagcugagauggaagaggcccucagagggcugccaauccgcuaccagaccccugcuauaagggcagagcacaccggacgugaaauuguggaccuuaugugucaugccacuuucaccaugcggcuguugucccccaucagaguuccaaauuauaaccuaaucauuauggaugaggcccacuuuacagacccugcuaguaucgcggcaagggguuacauuucuacgcgcgucgaaaugggcgaggccgcugggauauucaugacugccacacccccaggaagccgagacccguuuccucaguccaaugcacccaucauggaugaggaaagagagauuccagaacggucauggaacucuggccacgagugggugacagacuucaaggguaagaccgugugguuuguccccagcaucaaagccgggaaugauaucgcugcgugccugaggaagaacggcaaaaagguaauucaacucagucgcaaaacuuucgacuccgaauauauaaagacacguaccaaugauugggacuuugugguuacgacugauaucagcgagaugggcgccaacuucaaggcagagagagugauugacccucggagguguaugaaaccagucaucuuaacagauggcgaagaacgcgugauucuggcugggcccaugccuguuacccauucuucagccgcacagcgaagaggacggguggguaggaauccgaagaacgaaaaugaccaguacaucuacaugggcgagccacuugaaaacgaugaggacugcgcccacuggaaagaggcuaagaugcugcucgacaauauaaacacccccgaagggaucauuccuuccauguuugagcccgaacgcgagaaagucgaugccaucgacggagaauauagauugaggggcgaggcgcggaagacuuucguggaucugaugcgucgcggugaccucccaguauggcuggcauaccgaguggccgcugaggggauuaacuaugccgauagaaggugguguuuugacggcguuaaaaauaaccaaauccuugaagagaaugucgaaguggagauauggacaaaggagggagaacggaagaaacuaaagccucgcuggcuggaugcuagaauuuacagugaccccuuggcauuaaaagaguucaaggaguucgccgcuggcaggaaaagccugacccucaaccugaucacagagauggggcggcuuccaacuuuuaugacgcagaaggccaagaaugcacuggauaaccucgcgguguugcauaccgccgaagcuggaggucgagccuauaaucacgcacugucggagcuaccugagacacuggaaacucuccuucuguuaaccuugcuggcuacagucaccggcgggauuuuccucuuucugaugucuggaaaaggcaucgguaagaugacucuugggaugugcugcauaaucacggccuccauucugcucugguacgcacagauccagccgcacuggauugccgcuagcaucauauuggaguucuuucugauuguuuuacuaauccccgaaccagagaaacaaagaaccccucaggacaaccagcugacauaugugguaaucgcgauucucacuguggucgccgcaaccauggcuaaugaaaugggcuuccuugagaagaccaaaaaggauuuuggacugggcucaaucaccacucagcaacccgagaguaacauauuggacauugaucugcgcccagccucugccuggacacucuacgcaguggcuacgaccuucaucacuccuaugcugaggcauuccauugaaaauagcucaguuaacgugagucuuacagccaucgcgaaucaggcuaccguccucauggggcugggaaaggguuggcccuugagcaaaauggacauaggcguaccgcuguuagccaucggguguuacucccaggugaacccaauuacccuaacagcagcccugcuccuucugguugcucacuaugcaaucauuggaccuggcuugcaggccaaggcgacucgggaggcucaaaaacgugccgcagccgguaucaugaagaaucccacgguggacgggaugaccgucauugaucuggacccaauccccuacgauccuaaauuugaaaagcagcucggccaggugaugcugcuugucuuaugcgugacacagguucugaugaugagaacuaccugggcucucugugaggccuugacacuggcaaccggaccgauaucuacucuaugggaaggcaaccccgggagguucuggaauacgacaauugcugugagcauggccaacaucuuucgcggauccuaucuggcgggcgccggucuccuuuucucaaucaugaagaacaccgcaaauacucggcgagggaccggaaacacaggcgagacucugggugagaaauggaagaauagauugaacgcucugggcaaaucugaauuucaaauuuacaagaaaagugggauacaggagguagacaggacccucgccaaggaaggaaucaaacgcggcgagacagaucaucacgcagugucgcgggggagcgcuaagcugagaugguucgucgagcguaauuuaguuacgccagaaggaaagguggucgaccuuggcugcgguagagggggaugguccuauuacuguggcggucugaaaaacgugaaggagguaaaaggccucaccaaagggggaccuggccaugaagaacccauuccuaugucuacuuauggguggaaucuagugcggcugcagucaggaguugauguguucuuuacaccacccgaaaaaugcgacaccuugcugugugauaucggcgagagcuccccuaacccaacugucgaggccggucgcacacuccgagugcuuaaucuggucgaaaacugguugaauaacaauacccaauucugcauuaaggugcugaaccccuacaugccgaguguuaucgagaagauggaagcccuccagagaaaauacgggggagcguuaguaaggaauccucugucucggaacagcacgcacgagauguauugggugucaaacgcuuccggcaauauagucaguagcgugaacaugaucucucgcaugcuuauuaauagauuuaccaugaggcacaagaaagcaacauacgaaccagacguugaucugggcuccgggacucgaaacaucggaauugagucagagacccccaaucuagacaucauagguaagcggauugagaaaaucaagcaggagcaugaaacaagcuggcacuaugaucaggaccauccuuacaagacuugggccuaucacggcucguacgagaccaaacaaacagggucugcuaguuccauggugaacggagucgugcgucuccugaccaagccaugggacguaauccccauggugacucagauggccaugacggauacaaccccguucggccagcagagaguuuuuaaagaaaaggucgacacucgcacccaagagccuaaagaggguacaaagaaguugaugaaaauuacggcagaauggcuguggaaggagcucgggaaaaagaaaacccccaggauguguacucgggaagaguucacaagaaaggugcgcagcaaugccgcucuuggagcgauauuuaccgaugagaacaaauggaagucagccagggaagcaguggaggacuccggcuucugggaacuggucgauaaggagcgaaauuuacaccuggaaggcaaaugcgagacuuguguuuauaacaugauggggaagcgggagaaaaaguugggagaauuugguaaagcuaagggcucuagagccaucugguacauguggcucggggcaagguuccuggaguuugaagcccuaggauuccuuaaugaggaccauugguuuagccgcgaaaacagucuguccggcguggagggugaggggcuccacaagcugggauacauuuugcgugauguaagcaaaaaggaaggcggcgcuauguaugccgacgauacagcggggugggacacccggaucacacuggaggaucucaaaaaugaagagauggugacuaaccauauggaaggagagcacaagaaacuugcagaggccauuuucaagcugaccuaccagaauaaggucgugagaguucagaggccaacgccucgcgguaccgugauggacaucauaucucgacgggaccagagaggcucagggcaagucgugacauauggauuaaacacuuucaccaacauggaagcucagcugaucaggcagauggagggcgaagguguauuuaaaaguauucaacaguugacaguuaaggaggagaucgccgugaaaaauuggcucauucgcgucgggagagaacggcuguccaggauggcaaucagcggagaugacugcguggugaagccccuagaugaccguuucgcuucugcccuuacugcucugaacgauaugggcaaaguccgaaaggacauucagcagugggagccaucgcgcggcuggaaugauuggacccaaguucccuuuugcucacaucacuuccacgaacucauaaugaaggacgggagagugcugguagugccuugucggaaccaggaugaguugaucggaagggcccgcauuagccagggugcaggcugguccuuaagagaaacggcgugccuggggaaaaguuacgcccagauguggucucucauguauuuucaucggagggaccuucgacuggcugccaaugcaaucuguagcgcugucccaucccacuggaucccgacaucacguaccacuuggaguauucaugccacacacgaguggaugaccacugagaacaugcuaaccguguggaauagaguuuggauacaagaaaaccccuggauggaggauaagacaccuguggaaucuugggaggaaaucccauaccugggaaaacgcgaggaccaguggugcggcagccucauugguuugacgucccgggcaaccugggccaagaauauccagacugcgauuaaccaggucaggucacugaucgggaaugaggaauauacagauuacaugcccagcaugaaaagauuccgccgggaggaagaggaagcuggagugcuuugguga

SEQ ID NO: 14346 - RNA, 9876 nt, Artificial Sequence
  derived and/or modified CDS sequence (opt3) from DENV-2__KM279535__SS-prME
accgccggcaucauuauaaugaugauccccacagugauggcuuuccaccugacuacgagaaacggggagccucauaugauugucagcaggcaggaaaagggaaaaucccuccuuuuuaagaccgagaaugguguuaacaugugcacacugauggcaauggacuugggcgaauuaugugaggauacuaucaccuacaauugcccacugcuacggcaaaacgaaccggaggacauugauuguuggugcaauucuacaucaaccugggugacuuaugggacauguaccgccacgggagagcaccgccgagaaaaacguaguguagcgcucgugccccaugucggcaugggucuggagacuagaaccgaaacauggaugagcuccgagggggcuuggaagcacgcccagaggaucgagacuuggauacuucggcauccuggauucaccaucauggcagccauucuggcuuacacaaucggcaccacguauuuucagcgcguguugauuuucauccuccugacugcaguuacaccaucuauggccaugagaugcauaggcauuucgaacagggacuuuguggaaggggucucaggagguagcuggguggauaucguacuggagcacggcaguuguguuaccacuauggcuaaaaauaagcccacacucgacuucgaauuaauuaagaccgaggccaaacaccuggcgacgcuucggaaguacugcguggaagcaaaauugaccaacacaacuaccgccucccgcuguccuacacagggggagccaucucugaaugaggaacaagauaagcgauuugucugcaaacauagcaugguggacagaggauggggcaacgguugugggcuauucggaaagggcggcaucgugacuugcgcuauguuuaccugcaagaaaaauauggaggggaaggucguucagcccgaaaaccucgaguauacaaucgugauuaccccucacuccggagaagagaaugccguagguaacgauacuggcaaacaugggaaggagauaaaagugacgccacagucaaguaucacagaagcagagcugaccggauacggcacugucaccauggaauguagcccgaggacaggucuugacuucaaugagauggugcuguugcagauggaaaacaaggcuuggcucguucaccggcaaugguuucuggauuuaccccugccuuggcucccaggggccgacacccagggcucuaacuggauucagaaagagacucuugugacauucaagaauccccacgcgaagaaacaggaugucgugguacugggaucccaagagggcgccaugcauacggcauugaccggggcuacugaaauccagaugucaagcggaaaccuacuguuuacaggucaccucaagugccgucugcgcauggacaaacuucagcugaagggcaugaguuauucuauguguaccgggaaauucaagguugugaaggagauagccgaaacacaacauggaacuauugucaucagagugcaguacgagggcgacgguuccccuugcaaaaucccauucgagauuauggauuuggaaaagaggcacguccucgggcggcugaucaccgugaaucccauuguuacggagaaagacagcccggugaacauagaagcugagccucccuuuggcgauucguacaucauuaucggaguagaaccaggccaguuaaagcugucuugguucaaaaagggguccucaaucggacagauguuugagaccacaaugcgaggugccaagcgcauggcaauucuaggcgacacugccugggauuucgggagucucggaggcgucuuuaccagcauagguaaagcucugcaucaaguguucggggcgaucuauggcgcagccuuuuccggaguuucuuggacaaugaagauucuuaucggcguggucauuacuuggaucgggaugaauagcagaucaaccaguuuguccgugagccugguacucgugggaguugucacgcuguaccuuggcgugauggugcaggcugacucugguugugucguuucauggaaaaacaaggagcugaaaugcgggaguggaauauucaucacagauaaugugcacaccuggacugaacaguauaaguuucagccugagagccccuccaaguuggccucugcaauucaaaaagcccacgaagagggcaucugugguauuaggucggugacacggcucgaaaaccugauguggaagcagaucaccccagaguuaaaucauauacugacugagaacgaaguaaaacuaaccauuaugacaggcgacaucaaggggauuaugcaggcuggaaaacgcagccucagaccccagccuacggagcugaaguacuccuggaaagccuggggcaaggcaaagaugcuuucaaccgaauugcacaaucauacuuuccugaucgaugggccagagacagcggaaugcccgaacaccaauagggcuuggaacagucucgaggucgaggacuauggauuuggcguguucacaacuaauauauggcugaaauuaaaggaacgucaagauguuuuuugugacucuaaacugaugagcgccgcaaucaaggacaaccgggccgugcacgcugauauggguuacuggauugaguccgcccuuaacgacaccuggaaaaucgaaaaggcaucauucauugaggucaagagcugccacuggcccaaaucucauacguugugguccaauggggugcucgagagugaaaugaucauaccuaagaacuucgcuggaccaguuagccagcacaauuaucgacccggcuaccauacacagaccgccgguccuuggcaccugggcagacuagagauggauuuugacuucugugaagggacuaccgugguagucacagaggauugcggaaacaggggcccaucucugcgcacuaccacagcguccgggaaacucauuacggaauggugcugucggucaugcacccugcccccgcuuagauacaggggagaggacggcuguugguaugguauggagauccgcccuuugaaggaaaaagaggaaaaucuggugaacaguuuagugacugccgggcauggacagaucgauaauuuuagccucggcguccuggguauggcucuuuuccuggaggaaauguugcgaacacggguuggcaccaagcacgcaauucuccugguggccguaucguuugugacucuaaucacagggaacauguccuuccgugaccugggaagagucauggugaugguuggcgcuaccaugacggaugacauugggaugggagugacuuaccucgcccugcuugcagcguuuaaggucaggccaaccuucgccgcuggcuugcuguuacgcaaacucacaucuaaggagcugaugaugaccacuauagguaucgugcuucugagccaaucaacaauucccgagaguauccuagaacucaccgaugcccuggcauuggggaugaugguucugaaaauugugcggaauauggagaaguaucaguuagcugucacaaucauggccauauccugcguaccuaacgcagugauccuccagaaugccuggaaaguuucuuguacuacccuggcuguggucagcguguccccccuucuguugacgucaagccaacagaaggcggacuggauuccacucgcccugacaaucaagggacuaaacccuaccgcaauuuuucugacuacccuuaguagaacaucuaaaaagagguccuggccccucaaugaagcuaucauggccguaggcauggugagcauacuggccucgucauugcugaaaaacgauauuccaaugacuggcccguuagucgcugggggacuccugaccguuugcuacgugcuuacgggucgaucugcagaccuggaguuggaacgcgccgcggacgugcggugggaggagcaggcugaaaucaguggcuccagcccuauccucucuauuacaauaagcgaggauggguccaugucaaucaagaaugaagaggaggaacagacccugacuauucuaaucagaacaggacugcuugucauuaguggccucuuccccgugagcaucccaauaaccgccgcagccugguaucugugggagguuaaaaagcaaagggcugguguauugugggacgugcccucuccuccacccgucgggaaagcagaauuagaggauggagccuaccguaucaagcagaagggcauucugggcuauucccagaucggggcgggaguguacaaagaagguacuuuucacacaauguggcauguuacccgcggcgcugugcucaugcacaaggggaaacggauugagccuucaugggccgacgucaagaaagaucugaucaguuacggaggcgguuggaagcuugagggggaauggaaggagggagaagaggugcagguacuggcauuggaaccgggcaaaaacccaagagccguccaaacgaagcccggccuauucaaaacuaacaccgggacaauaggagcugugagccuggacuuuuccccugguaccucuggcucgccaauuguugauaagaaagggaagguggucggacucuauggcaauggugugguuacaaggagcgggacuuacgugucagccaucgcacagaccgagaaguccaucgaggacaaccccgaaauugaggaugacaucuuccgaaaaaagcggcugacgauaauggaucuucauccuggagcuggcaaaacaaagcgcuauuuaccggccauugucagagaagcgaucaaaaggggccugcggacucucauuuuggcccccacccgagugguagcagcugagauggaagaggcccugagagggcucccaauccgcuaccagacaccugcuauaagggcagagcacaccggacgugaaauuguggaccugaugugucaugccacuuucaccaugcggcuucugagucccaucagaguuccaaauuauaacuugaucauuauggaugaggcccacuuuacagacccugcuucuaucgcggcaagggguuacauuagcacgcgcgucgaaaugggcgaggccgcugggauauucaugacugccacccccccaggaucccgagacccguuuccucagucaaaugcacccaucauggaugaggaaagagagauuccagaacggucuuggaacagcggccacgagugggugacagacuucaaggguaagaccgugugguuuguccccaguaucaaagccgggaaugauaucgcugcgugccuaaggaagaacggaaaaaagguaauucaacugucccgcaaaacuuucgacagcgaauauauaaagacacguaccaaugauugggacuuugugguuacgacugauaucucugagaugggcgccaacuucaaggcagagagagugauugacccucggagguguaugaaaccagucauccucacagauggcgaagagcgcgugauuuuagcugggcccaugccuguuacccauucauccgccgcacagcgaagaggacggguggguaggaauccgaagaacgaaaaugaccaguacaucuacaugggcgagccacuggaaaacgaugaggacugcgcccacuggaaagaggcuaagaugcuucuggacaauauaaacacccccgaagggaucauuccuaguauguuugagcccgaacgcgagaaagucgaugccaucgacggagaauauagacucaggggcgaggcgcggaagacuuucguggauuugaugcgucgcggugaccugccaguauggcucgcauaccgaguggccgcugaggggauuaacuaugccgauagaaggugguguuuugacggcguuaaaaauaaccaaauccuggaagagaaugucgaaguggagauauggacaaaggagggagaacggaagaaacuuaagccucgcuggcuagaugcuagaauuuacagcgacccccuggcauugaaagaguucaaggaauucgccgcuggcaggaaaucguuaacccugaaccucaucacagagauggggcggcugccaacuuuuaugacgcagaaggccaagaaugcacuugauaaccuggcggugcuccauaccgccgaagcuggaggucgagccuauaaucacgcauugucugagcugccugagacacuagaaacucugcuccuucugaccuuauuggcuacagucaccggcgggauuuuccuguuucucauguccggaaaaggcaucgguaagaugacucuggggaugugcugcauaaucacggccagcauucuucugugguacgcacagauccagccgcacuggauugccgcuucaaucauacucgaguucuuuuugauuguucuguuaauccccgaaccagagaaacaaagaaccccucaggacaaccagcuaacauaugugguaaucgcgauucugacuguggucgccgcaaccauggcuaaugaaaugggcuuccucgagaagacaaaaaaggauuuuggacuuggcaguaucaccacucagcaacccgagucuaacauacuggacauugauuugcgcccagccuccgccuggacacuguacgcaguggcuacgaccuucaucacuccuaugcucaggcauagcauugaaaauucaaguguuaacgugagccugacagccaucgcgaaucaggcuaccguccuuauggggcucggaaaggguuggccccuguccaaaauggacauaggcguaccguugcuggccaucggguguuacucucaggugaacccaauuaccuuaacagcagcccuacugcuccuuguugcucacuaugcaaucauuggaccuggccugcaggccaaggcgacucgggaggcucaaaaacgugccgcagccgguaucaugaagaaucccacgguggacgggaugaccgucauugauuuggacccaauccccuacgauccuaaauuugaaaagcagcugggccaggugaugcuccugguccuuugcgugacacagguuuuaaugaugagaacuaccugggcucugugugaggcccucacauuggcaaccggaccgauaagcacucugugggaaggcaaccccgggagguucuggaauacgacaauugcuguguccauggccaacaucuuucgcggaucauaucuagcgggcgccggucugcucuucucuaucaugaagaacaccgcaaauacucggcgagggaccggaaacacaggcgagacucuuggugagaaauggaagaauagacugaacgcuuugggcaaaagugaauuucaaauuuacaagaaaucggggauacaggagguagacaggacccuggccaaggaaggaaucaaacgcggcgagacagaucaucacgcagugagccggggguccgcuaagcucagaugguucgucgagcguaaucugguuacgccagaaggaaagguggucgacuuaggcugcgguagggggggauggucuuauuacuguggcggucuuaaaaacgugaaggagguaaaaggccugaccaaggggggaccuggccaugaagagcccauuccuaugucaacuuauggguggaaucucgugcggcuacagagcggaguugauguguucuuuacaccacccgaaaaaugcgacacccuguugugugauaucggcgaguccaguccuaacccaacugucgaggccggucgcacacugcgagugcucaaucuugucgaaaacuggcugaauaacaauacccaauucugcauuaagguguugaaccccuacaugccgucuguuaucgagaagauggaagcccugcagagaaaauacgggggagcgcucguaaggaauccuuuaagccggaacucaacgcacgagauguauuggguguccaacgcuaguggcaauauagucagcucugugaacaugaucucccgcaugcugauuaauagauuuaccaugaggcacaagaaagcaacauacgaaccagacguugaucuuggcucagggacucgaaacaucggaauugagagcgagacccccaaucuggacaucauagguaagcggauugaaaaaaucaagcaggagcaugaaacaucguggcacuaugaucaggaccauccuuacaagacuugggccuaucacggcucuuacgagaccaaacaaacagggagugcuuccagcauggugaacggagucgugcgucuacucaccaagccaugggacguaauccccauggugacucagauggccaugacggauacaaccccguucggccagcagagaguuuuuaaagaaaaggucgacacucgcacccaagagccuaaagaggguacaaagaagcugaugaaaauuacggcagaaugguuguggaaggagcuggggaaaaagaaaacccccaggauguguacucgggaagaguucacaagaaaggugcgcucaaaugccgcucucggagcgauauuuaccgaugagaacaaauggaaguccgccagggaagcaguggaggacucuggcuucugggaacuugucgauaaggagcgaaaucugcacuuagaaggcaaaugcgagacuuguguuuauaacaugauggggaagcgggagaaaaagcugggagaauuugguaaagcuaagggcagcagagccaucugguacaugugguugggggcaagguuccucgaguuugaagcccugggauuccuaaaugaggaccauugguuuagucgcgaaaacucccuuagcggcguggagggugaggggcugcacaagcucggauacauucugcgugauguaucuaaaaaggaaggcggcgcuauguaugccgacgauacagcggggugggacacccggaucacauuggaggaucugaaaaaugaagagauggugacuaaccauauggaaggagagcacaagaaacucgcagaggccauuuucaagcuuaccuaccagaauaaggucgugagaguucagaggccaacgccucgcgguaccgugauggacaucauaucacgacgggaccagagaggcagugggcaagucgugacauauggacugaacacuuucaccaacauggaagcucaguuaaucaggcagauggagggcgaagguguauuuaaauccauucaacagcugacaguuaaggaggagaucgccgugaaaaauugguugauucgcgucgggagagaacggcucagcaggauggcaaucucuggagaugacugcguggugaagccccuggaugaccguuucgcuucggcccuaacugcucuuaacgauaugggcaaaguccgaaaggacauucagcagugggagccaucacgcggcuggaaugauuggacccaaguucccuuuugcagccaucacuuccacgaacugauaaugaaggacgggagagugcucguagugccuugucggaaccaggaugagcugaucggaagggcccgcauuucccagggugcaggcuggaguuugagagaaacggcgugcuuagggaaaucuuacgcccagauguggagccugauguauuuucaucggagggaccuccgacuugcugccaaugcaaucuguuccgcugucccaucacacuggaucccgacaagucguaccacuuggucuauucaugccacacacgaguggaugaccacugaggauaugcugaccguguggaacagaguuuggauacaagaaaaucccuggauggaggacaagacaccuguggaaagcugggaggaaaucccauaccuaggaaaacgcgaggaucaguggugcggcucccugauuggucucacgucacgggcaaccugggccaagaacauccagacugcgauuaaucaggucaggagcuugaucgggaacgaggaauauacagacuacaugcccucuaugaaaagauuccgccgggaggaagaggaagcuggagugcugugguga

SEQ ID NO: 14347 - RNA, 9876 nt, Artificial Sequence
  derived and/or modified CDS sequence (opt3) from DENV-2__KM279539__SS-prME
accgccggcaucauuauaaugaugauccccacagugauggcuuuccaccugacuacgaggaacggggaaccucauaugauugucagcaggcaggaaaagggaaaaucccuccuuuuuaagaccgaaaaugguguuaacaugugcacacugauggcaauggacuugggcgaauuaugugaggauacuaucaccuacaauugcccacuguuacggcaaaacgaaccggaggacauugauuguuggugcaauucuacaucaaccugggugacuuaugggacauguaccgccacgggagagcaccgccgagaaaaacguaguguugcgcucgugccccaugucggcaugggucuggagacuaggaccgaaacauggaugagcuccgagggggcuuggaagcacgcccagaggaucgagacuuggauacuucggcauccuggauucaccaucauggcagccauucuggcuuacacaaucggcaccacguauuuucagcgcguguugauuuucauccuccugacugcaguuacaccaucuauggccaugagaugcauaggcauuucgaacagggacuuuguggaaggggucucaggagguagcuggguggauaucguacuggagcacggcaguuguguuaccacuauggcuaaaaauaagcccacacucgacuucgaauuaauuaagaccgaggccaaacaccuggcgacgcuucggaaguacugcguggaagcaaaauugaccaacacaacuaccgccucccgcuguccuacacagggggagccaucucugaaugaggaacaagauaagcgauuugucugcaaacauagcaugguggacagaggauggggcaacgguugugggcuauucggaaagggcggcaucgugacuugcgcuauguuuaccugcaagaaaaauauggaggggaaggucguucagcccgaaaaccucgaguauacaaucgugauuaccccucacuccggagaagagaaugccguagguaacgauacuggcaaacaugggaaggagauaaaagugacgccacagucaaguaucacagaagcagagcugaccggauacggcacugucaccauggaauguagcccgaggacaggucuugacuucaaugagauggugcuguugcagauggaaaacaaggcuuggcucguucaccggcaaugguuucuggauuuaccccugccuuggcucccaggggccgacacccagggcucuaacuggauucagaaagagacucuugugacauucaagaauccccacgcgaagaaacaggaugucgugguacugggaucccaagagggcgccaugcauacggcauugaccggggcuacugaaauccagaugucaagcggaaaccuacuguuuacaggucaccucaagugccgucugcgcauggacaaacuucagcugaagggcaugaguuauucuauguguaccgggaaauucaagguugugaaggagauagccgaaacacaacauggaacuauugucaucagagugcaguacgagggcgacgguuccccuugcaaaaucccauucgagauuauggauuuggaaaagaggcacguccucgggcggcugaucaccgugaaucccauuguuacggagaaagacagcccggugaacauagaagcugagccucccuuuggcgauucguacaucauuaucggaguagaaccaggccaguuaaagcugucuugguucaaaaagggguccucaaucggacagauguuugagaccacaaugcgaggugccaagcgcauggcaauucuaggcgacacugccugggauuucgggagucucggaggcgucuuuaccagcauagguaaagcucugcaucaaguguucggggcgaucuauggcgcagccuuuuccggaguuucuuggacaaugaagauucuuaucggcguggucauuacuuggaucgggaugaauagcagaucaaccaguuuguccgugagccugguacucgugggaguugucacgcuguaccuuggcgugauggugcaggcugacucugguugugucguuucauggaaaaacaaggagcugaaaugcgggaguggaauauucaucacagauaaugugcacaccuggacugaacaguauaaguuucagccugagagccccuccaaguuggccucugcaauucaaaaagcccacgaagagggcaucugugguauuaggucggugacacggcucgaaaaccugauguggaagcagaucaccccagaguuaaaucauauacugacugagaacgaaguaaaacuaaccauuaugacaggcgacaucaaggggauuaugcaggcuggaaaacgcagccucagaccccagccuacggagcugaaguacuccuggaaagccuggggcaaggcaaagaugcuuucaaccgaauugcacaaucauacuuuccugaucgaugggccagagacagcggaaugcccgaacaccaauagggcuuggaacagucucgaggucgaggacuauggauuuggcguguucacaacuaauauauggcugaaauuaaaggaacgucaagauguauuuugugacucuaaacugaugagcgccgcaaucaaggacaaccgggccgugcacgcugauauggguuacuggauugaguccgcccuuaacgacaccuggaaaaucgaaaaggcaucauucauugaggucaagagcugccacuggcccaaaucucauacguugugguccaauggggugcucgagagugaaaugaucauaccuaagaacuucgcuggaccaguuagccagcacaauuaucgacccggcuaccauacacagaccgccgguccuuggcaccugggcagacuagagauggauuuugacuucugugaagggacuaccgugguagucacagaggauugcggaaacaggggcccaucucugcgcacuaccacagcguccgggaaacucauuacggaauggugcugucggucaugcacccugcccccgcuuagauacaggggagaggacggcuguugguaugguauggagauccgcccuuugaaggaaaaagaggaaaaucuggugaacaguuuagugacugccgggcauggacagaucgauaauuuuagccucggcguccuggguauggcucuuuuccuggaggaaauguugcgaacacggguuggcaccaagcacgcaauucuccugguggccguaucguuugugacucuaaucacagggaacauguccuuccgugaccugggaagagucauggugaugguuggcgcuaccaugacggaugacauugggaugggagugacuuaccucgcccugcuugcagcguuuaaggucaggccaaccuucgccgcuggcuugcuguuacgcaaacucacaucuaaggagcugaugaugaccacuauagguaucgugcuucugagccaaucaacaauucccgagaguauccuagaacucaccgaugcccuggcauuggggaugaugguucugaaaauugugcggaauauggagaaguaucaguuagcugucacaaucauggccauacucugcguaccuaacgcagugauccugcagaaugccuggaaaguuuccuguacuacccuugcuguggucucugugagcccccuguugcucacguccucacaacagaaggcggacuggauuccacuggcccuaacaaucaagggacugaacccuaccgcaauuuuucuuacuacccucagcagaacaaguaaaaagaggucuuggccccugaaugaagcuaucauggccguaggcaugguguccauauuggccagcucgcugcuaaagaacgauauuccaaugacuggcccgcucgucgcugggggacugcuuaccguuugcuacgugcugacgggucgaucagcagacuuggagcucgaacgcgccgcggacgugcggugggaggagcaggcugaaaucucuggcaguuccccuauccugagcauuacaauaucugaggaugggagcauguccaucaagaaugaagaggaggaacagacccuaacuauucugaucagaacaggacuucucgucauuucaggccuguuccccgugaguaucccaauaaccgccgcagccugguauuugugggagguuaaaaagcaaagggcugguguauuaugggacgugcccagcccuccacccgucgggaaagcagaacuggaggauggagccuaccguaucaagcagaagggcauucucggcuauucucagaucggggcgggaguguacaaagaagguacuuuucacacaauguggcauguuacccgcggcgcugugcugaugcacaaggggaaacggauugagccuuccugggccgacgucaagaaagaucuuaucucauacggaggcgguuggaagcuggagggggaauggaaggagggagaagaggugcagguauuggcacuagaaccgggcaaaaacccaagagccguccaaacgaagcccggccuguucaaaacuaacaccgggacaauaggagcugugagucucgacuuuagcccugguaccuccggcucuccaauuguugauaagaaagggaagguggucggacuguauggcaauggugugguuacaaggucggggacuuacgugagcgccaucgcacagaccgaggagucaaucgaagacaaccccgagauugaagaugacaucuuccgaaagaaacggcuuacgauaauggauuuacauccuggagcuggcaagacaaaacgcuaucugccggccauugucagagaggcgaucaagaggggccuccggacuuugauucuggcccccacccgagugguagcagcugaaauggaggaggcccucagagggcugccaauccgcuaccagaccccugcuauaagggcagaacacaccggacgugagauuguggaccuuaugugucaugccacuuucaccaugcggcuguugucccccaucagaguuccaaauuauaaccuaaucauuauggaugaagcccacuuuacagacccugcuaguaucgcggcaagggguuacauuucuacgcgcgucgagaugggcgaggccgcugggauauucaugacugccacacccccaggaagccgagacccguuuccucaguccaaugcacccaucauggaugaagagagagaaauuccagagcggucauggaacucuggccacgaaugggugacagacuucaaagguaagaccgugugguuuguccccagcaucaaggccgggaaugauaucgcugcgugccugaggaaaaacggaaagaaaguaauucaacucagucgcaagacuuucgacuccgaguauauaaaaacacguaccaaugauugggacuuugugguuacgacugauaucagcgagaugggcgccaacuucaaggcagaaagagugauugacccucggagguguaugaagccagucaucuuaacagauggcgaggaacgcgugauucuggcugggcccaugccuguuacccauucuucagccgcacagcgaagaggacggguggguaggaauccgaaaaacgagaaugaccaguacaucuacaugggcgaaccacuugagaacgaugaggacugcgcccacuggaaggaagcuaaaaugcugcucgacaauauaaacacccccgaggggaucauuccuuccauguuugaacccgagcgcgaaaaggucgaugccaucgacggagaguauagauugaggggcgaggcgcggaaaacuuucguggaucugaugcgucgcggugaccucccaguauggcuggcauaccgaguggccgcugaagggauuaacuaugccgauagaaggugguguuuugacggcguuaagaauaaccaaauccuugaggaaaaugucgagguggagauauggacaaaagaaggagagcggaagaagcuaaaaccucgcuggcuggaugcuagaauuuacagugaccccuuggcauuaaaggaguucaaagaguucgccgcuggcagaaagagccugacccucaaccugaucacagaaauggggcggcuuccaacuuuuaugacgcagaaagccaagaaugcacuggauaaccucgcgguguugcauaccgccgaggcuggaggucgagccuauaaucacgcacugucggagcuaccugaaacacuggagacucuccuucuguuaaccuugcuggcuacagucaccggcgggauuuuccucuuucugaugucuggaaagggcaucgguaaaaugacucuugggaugugcugcauaaucacggccuccauucugcucugguacgcacagauccagccgcacuggauugccgcuagcaucauauuggaguucuuucugauuguuuuacuaauccccgagccagaaaagcaaagaaccccucaggacaaccagcugacauaugugguaaucgcgauucucacuguggucgccgcaaccauggcuaaugagaugggcuuccuugagaaaacaaagaaagauuuuggacugggcucaaucaccacucagcaacccgaaaguaacauauuggacauugaucugcgcccagccucugccuggacacucuacgcaguggcuacgaccuucaucacuccuaugcugaggcauuccauugagaauagcucaguuaacgugagucuuacagccaucgcgaaucaggcuaccguccucauggggcugggaaaggguuggcccuugagcaagauggacauaggcguaccgcuguuagccaucggguguuacucccaggugaacccaauuacccuaacagcagcccugcuccuucugguugcucacuaugcaaucauuggaccuggcuugcaggccaaagcgacucgggaagcucaaaagcgugccgcagccgguaucaugaaaaaucccacgguggacgggaugaccgucauugaucuggacccaauccccuacgauccuaaguuugagaaacagcucggccaggugaugcugcuugucuuaugcgugacacagguucugaugaugagaacuaccugggcucucugugaagccuugacacuggcaaccggaccgauaucuacucuaugggagggcaaccccgggagguucuggaauacgacaauugcugugagcauggccaacaucuuucgcggauccuaucuggcgggcgccggucuccuuuucucaaucaugaagaacaccgcaaauacucggcgagggaccggaaacacaggcgagacucugggugaaaaguggaaaaauagauugaacgcucugggcaagucugaguuucaaauuuacaaaaagagugggauacaggaaguagacaggacccucgccaaagagggaaucaagcgcggcgagacagaucaucacgcagugucgcgggggagcgcuaaacugagaugguucgucgaacguaauuuaguuacgccagagggaaagguggucgaccuuggcugcgguagagggggaugguccuauuacuguggcggucugaagaacgugaaagaaguaaagggccucaccaaagggggaccuggccaugaggaacccauuccuaugucuacuuauggguggaaucuagugcggcugcagucaggaguugauguguucuuuacaccacccgagaagugcgacaccuugcugugugauaucggcgagagcuccccuaacccaacugucgaagccggucgcacacuccgagugcuuaaucuggucgagaacugguugaauaacaauacccaauucugcauuaaagugcugaaccccuacaugccgaguguuaucgaaaagauggaggcccuccagagaaaguacgggggagcguuaguaaggaauccucugucucggaacagcacgcacgaaauguauugggugucaaacgcuuccggcaauauagucaguagcgugaacaugaucucucgcaugcuuauuaauagauuuaccaugaggcacaaaaaggcaacauacgagccagacguugaucugggcuccgggacucgaaacaucggaauugagucagaaacccccaaucuagacaucauagguaaacggauugagaagaucaaacaggaacaugagacaagcuggcacuaugaucaggaccauccuuacaagacuugggccuaucacggcucguacgaaaccaagcaaacagggucugcuaguuccauggugaacggagucgugcgucuccugaccaaaccaugggacguaauccccauggugacucagauggccaugacggauacaaccccguucggccagcagagaguuuuuaaggagaaagucgacacucgcacccaagagccuaaggaagguaccaaaaaguugaugaagauuacggcagaguggcuguggaaagaacucgggaagaaaaagacccccaggauguguacucgggaggaguucacaagaaaagugcgcagcaaugccgcucuuggagcgauauuuaccgaugaaaacaaguggaaaucagccagggaggcaguggaagacuccggcuucugggagcuggucgauaaggaacgaaauuuacaccuggagggcaagugcgagacuuguguuuauaacaugauggggaaacgggaaaagaaauugggagaguuugguaaggcuaaaggcucuagagccaucugguacauguggcucggggcaagguuccuggaauuugaggcccuaggauuccuuaaugaagaccauugguuuagccgcgagaacagucuguccggcguggagggugaagggcuccacaagcugggauacauuuugcgugauguaagcaagaaagagggcggcgcuauguaugccgacgauacagcggggugggacacccggaucacacuggaagaucucaagaaugaggaaauggugacuaaccauauggagggagagcacaagaaacuugcagaagccauuuucaaacugaccuaccagaauaaagucgugagaguucagaggccaacgccucgcgguaccgugauggacaucauaucucgacgggaccagagaggcucagggcaagucgugacauauggauuaaacacuuucaccaacauggaggcucagcugaucaggcagauggaaggcgaggguguauuuaagaguauucaacaguugacaguuaaagaggaaaucgccgugaagaauuggcucauucgcgucgggagagagcggcuguccaggauggcaaucagcggagaugacugcguggugaaaccccuagaugaccguuucgcuucugcccuuacugcucugaacgauaugggcaagguccgaaaagacauucagcagugggaaccaucgcgcggcuggaaugauuggacccaaguucccuuuugcucacaucacuuccacgagcucauaaugaaggacgggagagugcugguagugccuugucggaaccaggaugaauugaucggaagggcccgcauuagccagggugcaggcugguccuuaagagagacggcgugccuggggaagaguuacgcccagauguggucucucauguauuuucaucggagggaccuucgacuggcugccaaugcaaucuguagcgcugucccaucccacuggaucccgacaucacguaccacuuggaguauucaugccacacacgaguggaugaccacugaagauaugcuaaccguguggaacagaguuuggauacaagagaaucccuggauggaagacaaaacaccuguggagucuugggaagagaucccauaccugggaaagcgcgaggaucaguggugcggcagccucauugguuugacgucccgggcaaccugggccaaaaacauccagacugcgauuaaucaggucaggucacugaucgggaacgaagaguauacagacuacaugcccagcaugaagagauuccgccgggaagaggaagaggcuggagugcuuugguga

SEQ ID NO: 14348 - RNA, 9876 nt, Artificial Sequence
  derived and/or modified CDS sequence (opt3) from DENV-2__KM279543__SS-prME
accgccggaaucauuauaaugaugauccccacagugauggcuuuccaccugacuacgcgaaacggggagccucauaugauugucagcaggcaggaaaagggaaaaucccuccuuuuuaagaccgagaaugguguuaacaugugcacacugauggcaauggacuugggcgaauuaugugaggauacuaucaccuacaauugcccacuguuacggcaaaacgaaccggaggacauugauuguuggugcaauucuacaucaaccugggugacuuaugggacauguaccgccacgggagagcaccgccgagaaaaacguaguguggcgcucgugccccaugucggcaugggucuggagacuagaaccgaaacauggaugagcuccgagggggcuuggaagcacgcccagaggaucgagacuuggauacuucggcauccuggauucaccaucauggcagccauucuggcuuacacaaucggcaccacguauuuucagcgcguguugauuuucauccuccugacugcaguuacaccaucuauggccaugaggugcauaggcauuucgaacagggacuuuguggaaggggucucaggagguagcuggguggauaucguacuggagcacggcaguuguguuaccacuauggcuaaaaauaagcccacacucgacuucgaauuaauuaagaccgaggccaaacaccuggcgacgcuucggaaguacugcguggaagcaaaauugaccaacacaacuaccgccucccgcuguccuacacagggggagccaucucugaaugaggaacaagauaagcgauuugucugcaaacauagcaugguggacagaggauggggcaacgguugugggcuauucggaaagggcggcaucgugacuugcgcuauguuuaccugcaagaaaaauauggaggggaaggucguucagcccgaaaaccucgaguauacaaucgugauuaccccucacuccggagaagagaaugccguagguaacgauacuggcaaacaugggaaggagauaaaagugacgccacagucaaguaucacagaagcagagcugaccggauacggcacugucaccauggaauguagcccgaggacaggucuugacuucaaugagauggugcuguugcagauggaaaacaaggcuuggcucguucaccggcaaugguuucuggauuuaccccugccuuggcucccaggggccgacacccagggcucuaacuggauucagaaagagacucuugugacauucaagaauccccacgcgaagaaacaggaugucgugguacugggaucccaagagggcgccaugcauacggcauugaccggggcuacugaaauccagaugucaagcggaaaccuacuguuuacaggucaccucaagugccgucugcgcauggacaaacuucagcugaagggcaugaguuauucuauguguaccgggaaauucaagguugugaaggagauagccgaaacacaacauggaacuauugucaucagagugcaguacgagggcgacgguuccccuugcaaaaucccauucgagauuauggauuuggaaaagaggcacguccucgggcggcugaucaccgugaaucccauuguuacggagaaagacagcccggugaacauagaagcugagccucccuuuggcgauucguacaucauuaucggaguagaaccaggccaguuaaagcugucuugguucaaaaagggguccucaaucggacagauguuugagaccacaaugcgaggugccaagcgcauggcaauucuaggcgacacugccugggauuucgggagucucggaggcauguuuaccagcauagguaaagcucugcaucaagucuucggggcgaucuauggcgcagccuuuuccggagugucuuggacaaugaagauucuuaucggcguugugauuacuuggaucgggaugaauagcagaucaaccaguuuguccgucagccuggugcucguaggagugguuacgcuguaccuuggcgucauggugcaggcugacucugguuguguggucucauggaaaaacaaggagcugaaaugcgggaguggaauauucaucacagauaauguucacaccuggacugaacaguauaaguuucagccugagagccccuccaaguuggccucugcaauucaaaaagcccacgaagagggcaucugugguauuaggucggugacacggcucgaaaaccugauguggaagcagaucaccccagaguuaaaucauauacugacugagaacgaagugaaacuaaccauuaugacaggcgacaucaaggggauuaugcaggcuggaaaacgcagccucagaccccagccuacggagcugaaguacuccuggaaagccuggggcaaggcaaagaugcuuucaaccgaauugcacaaucauacuuuccugaucgaugggccagagacagcggaaugcccgaacaccaauagggcuuggaacagucucgagguagaggacuauggauuuggcgucuucacaacuaauauauggcugaaauuaaaggaacgucaagauguguuuugugacucuaaacugaugagcgccgcaaucaaggacaaccgggccguucacgcugauauggguuacuggauugaguccgcccuuaacgacaccuggaaaaucgaaaaggcaucauucauugagguaaagagcugccacuggcccaaaucucauacguugugguccaaugggguccucgagagugaaaugaucauaccuaagaacuucgcuggaccagugagccagcacaauuaucgacccggcuaccauacacagaccgccgguccuuggcaccugggcagacuagagauggauuuugacuucugugaagggacuaccguugugguaacagaggauugcggaaacaggggcccaucucugcgcacuaccacagcguccgggaaacucauuacggaauggugcugucggucaugcacccugcccccgcuuagauacaggggagaggacggcuguugguaugguauggagauccgcccuuugaaggaaaaagaggaaaaucuggucaacaguuuagugacugccgggcauggacagaucgauaauuuuagccucggcgugcuggguauggcucuuuuccuggaggaaauguugcgaacacgggucggcaccaagcacgcaauucuccugguugccgugucguuuguaacucuaaucacagggaacauguccuuccgugaccugggaagagugauggucauggugggcgcuaccaugacggaugacauugggaugggaguuacuuaccucgcccugcuugcagcguuuaaggugaggccaaccuucgccgcuggcuugcuguuacgcaaacucacaucuaaggagcugaugaugaccacuauagguaucguccuucugagccaaucaacaauucccgagaguauccuagaacucaccgaugcccuggcauuggggaugauggugcugaaaauuguucggaauauggagaaguaucaguuagcugugacaaucauggccauacucugcgucccuaacgcaguaauccugcagaaugccuggaaaguguccuguacuacccuugcuguugugucugucagcccccuguugcucacguccucacaacagaaggcggacuggauuccacuggcccuaacaaucaagggacugaacccuaccgcaauuuuucuuacuacccucagcagaacaaguaaaaagaggucuuggccccugaaugaagcuaucauggccgugggcaugguauccauauuggccagcucgcugcuaaagaacgauauuccaaugacuggcccgcucguggcugggggacugcuuaccgucugcuacguucugacgggucgaucagcagacuuggagcucgaacgcgccgcggacgugcggugggaggagcaggcugaaaucucuggcaguuccccuauccugagcauuacaauaucugaggaugggagcauguccaucaagaaugaagaggaggaacagacccuaacuauucugaucagaacaggacuucucgugauuucaggccuguuccccgucaguaucccaauaaccgccgcagccugguauuugugggaggugaaaaagcaaagggcugguguuuuaugggacguacccagcccuccacccguggggaaagcagaacuggaggauggagccuaccguaucaagcagaagggcauucucggcuauucucagaucggggcgggagucuacaaagaagguacuuuucacacaauguggcaugugacccgcggcgcuguucugaugcacaaggggaaacggauugagccuuccugggccgacgugaagaaagaucuuaucucauacggaggcgguuggaagcuggagggggaauggaaggagggagaagagguccagguguuggcacuagaaccgggcaaaaacccaagagccguacaaacgaagcccggccuguucaaaacuaacaccgggacaauaggagcugucagucucgacuuuagcccugguaccuccggcucuccaauuguggauaagaaagggaagguugugggacuguauggcaauggugucgugacaaggucggggacuuacguuagcgccaucgcacagaccgagaagucaaucgaggacaaccccgaaauugaggaugacaucuuccggaaaaagagacuuacgauaauggauuuacauccuggagcuggcaaaacaaagcgcuaucugccggccauugugagagaagcgaucaaaaggggccuccggacuuugauucuggcccccacccgagucguggcagcugagauggaagaggcccucagagggcugccaauccgcuaccagaccccugcuauaagggcagagcacaccggacgugaaauuguagaccuuaugugucaugccacuuucaccaugcggcuguugucccccaucagagugccaaauuauaaccuaaucauuauggaugaggcccacuuuacagacccugcuaguaucgcggcaagggguuacauuucuacgcgcguugaaaugggcgaggccgcugggauauucaugacugccacacccccaggaagccgagacccguuuccucaguccaaugcacccaucauggaugaggaaagagagauuccagaacggucauggaacucuggccacgagugggucacagacuucaaggguaagaccgugugguuugugcccagcaucaaagccgggaaugauaucgcugcgugccugaggaagaacggcaaaaaggucauucaacucagucgcaaaacuuucgacuccgaauauauaaagacacguaccaaugauugggacuuuguagugacgacugauaucagcgagaugggcgccaacuucaaggcagagagaguuauugacccucggagguguaugaaaccagugaucuuaacagauggcgaagaacgcgucauucuggcugggcccaugccugugacccauucuucagccgcacagcgaagaggacggguugguaggaauccgaagaacgaaaaugaccaguacaucuacaugggcgagccacuugaaaacgaugaggacugcgcccacuggaaagaggcuaagaugcugcucgacaauauaaacacccccgaagggaucauuccuuccauguuugagcccgaacgcgagaaaguggaugccaucgacggagaauauagauugaggggcgaggcgcggaagacuuucgucgaucugaugcgucgcggugaccucccaguguggcuggcauaccgaguagccgcugaggggauuaacuaugccgauagaaggugguguuuugacggcgugaaaaauaaccaaauccuugaagagaauguugaagucgagauauggacaaaggagggagaacggaagaaacuaaagccucgcuggcuggaugcuagaauuuacagugaccccuuggcauuaaaagaguucaaggaguucgccgcuggcaggaaaagccugacccucaaccugaucacagagauggggcggcuuccaacuuuuaugacgcagaaggccaagaaugcacuggauaaccucgcgguguugcauaccgccgaagcuggaggucgagccuauaaucacgcacugucggagcuaccugagacacuggaaacucuccuucuguuaaccuugcuggcuacagugaccggcgggauuuuccucuuucugaugucuggaaaaggcaucgguaagaugacucuugggaugugcugcauaaucacggccuccauucugcucugguacgcacagauccagccgcacuggauugccgcuagcaucauauuggaguucuuucugauugucuuacuaauccccgaaccagagaaacaaagaaccccucaggacaaccagcugacauauguugugaucgcgauucucacuguaguggccgcaaccauggcuaaugaaaugggcuuccuugagaagaccaaaaaggauuuuggacugggcucaaucaccacucagcaacccgagaguaacauauuggacauugaucugcgcccagccucugccuggacacucuacgcagucgcuacgaccuucaucacuccuaugcugaggcauuccauugaaaauagcucagugaacguuagucuuacagccaucgcgaaucaggcuaccgugcucauggggcugggaaaggguuggcccuugagcaaaauggacauaggcgucccgcuguuagccaucggguguuacucccagguaaacccaauuacccuaacagcagcccugcuccuucugguggcucacuaugcaaucauuggaccuggcuugcaggccaaggcgacucgggaggcucaaaaacgugccgcagccgguaucaugaagaaucccacgguugacgggaugaccgugauugaucuggacccaauccccuacgauccuaaauuugaaaagcagcucggccaggucaugcugcuuguguuaugcgucacacaggugcugaugaugagaacuaccugggcucucugugaggccuugacacuggcaaccggaccgauaucuacucuaugggaaggcaaccccgggagguucuggaauacgacaauugcuguuagcauggccaacaucuuucgcggauccuaucuggcgggcgccggucuccuuuucucaaucaugaagaacaccgcaaauacucggcgagggaccggaaacacaggcgagacucugggugagaaauggaagaauagauugaacgcucugggcaaaucugaauuucaaauuuacaagaaaagugggauacaggagguggacaggacccucgccaaggaaggaaucaaacgcggcgagacagaucaucacgcaguaucgcgggggagcgcuaagcugagaugguucguggagcguaauuuagucacgccagaaggaaagguuguggaccuuggcugcgguagagggggaugguccuauuacuguggcggucugaaaaacgucaaggaggugaaaggccucaccaaagggggaccuggccaugaagaacccauuccuaugucuacuuauggguggaaucuaguacggcugcagucaggaguggauguuuucuuuacaccacccgaaaaaugcgacaccuugcugugugauaucggcgagagcuccccuaacccaacuguggaggccggucgcacacuccgaguccuuaaucugguggaaaacugguugaauaacaauacccaauucugcauuaagguccugaaccccuacaugccgagugugaucgagaagauggaagcccuccagagaaaauacgggggagcguuaguuaggaauccucugucucggaacagcacgcacgagauguauuggguaucaaacgcuuccggcaauauagugaguagcgucaacaugaucucucgcaugcuuauuaauagauuuaccaugaggcacaagaaagcaacauacgaaccagacguggaucugggcuccgggacucgaaacaucggaauugagucagagacccccaaucuagacaucauagguaagcggauugagaaaaucaagcaggagcaugaaacaagcuggcacuaugaucaggaccauccuuacaagacuugggccuaucacggcucguacgagaccaaacaaacagggucugcuaguuccaugguuaacggagugguccgucuccugaccaagccaugggacgugauccccaugguaacucagauggccaugacggauacaaccccguucggccagcagagaguguuuaaagaaaagguugacacucgcacccaagagccuaaagaggguacaaagaaguugaugaaaauuacggcagaauggcuguggaaggagcucgggaaaaagaaaacccccaggauguguacucgggaagaguucacaagaaagguccgcagcaaugccgcucuuggagcgauauuuaccgaugagaacaaauggaagucagccagggaagcaguggaggacuccggcuucugggaacugguggauaaggagcgaaauuuacaccuggaaggcaaaugcgagacuugugucuauaacaugauggggaagcgggagaaaaaguugggagaauuugguaaagcuaagggcucuagagccaucugguacauguggcucggggcaagguuccuggaguuugaagcccuaggauuccuuaaugaggaccauugguuuagccgcgaaaacagucuguccggcguugagggugaggggcuccacaagcugggauacauuuugcgugaugugagcaaaaaggaaggcggcgcuauguaugccgacgauacagcggggugggacacccggaucacacuggaggaucucaaaaaugaagagaugguaacuaaccauauggaaggagagcacaagaaacuugcagaggccauuuucaagcugaccuaccagaauaagguggucagagugcagaggccaacgccucgcgguaccguuauggacaucauaucucgacgggaccagagaggcucagggcaaguggucacauauggauuaaacacuuucaccaacauggaagcucagcugaucaggcagauggagggcgaagguguguuuaaaaguauucaacaguugacaguaaaggaggagaucgccguuaaaaauuggcucauucgcguggggagagaacggcuguccaggauggcaaucagcggagaugacugcgucgugaagccccuagaugaccguuucgcuucugcccuuacugcucugaacgauaugggcaaagugcgaaaggacauucagcagugggagccaucgcgcggcuggaaugauuggacccaaguccccuuuugcucacaucacuuccacgaacucauaaugaaggacgggagaguucuggugguaccuugucggaaccaggaugaguugaucggaagggcccgcauuagccagggugcaggcugguccuuaagagaaacggcgugccuggggaaaaguuacgcccagauguggucucucauguauuuucaucggagggaccuucgacuggcugccaaugcaaucuguagcgcugugccaucccacuggaucccgacaucacguaccacuuggaguauucaugccacacacgaguggaugaccacugaggauaugcuaaccgucuggaacagaguguggauacaagaaaaucccuggauggaggacaagacaccuguugaaucuugggaggaaaucccauaccugggaaaacgcgaggaucaguggugcggcagccucauugguuugacgucccgggcaaccugggccaagaacauccagacugcgauuaaucaggugaggucacugaucgggaacgaggaauauacagacuacaugcccagcaugaaaagauuccgccgggaggaagaggaagcuggaguccuuugguga

SEQ ID NO: 14349 - RNA, 9876 nt, Artificial Sequence
  derived and/or modified CDS sequence (opt3) from DENV-2__KM279571__SS-prME
accgccggcaucauuauaaugaugauccccacagugauggcuuuccaccugacuacgcgaaacggggagccucauaugauugucagcaggcaggaaaagggaaaaucccuccuuuuuaagaccgagaaugguguuaacaugugcacacugauggcaauggacuugggcgaauuaugugaggauacuaucaccuacaauugcccacuguuacggcaaaacgaaccggaggacauugauuguuggugcaauucuacaucaaccugggugacuuaugggacauguaccgccacgggagagcaccgccgagaaaaacguaguguagcgcucgugccccaugucggcaugggucuggagacuagaaccgaaacauggaugagcuccgagggggcuuggaagcacgcccagaggaucgagacuuggauacuucggcauccuggauucaccaucauggcagccauucuggcuuacacaaucggcaccacguauuuucagcgcguguugauuuucauccuccugacugcaguuacaccaucuauggccaugagaugcauaggcauuucgaacagggacuuuguggaaggggucucaggagguagcuggguggauaucguacuggagcacggcaguuguguuaccacuauggcuaaaaauaagcccacacucgacuucgaauuaauuaagaccgaggccaaacaccuggcgacgcuucggaaguacugcguggaagcaaaauugaccaacacaacuaccgccucccgcuguccuacacagggggagccaucucugaaugaggaacaagauaagcgauuugucugcaaacauagcaugguggacagaggauggggcaacgguugugggcuauucggaaagggcggcaucgugacuugcgcuauguuuaccugcaagaaaaauauggaggggaaggucguucagcccgaaaaccucgaguauacaaucgugauuaccccucacuccggagaagagaaugccguagguaacgauacuggcaaacaugggaaggagauaaaagugacgccacagucaaguaucacagaagcagagcugaccggauacggcacugucaccauggaauguagcccgaggacaggucuugacuucaaugagauggugcuguugcagauggaaaacaaggcuuggcucguucaccggcaaugguuucuggauuuaccccugccuuggcucccaggggccgacacccagggcucuaacuggauucagaaagagacucuugugacauucaagaauccccacgcgaagaaacaggaugucgugguacugggaucccaagagggcgccaugcauacggcauugaccggggcuacugaaauccagaugucaagcggaaaccuacuguuuacaggucaccucaagugccgucugcgcauggacaaacuucagcugaagggcaugaguuauucuauguguaccgggaaauucaagguugugaaggagauagccgaaacacaacauggaacuauugucaucagagugcaguacgagggcgacgguuccccuugcaaaaucccauucgagauuauggauuuggaaaagaggcacguccucgggcggcugaucaccgugaaucccauuguuacggagaaagacagcccggugaacauagaagcugagccucccuuuggcgauucguacaucauuaucggaguagaaccaggccaguuaaagcugucuugguucaaaaagggguccucaaucggacagauguuugagaccacaaugcgaggugccaagcgcauggcaauucuaggcgacacugccugggauuucgggagucucggaggcgucuuuaccagcauagguaaagcucugcaucaaguguucggggcgaucuauggcgcagccuuuuccggaguuucuuggacaaugaagauucuuaucggcguggucauuacuuggaucgggaugaauagcagaucaaccaguuuguccgugagccugguacucgugggaguugucacgcuguaccuuggcgugauggugcaggcugacucugguugugucguuucauggaaaaacaaggagcugaaaugcgggaguggaauauucaucacagauaaugugcacaccuggacugaacaguauaaguuucagccugagagccccuccaaguuggccucugcaauucaaaaagcccacgaagagggcaucugugguauuaggucggugacacggcucgaaaaccugauguggaagcagaucaccccagaguuaaaucauauacugacugagaacgaaguaaaacuaaccauuaugacaggcgacaucaaggggauuaugcaggcuggaaaacgcacgcucagaccccagccuaccgagcugaaguacagcuggaaagccuggggcaaggcaaagaugcuuuccacugaauugcacaaucauacauuccugaucgaugggccagagaccgcggaaugcccgaacacaaauagggcuuggaacucacucgaggucgaggacuauggauuuggcguguucacuaccaauauauggcugaaauuaaaggaacgucaagauguauuuugugacaguaaacugaugucugccgcaaucaaggacaaccgggccgugcacgcugauauggguuacuggauugagagcgcccuuaacgacacguggaaaaucgaaaaggcauccuucauugaggucaagucaugccacuggcccaaaagccauacauuguggucuaauggggugcucgaguccgaaaugaucauaccuaagaacuucgcuggaccaguuagucagcacaauuaucgacccggcuaccauacccagacugccgguccuuggcaccugggcagacuagagauggauuuugacuucugugaagggaccacagugguagucacugaggauugcggaaacaggggcccaagccugcgcaccacaacggcgucugggaaacucauuaccgaauggugcugucgguccugcacucugcccccgcuuagauacaggggagaggacggcuguugguaugguauggagauccgcccuuugaaggaaaaagaggaaaaucuggugaacucauuagugacagccgggcauggacagaucgauaauuuuagucucggcguccuggguauggcucuuuuccuggaggaaauguugcgaacccggguuggcacuaagcacgcaauucuccugguggccguuagcuuugugacacuaaucaccgggaacaugucguuccgugaccugggaagagucauggugaugguuggcgcuacgaugacugaugacauugggaugggagugaccuaccucgcccugcuugcagcguuuaagauaaggccaacauucgccgcuggcuugcuguuacgcaaacucaccuccaaggagcugaugaugacuacaaucgguauuguccuucugucucaaagcaccauccccgagucaauucuagaacucacagaugcccuggcauuggggaugauggugcugaaaaucguucggaauauggagaaguaucaguuagcugugacuauaauggccauccucugcgucccuaacgcaguaauucugcagaaugccuggaaagugaguuguaccacgcuugcuguuguguccgucucuccccuguugcucacaagcucccaacagaaggcggacuggaucccacuggcccuaaccauuaagggacugaacccuacugcaaucuuucuuaccacacucucaagaacuagcaaaaagaggaguuggccccugaaugaagcuauaauggccgugggcaugguaucuauuuuggccuccagccugcuaaagaacgauaucccaaugaccggcccgcucguggcugggggacugcuuacggucugcuacguucugacaggucgaucggcagacuuggagcucgaacgcgccgcggacgugcggugggaggagcaggcugaaaucucaggcucuaguccuauucuguccauaaccaucagcgaggaugggucuaugagcauuaagaaugaagaggaggaacagacucuaacaauccugauuagaaccggacuucucgugaucuccggccuguuccccgucucaauaccaaucacugccgcagccugguauuugugggaggugaaaaagcaaagggcugguguuuuaugggacguacccaguccuccacccguggggaaagcagaacuggaggauggagccuaccguauuaagcagaagggcauccucggcuauagccagauuggggcgggagucuacaaagaagguacauuucacaccauguggcaugugacgcgcggcgcuguucugaugcacaaggggaaacggaucgagccuucuugggccgacgugaagaaagaucuuauauccuacggaggcgguuggaagcuggagggggaauggaaggagggagaagagguccagguguuggcacuagaaccgggcaaaaacccaagagccguacaaacuaagcccggccuguucaaaaccaacacagggaccauuggagcugucucacucgacuuuaguccugguacaagcggcuccccaaucguggauaagaaagggaagguugugggacuguauggcaauggugucgugacuaggucugggaccuacguuucggccaucgcacagacggaaaagagcauugaggacaaccccgaaaucgaggaugacauauucagaaagaagcggcuuacaauuauggauuuacauccuggagcuggcaaaacuaagcgcuaucugccggccaucgugagagaagcgauuaaaaggggccuccggaccuugauccuggcccccacacgagucguggcagcugagauggaagaggcccucagagggcugccaauacgcuaccagaccccugcuauuagggcagagcacacuggacgugaaaucguagaccuuaugugucaugccaccuucacaaugcggcuguugucacccaucagagugccaaauuauaaccuaauuaucauggaugaggcccacuuuacggacccugcuuccauugcggcaagggguuacauaaguacucgcguugaaaugggcgaggccgcugggaucuucaugaccgccacacccccaggaucucgagacccguuuccucagagcaaugcacccauuauggaugaggaaaaggagaucccagaaagauccuggaacucaggccacgagugggucaccgacuucaaggguaaaacugugugguuugugcccucuaucaaggccgggaaugauauugcugcgugccugcggaaaaacggaaagaaagucauacaacucagcaggaagacauucgacagugaauauaucaagacccgcacgaaugauugggacuuuguagugacuacagauauuuccgagaugggcgccaacuucaaagcagagcguguuaucgacccuagacgguguaugaagccagugauuuuaaccgauggcgaagagagggucauccuggcugggcccaugccugugacccauagcucugccgcacagcgccgaggaagaguuggucggaauccgaaaaacgaaaaugaccaguacauauacaugggcgagccacuugaaaacgaugaggacugcgcccacuggaaggaggcuaaaaugcugcucgacaauaucaacacucccgaagggauuaucccuucaauguuugagcccgaaagggagaagguggaugccauugacggagaauaucgcuugagaggcgaggcgaggaaaacauucgucgaucugaugcggcguggugaccucccaguguggcuggcauaccgcguagccgcugaggggaucaacuaugccgaucgaagaugguguuuugacggcgugaagaauaaccaaauacuugaagagaauguugaagucgagauuuggaccaaggagggagaaaggaaaaagcuaaaaccucgguggcuggaugcucgcaucuacuccgaccccuuggcauuaaaggaguucaaagaguucgccgcuggcagaaagagucugacacucaaccugauuacugagauggggaggcuuccaacguuuaugacccagaaggccaaaaaugcacuggauaaccucgcgguguugcauacagccgaagcuggaggucgggccuauaaucacgcacugagcgagcuaccugagacucuggaaacccuccuucuguuaacauugcuggcuaccgugacuggcgggaucuuccucuuucugaugucgggaaagggcauagguaaaaugacgcuugggaugugcugcaucauuaccgccucuauccugcucugguacgcacagauucagccgcacuggaucgccgcuuccauaauuuuggaguucuuucugaucgucuuacuaauccccgaaccagagaagcaacgaacaccucaggacaaccagcugacuuauguugugauugcgauccucaccguaguggccgcaacaauggcuaaugaaaugggcuuccuugagaaaaccaagaaggauuuuggacugggcagcauaacuacacagcaacccgagucaaacauuuuggacaucgaucugagaccagccagugccuggacgcucuacgcagucgcuaccacuuucauuacaccuaugcugcgccauucuaucgaaaauuccagcgugaacguuucacuuaccgccauagcgaaucaggcuaccgugcucauggggcugggaaaagguuggcccuugaguaagauggacaucggcgucccgcuguuagccauuggguguuacagccagguaaacccaaucacacuaacugcagcccugcuccuucugguggcucacuaugcaauuaucggaccuggcuugcaggccaaagcgacgagggaggcucaaaagcgggccgcagccgguauuaugaaaaaucccaccguugacgggaugacagugaucgaucuggacccaauacccuacgauccuaaguuugaaaagcagcucggccaggucaugcugcuuguguuaugcgucacucaggugcugaugaugcguaccacaugggcucucugugaggccuugacccuggcaacuggaccgauuuccacgcuaugggaaggcaaccccgggagauucuggaauacaaccaucgcuguuucuauggccaacaucuuuaggggaagcuaucuggcgggcgccggucuccuuuucuccauuaugaaaaacacugcaaauacccgccgggggacaggaaacacuggcgagacccugggugagaaguggaaaaaucgauugaacgcucugggcaagucagaauuucaaauauacaaaaagucugggauccaggagguggacagaacacucgccaaagaaggaauuaagaggggcgagacggaucaucacgcaguaagucgcgggucggcuaagcugcggugguucguggagagaaauuuagucaccccagaaggaaaaguuguggaccuuggcugcggucgugggggauggagcuauuacuguggcggucugaagaacgucaaagaggugaagggccucacuaaagggggaccuggccaugaggaacccaucccuauguccacauauggguggaaucuaguaaggcugcagucuggaguggauguuuucuuuaccccacccgaaaagugcgacacuuugcugugugauauuggcgagucaagcccuaacccaacaguggaggccggucggacccuccgcguccuuaaucugguggaaaacugguugaauaacaauacgcaauucugcaucaagguccugaaccccuacaugccguccgugauagagaaaauggaagcccuccagcgaaaguacgggggagcguuaguuagaaauccucugaguaggaacucuacccacgagauguauuggguaagcaacgcuucaggcaauaucguguccagugucaacaugauuagccggaugcuuaucaaucgcuuuacaaugagacacaaaaaggcaacuuacgaaccagacguggaucugggcucugggaccaggaacauuggaaucgaguccgagacacccaaucuagacauaauugguaaacgaaucgaaaagaucaagcaggagcaugaaacuucauggcacuaugaucaggaccauccuuacaaaaccugggccuaucacggcagcuacgagacaaagcaaaccgggucggcuucuaguaugguuaacggagugguccggcuccugacuaaaccaugggacgugauucccaugguaacgcagauggccaugacagauaccacuccguucggccagcagcguguguuuaaggaaaaaguugacaccagaacacaagagccuaaggaggguacgaagaaauugaugaagauaaccgcagaauggcuguggaaagagcucgggaagaaaaagacuccccgcauguguacaagggaagaguucacccggaaagucagauccaaugccgcucuuggagcgaucuuuacugaugagaacaaguggaaaagcgcccgcgaagcaguggaggacucaggcuucugggaacugguggauaaagagaggaauuuacaccuggaaggcaagugcgagacaugugucuauaacaugauggggaaacgagagaagaaauugggagaauuugguaaggcuaagggcucccgggccauuugguacauguggcucggggcaagauuccuggaguuugaagcccuaggauuccuuaaugaggaccauugguuuucuagggaaaacagccugaguggcguugagggugaggggcuccacaaacugggauacaucuugcgcgauguguccaagaaagaaggcggcgcuauguaugccgacgauaccgcggggugggacacacguauuacucuggaggaucucaagaaugaagagaugguaaccaaccauauggaaggagagcacaagaaacuugcagaggccaucuucaaacugacguaccagaauaaagugguccgggugcagagaccaaccccuagggguacaguuauggacauaaucagccgccgagaccagcggggcucugggcaaguggucacuuauggauuaaacaccuucacaaacauggaagcucagcugauuagacagauggagggcgaagguguguuuaagucaauccaacaguugacuguaaaagaggagauugccguuaagaauuggcucaucaggguggggcgcgaaagacugagucggauggcaauuuccggagaugacugcgucgugaaaccccuagaugacagguucgcuagcgcccuuaccgcucugaacgauaugggcaaggugcguaaggacauacagcagugggagccaucucgaggcuggaaugauuggacgcaaguccccuuuugcucgcaucacuuccacgaacucaucaugaaagacgggcgcguucuggugguaccuuguagaaaccaggaugaguugauuggacgggccaggaucucacagggugcaggcuggagcuuacgcgaaacagcgugccuggggaaguccuacgcccagauguggagucucauguauuuucauagacgggaccuuaggcuggcugccaaugcaaucuguucugcugugccaagccacuggauuccgaccucccgaacuacauggucaauacaugccacccacgaguggaugacuaccgaggauaugcuaacagucuggaaccguguguggauccaagaaaaucccuggauggaggacaaaacgccuguugaaaguugggaggaaauuccauaccugggaaagagagaggaucaguggugcggcucucucaucgguuugaccagccgcgcaacuugggccaaaaacauucagacagcgaucaaucaggugcggucccugauagggaacgaggaauauaccgacuacaugcccucaaugaagagguucagacgcgaggaagaggaagcuggaguccuuugguga

SEQ ID NO: 14350 - RNA, 9876 nt, Artificial Sequence
  derived and/or modified CDS sequence (opt3) from DENV-2__KM279544__SS-prME
accgccggaaucauuauaaugaugauccccacugugauggcuuuccaccugacuacgcgaaacggggagccucauaugauugucagcaggcaggaaaagggaaaaucccuccuuuuuaagaccgagaaugguguuaacaugugcacacugauggcaauggacuugggcgaauuaugugaggauacuaucaccuacaauugcccacuguuacggcaaaacgaaccggaggacauugauuguuggugcaauucuacaucaaccugggugacuuaugggacauguaccgccacgggagagcaccgccgagaaaaacguaguguggcgcucgugccccaugucggcaugggucuggagacuagaaccgaaacauggaugagcuccgagggggcuuggaagcacgcccagaggaucgagacuuggauacuucggcauccuggauucaccaucauggcagccauucuggcuuacacaaucggcaccacguauuuucagcgcguguugauuuucauccuccugacugcaguuacaccaucuauggccaugaggugcauaggcaccucgaacagggacuuuguggaaggggucucaggagguagcuggguggauauuguacuggagcacggcaguuguguuacuacaauggcuaaaaauaagcccacccucgacuucgaauuaaucaagacggaggccaaacaccuggcgacccuucggaaguacugcguggaagcaaaauugacaaacacuaccacagccucccgcuguccuacucagggggagccaucucugaaugaggaacaagauaagcgauuugucugcaaacauagcaugguggacagaggauggggcaacgguugugggcuauucggaaagggcggcauugugaccugcgcuauguuuacaugcaagaaaaauauggaggggaaggucguucagcccgaaaaccucgaguauaccaucgugaucacuccucacuccggagaagagaaugccguagguaacgauacgggcaaacaugggaaggagauuaaagugacaccacagucaaguauaaccgaagcagagcugacuggauacggcaccgucacaauggaauguagcccgaggaccggucuugacuucaaugagauggugcuguugcagauggaaaacaaggcuuggcucguucaccggcaaugguuucuggauuuaccccugccuuggcucccaggggccgacacucagggcucuaacuggauccagaaagagacacuugugacguucaagaauccccacgcgaagaaacaggaugucgugguacugggaucccaagagggcgccaugcauaccgcauugacuggggcuacagaaauucagaugucaagcggaaaccuacuguuuaccggucaccucaagugccgucugcgcauggacaaacuucagcugaagggcaugaguuauucuauguguacagggaaauucaagguugugaaggagaucgccgaaacucaacauggaaccauagucauuagagugcaguacgagggcgacgguuccccuugcaaaaucccauucgagaucauggauuuggaaaagaggcacguccucgggcggcugauuacggugaaucccaucguuaccgagaaagacagcccggugaacauugaagcugagccucccuuuggcgauucguacauaaucauuggaguagaaccaggccaguuaaagcugucuugguucaaaaagggguccucaaucggacagauguuugagacaacuaugcgaggugccaagcgcauggcaauccuaggcgacaccgccugggauuucgggagucucggaggcauguuuacaagcauugguaaagcucugcaucaagucuucggggcgauauauggcgcagccuuuuccggagugucuuggacuaugaagauccuuauuggcguugugaucaccuggauugggaugaauagcagaucaacgaguuuguccgucagccuggugcucguaggagugguuacacuguaccuuggcgucauggugcaggcugacucugguuguguggucucauggaaaaacaaggagcugaaaugcgggaguggaaucuucauaaccgauaauguucacacuuggacagaacaguauaaguuucagccugagagccccuccaaguuggccucugcaauccaaaaagcccacgaagagggcauuugugguaucaggucggugacccggcucgaaaaccugauguggaagcagauuacuccagaguuaaaucauauccugaccgagaacgaagugaaacuaacaauaaugacgggcgacauuaaggggaucaugcaggcuggaaaacgcagccucagaccccagccuaccgagcugaaguacuccuggaaagccuggggcaaggcaaagaugcuuucaacugaauugcacaaucauacauuccugauugaugggccagagaccgcggaaugcccgaacacaaauagggcuuggaacagucucgagguagaggacuauggauuuggcgucuucacuaccaauaucuggcugaaauuaaaggaacgucaagauguguuuugugacucuaaacugaugagcgccgcaauaaaggacaaccgggccguucacgcugauauggguuacuggaucgaguccgcccuuaacgacacguggaaaauugaaaaggcaucauucaucgagguaaagagcugccacuggcccaaaucucauacauugugguccaaugggguccucgagagugaaaugauuaucccuaagaacuucgcuggaccagugagccagcacaauuaucgacccggcuaccauacccagacugccgguccuuggcaccugggcagacuagagauggauuuugacuucugugaagggaccacaguugugguaacugaggauugcggaaacaggggcccaucucugcgcaccacaacggcguccgggaaacucauaaccgaauggugcugucggucaugcacucugcccccgcuuagauacaggggagaggacggcuguugguaugguauggagauucgcccuuugaaggaaaaagaggaaaaucuggucaacaguuuagugacagccgggcauggacagaucgauaauuuuagccucggcgugcuggguauggcucuuuuccuggaggaaauguugcgaacccgggucggcacuaagcacgcaauccuccugguugccgugucguuuguaacacuaauuaccgggaacauguccuuccgugaccugggaagagugauggucauggugggcgcuacgaugacugaugacaucgggaugggaguuaccuaccucgcccugcuugcagcguuuaaggugaggccaacauucgccgcuggcuugcuguuacgcaaacucaccucuaaggagcugaugaugacuacaauugguauaguccuucugagccaaucaaccauccccgagaguauucuagaacucacagaugcccuggcauuggggaugauggugcugaaaaucguucggaauauggagaaguaucaguuagcugugacuauuauggccauccucugcgucccuaacgcaguaauacugcagaaugccuggaaaguguccuguaccacgcuugcuguugugucugucagcccccuguugcucacauccucacaacagaaggcggacuggaucccacuggcccuaaccauuaagggacugaacccuacugcaaucuuucuuaccacacucagcagaacaaguaaaaagaggucuuggccccugaaugaagcuauuauggccgugggcaugguauccaucuuggccagcucgcugcuaaagaacgauauaccaaugaccggcccgcucguggcugggggacugcuuacggucugcuacguucugacaggucgaucagcagacuuggagcucgaacgcgccgcggacgugcggugggaggagcaggcugaaauuucuggcaguuccccuauccugagcaucaccauuucugaggaugggagcauguccauaaagaaugaagaggaggaacagacucuaacaauccugauuagaaccggacuucucgugaucucaggccuguuccccgucaguauuccaaucacugccgcagccugguauuugugggaggugaaaaagcaaagggcugguguuuuaugggacguacccagcccuccacccguggggaaagcagaacuggaggauggagccuaccguauaaagcagaagggcauccucggcuauucucagauuggggcgggagucuacaaagaagguacauuucacaccauguggcaugugacgcgcggcgcuguucugaugcacaaggggaaacggaucgagccuuccugggccgacgugaagaaagaucuuauuucauacggaggcgguuggaagcuggagggggaauggaaggagggagaagagguccagguguuggcacuagaaccgggcaaaaacccaagagccguacaaacuaagcccggccuguucaaaaccaacacagggaccaucggagcugucagucucgacuuuagcccugguacauccggcucuccaauaguggauaagaaagggaagguugugggacuguauggcaauggugucgugacuaggucggggaccuacguuagcgccauugcacagacggagaagucaaucgaggacaaccccgaaaucgaggaugacauuuuccggaaaaagagacuuacaaucauggauuuacauccuggagcuggcaaaacuaagcgcuaucugccggccauagugagagaagcgauuaaaaggggccuccggaccuugauccuggcccccacacgagucguggcagcugagauggaagaggcccucagagggcugccaauucgcuaccagaccccugcuaucagggcagagcacacuggacgugaaauaguagaccuuaugugucaugccaccuucacaaugcggcuguugucccccauuagagugccaaauuauaaccuaaucaucauggaugaggcccacuuuacggacccugcuaguauugcggcaagggguuacaucucuacucgcguugaaaugggcgaggccgcugggauuuucaugaccgccacacccccaggaagccgagacccguuuccucaguccaaugcacccauaauggaugaggaaagagagaucccagaacggucauggaacucuggccacgagugggucaccgacuucaaggguaagacugugugguuugugcccagcauuaaagccgggaaugauaucgcugcgugccugaggaagaacggcaaaaaggucauccaacucagucgcaaaacauucgacuccgaauauauuaagacccguacgaaugauugggacuuuguagugacuacagauauaagcgagaugggcgccaacuucaaggcagagagaguuaucgacccucggagguguaugaaaccagugauuuuaaccgauggcgaagaacgcgucauccuggcugggcccaugccugugacccauucuucagccgcacagcgaagaggacggguugguaggaauccgaagaacgaaaaugaccaguacauuuacaugggcgagccacuugaaaacgaugaggacugcgcccacuggaaagaggcuaagaugcugcucgacaauaucaacacucccgaagggauaaucccuuccauguuugagcccgaacgcgagaaaguggaugccauugacggagaauauagauugaggggcgaggcgcggaagacauucgucgaucugaugcgucgcggugaccucccaguguggcuggcauaccgaguagccgcugaggggaucaacuaugccgauagaaggugguguuuugacggcgugaaaaauaaccaaauucuugaagagaauguugaagucgagaucuggaccaaggagggagaacggaagaaacuaaagccucgcuggcuggaugcuagaauauacagugaccccuuggcauuaaaagaguucaaggaguucgccgcuggcaggaaaagccugacacucaaccugauuacugagauggggcggcuuccaacguuuaugacccagaaggccaagaaugcacuggauaaccucgcgguguugcauacagccgaagcuggaggucgagccuauaaucacgcacugucggagcuaccugagacucuggaaacccuccuucuguuaacauugcuggcuaccgugacuggcgggaucuuccucuuucugaugucuggaaaaggcauugguaagaugacgcuugggaugugcugcaucauaaccgccuccauccugcucugguacgcacagauucagccgcacuggaucgccgcuagcauuaucuuggaguucuuucugauagucuuacuaauucccgaaccagagaaacaaagaacaccucaggacaaccagcugacuuauguugugaucgcgauccucaccguaguggccgcaacaauggcuaaugaaaugggcuuccuugagaagaccaaaaaggauuuuggacugggcucaauuacuacacagcaacccgagaguaacaucuuggacauagaucugcgcccagccucugccuggacgcucuacgcagucgcuaccacuuucauuacaccuaugcugaggcauuccaucgaaaauagcucagugaacguuagucuuaccgccauugcgaaucaggcuaccgugcucauggggcugggaaaggguuggcccuugagcaaaauggacaucggcgucccgcuguuagccauaggguguuacucccagguaaacccaaucacacuaacugcagcccugcuccuucugguggcucacuaugcaauuaucggaccuggcuugcaggccaaggcgacgcgggaggcucaaaaacgugccgcagccgguauuaugaagaaucccaccguugacgggaugacagugaucgaucuggacccaauucccuacgauccuaaauuugaaaagcagcucggccaggucaugcugcuuguguuaugcgucacucaggugcugaugaugagaaccacaugggcucucugugaggccuugacccuggcaacuggaccgaucucuacgcuaugggaaggcaaccccgggagguucuggaauacaaccauagcuguuagcauggccaacauuuuucgcggauccuaucuggcgggcgccggucuccuuuucucaaucaugaagaacacugcaaauacccggcgagggacaggaaacacuggcgagacccugggugagaaauggaagaauagauugaacgcucugggcaaaucugaauuucaaaucuacaagaaaagugggauucaggagguggacaggacacucgccaaggaaggaauaaaacgcggcgagacggaucaucacgcaguaucgcgggggagcgcuaagcugagaugguucguggagcguaauuuagucaccccagaaggaaagguuguggaccuuggcugcgguagagggggaugguccuauuacuguggcggucugaaaaacgucaaggaggugaaaggccucacuaaagggggaccuggccaugaagaacccaucccuaugucuacauauggguggaaucuaguacggcugcagucaggaguggauguuuucuuuaccccacccgaaaaaugcgacacuuugcugugugauauuggcgagagcuccccuaacccaacaguggaggccggucgcacccuccgaguccuuaaucugguggaaaacugguugaauaacaauacgcaauucugcaucaagguccugaaccccuacaugccgagugugauugagaagauggaagcccuccagagaaaauacgggggagcguuaguuaggaauccucugucucggaacagcacccacgagauguauuggguaucaaacgcuuccggcaauaucgugaguagcgucaacaugauaucucgcaugcuuaucaauagauuuacaaugaggcacaagaaagcaacuuacgaaccagacguggaucugggcuccgggacccgaaacauuggaaucgagucagagacacccaaucuagacauuaucgguaagcggauagagaaaauuaagcaggagcaugaaacuagcuggcacuaugaucaggaccauccuuacaagaccugggccuaucacggcucguacgagacaaaacaaaccgggucugcuaguuccaugguuaacggagugguccgucuccugacuaagccaugggacgugauccccaugguaacgcagauggccaugacagauaccacuccguucggccagcagagaguguuuaaagaaaagguugacacccgcacacaagagccuaaagaggguacgaagaaguugaugaaaaucaccgcagaauggcuguggaaggagcucgggaaaaagaaaacucccaggauguguacacgggaagaguucaccagaaagguccgcagcaaugccgcucuuggagcgauuuuuacugaugagaacaaauggaagucagccagggaagcaguggaggacuccggcuucugggaacugguggauaaggagcgaaauuuacaccuggaaggcaaaugcgagacaugugucuauaacaugauggggaagcgggagaaaaaguugggagaauuugguaaagcuaagggcucuagagccauaugguacauguggcucggggcaagguuccuggaguuugaagcccuaggauuccuuaaugaggaccauugguuuagccgcgaaaacagucuguccggcguugagggugaggggcuccacaagcugggauacaucuugcgugaugugagcaaaaaggaaggcggcgcuauguaugccgacgauaccgcggggugggacacacggauuacucuggaggaucucaaaaaugaagagaugguaaccaaccauauggaaggagagcacaagaaacuugcagaggccaucuucaagcugacguaccagaauaagguggucagagugcagaggccaaccccucgcgguacaguuauggacauuaucucucgacgggaccagagaggcucagggcaaguggucacuuauggauuaaacaccuucacaaacauggaagcucagcugauaaggcagauggagggcgaagguguguuuaaaaguauccaacaguugacuguaaaggaggagauugccguuaaaaauuggcucauccgcguggggagagaacggcuguccaggauggcaauuagcggagaugacugcgucgugaagccccuagaugaccguuucgcuucugcccuuaccgcucugaacgauaugggcaaagugcgaaaggacauccagcagugggagccaucgcgcggcuggaaugauuggacgcaaguccccuuuugcucacaucacuuccacgaacucauuaugaaggacgggagaguucuggugguaccuugucggaaccaggaugaguugauaggaagggcccgcaucagccagggugcaggcugguccuuaagagaaacagcgugccuggggaaaaguuacgcccagauguggucucucauguauuuucaucggagggaccuucgacuggcugccaaugcaauuuguagcgcugugccaucccacuggaucccgaccucacguacuacauggaguauccaugccacccacgaguggaugacuaccgaggauaugcuaacagucuggaacagaguguggauucaagaaaaucccuggauggaggacaagacgcugguugaaucuugggaggaaauaccuuaccucggaaaacgcgaggaucaguggugcggcagcuugaucggucugaccucccgggcaacuugggccaagaacauucagacagcgaucaaucaggugaggucacuuauugggaacgaggaauauaccgacuacaugccaagcaugaaaagauuccgccgggaggaagaggaagcuggaguccugugguga

SEQ ID NO: 14351 - RNA, 9876 nt, Artificial Sequence
  derived and/or modified CDS sequence (opt3) from DENV-2__KM279549__SS-prME
accgccggaaucauuauaaugaugauccccacagugauggcuuuccaccugacuacgcgaaacggggagccucauaugauugucagcaggcaggaaaagggaaaaucccuccuuuuuaagaccgagaaugguguuaacaugugcacacugauggcaauggacuugggcgaauuaugugaggauacuaucaccuacaauugcccacuguuacggcaaaacgaaccggaggacauugauuguuggugcaauucuacaucaaccugggugacuuaugggacauguaccgccacgggagagcaccgccgagaaaaacguaguguugcgcucgugccccaugucggcaugggucuggagacuagaaccgaaacauggaugagcuccgagggggcuuggaagcacgcccagaggaucgagacuuggauacuucggcauccuggauucaccaucauggcagccauucuggcuuacacaaucggcaccacguauuuucagcgcguguugauuuucauccuccugacugcaguuacaccaucuauggccaugaggugcauaggcauuucgaacagggacuuuguggaaggggucucaggagguagcuggguggauaucguacuggagcacggcaguuguguuaccacuauggcuaaaaauaagcccacacucgacuucgaauuaauuaagaccgaggccaaacaccuggcgacgcuucggaaguacugcguggaagcaaaauugaccaacacaacuaccgccucccgcuguccuacacagggggagccaucucugaaugaggaacaagauaagcgauuugucugcaaacauagcaugguggacagaggauggggcaacgguugugggcuauucggaaagggcggcaucgugacuugcgcuauguuuaccugcaagaaaaauauggaggggaaggucguucagcccgaaaaccucgaguauacaaucgugauuaccccucacuccggagaagagaaugccguagguaacgauacuggcaaacaugggaaggagauaaaagugacgccacagucaaguaucacagaagcagagcugaccggauacggcacugucaccauggaauguagcccgaggacaggucuugacuucaaugagauggugcuguugcagauggaaaacaaggcuuggcucguucaccggcaaugguuucuggauuuaccccugccuuggcucccaggggccgacacccagggcucuaacuggauucagaaagagacucuugugacauucaagaauccccacgcgaagaaacaggaugucgugguacugggaucccaagagggcgccaugcauacggcauugaccggggcuacugaaauccagaugucaagcggaaaccuacuguuuacaggucaccucaagugccgucugcgcauggacaaacuucagcugaagggcaugaguuauucuauguguaccgggaaauucaagguugugaaggagauagccgaaacacaacauggaacuauugucaucagagugcaguacgagggcgacgguuccccuugcaaaaucccauucgagauuauggauuuggaaaagaggcacguccucgggcggcugaucaccgugaaucccauuguuacggagaaagacagcccggugaacauagaagcugagccucccuuuggcgauucguacaucauuaucggaguagaaccaggccaguuaaagcugucuugguucaaaaagggguccucaaucggacagauguuugagaccacaaugcgaggugccaagcgcauggcaauucuaggcgacacugccugggauuucgggagucucggaggcgucuuuaccagcauagguaaagcucugcaucaaguguucggggcgaucuauggcgcagccuuuuccggaguuucuuggacaaugaagauucuuaucggcguggucauuacuuggaucgggaugaauagcagaucaaccaguuuguccgugagccugguacucgugggaguugucacgcuguaccuuggcgugauggugcaggcugacucugguugugucguuucauggaaaaacaaggagcugaaaugcgggaguggaauauucaucacagauaaugugcacaccuggacugaacaguauaaguuucagccugagagccccuccaaguuggccucugcaauucaaaaagcccacgaagagggcaucugugguauuaggucggugacacggcucgaaaaccugauguggaagcagaucaccccagaguuaaaucauauacugacugagaacgaaguaaaacuaaccauuaugacaggcgacaucaaggggauuaugcaggcuggaaaacgcagccucagaccccagccuacggagcugaaguacuccuggaaagccuggggcaaggcaaagaugcuuucaaccgaauugcacaaucauacuuuccugaucgaugggccagagacagcggaaugcccgaacaccaauagggcuuggaacagucucgaggucgaggacuauggauuuggcguguucacaacuaauauauggcugaaauuaaaggaacgucaagauguauuuugugacucuaaacugaugagcgccgcaaucaaggacaaccgggccgugcacgcugauauggguuacuggauugaguccgcccuuaacgacaccuggaaaaucgaaaaggcaucauucauugaggucaagagcugccacuggcccaaaucucauacguugugguccaauggggugcucgagagugaaaugaucauaccuaagaacuucgcuggaccaguuagccagcacaauuaucgacccggcuaccauacacagaccgccgguccuuggcaccugggcagacuagagauggauuuugacuucugugaagggacuaccgugguagucacagaggauugcggaaacaggggcccaucucugcgcacuaccacagcguccgggaaacucauuacggaauggugcugucggucaugcacccugcccccgcuuagauacaggggagaggacggcuguugguaugguauggagauccgcccuuugaaggaaaaagaggaaaaucuggugaacaguuuagugacugccgggcauggacagaucgauaauuuuagccucggcguccuggguauggcucuuuuccuggaggaaauguugcgaacacggguuggcaccaagcacgcaauucuccugguggccguaucguuugugacucuaaucacagggaacauguccuuccgugaccugggaagagucauggugaugguuggcgcuaccaugacggaugacauugggaugggagugacuuaccucgcccugcuugcagcguuuaaggucaggccaaccuucgccgcuggcuugcuguuacgcaaacucacaucuaaggagcugaugaugaccacuauagguaucgugcuucugagccaaucaacaauucccgagaguauccuagaacucaccgaugcccuggcauuggggaugaugguucugaaaauugugcggaauauggagaaguaucaguuagcugucacaaucauggccauacucugcguaccuaacgcagugauccugcagaaugccuggaaaguuuccuguacuacccuugcuguggucucugugagcccccuguugcucacguccucacaacagaaggcggacuggauuccacuggcccuaacaaucaagggacugaacccuaccgcaauuuuucuuacuacccucagcagaacaaguaaaaagaggucuuggccccugaaugaagcuaucauggccguaggcaugguguccauauuggccagcucgcugcuaaagaacgauauuccaaugacuggcccgcucgucgcugggggacugcuuaccguuugcuacgugcugacgggucgaucagcagacuuggagcucgaacgcgccgcggacgugcggugggaggagcaggcugaaaucucuggcaguuccccuauccugagcauuacaauaucugaggaugggagcauguccaucaagaaugaagaggaggaacagacccuaacuauucugaucagaacaggacuucucgucauuucaggccuguuccccgugaguaucccaauaaccgccgcagccugguauuugugggagguuaaaaagcaaagggcugguguauuaugggacgugcccagcccuccacccgucgggaaagcagaacuggaggauggagccuaccguaucaagcagaagggcauucucggcuauucucagaucggggcgggaguguacaaagaagguacuuuucacacaauguggcauguuacccgcggcgcugugcugaugcacaaggggaaacggauugagccuuccugggccgacgucaagaaagaucuuaucucauacggaggcgguuggaagcuggagggggaauggaaggagggagaagaggugcagguauuggcacuagaaccgggcaaaaacccaagagccguccaaacgaagcccggccuguucaaaacuaacaccgggacaauaggagcugugagucucgacuuuagcccugguaccuccggcucuccaauuguugauaagaaagggaagguggucggacuguauggcaauggugugguuacaaggucggggacuuacgugagcgccaucgcacagaccgagaagucaaucgaggacaaccccgaaauugaggaugacaucuuccggaaaaagagacuuacgauaauggauuuacauccuggagcuggcaaaacaaagcgcuaucugccggccauugucagagaagcgaucaaaaggggccuccggacuuugauucuggcccccacccgagugguagcagcugagauggaagaggcccucagagggcugccaauccgcuaccagaccccugcuauaagggcagagcacaccggacgugaaauuguggaccuuaugugucaugccacuuucaccaugcggcuguugucccccaucagaguuccaaauuauaaccuaaucauuauggaugaggcccacuuuacagacccugcuaguaucgcggcaagggguuacauuucuacgcgcgucgaaaugggcgaggccgcugggauauucaugacugccacacccccaggaagccgagacccguuuccucaguccaaugcacccaucauggaugaggaaagagagauuccagaacggucauggaacucuggccacgagugggugacagacuucaaggguaagaccgugugguuuguccccagcaucaaagccgggaaugauaucgcugcgugccugaggaagaacggcaaaaagguaauucaacucagucgcaaaacuuucgacuccgaauauauaaagacacguaccaaugauugggacuuugugguuacgacugauaucagcgagaugggcgccaacuucaaggcagagagagugauugacccucggagguguaugaaaccagucaucuuaacagauggcgaagaacgcgugauucuggcugggcccaugccuguuacccauucuucagccgcacagcgaagaggacggguggguaggaauccgaagaacgaaaaugaccaguacaucuacaugggcgagccacuugaaaacgaugaggacugcgcccacuggaaagaggcuaagaugcugcucgacaauauaaacacccccgaagggaucauuccuuccauguuugagcccgaacgcgagaaagucgaugccaucgacggagaauauagauugaggggcgaggcgcggaagacuuucguggaucugaugcgucgcggugaccucccaguauggcuggcauaccgaguggccgcugaggggauuaacuauguugauagaaggugguguuuugacggcgucaaaaauaaccaaauccuugaagagaauguggaaguggagauauggacaaaggagggagaacggaagaaacuaaagccucgcuggcuggaugccagaauuuacagugaccccuuggcuuuaaaagaguucaaggaguucgcagccggcaggaaaagccugacccucaaccugaucacagagauggggcggcuuccaacuuuuaugacgcagaaggcuaagaaugcccuggauaaccucgcagucuugcauaccgcggaagccggaggucgagcuuauaaucacgcccugucggagcuaccugagacacuggaaacucuccuucuguuaaccuugcuggcaacaguuaccggcgggauuuuccucuuucugaugucuggaaaaggcaucgguaagaugacucuugggaugugcugcauaaucacggcuuccauucugcucugguacgcccagauccagccgcacuggauugcagccagcaucauauuggaguucuuucugauuguguuacuaauccccgaaccagagaaacaaagaaccccucaggacaaccagcugacauauguagugaucgcuauucucacugucguggcggccaccauggcaaaugaaaugggcuuccuugagaagaccaaaaaggauuuuggacugggcucaaucaccacucagcaacccgagaguaacauauuggacauugaucugcgcccagcuucugccuggacacucuacgccguugcaacgaccuucaucacuccuaugcugaggcauuccauugaaaauagcucagugaacgucagucuuacagcuaucgccaaucaggcgaccguacucauggggcugggaaaggguuggcccuugagcaaaauggacauaggcgugccgcuguuagcuaucggguguuacucccagguuaacccaauuacccuaacagccgcacugcuccuucugguggcccacuaugcuaucauuggaccuggcuugcaggcaaaggccacucgggaggcgcaaaaacgugcugccgcagguaucaugaagaaucccacggucgacgggaugaccgugauugaucuggacccaauccccuacgauccuaaauuugaaaagcagcucggccaggucaugcugcuuguguuaugcguuacacaggugcugaugaugagaacuaccugggcccucugugaggcuuugacacuggccaccggaccgauaucuacucuaugggaaggcaaccccgggagguucuggaauacgacaauugcaguaagcauggcuaacaucuuucgcggauccuaucuggccggcgcgggucuccuuuucucaaucaugaagaacaccgccaauacucggcgagggaccggaaacacaggcgagacucugggugagaaauggaagaauagauugaacgcacugggcaaaucugaauuucaaauuuacaagaaaagugggauacaggagguggacaggacccucgcuaaggaaggaaucaaacgcggcgagacagaucaucacgccgucucgcgggggagcgcaaagcugagaugguucguugagcguaauuuagugacgccagaaggaaaggucguggaccuuggcugcgguagagggggaugguccuauuacuguggcggucugaaaaacguaaaggaggugaaaggccucaccaaagggggaccuggccaugaagaacccauuccuaugucuacuuauggguggaaucuaguucggcugcagucaggaguggaugucuucuuuacaccacccgaaaaaugcgacaccuugcugugugauaucggcgagagcuccccuaacccaacuguggaggcuggucgcacacuccgaguccuuaaucugguggaaaacugguugaauaacaauacccaauucugcauuaagguucugaaccccuacaugccgaguguaaucgagaagauggaagcccuccagagaaaauacgggggagccuuagugaggaauccucugucucggaacagcacgcacgagauguauugggucucaaacgcguccggcaauauagugaguagcguuaacaugaucucucgcaugcuuauuaauagauuuaccaugaggcacaagaaagcuacauacgaaccagacguggaucugggcuccgggacucgaaacaucggaauugagucagagacccccaaucuagacaucauagguaagcggauugagaaaaucaagcaggagcaugaaacaagcuggcacuaugaucaggaccauccuuacaagacuugggcauaucacggcucguacgagaccaaacaaacagggucugccaguuccauggucaacggagugguacgucuccugaccaagccaugggacgugauccccaugguuacucagauggcuaugacggauacaaccccguucggccagcagagagucuuuaaagaaaagguggacacucgcacccaagagccuaaagaggguacaaagaaguugaugaaaauuacggccgaauggcuguggaaggagcucgggaaaaagaaaacccccaggauguguacucgggaagaguucacaagaaaggugcgcagcaaugcagcccuuggagcuauauuuaccgaugagaacaaauggaagucagcgagggaagccgucgaggacuccggcuucugggaacugguugauaaggagcgaaauuuacaccuggaaggcaaaugcgagacuuguguguauaacaugauggggaagcgggagaaaaaguugggagaauuugguaaagcaaagggcucuagagcuaucugguacauguggcucggggccagguuccuggaguuugaagcacuaggauuccuuaaugaggaccauugguuuagccgcgaaaacagucuguccggcguagagggugaggggcuccacaagcugggauacauuuugcgugaugugagcaaaaaggaaggcggcgccauguaugcugacgauacagccgggugggacacccggaucacacuggaggaucucaaaaaugaagagauggucacuaaccauauggaaggagagcacaagaaacuugcggaggcaauuuucaagcugaccuaccagaauaaggugguuagagugcagaggccaacgccucgcgguaccgucauggacaucauaucucgacgggaccagagaggcucagggcaagugguaacauauggauuaaacacuuucaccaacauggaagcccagcugaucaggcagauggagggcgaagguguuuuuaaaaguauucaacaguugacagugaaggaggagaucgcugucaaaaauuggcucauucgcguggggagagaacggcuguccaggauggccaucagcggagaugacugcguggucaagccccuagaugaccguuucgcaucugcucuuacugcccugaacgauaugggcaaaguucgaaaggacauucagcagugggagccaucgcgcggcuggaaugauuggacccaagugcccuuuugcucacaucacuuccacgaacucauaaugaaggacgggagaguacugguggucccuugucggaaccaggaugaguugaucggaagggcucgcauuagccagggugccggcugguccuuaagagaaacggcaugccuggggaaaaguuacgcgcagauguggucucucauguauuuucaucggagggaccuucgacuggccgcuaaugccaucuguagcgcagugccaucccacuggaucccgacaucacguaccacuuggaguauucaugcuacacacgaguggaugaccacugaggauaugcuaaccguuuggaacagaguguggauacaagaaaaucccuggauggaggacaagacaccugucgaaucuugggaggaaaucccauaccugggaaaacgcgaggaucaguggugcggcagccucauugguuugacgucccgggccaccugggcaaagaacauccagacugccauuaaucaggugaggucacugaucgggaacgaggaauauacagacuacaugcccagcaugaaaagauuccgccgggaggaagaggaagcgggaguacuuugguga

SEQ ID NO: 14352 - RNA, 9876 nt, Artificial Sequence
  derived and/or modified CDS sequence (opt3) from DENV-2__KM279552__SS-prME
accgccggaaucauuauaaugaugauccccacagugauggcuuuccaccugacuacgcgaaacggggagccucauaugauugucagcaggcaggaaaagggaaaaucccuccuuuuuaagaccgagaaugguguuaacaugugcacacugauggcaauggacuugggcgaauuaugugaggauacuaucaccuacaauugcccacuguuacggcaaaacgaaccggaggacauugauuguuggugcaauucuacaucaaccugggugacuuaugggacauguaccgccacgggagagcaccgccgagaaaaacguaguguugcgcucgugccccaugucggcaugggucuggagacuagaaccgaaacauggaugagcuccgagggggcuuggaagcacgcccagaggaucgagacuuggauacuucggcauccuggauucaccaucauggcagccauucuggcuuacacaaucggcaccacguauuuucagcgcguguugauuuucauccuccugacugcaguuacaccaucuauggccaugaggugcauaggcauuucgaacagggacuuuguggaaggggucucaggagguagcuggguggauaucguacuggagcacggcaguuguguuaccacuauggcuaaaaauaagcccacacucgacuucgaauuaauuaagaccgaggccaaacaccuggcgacgcuucggaaguacugcguggaagcaaaauugaccaacacaacuaccgccucccgcuguccuacacagggggagccaucucugaaugaggaacaagauaagcgauuugucugcaaacauagcaugguggacagaggauggggcaacgguugugggcuauucggaaagggcggcaucgugacuugcgcuauguuuaccugcaagaaaaauauggaggggaaggucguucagcccgaaaaccucgaguauacaaucgugauuaccccucacuccggagaagagaaugccguagguaacgauacuggcaaacaugggaaggagauaaaagugacgccacagucaaguaucacagaagcagagcugaccggauacggcacugucaccauggaauguagcccgaggacaggucuugacuucaaugagauggugcuguugcagauggaaaacaaggcuuggcucguucaccggcaaugguuucuggauuuaccccugccuuggcucccaggggccgacacccagggcucuaacuggauucagaaagagacucuugugacauucaagaauccccacgcgaagaaacaggaugucgugguacugggaucccaagagggcgccaugcauacggcauugaccggggcuacugaaauccagaugucaagcggaaaccuacuguuuacaggucaccucaagugccgucugcgcauggacaaacuucagcugaagggcaugaguuauucuauguguaccgggaaauucaagguugugaaggagauagccgaaacacaacauggaacuauugucaucagagugcaguacgagggcgacgguuccccuugcaaaaucccauucgagauuauggauuuggaaaagaggcacguccucgggcggcugaucaccgugaaucccauuguuacggagaaagacagcccggugaacauagaagcugagccucccuuuggcgauucguacaucauuaucggaguagaaccaggccaguuaaagcugucuugguucaaaaagggguccucaaucggacagauguuugagaccacaaugcgaggugccaagcgcauggcaauucuaggcgacacugccugggauuucgggagucucggaggcgucuuuaccagcauagguaaagcucugcaucaaguguucggggcgaucuauggcgcagccuuuuccggaguuucuuggacaaugaagauucuuaucggcguggucauuacuuggaucgggaugaauagcagaucaaccaguuuguccgugagccugguacucgugggaguugucacgcuguaccuuggcgugauggugcaggcugacucugguugugucguuucauggaaaaacaaggagcugaaaugcgggaguggaauauucaucacagauaaugugcacaccuggacugaacaguauaaguuucagccugagagccccuccaaguuggccucugcaauucaaaaagcccacgaagagggcaucugugguauuaggucggugacacggcucgaaaaccugauguggaagcagaucaccccagaguuaaaucauauacugacugagaacgaaguaaaacuaaccauuaugacaggcgacaucaaggggauuaugcaggcuggaaaacgcagccucagaccccagccuacggagcugaaguacuccuggaaagccuggggcaaggcaaagaugcuuucaaccgaauugcacaaucauacuuuccugaucgaugggccagagacagcggaaugcccgaacaccaauagggcuuggaacagucucgaggucgaggacuauggauuuggcguguucacaacuaauauauggcugaaauuaaaggaacgucaagauguauuuugugacucuaaacugaugagcgccgcaaucaaggacaaccgggccgugcacgcugauauggguuacuggauugaguccgcccuuaacgacaccuggaaaaucgaaaaggcaucauucauugaggucaagagcugccacuggcccaaaucucauacguugugguccaauggggugcucgagagugaaaugaucauaccuaagaacuucgcuggaccaguuagccagcacaauuaucgacccggcuaccauacacagaccgccgguccuuggcaccugggcagacuagagauggauuuugacuucugugaagggacuaccgugguagucacagaggauugcggaaacaggggcccaucucugcgcacuaccacagcguccgggaaacucauuacggaauggugcugucggucaugcacccugcccccgcuuagauacaggggagaggacggcuguugguaugguauggagauccgcccuuugaaggaaaaagaggaaaaucuggugaacaguuuagugacugccgggcauggacagaucgauaauuuuagccucggcguccuggguauggcucuuuuccuggaggaaauguugcgaacacggguuggcaccaagcacgcaauucuccugguggccguaucguuugugacucuaaucacagggaacauguccuuccgugaccugggaagagucauggugaugguuggcgcuaccaugacggaugacauugggaugggagugacuuaccucgcccugcuugcagcguuuaaggucaggccaaccuucgccgcuggcuugcuguuacgcaaacucacaucuaaggagcugaugaugaccacuauagguaucgugcuucugagccacucaacaauucccgagaguauccuagaacucaccgaugcccuggcauuggggaugaugguucugaaaauugugcggaauauggagaaguaucaauuagcugucacaaucauggccauacucugcguaccuaacgcagugauccugcagaaugccuggaaaguuuccuguacuacccuugcuguggucucugugagcccccuguugcucacguccucacagcaaaaggcggacuggauuccacuggcccuaacaaucaagggacugaacccuaccgcaauuuuucuuacuacccucagcagaacaaguaaaaagaggucuuggccccugaaugaagcuaucauggccguaggcaugguguccauauuggccagcucgcugcuaaagaacgauauuccaaugacuggcccgcucgucgcugggggacugcuuaccguuugcuacgugcugacgggucgaucagcagacuuggagcucgaacgcgccgcggacgugcggugggaggagcaggcugaaaucucuggcaguuccccuauccugagcauuacaauaucugaggaugggagcauguccaucaagaaugaagaggaggaacagacccuaacuauucugaucagaacaggacuucucgucauuucaggccuguuccccgugaguaucccaauaaccgccgcagccugguauuugugggagguuaaaaagcagagggcugguguauuaugggacgugcccagcccuccacccgucgggaaagcagaacuggaggauggagccuaccguaucaagcaaaagggcauucucggcuauucucagaucggggcgggaguguacaaagaagguacuuuucauacaauguggcacguuacccgcggcgcugugcugaugcauaaggggaaacggauugagccuuccugggccgacgucaagaaagaucuuaucucauacggaggcgguuggaagcuggagggggaauggaaggagggagaagaggugcagguauuggcacuagaaccgggcaaaaacccaagagccguccagacgaagcccggccuguucaaaacuaacaccgggacaauaggagcugugagucucgacuuuagcccugguaccuccggcucuccaauuguugauaagaaagggaagguggucggacuguauggcaauggugugguuacaaggucggggacuuacgugagcgccaucgcacaaaccgagaagucaaucgaggacaaccccgaaauugaggaugacaucuuccggaaaaagagacuuacgauaauggauuuacacccuggagcuggcaaaacaaagcgcuaucugccggccauugucagagaagcgaucaaaaggggccuccggacuuugauucuggcccccacccgagugguagcagcugagauggaagaggcccucagagggcugccaauccgcuaccagaccccugcuauaagggcagagcauaccggacgugaaauuguggaccuuaugugucacgccacuuucaccaugcggcuguugucccccaucagaguuccaaauuauaaccuaaucauuauggaugaggcccacuuuacagacccugcuaguaucgcggcaagggguuacauuucuacgcgcgucgaaaugggcgaggccgcugggauauucaugacugccacacccccaggaagccgagacccguuuccucaguccaaugcacccaucauggaugaggaaagagagauuccagaacggucauggaacucuggccaugagugggugacagacuucaaggguaagaccgugugguuuguccccagcaucaaagccgggaaugauaucgcugcgugccugaggaagaacggcaaaaagguaauucagcucagucgcaaaacuuucgacuccgaauauauaaagacacguaccaaugauugggacuuugugguuacgacugauaucagcgagaugggcgccaacuucaaggcagagagagugauugacccucggagguguaugaaaccagucaucuuaacagauggcgaagaacgcgugauucuggcugggcccaugccuguuacccacucuucagccgcacaacgaagaggacggguggguaggaauccgaagaacgaaaaugaccaguacaucuacaugggcgagccacuugaaaacgaugaggacugcgcccauuggaaagaggcuaagaugcugcucgacaauauaaacacccccgaagggaucauuccuuccauguuugagcccgaacgcgagaaagucgaugccaucgacggagaauauagauugaggggcgaggcgcggaagacuuucguggaucugaugcgucgcggugaccucccaguauggcuggcauaccgaguggccgcugaggggauuaacuaugccgauagaaggugguguuuugacggcguuaaaaauaaccagauccuugaagagaaugucgaaguggagauauggacaaaggagggagaacggaagaaacuaaagccucgcuggcuggaugcuagaauuuacagugaccccuuggcauuaaaagaguucaaggaguucgccgcuggcaggaaaagccugacccucaaccugaucacagagauggggcggcuuccaacuuuuaugacgcaaaaggccaagaaugcacuggauaaccucgcgguguugcacaccgccgaagcuggaggucgagccuauaaucacgcacugucggagcuaccugagacacuggaaacucuccuucuguuaaccuugcuggcuacagucaccggcgggauuuuccucuuucugaugucuggaaaaggcaucgguaagaugacucuugggaugugcugcauaaucacggccuccauucugcucugguacgcacagauccagccgcauuggauugccgcuagcaucauauuggaguucuuucugauuguuuuacuaauccccgaaccagagaaacagagaaccccucaagacaaccagcugacauaugugguaaucgcgauucucacuguggucgccgcaaccauggcuaaugaaaugggcuuccuugagaagaccaaaaaggauuuuggacugggcucaaucaccacucagcagcccgagaguaacauauuggacauugaucugcgcccagccucugccuggacacucuacgcaguggcuacgaccuucaucacuccuaugcugaggcacuccauugaaaauagcucaguuaacgugagucuuacagccaucgcgaaucaagcuaccguccucauggggcugggaaaggguuggcccuugagcaaaauggacauaggcguaccgcuguuagccaucggguguuacucccaggugaacccaauuacccuaacagcagcccugcuccuucugguugcucauuaugcaaucauuggaccuggcuugcaggccaaggcgacucgggaggcucagaaacgugccgcagccgguaucaugaagaaucccacgguggacgggaugaccgucauugaucuggacccaauccccuacgauccuaaauuugaaaagcaacucggccaggugaugcugcuugucuuaugcgugacacagguucugaugaugagaacuaccugggcucucugugaggccuugacacuggcaaccggaccgauaucuacucuaugggaaggcaaccccgggagguucuggaauacgacaauugcugugagcauggccaacaucuuucgcggauccuaucuggcgggcgccggucuccuuuucucaaucaugaagaacaccgcaaauacucggcgagggaccggaaacacaggcgagacucugggugagaaauggaagaauagauugaacgcucugggcaaaucugaauuucagauuuacaagaaaagugggauacaagagguagacaggacccucgccaaggaaggaaucaaacgcggcgagacagaucaccaugcagugucgcgggggagcgcuaagcugagaugguucgucgagcguaauuuaguuacgccagaaggaaagguggucgaccuuggcugcgguagagggggaugguccuauuacuguggcggucugaaaaacgugaaggagguaaaaggccucaccaaagggggaccuggccacgaagaacccauuccuaugucuacuuauggguggaaucuagugcggcugcagucaggaguugauguguucuuuacaccacccgaaaaaugcgacaccuugcugugugauaucggcgagagcuccccuaacccaacugucgaggccggucgcacacuccgagugcuuaaucuggucgaaaacugguugaauaacaauacccaguucugcauuaaggugcugaaccccuacaugccgaguguuaucgagaagauggaagcccuccaaagaaaauacgggggagcguuaguaaggaauccucugucucggaacagcacgcacgagauguauugggugucaaacgcuuccggcaauauagucaguagcgugaacaugaucucucgcaugcuuauuaauagauuuaccaugaggcauaagaaagcaacauacgaaccagacguugaucugggcuccgggacucgaaacaucggaauugagucagagacccccaaucuagacaucauagguaagcggauugagaaaaucaagcaggagcacgaaacaagcuggcauuaugaucaggaccacccuuacaagacuugggccuaucacggcucguacgagaccaaacagacagggucugcuaguuccauggugaacggagucgugcgucuccugaccaagccaugggacguaauccccauggugacucaaauggccaugacggauacaaccccguucggccagcagagaguuuuuaaagaaaaggucgacacucgcacccaggagccuaaagaggguacaaagaaguugaugaaaauuacggcagaauggcuguggaaggagcucgggaaaaagaaaacccccaggauguguacucgggaagaguucacaagaaaggugcgcagcaaugccgcucuuggagcgauauuuaccgaugagaacaaauggaagucagccagggaagcaguggaggacuccggcuucugggaacuggucgauaaggagcgaaauuuacaucuggaaggcaaaugcgagacuuguguuuauaacaugauggggaagcgggagaaaaaguugggagaauuugguaaagcuaagggcucuagagccaucugguacauguggcucggggcaagguuccuggaguuugaagcccuaggauuccuuaaugaggaccacugguuuagccgcgaaaacagucuguccggcguggagggugaggggcuccauaagcugggauacauuuugcgugauguaagcaaaaaggaaggcggcgcuauguaugccgacgauacagcggggugggacacccggaucacacuggaggaucucaaaaaugaagagauggugacuaaccacauggaaggagagcauaagaaacuugcagaggccauuuucaagcugaccuaccaaaauaaggucgugagaguucagaggccaacgccucgcgguaccgugauggacaucauaucucgacgggaccagagaggcucagggcaggucgugacauauggauuaaacacuuucaccaacauggaagcucaacugaucaggcagauggagggcgaagguguauuuaaaaguauucagcaauugacaguuaaggaggagaucgccgugaaaaauuggcucauucgcgucgggagagaacggcuguccaggauggcaaucagcggagaugacugcguggugaagccccuagaugaccguuucgcuucugcccuuacugcucugaacgauaugggcaaaguccgaaaggacauucagcagugggagccaucgcgcggcuggaaugauuggacccagguucccuuuugcucacaccacuuccaugaacucauaaugaaggacgggagagugcugguagugccuugucggaaccaagaugaguugaucggaagggcccgcauuagccagggugcaggcugguccuuaagagaaacggcgugccuggggaaaaguuacgcccagauguggucucucauguauuuucaccggagggaccuucgacuggcugccaaugcaaucuguagcgcugucccaucccauuggaucccgacaucacguaccacuuggaguauucacgccacacacgaguggaugaccacugaggauaugcuaaccguguggaacagaguuuggauacaggaaaaucccuggauggaggacaagacaccuguggaaucuugggaggaaaucccauaccugggaaaacgcgaggaucaauggugcggcagccucauugguuugacgucccgggcaaccugggccaagaacauccagacugcgauuaaucaggucaggucacugaucgggaacgaggaauauacagacuacaugcccagcaugaaaagauuccgccgggaggaagaggaagcuggagugcuuugguga

SEQ ID NO: 14353 - RNA, 9876 nt, Artificial Sequence
  derived and/or modified CDS sequence (opt3) from DENV-2__KM279557__SS-prME
accgccggaaucauuauaaugaugauccccacagugauggcuuuccaccugacuacgcgaaacggggagccucauaugauugucagcaggcaggaaaagggaaaaucccuccuuuuuaagaccgagaaugguguuaacaugugcacacugauggcaauggacuugggcgaauuaugugaggauacuaucaccuacaauugcccacuguuacggcaaaacgaaccggaggacauugauuguuggugcaauucuacaucaaccugggugacuuaugggacauguaccgccacgggagagcaccgccgagaaaaacguaguguugcgcucgugccccaugucggcaugggucuggagacuagaaccgaaacauggaugagcuccgagggggcuuggaagcacgcccagaggaucgagacuuggauacuucggcauccuggauucaccaucauggcagccauucuggcuuacacaaucggcaccacguauuuucagcgcguguugauuuucauccuccugacugcaguuacaccaucuauggccaugaggugcauaggcauuucgaacagggacuuuguggaaggggucucaggagguagcuggguggauaucguacuggagcacggcaguuguguuaccacuauggcuaaaaauaagcccacacucgacuucgaauuaauuaagaccgaggccaaacaccuggcgacgcuucggaaguacugcguggaagcaaaauugaccaacacaacuaccgccucccgcuguccuacacagggggagccaucucugaaugaggaacaagauaagcgauuugucugcaaacauagcaugguggacagaggauggggcaacgguugugggcuauucggaaagggcggcaucgugacuugcgcuauguuuaccugcaagaaaaauauggaggggaaggucguucagcccgaaaaccucgaguauacaaucgugauuaccccucacuccggagaagagaaugccguagguaacgauacuggcaaacaugggaaggagauaaaagugacgccacagucaaguaucacagaagcagagcugaccggauacggcacugucaccauggaauguagcccgaggacaggucuugacuucaaugagauggugcuguugcagauggaaaacaaggcuuggcucguucaccggcaaugguuucuggauuuaccccugccuuggcucccaggggccgacacccagggcucuaacuggauucagaaagagacucuugugacauucaagaauccccacgcgaagaaacaggaugucgugguacugggaucccaagagggcgccaugcauacggcauugaccggggcuacugaaauccagaugucaagcggaaaccuacuguuuacaggucaccucaagugccgucugcgcauggacaaacuucagcugaagggcaugaguuauucuauguguaccgggaaauucaagguugugaaggagauagccgaaacacaacauggaacuauugucaucagagugcaguacgagggcgacgguuccccuugcaaaaucccauucgagauuauggauuuggaaaagaggcacguccucgggcggcugaucaccgugaaucccauuguuacggagaaagacagcccggugaacauagaagcugagccucccuuuggcgauucguacaucauuaucggaguagaaccaggccaguuaaagcugucuugguucaaaaagggguccucaaucggacagauguuugagaccacaaugcgaggugccaagcgcauggcaauucuaggcgacacugccugggauuucgggagucucggaggcgucuuuaccagcauagguaaagcucugcaucaaguguucggggcgaucuauggcgcagccuuuuccggaguuucuuggacaaugaagauucuuaucggcguggucauuacuuggaucgggaugaauagcagaucaaccaguuuguccgugagccugguacucgugggaguugucacgcuguaccuuggcgugauggugcaggcugacucugguugugucguuucauggaaaaacaaggagcugaaaugcgggaguggaauauucaucacagauaaugugcacaccuggacugaacaguauaaguuucagccugagagccccuccaaguuggccucugcaauucaaaaagcccacgaagagggcaucugugguauuaggucggugacacggcucgaaaaccugauguggaagcagaucaccccagaguuaaaucauauacugacugagaacgaaguaaaacuaaccauuaugacaggcgacaucaaggggauuaugcaggcuggaaaacgcagccucagaccccagccuacggagcugaaguacuccuggaaagccuggggcaaggcaaagaugcuuucaaccgaauugcacaaucauacuuuccugaucgaugggccagagacagcggaaugcccgaacaccaauagggcuuggaacagucucgaggucgaggacuauggauuuggcguguucacaacuaauauauggcugaaauuaaaggaacgucaagauguauuuugugacucuaaacugaugagcgccgcaaucaaggacaaccgggccgugcacgcugauauggguuacuggauugaguccgcccuuaacgacaccuggaaaaucgaaaaggcaucauucauugaggucaagagcugccacuggcccaaaucucauacguugugguccaauggggugcucgagagugaaaugaucauaccuaagaacuucgcuggaccaguuagccagcacaauuaucgacccggcuaccauacacagaccgccgguccuuggcaccugggcagacuagagauggauuuugacuucugugaagggacuaccgugguagucacagaggauugcggaaacaggggcccaucucugcgcacuaccacagcguccgggaaacucauuacggaauggugcugucggucaugcacccugcccccgcuuagauacaggggagaggacggcuguugguaugguauggagauccgcccuuugaaggaaaaagaggaaaaucuggugaacaguuuagugacugccgggcauggacagaucgauaauuuuagccucggcguccuggguauggcucuuuuccuggaggaaauguugcgaacacggguuggcaccaagcacgcaauucuccugguggccguaucguuugugacucuaaucacagggaacauguccuuccgugaccugggaagagucauggugaugguuggcgcuaccaugacggaugacauugggaugggagugacuuaccucgcccugcuugcagcguuuaaggucaggccaaccuucgccgcuggcuugcuguuacgcaaacucacaucuaaggagcugaugaugaccacuauagguaucgugcuucugagccaaucaacaauucccgagaguauccuagaacucaccgaugcccuggcauuggggaugaugguucugaaaauugugcggaauauggagaaguaucaguuagcugucacaaucauggccauacucugcguaccuaacgcagugauccugcagaaugccuggaaaguuuccuguacuacccuugcuguggucucugugagcccccuguugcucacguccucacaacagaaggcggacuggauuccacuggcccuaacaaucaagggacugaacccuaccgcaauuuuucuuacuacccucagcagaacaaguaaaaagaggucuuggccccugaaugaagcuaucauggccguaggcaugguguccauauuggccagcucgcugcuaaagaacgauauuccaaugacuggcccgcucgucgcugggggacugcuuaccguuugcuacgugcugacgggucgaucagcagacuuggagcucgaacgcgccgcggacgugcggugggaggagcaggcugaaaucucuggcaguuccccuauccugagcauuacaauaucugaggaugggagcauguccaucaagaaugaagaggaggaacagacccuaacuauucugaucagaacaggacuucucgucauuucaggccuguuccccgugaguaucccaauaaccgccgcagccugguauuugugggagguuaaaaagcaaagggcugguguauuaugggacgugcccagcccuccacccgucgggaaagcagaacuggaggauggagccuaccguaucaagcagaagggcauucucggcuauucucagaucggggcgggaguguacaaagaagguacuuuucacacaauguggcauguuacccgcggcgcugugcugaugcacaaggggaaacggauugagccuuccugggccgacgucaagaaagaucuuaucucauacggaggcgguuggaagcuggagggggaauggaaggagggagaagaggugcagguauuggcacuagaaccgggcaaaaacccaagagccguccaaacgaagcccggccuguucaaaacuaacaccgggacaauaggagcugugagucucgacuuuagcccugguaccuccggcucuccaauuguugauaagaaagggaagguggucggacuguauggcaauggugugguuacaaggucggggacuuacgugagcgccaucgcacagaccgagaagucaaucgaggacaaccccgaaauugaggaugacaucuuccggaaaaagagacuuacgauaauggauuuacauccuggagcuggcaaaacaaagcgcuaucugccggccauugucagagaagcgaucaaaaggggccuccggacuuugauucuggcccccacccgagugguagcagcugagauggaagaggcccucagagggcugccaauccgcuaccagaccccugcuauaagggcagagcacaccggacgugaaauuguggaccuuaugugucaugccacuuucaccaugcggcuguugucccccaucagaguuccaaauuauaaccuaaucauuauggaugaggcccacuuuacagacccugcuaguaucgcggcaagggguuacauuucuacgcgcgucgaaaugggcgaggccgcugggauauucaugacugccacacccccaggaagccgagacccguuuccucaguccaaugcacccaucauggaugaggaaagagagauuccagaacggucauggaacucuggccacgagugggugacagacuucaaggguaagaccgugugguuuguccccagcaucaaagccgggaaugauaucgcugcgugccugaggaagaacggcaaaaagguaauucaacucagucgcaaaacuuucgacuccgaauauauaaagacacguaccaaugauugggacuuugugguuacgacugauaucagcgagaugggcgccaacuucaaggcagagagagugauugacccucggagguguaugaaaccagucaucuuaacagauggcgaagaacgcgugauucuggcugggcccaugccuguuacccauucuucagccgcacagcgaagaggacggguggguaggaauccgaagaacgaaaaugaccaguacaucuacaugggcgagccacuugaaaacgaugaggacugcgcccacuggaaagaggcuaagaugcugcucgacaauauaaacacccccgaagggaucauuccuuccauguuugagcccgaacgcgagaaagucgaugccaucgacggagaauauagauugaggggcgaggcgcggaagacuuucguggaucugaugcgucgcggugaccucccaguauggcuggcauaccgaguggccgcugaggggauuaacuaugccgauagaaggugguguuuugacggcguuaaaaauaaccaaauccuugaagagaaugucgaaguggagauauggacaaaggagggagaacggaagaaacuaaagccucgcuggcuggaugcuagaauuuacagugaccccuuggcauuaaaagaguucaaggaguucgccgcuggcaggaaaagccugacccucaaccugaucacagagauggggcggcuuccaacuuuuaugacgcagaaggccaagaaugcacuggauaaccucgcgguguugcauaccgccgaagcuggaggucgagccuauaaucacgcacugucggagcuaccugagacacuggaaacucuccuucuguuaaccuugcuggcuacagucaccggcgggauuuuccucuuucugaugucuggaaaaggcaucgguaagaugacucuugggaugugcugcauaaucacggccuccauucugcucugguacgcacagauccagccgcacuggauugccgcuagcaucauauuggaguucuuucugauuguuuuacuaauccccgaaccagagaaacaaagaaccccucaggacaaccagcugacauaugugguaaucgcgauucucacuguggucgccgcaaccauggcuaaugaaaugggcuuccuugagaagaccaaaaaggauuuuggacugggcucaaucaccacucagcaacccgagaguaacauauuggacauugaucugcgcccagccucugccuggacacucuacgcaguggcuacgaccuucaucacuccuaugcugaggcauuccauugaaaauagcucaguuaacgugagucuuacagccaucgcgaaucaggcuaccguccucauggggcugggaaaggguuggcccuugagcaaaauggacauaggcguaccgcuguuagccaucggguguuacucccaggugaacccaauuacccuaacagcagcccugcuccuucugguugcucacuaugcaaucauuggaccuggcuugcaggccaaggcgacucgggaggcucaaaaacgugccgcagccgguaucaugaagaaucccacgguggacgggaugaccgucauugaucuggacccaauccccuacgauccuaaauuugaaaagcagcucggccaggugaugcugcuugucuuaugcgugacacagguucugaugaugagaacuaccugggcucucugugaggccuugacacuggcaaccggaccgauaucuacucuaugggaaggcaaccccgggagguucuggaauacgacaauugcugugagcauggccaacaucuuucgcggauccuaucuggcgggcgccggucuccuuuucucaaucaugaagaacaccgcaaauacucggcgagggaccggaaacacaggcgagacucugggugagaaauggaagaauagauugaacgcucugggcaaaucugaauuucaaauuuacaagaaaagugggauacaggagguagacaggacccucgccaaggaaggaaucaaacgcggcgagacagaucaucacgcagugucgcgggggagcgcuaagcugagaugguucgucgagcguaauuuaguuacgccagaaggaaagguggucgaccuuggcugcgguagagggggaugguccuauuacuguggcggucugaaaaacgugaaggagguaaaaggccucaccaaagggggaccuggccaugaagaacccauuccuaugucuacuuauggguggaaucuagugcggcugcagucaggaguugauguguucuuuacaccacccgaaaaaugcgacaccuugcugugugauaucggcgagagcuccccuaacccaacugucgaggccggucgcacacuccgagugcuuaaucuggucgaaaacugguugaauaacaauacccaauucugcauuaaggugcugaaccccuacaugccgaguguuaucgagaagauggaagcccuccagagaaaauacgggggagcguuaguaaggaauccucugucucggaacagcacgcacgagauguauugggugucaaacgcuuccggcaauauagucaguagcgugaacaugaucucucgcaugcuuauuaauagauuuaccaugaggcacaagaaagcaacauacgaaccagacguugaucugggcuccgggacucgaaacaucggaauugagucagagacccccaaucuagacaucauagguaagcggauugagaaaaucaagcaggagcaugaaacaagcuggcacuaugaucaggaccauccuuacaagacuugggccuaucacggcucguacgagaccaaacaaacagggucugcuaguuccauggugaacggagucgugcgucuccugaccaagccaugggacguaauccccauggugacucagauggccaugacggauacaaccccguucggccagcagagaguuuuuaaagaaaaggucgacacucgcacccaagagccuaaagaggguacaaagaaguugaugaaaauuacggcagaauggcuguggaaggagcucgggaaaaagaaaacccccaggauguguacucgggaagaguucacaagaaaggugcgcagcaaugccgcucuuggagcgauauuuaccgaugagaacaaauggaagucagccagggaagcaguggaggacuccggcuucugggaacuggucgauaaggagcgaaauuuacaccuggaaggcaaaugcgagacuuguguuuauaacaugauggggaagcgggagaaaaaguugggagaauuugguaaagcuaagggcucuagagccaucugguacauguggcucggggcaagguuccuggaguuugaagcccuaggauuccuuaaugaggaccauugguuuagccgcgaaaacagucuguccggcguggagggugaggggcuccacaagcugggauacauuuugcgugauguaagcaaaaaggaaggcggcgcuauguaugccgacgauacagcggggugggacacccggaucacacuggaggaucucaaaaaugaagagauggugacuaaccauauggaaggagagcacaagaaacuugcagaggccauuuucaagcugaccuaccagaauaaggucgugagaguucagaggccaacgccucgcgguaccgugauggacaucauaucucgacgggaccagagaggcucagggcaagucgugacauauggauuaaacacuuucaccaacauggaagcucagcugaucaggcagauggagggcgaagguguauuuaaaaguauucaacaguugacaguuaaggaggagaucgccgugaaaaauuggcucauucgcgucgggagagaacggcuguccaggauggcaaucagcggagaugacugcguggugaagccccuagaugaccguuucgcuucugcccuuacugcucugaacgauaugggcaaaguccgaaaggacauucagcagugggagccaucgcgcggcuggaaugauuggacccaaguucccuuuugcucacaucacuuccacgaacucauaaugaaggacgggagagugcugguagugccuugucggaaccaggaugaguugaucggaagggcccgcauuagccagggugcaggcugguccuuaagagaaacggcgugccuggggaaaaguuacgcccagauguggucucucauguauuuucaucggagggaccuucgacuggcugccaauagcaucuguuccgcagucccaucacacuggaucccgacaagucguaccacuuggucuauucaugcuacacacgaguggaugaccacugaggauaugcuaaccguguggaacagaguuuggauacaagaaaaucccuggauggaggacaagacaccuguggaaagcugggaggaaaucccauaccugggaaaacgcgaggaucaguggugcggcucccucauugguuugacgucacgggccaccugggcaaagaacauccagacugccauuaaucaggucaggagccugaucgggaacgaggaauauacagacuacaugcccucuaugaaaagauuccgccgggaggaagaggaagcgggagugcuuugguga

SEQ ID NO: 14354 - RNA, 9876 nt, Artificial Sequence
  derived and/or modified CDS sequence (opt3) from DENV-2__KM279591__SS-prME
accgccggcaucauuauaaugaugauccccacagugauggcuuuccaccugacuacgagaaacggggagccucauaugauugucagcaggcaggaaaagggaaaaucccuccuuuuuaagaccgagaaugguguuaacaugugcacacugauggcaauggacuugggcgaauuaugugaggauacuaucaccuacaauugcccacugcuacggcaaaacgaaccggaggacauugauuguuggugcaauucuacaucaaccugggugacuuaugggacauguaccgccacgggagagcaccgccgagaaaaacguaguguagcgcucgugccccaugucggcaugggucuggagacuagaaccgaaacauggaugagcuccgagggggcuuggaagcacgcccagaggaucgagacuuggauacuucggcauccuggauucaccaucauggcagccauucuggcuuacacaaucggcaccacguauuuucagcgcguguugauuuucauccuccugacugcaguuacaccaucuauggccaugagaugcauaggcauuucgaacagggacuuuguggaaggggucucaggagguagcuggguggauaucguacuggagcacggcaguuguguuaccacuauggcuaaaaauaagcccacacucgacuucgaauuaauuaagaccgaggccaaacaccuggcgacgcuucggaaguacugcguggaagcaaaauugaccaacacaacuaccgccucccgcuguccuacacagggggagccaucucugaaugaggaacaagauaagcgauuugucugcaaacauagcaugguggacagaggauggggcaacgguugugggcuauucggaaagggcggcaucgugacuugcgcuauguuuaccugcaagaaaaauauggaggggaaggucguucagcccgaaaaccucgaguauacaaucgugauuaccccucacuccggagaagagaaugccguagguaacgauacuggcaaacaugggaaggagauaaaagugacgccacagucaaguaucacagaagcagagcugaccggauacggcacugucaccauggaauguagcccgaggacaggucuugacuucaaugagauggugcuguugcagauggaaaacaaggcuuggcucguucaccggcaaugguuucuggauuuaccccugccuuggcucccaggggccgacacccagggcucuaacuggauucagaaagagacucuugugacauucaagaauccccacgcgaagaaacaggaugucgugguacugggaucccaagagggcgccaugcauacggcauugaccggggcuacugaaauccagaugucaagcggaaaccuacuguuuacaggucaccucaagugccgucugcgcauggacaaacuucagcugaagggcaugaguuauucuauguguaccgggaaauucaagguugugaaggagauagccgaaacacaacauggaacuauugucaucagagugcaguacgagggcgacgguuccccuugcaaaaucccauucgagauuauggauuuggaaaagaggcacguccucgggcggcugaucaccgugaaucccauuguuacggagaaagacagcccggugaacauagaagcugagccucccuuuggcgauucguacaucauuaucggaguagaaccaggccaguuaaagcugucuugguucaaaaagggguccucaaucggacagauguuugagaccacaaugcgaggugccaagcgcauggcaauucuaggcgacacugccugggauuucgggagucucggaggcgucuuuaccagcauagguaaagcucugcaucaaguguucggggcgaucuauggcgcagccuuuuccggaguuucuuggacaaugaagauucuuaucggcguggucauuacuuggaucgggaugaauagcagaucaaccaguuuguccgugagccugguacucgugggaguugucacgcuguaccuuggcgugauggugcaggcugacucugguugugucguuucauggaaaaacaaggagcugaaaugcgggaguggaauauucaucacagauaaugugcacaccuggacugaacaguauaaguuucagccugagagccccuccaaguuggccucugcaauucaaaaagcccacgaagagggcaucugugguauuaggucggugacacggcucgaaaaccugauguggaagcagaucaccccagaguuaaaucauauacugacugagaacgaaguaaaacuaaccauuaugacaggcgacaucaaggggauuaugcaggcuggaaaacgcacgcucagaccccagccuaccgagcugaaguacagcuggaaagccuggggcaaggcaaagaugcuuuccacugaauugcacaaucauacauuccugaucgaugggccagagaccgcggaaugcccgaacacaaauagggcuuggaacucacucgaggucgaggacuauggauuuggcguguucacuaccaauauauggcugaaauuaaaggaacgucaagauguuuuuugugacaguaaacugaugucugccgcaaucaaggacaaccgggccgugcacgcugauauggguuacuggauugagagcgcccuuaacgacacguggaaaaucgaaaaggcauccuucauugaggucaagucaugccacuggcccaaaagccauacauuguggucuaauggggugcucgaguccgaaaugaucauaccuaagaacuucgcuggaccaguuagucagcacaauuaucgacccggcuaccauacccagacugccgguccuuggcaccugggcagacuagagauggauuuugacuucugugaagggaccacagugguagucacugaggauugcggaaacaggggcccaagccugcgcaccacaacggcgucugggaaacucauuaccgaauggugcugucgguccugcacucugcccccgcuuagauacaggggagaggacggcuguugguaugguauggagauccgcccuuugaaggaaaaagaggaaaaucuggugaacucauuagugacagccgggcauggacagaucgauaauuuuagucucggcguccuggguauggcucuuuuccuggaggaaauguugcgaacccggguuggcacuaagcacgcaauucuccugguggccguaagcuuugugacacuaaucaccgggaacaugucguuccgugaccugggaagagucauggugaugguuggcgcuacgaugacugaugacauugggaugggagugaccuaccucgcccugcuugcagcguuuaaggucaggccaacauucgccgcuggcuugcuguuacgcaaacucaccuccaaggagcugaugaugacuacaauagguaucgugcuucugucucaaagcaccauucccgagucaauccuagaacucacagaugcccuggcauuggggaugaugguucugaaaauugugcggaauauggagaaguaucaguuagcugucacuaucauggccauacucugcguaccuaacgcagugauccugcagaaugccuggaaaguuaguuguaccacgcuugcuguggucuccgugucuccccuguugcucacaagcucccaacagaaggcggacuggauuccacuggcccuaaccaucaagggacugaacccuacugcaauuuuucuuaccacacucucaagaacuagcaaaaagaggaguuggccccugaaugaagcuaucauggccguaggcauggugucuauauuggccuccagccuguuaaaaaacgauauuccaaugaccggcccgcucgucgcugggggacugcuuacgguuugcuacgugcugacaggucgaucggcagacuuggagcucgaacgcgccgcggacgugcggugggaggagcaggcugaaaucucaggcucuaguccuauccuguccauuaccauaagcgaggaugggucuaugagcaucaagaaugaagaggaggaacagacucuaacaauucugaucagaaccggacuucucgucauuuccggccuguuccccgugucaaucccaauaacugccgcagccugguauuugugggagguuaaaaagcaaagggcugguguauuaugggacgugcccaguccuccacccgucgggaaagcagaacuggaggauggagccuaccguaucaagcagaagggcauucucggcuauagccagaucggggcgggaguguacaaagaagguacauuucacaccauguggcauguuacgcgcggcgcugugcugaugcacaaggggaaacggauugagccuucuugggccgacgucaagaaagaucuuaucuccuacggaggcgguuggaagcuggagggggaauggaaggagggagaagaggugcagguauuggcacuagaaccgggcaaaaacccaagagccguccaaacuaagcccggccuguucaaaaccaacacagggaccauaggagcugugucacucgacuuuaguccugguacaagcggcuccccaauuguugauaagaaagggaagguggucggacuguauggcaauggugugguuacuaggucugggaccuacgugucggccaucgcacagacggagaagagcaucgaggacaaccccgaaauugaggaugacaucuuccgaaaaaagcggcuuacaauaauggauuuacauccuggagcuggcaaaacuaagcgcuaucugccggccauugucagagaagcgaucaaaaggggccuccggaccuugauucuggcccccacacgagugguagcagcugagauggaagaggcccucagagggcugccaauccgcuaccagaccccugcuauaagggcagagcacacuggacgugaaauuguggaccuuaugugucaugccaccuucacaaugcggcuguugucacccaucagaguuccaaauuauaaccuaaucauuauggaugaggcccacuuuacggacccugcuuccaucgcggcaagggguuacauuaguacucgcgucgaaaugggcgaggccgcugggauauucaugaccgccacacccccaggaucucgagacccguuuccucagagcaaugcacccaucauggaugaggaaagagagauuccagaacgguccuggaacucaggccacgagugggugaccgacuucaaggguaagacugugugguuuguccccucuaucaaagccgggaaugauaucgcugcgugccugaggaagaacggaaaaaagguaauucaacucagccgcaaaacauucgacagugaauauauaaagacccguacgaaugauugggacuuugugguuacuacagauaucuccgagaugggcgccaacuucaaggcagagagagugauugacccucggagguguaugaaaccagucaucuuaaccgauggcgaagagcgcgugauucuggcugggcccaugccuguuacccauagcucugccgcacagcgaagaggacggguggguaggaauccgaagaacgaaaaugaccaguacaucuacaugggcgagccacuugaaaacgaugaggacugcgcccacuggaaagaggcuaagaugcugcucgacaauauaaacacucccgaagggaucauuccuucaauguuugagcccgaacgcgagaaagucgaugccaucgacggagaauauagauugaggggcgaggcgcggaagacauucguggaucugaugcgucgcggugaccucccaguauggcuggcauaccgaguggccgcugaggggauuaacuauguugauagaaggugguguuuugacggcgucaaaaauaaccaaauccuugaagagaauguggaaguggagauauggaccaaggagggagaacggaagaaacuaaagccucgcuggcuggaugccagaauuuacuccgaccccuuggcuuuaaaagaguucaaggaauucgcagccggcaggaaaagucugacacucaaccugaucacugagauggggcggcuuccaacguuuaugacccagaaggcuaagaaugcccuggauaaccucgcagucuugcauacagcggaagccggaggucgagcuuauaaucacgcccugagcgagcuaccugagacucuggaaacccuccuucuguuaacauugcuggcaaccguuacuggcgggauuuuccucuuucugaugucgggaaaaggcaucgguaagaugacgcuugggaugugcugcauaaucaccgcuucuauucugcucugguacgcccagauccagccgcacuggauugcagccuccaucauauuggaguucuuucugauuguguuacuaauccccgaaccagagaaacaaagaacaccucaggacaaccagcugacuuauguagugaucgcuauucucaccgucguggcggccacaauggcaaaugaaaugggcuuccuugagaagaccaaaaaggauuuuggacugggcagcaucacuacacagcaacccgagucaaacauauuggacauugaucugcgcccagcuagugccuggacgcucuacgccguugcaaccacuuucaucacaccuaugcugaggcauucuauugaaaauuccagcgugaacgucucacuuaccgcuaucgccaaucaggcgaccguacucauggggcugggaaaggguuggcccuugaguaaaauggacauaggcgugccgcuguuagcuaucggguguuacagccagguuaacccaauuacacuaacugccgcacugcuccuucugguggcccacuaugcuaucauuggaccuggcuugcaggcaaaggccacgcgggaggcgcaaaaacgugcugccgcagguaucaugaagaaucccaccgucgacgggaugacagugauugaucuggacccaauccccuacgauccuaaauuugaaaagcagcucggccaggucaugcugcuuguguuaugcguuacucaggugcugaugaugagaaccacaugggcccucugugaggcuuugacccuggccacuggaccgauauccacgcuaugggaaggcaaccccgggagguucuggaauacaaccauugcaguaucuauggcuaacaucuuucgcggaagcuaucuggccggcgcgggucuccuuuucuccaucaugaagaacacugccaauacccggcgagggacaggaaacacuggcgagacccugggugagaaauggaagaauagauugaacgcacugggcaaaucagaauuucaaauuuacaagaaaucugggauacaggagguggacaggacacucgcuaaggaaggaaucaaacgcggcgagacggaucaucacgccgucagucgggggucggcaaagcugagaugguucguugagcguaauuuagugaccccagaaggaaaggucguggaccuuggcugcgguagggggggauggagcuauuacuguggcggucugaaaaacguaaaggaggugaaaggccucacuaaggggggaccuggccaugaagagcccauuccuauguccacauauggguggaaucuaguucggcugcagucuggaguggaugucuucuuuaccccacccgaaaaaugcgacacuuugcugugugauaucggcgagucaagcccuaacccaacaguggaggcuggucgcacccuccgaguccuuaaucugguggaaaacugguugaauaacaauacgcaauucugcauuaagguucugaaccccuacaugccguccguaaucgagaagauggaagcccuccagagaaaauacgggggagccuuagugaggaauccucugagucggaacucuacccacgagauguauugggucagcaacgcgucaggcaauauaguguccaguguuaacaugaucagccgcaugcuuauuaauagauuuacaaugaggcacaagaaagcuacuuacgaaccagacguggaucugggcucugggacccgaaacaucggaauugaguccgagacacccaaucuagacaucauagguaagcggauugaaaaaaucaagcaggagcaugaaacuucauggcacuaugaucaggaccauccuuacaagaccugggcauaucacggcagcuacgagacaaaacaaaccgggucggccucuaguauggucaacggagugguacgucuccugacuaagccaugggacgugauccccaugguuacgcagauggcuaugacagauaccacuccguucggccagcagagagucuuuaaagaaaagguggacacccgcacacaagagccuaaagaggguacgaagaaguugaugaaaauuaccgccgaauggcuguggaaggagcucgggaaaaagaaaacucccaggauguguacacgggaagaguucaccagaaaggugcgcuccaaugcagcccuuggagcuauauuuacugaugagaacaaauggaagagcgcgagggaagccgucgaggacucaggcuucugggaacugguugauaaggagcgaaauuuacaccuggaaggcaaaugcgagacauguguguauaacaugauggggaagcgggagaaaaaguugggagaauuugguaaagcaaagggcuccagagcuaucugguacauguggcucggggccagguuccuggaguuugaagcacuaggauuccuuaaugaggaccauugguuuucucgcgaaaacagccugaguggcguagagggugaggggcuccacaagcugggauacauuuugcgugauguguccaaaaaggaaggcggcgccauguaugcugacgauaccgccgggugggacacacggaucacucuggaggaucucaaaaaugaagagauggucaccaaccauauggaaggagagcacaagaaacuugcggaggcaauuuucaagcugacguaccagaauaaggugguuagagugcagaggccaaccccucgcgguacagucauggacaucauaagccgacgggaccagagaggcucugggcaagugguaacuuauggauuaaacaccuucacaaacauggaagcccagcugaucaggcagauggagggcgaagguguuuuuaaaucaauucaacaguugacugugaaggaggagaucgcugucaaaaauuggcucauucgcguggggagagaacggcugaguaggauggccaucuccggagaugacugcguggucaagccccuagaugaccguuucgcaagcgcucuuaccgcccugaacgauaugggcaaaguucgaaaggacauucagcagugggagccaucucgcggcuggaaugauuggacgcaagugcccuuuugcucgcaucacuuccacgaacucauaaugaaggacgggagaguacugguggucccuugucggaaccaggaugaguugaucggaagggcucgcauuucacagggugccggcuggagcuuaagagaaacagcaugccuggggaaauccuacgcgcagauguggagucucauguauuuucaucggagggaccuucgacuggccgcuaaugccaucuguucugcagugccaagccacuggaucccgaccucccguacuacauggucaauucaugcuacccacgaguggaugacuaccgaggauaugcuaacaguuuggaacagaguguggauacaagaaaaucccuggauggaggacaagacgccugucgaaaguugggaggaaaucccauaccugggaaaacgcgaggaucaguggugcggcucucucauugguuugaccagccgggccacuugggcaaagaacauccagacagccauuaaucaggugaggucccugaucgggaacgaggaauauaccgacuacaugcccucaaugaaaagauuccgccgggaggaagaggaagcgggaguacuuugguga

SEQ ID NO: 14355 - RNA, 9876 nt, Artificial Sequence
  derived and/or modified CDS sequence (opt3) from DENV-2__KM279558__SS-prME
accgccggcaucauuauaaugaugauccccacagugauggcuuuccaccugacuacgagaaacggggagccucauaugauugucagcaggcaggaaaagggaaaaucccuccuuuuuaagaccgagaaugguguuaacaugugcacacugauggcaauggacuugggcgaauuaugugaggauacuaucaccuacaauugcccacugcuacggcaaaacgaaccggaggacauugauuguuggugcaauucuacaucaaccugggugacuuaugggacauguaccgccacgggagagcaccgccgagaaaaacguaguguagcgcucgugccccaugucggcaugggucuggagacuagaaccgaaacauggaugagcuccgagggggcuuggaagcacgcccagaggaucgagacuuggauacuucggcauccuggauucaccaucauggcagccauucuggcuuacacaaucggcaccacguauuuucagcgcguguugauuuucauccuccugacugcaguuacaccaucuauggccaugagaugcauaggcauuucgaacagggacuuuguggaaggggucucaggagguagcuggguggauaucguacuggagcacggcaguuguguuaccacuauggcuaaaaauaagcccacacucgacuucgaauuaauuaagaccgaggccaaacaccuggcgacgcuucggaaguacugcguggaagcaaaauugaccaacacaacuaccgccucccgcuguccuacacagggggagccaucucugaaugaggaacaagauaagcgauuugucugcaaacauagcaugguggacagaggauggggcaacgguugugggcuauucggaaagggcggcaucgugacuugcgcuauguuuaccugcaagaaaaauauggaggggaaggucguucagcccgaaaaccucgaguauacaaucgugauuaccccucacuccggagaagagaaugccguagguaacgauacuggcaaacaugggaaggagauaaaaaucacgccacagucaaguauuacagaagcagagcugaccggauacggcacugugaccauggaauguagcccgaggacaggucuugacuucaaugagaugguccuguugcagauggaaaacaaggcuuggcucgugcaccggcaaugguuucuggauuuaccccugccuuggcucccaggggccgacacccagggcucuaacuggauccagaaagagacucuuguuacauucaagaauccccacgcgaagaaacaggauguggucgugcugggaucccaagagggcgccaugcauacggcauugaccggggcuacugaaauacagaugucaagcggaaaccuacuguuuacaggucaccucaagugccgucugcgcauggacaaacuucagcugaagggcaugaguuauucuauguguaccgggaaauucaagguaguuaaggagauugccgaaacacaacauggaacuaucgugaucagaguccaguacgagggcgacgguuccccuugcaaaauuccauucgagaucauggauuuggaaaagaggcacgugcucgggcggcugauuaccgucaaucccauagugacggagaaagacagcccgguuaacaucgaagcugagccucccuuuggcgauucguacauuaucaucggaguggaaccaggccaguuaaagcugucuugguucaaaaagggguccucaauuggacagauguuugagaccacaaugcgaggugccaagcgcauggcaauacuaggcgacacugccugggauuucgggagucucggaggcguauuuaccagcaucgguaaagcucugcaucaagucuucggggcgauuuauggcgcagccuuuuccggagugucuuggacaaugaagauccuuauuggcguugugaucacuuggauagggaugaauagcagaucaaccaguuuguccgucagccuggugcucguaggagugguuacgcuguaccuuggcgucauggugcaggcugacucugguuguguggucucauggaaaaacaaggagcugaaaugcgggaguggaaucuucauuacagauaauguucacaccuggacugaacaguauaaguuucagccugagagccccuccaaguuggccucugcaauccaaaaagcccacgaagagggcauuugugguaucaggucggugacacggcucgaaaaccugauguggaagcagauaaccccagaguuaaaucauauucugacugagaacgaagugaaacuaaccaucaugacaggcgacauuaaggggaucaugcaggcuggaaaacgcagccucagaccccagccuacggagcugaaguacuccuggaaagccuggggcaaggcaaagaugcuuucaaccgaauugcacaaucauacuuuccugauagaugggccagagacagcggaaugcccgaacaccaauagggcuuggaacagucucgagguagaggacuauggauuuggcgucuucacaacuaauaucuggcugaaauuaaaggaacgucaagauguguuuugugacucuaaacugaugagcgccgcaauuaaggacaaccgggccguucacgcugauauggguuacuggaucgaguccgcccuuaacgacaccuggaaaauugaaaaggcaucauucaucgaggugaagagcugccacuggcccaaaucucauacguugugguccaaugggguccucgagagugaaaugauaauuccuaagaacuucgcuggaccagugagccagcacaauuaucgacccggcuaccauacacagaccgccgguccuuggcaccugggcagacuagagauggauuuugacuucugugaagggacuaccguugugguaacagaggauugcggaaacaggggcccaucucugcgcacuaccacagcguccgggaaacucaucacggaauggugcugucggucaugcacccugcccccgcuuagauacaggggagaggacggcuguugguaugguauggagauccgcccuuugaaggaaaaagaggaaaaucuggucaacaguuuagugacugccgggcauggacagauugauaauuuuagccucggcgugcuggguauggcucuuuuccuggaggaaauguugcgaacacgggucggcaccaagcacgcaauccuccugguugccgugucguuuguaacucuaauuacagggaacauguccuuccgugaccugggaagagugauggucauggugggcgcuaccaugacggaugacauagggaugggaguuacuuaccucgcccugcuugcagcguuuaaggugaggccaaccuucgccgcuggcuugcuguuacgcaaacucacaucuaaggagcugaugaugaccacuaucgguauuguccuucugagccaaucaacaauccccgagaguauucuagaacucaccgaugcccuggcauuggggaugauggugcugaaaaucguucggaauauggagaaguaucaguuagcugugacaauaauggccaucuccugcgucccuaacgcaguaauucuccagaaugccuggaaagugucuuguacuacccuggcuguugugagcgucuccccccuucuguugacgucaagccaacagaaggcggacuggaucccacucgcccugacaauuaagggacuaaacccuaccgcaaucuuucugacuacccuuaguagaacaucuaaaaagagguccuggccccucaaugaagcuauaauggccgugggcaugguaagcauucuggccucgucauugcugaaaaacgauaucccaaugacuggcccguuaguggcugggggacuccugaccgucugcuacguucuuacgggucgaucugcagaccuggaguuggaacgcgccgcggacgugcggugggaggagcaggcugaaaucaguggcuccagcccuauucucucuauaacaaucagcgaggauggguccaugucaauuaagaaugaagaggaggaacagacccugacuauccuaauuagaacaggacugcuugugaucaguggccucuuccccgucagcauaccaaucaccgccgcagccugguaucugugggaggugaaaaagcaaagggcugguguuuugugggacguacccucuccuccacccguggggaaagcagaauuagaggauggagccuaccguauuaagcagaagggcauccugggcuauucccagauuggggcgggagucuacaaagaagguacuuuucacacaauguggcaugugacccgcggcgcuguucucaugcacaaggggaaacggaucgagccuucaugggccgacgugaagaaagaucugauaaguuacggaggcgguuggaagcuugagggggaauggaaggagggagaagagguccaggugcuggcauuggaaccgggcaaaaacccaagagccguacaaacgaagcccggccuauucaaaacuaacaccgggacaauuggagcugucagccuggacuuuuccccugguaccucuggcucgccaaucguggauaagaaagggaagguugugggacucuauggcaauggugucgugacaaggagcgggacuuacguuucagccaucgcacagaccgagaaguccauugaggacaaccccgaaaucgaggaugacauauuccgaaaaaagcggcugacgauuauggaucuucauccuggagcuggcaaaacaaagcgcuauuuaccggccaucgugagagaagcgauuaaaaggggccugcggacucucaucuuggcccccacccgagucguggcagcugagauggaagaggcccugagagggcucccaauacgcuaccagacaccugcuauuagggcagagcacaccggacgugaaaucguagaccugaugugucaugccacuuucaccaugcggcuucugagucccaucagagugccaaauuauaacuugauuaucauggaugaggcccacuuuacagacccugcuucuauugcggcaagggguuacauaagcacgcgcguugaaaugggcgaggccgcugggaucuucaugacugccacccccccaggaucccgagacccguuuccucagucaaaugcacccauuauggaugaggaaagagagaucccagaacggucuuggaacagcggccacgagugggucacagacuucaaggguaagaccgugugguuugugcccaguaucaaagccgggaaugauauugcugcgugccuaaggaagaacggaaaaaaggucauacaacugucccgcaaaacuuucgacagcgaauauaucaagacacguaccaaugauugggacuuuguagugacgacugauauuucugagaugggcgccaacuucaaggcagagagaguuaucgacccucggagguguaugaaaccagugauucucacagauggcgaagagcgcgucaucuuagcugggcccaugccugugacccauucauccgccgcacagcgaagaggacggguugguaggaauccgaagaacgaaaaugaccaguacauauacaugggcgagccacuggaaaacgaugaggacugcgcccacuggaaagaggcuaagaugcuucuggacaauaucaacacccccgaagggauuaucccuaguauguuugagcccgaacgcgagaaaguggaugccauugacggagaauauagacucaggggcgaggcgcggaagacuuucgucgauuugaugcgucgcggugaccugccaguguggcucgcauaccgaguagccgcugaggggaucaacuaugccgauagaaggugguguuuugacggcgugaaaaauaaccaaauacuggaagagaauguugaagucgagauuuggacaaaggagggagaacggaagaaacuuaagccucgcuggcuagaugcuagaaucuacagcgacccccuggcauugaaagaguucaaggaauucgccgcuggcaggaaaucguuaacccugaaccucauuacagagauggggcggcugccaacuuuuaugacgcagaaggccaagaaugcacuugauaaccuggcggugcuccauaccgccgaagcuggaggucgagccuauaaucacgcauugucugagcugccugagacacuagaaacucugcuccuucugaccuuauuggcuacagugaccggcgggaucuuccuguuucucauguccggaaaaggcauagguaagaugacucuggggaugugcugcaucauuacggccagcauccuucugugguacgcacagauucagccgcacuggaucgccgcuucaauaauucucgaguucuuuuugaucguccuguuaauccccgaaccagagaaacaaagaaccccucaggacaaccagcuaacauauguugugauugcgauccugacuguaguggccgcaaccauggcuaaugaaaugggcuuccucgagaagacaaaaaaggauuuuggacuuggcaguauaaccacucagcaacccgagucuaacauucuggacaucgauuugcgcccagccuccgccuggacacuguacgcagucgcuacgaccuucauuacuccuaugcucaggcauagcaucgaaaauucaagugugaacguuagccugacagccauagcgaaucaggcuaccgugcuuauggggcucggaaaggguuggccccuguccaaaauggacaucggcgucccguugcuggccauuggguguuacucucagguaaacccaaucaccuuaacagcagcccuacugcuccuuguggcucacuaugcaauuaucggaccuggccugcaggccaaggcgacucgggaggcucaaaaacgugccgcagccgguauuaugaagaaucccacgguugacgggaugaccgugaucgauuuggacccaauacccuacgauccuaaauuugaaaagcagcugggccaggucaugcuccuggugcuuugcgucacacagguguuaaugaugagaacuaccugggcucugugugaggcccucacauuggcaaccggaccgauuagcacucugugggaaggcaaccccgggagguucuggaauacgacaaucgcuguuuccauggccaacaucuuucgcggaucauaucuagcgggcgccggucugcucuucucuauuaugaagaacaccgcaaauacucggcgagggaccggaaacacaggcgagacucuuggugagaaauggaagaauagacugaacgcuuugggcaaaagugaauuucaaauauacaagaaaucggggauccaggagguggacaggacccuggccaaggaaggaauuaaacgcggcgagacagaucaucacgcaguaagccggggguccgcuaagcucagaugguucguggagcguaaucuggucacgccagaaggaaagguuguggacuuaggcugcgguagggggggauggucuuauuacuguggcggucuuaaaaacgucaaggaggugaaaggccugaccaaggggggaccuggccaugaagagcccaucccuaugucaacuuauggguggaaucucguacggcuacagagcggaguggauguuuucuuuacaccacccgaaaaaugcgacacccuguugugugauauuggcgaguccaguccuaacccaacuguggaggccggucgcacacugcgaguccucaaucuuguggaaaacuggcugaauaacaauacccaauucugcaucaaggucuugaaccccuacaugccgucugugauagagaagauggaagcccugcagagaaaauacgggggagcgcucguuaggaauccuuuaagccggaacucaacgcacgagauguauuggguauccaacgcuaguggcaauaucgugagcucugucaacaugauuucccgcaugcugaucaauagauuuaccaugaggcacaagaaagcaacauacgaaccagacguggaucuuggcucagggacucgaaacauuggaaucgagagcgagacccccaaucuggacauaauugguaagcggaucgaaaaaaucaagcaggagcaugaaacaucguggcacuaugaucaggaccauccuuacaagacuugggccuaucacggcucuuacgagaccaaacaaacagggagugcuuccagcaugguuaacggagugguccgucuacucaccaagccaugggacgugauucccaugguaacucagauggccaugacggauacaaccccguucggccagcagagaguguuuaaagaaaagguugacacucgcacccaagagccuaaagaggguacaaagaagcugaugaaaauaacggcagaaugguuguggaaggagcuggggaaaaagaaaacccccaggauguguacucgggaagaguucacaagaaagguccgcucaaaugccgcucucggagcgaucuuuaccgaugagaacaaauggaaguccgccagggaagcaguggaggacucuggcuucugggaacuuguggauaaggagcgaaaucugcacuuagaaggcaaaugcgagacuugugucuauaacaugauggggaagcgggagaaaaagcugggagaauuugguaaagcuaagggcagcagagccauuugguacaugugguugggggcaagguuccucgaguuugaagcccugggauuccuaaaugaggaccauugguuuagucgcgaaaacucccuuagcggcguugagggugaggggcugcacaagcucggauacauccugcgugaugugucuaaaaaggaaggcggcgcuauguaugccgacgauacagcggggugggacacccggauuacauuggaggaucugaaaaaugaagagaugguaacuaaccauauggaaggagagcacaagaaacucgcagaggccaucuucaagcuuaccuaccagaauaagguggucagagugcagaggccaacgccucgcgguaccguuauggacauaaucucacgacgggaccagagaggcagugggcaaguggucacauauggacugaacacuuucaccaacauggaagcucaguuaauuaggcagauggagggcgaagguguguuuaaauccauccaacagcugacaguaaaggaggagauugccguuaaaaauugguugauccgcguggggagagaacggcucagcaggauggcaauuucuggagaugacugcgucgugaagccccuggaugaccguuucgcuucggcccuaacugcucuuaacgauaugggcaaagugcgaaaggacauacagcagugggagccaucacgcggcuggaaugauuggacccaaguccccuuuugcagccaucacuuccacgaacugaucaugaaggacgggagaguucucgugguaccuugucggaaccaggaugagcugauuggaagggcccgcaucucccagggugcaggcuggaguuugagagaaacggcgugcuuagggaaaucuuacgcccagauguggagccugauguauuuucaucggagggaccuccgacuugcugccaaugcaaucuguuccgcugugccaucacacuggauuccgacaagucguaccacuuggucuauacaugccacacacgaguggaugaccacugaggauaugcugaccgucuggaacagaguguggauccaagaaaaucccuggauggaggacaagacaccuguugaaagcugggaggaaauuccauaccuaggaaaacgcgaggaucaguggugcggcucccugaucggucucacgucacgggcaaccugggccaagaacauucagacugcgaucaaucaggugaggagcuugauagggaacgaggaauauacagacuacaugcccucuaugaaaagauuccgccgggaggaagaggaagcuggaguccugugguga

SEQ ID NO: 14356 - RNA, 9876 nt, Artificial Sequence
  derived and/or modified CDS sequence (opt3) from DENV-2__KM279564__SS-prME
accgccggcaucauuauaaugaugauccccacagugauggcuuuccaccugacuacgagaaacggggagccucauaugauugucagcaggcaggaaaagggaaaaucccuccuuuuuaagaccgagaaugguguuaacaugugcacacugauggcaauggacuugggcgaauuaugugaggauacuaucaccuacaauugcccacugcuacggcaaaacgaaccggaggacauugauuguuggugcaauucuacaucaaccugggugacuuaugggacauguaccgccacgggagagcaccgccgagaaaaacguaguguagcgcucgugccccaugucggcaugggucuggagacuagaaccgaaacauggaugagcuccgagggggcuuggaagcacgcccagaggaucgagacuuggauacuucggcauccuggauucaccaucauggcagccauucuggcuuacacaaucggcaccacguauuuucagcgcguguugauuuucauccuccugacugcaguuacaccaucuauggccaugagaugcauaggcauuucgaacagggacuuuguggaaggggucucaggagguagcuggguggauaucguacuggagcacggcaguuguguuaccacuauggcuaaaaauaagcccacacucgacuucgaauuaauuaagaccgaggccaaacaccuggcgacgcuucggaaguacugcguggaagcaaaauugaccaacacaacuaccgccucccgcuguccuacacagggggagccaucucugaaugaggaacaagauaagcgauuugucugcaaacauagcaugguggacagaggauggggcaacgguugugggcuauucggaaagggcggcaucgugacuugcgcuauguuuaccugcaagaaaaauauggaggggaaggucguucagcccgaaaaccucgaguauacaaucgugauuaccccucacuccggagaagagaaugccguagguaacgauacuggcaaacaugggaaggagauaaaaaucacgccacagucaaguauuacagaagcagagcugaccggauacggcacugugaccauggaauguagcccgaggacaggucuugacuucaaugagaugguccuguugcagauggaaaacaaggcuuggcucgugcaccggcaaugguuucuggauuuaccccugccuuggcucccaggggccgacacccagggcucuaacuggauccagaaagagacucuuguuacauucaagaauccccacgcgaagaaacaggauguggucgugcugggaucccaagagggcgccaugcauacggcauugaccggggcuacugaaauacagaugucaagcggaaaccuacuguuuacaggucaccucaagugccgucugcgcauggacaaacuucagcugaagggcaugaguuauucuauguguaccgggaaauucaagguaguuaaggagauugccgaaacacaacauggaacuaucgugaucagaguccaguacgagggcgacgguuccccuugcaaaauuccauucgagaucauggauuuggaaaagaggcacgugcucgggcggcugauuaccgucaaucccauagugacggagaaagacagcccgguuaacaucgaagcugagccucccuuuggcgauucguacauuaucaucggaguggaaccaggccaguuaaagcugucuugguucaaaaagggguccucaauuggacagauguuugagaccacaaugcgaggugccaagcgcauggcaauacuaggcgacacugccugggauuucgggagucucggaggcguauuuaccagcaucgguaaagcucugcaucaagucuucggggcgauuuauggcgcagccuuuuccggagugucuuggacaaugaagauccuuauuggcguugugaucacuuggauagggaugaauagcagaucaaccaguuuguccgucagccuggugcucguaggagugguuacgcuguaccuuggcgucauggugcaggcugacucugguuguguggucucauggaaaaacaaggagcugaaaugcgggaguggaaucuucauuacagauaauguucacaccuggacugaacaguauaaguuucagccugagagccccuccaaguuggccucugcaauccaaaaagcccacgaagagggcauuugugguaucaggucggugacacggcucgaaaaccugauguggaagcagauaaccccagaguuaaaucauauucugacugagaacgaagugaaacuaaccaucaugacaggcgacauuaaggggaucaugcaggcuggaaaacgcagccucagaccccagccuacggagcugaaguacuccuggaaagccuggggcaaggcaaagaugcuuucaaccgaauugcacaaucauacuuuccugauagaugggccagagacagcggaaugcccgaacaccaauagggcuuggaacagucucgagguagaggacuauggauuuggcgucuucacaacuaauaucuggcugaaauuaaaggaacgucaagauguguuuugugacucuaaacugaugagcgccgcaauuaaggacaaccgggccguucacgcugauauggguuacuggaucgaguccgcccuuaacgacaccuggaaaauugaaaaggcaucauucaucgaggugaagagcugccacuggcccaaaucucauacguugugguccaaugggguccucgagagugaaaugauaauuccuaagaacuucgcuggaccagugagccagcacaauuaucgacccggcuaccauacacagaccgccgguccuuggcaccugggcagacuagagauggauuuugacuucugugaagggacuaccguugugguaacagaggauugcggaaacaggggcccaucucugcgcacuaccacagcguccgggaaacucaucacggaauggugcugucggucaugcacccugcccccgcuuagauacaggggagaggacggcuguugguaugguauggagauccgcccuuugaaggaaaaagaggaaaaucuggucaacaguuuagugacugccgggcauggacagauugauaauuuuagccucggcgugcuggguauggcucuuuuccuggaggaaauguugcgaacacgggucggcaccaagcacgcaauccuccugguugccgugucguuuguaacucuaauuacagggaacauguccuuccgugaccugggaagagugauggucauggugggcgcuaccaugacggaugacauagggaugggaguuacuuaccucgcccugcuugcagcguuuaaggugaggccaaccuucgccgcuggcuugcuguuacgcaaacucacaucuaaggagcugaugaugaccacuaucgguauuguccuucugagccaaucaacaauccccgagaguauucuagaacucaccgaugcccuggcauuggggaugauggugcugaaaaucguucggaauauggagaaguaucaguuagcugugacaauaauggccaucuccugcgucccuaacgcaguaauucuccagaaugccuggaaagugucuuguacuacccuggcuguugugagcgucuccccccuucuguugacgucaagccaacagaaggcggacuggaucccacucgcccugacaauuaagggacuaaacccuaccgcaaucuuucugacuacccuuaguagaacaucuaaaaagagguccuggccccucaaugaagcuauaauggccgugggcaugguaagcauucuggccucgucauugcugaaaaacgauaucccaaugacuggcccguuaguggcugggggacuccugaccgucugcuacguucuuacgggucgaucugcagaccuggaguuggaacgcgccgcggacgugcggugggaggagcaggcugaaaucaguggcuccagcccuauucucucuauaacaaucagcgaggauggguccaugucaauuaagaaugaagaggaggaacagacccugacuauccuaauuagaacaggacugcuugugaucaguggccucuuccccgucagcauaccaaucaccgccgcagccugguaucugugggaggugaaaaagcaaagggcugguguuuugugggacguacccucuccuccacccguggggaaagcagaauuagaggauggagccuaccguauuaagcagaagggcauccugggcuauucccagauuggggcgggagucuacaaagaagguacuuuucacacaauguggcaugugacccgcggcgcuguucucaugcacaaggggaaacggaucgagccuucaugggccgacgugaagaaagaucugauaaguuacggaggcgguuggaagcuugagggggaauggaaggagggagaagagguccaggugcuggcauuggaaccgggcaaaaacccaagagccguacaaacgaagcccggccuauucaaaacuaacaccgggacaauuggagcugucagccuggacuuuuccccugguaccucuggcucgccaaucguggauaagaaagggaagguugugggacucuauggcaauggugucgugacaaggagcgggacuuacguuucagccaucgcacagaccgagaaguccauugaggacaaccccgaaaucgaggaugacauauuccgaaaaaagcggcugacgauuauggaucuucauccuggagcuggcaaaacaaagcgcuauuuaccggccaucgugagagaagcgauuaaaaggggccugcggacucucaucuuggcccccacccgagucguggcagcugagauggaagaggcccugagagggcucccaauacgcuaccagacaccugcuauuagggcagagcacaccggacgugaaaucguagaccugaugugucaugccacuuucaccaugcggcuucugagucccaucagagugccaaauuauaacuugauuaucauggaugaggcccacuuuacagacccugcuucuauugcggcaagggguuacauaagcacgcgcguugaaaugggcgaggccgcugggaucuucaugacugccacccccccaggaucccgagacccguuuccucagucaaaugcacccauuauggaugaggaaagagagaucccagaacggucuuggaacagcggccacgagugggucacagacuucaaggguaagaccgugugguuugugcccaguaucaaagccgggaaugauauugcugcgugccuaaggaagaacggaaaaaaggucauacaacugucccgcaaaacuuucgacagcgaauauaucaagacacguaccaaugauugggacuuuguagugacgacugauauuucugagaugggcgccaacuucaaggcagagagaguuaucgacccucggagguguaugaaaccagugauucucacagauggcgaagagcgcgucaucuuagcugggcccaugccugugacccauucauccgccgcacagcgaagaggacggguugguaggaauccgaagaacgaaaaugaccaguacauauacaugggcgagccacuggaaaacgaugaggacugcgcccacuggaaagaggcuaagaugcuucuggacaauaucaacacccccgaagggauuaucccuaguauguuugagcccgaacgcgagaaaguggaugccauugacggagaauauagacucaggggcgaggcgcggaagacuuucgucgauuugaugcgucgcggugaccugccaguguggcucgcauaccgaguagccgcugaggggaucaacuaugccgauagaaggugguguuuugacggcgugaaaaauaaccaaauacuggaagagaauguugaagucgagauuuggacaaaggagggagaacggaagaaacuuaagccucgcuggcuagaugcuagaaucuacagcgacccccuggcauugaaagaguucaaggaauucgccgcuggcaggaaaucguuaacccugaaccucauuacagagauggggcggcugccaacuuuuaugacgcagaaggccaagaaugcacuugauaaccuggcggugcuccauaccgccgaagcuggaggucgagccuauaaucacgcauugucugagcugccugagacacuagaaacucugcuccuucugaccuuauuggcuacagugaccggcgggaucuuccuguuucucauguccggaaaaggcauagguaagaugacucuggggaugugcugcaucauuacggccagcauccuucugugguacgcacagauucagccgcacuggaucgccgcuucaauaauucucgaguucuuuuugaucguccuguuaauccccgaaccagagaaacaaagaaccccucaggacaaccagcuaacauauguugugauugcgauccugacuguaguggccgcaaccauggcuaaugaaaugggcuuccucgagaagacaaaaaaggauuuuggacuuggcaguauaaccacucagcaacccgagucuaacauucuggacaucgauuugcgcccagccuccgccuggacacuguacgcagucgcuacgaccuucauuacuccuaugcucaggcauagcaucgaaaauucaagugugaacguuagccugacagccauagcgaaucaggcuaccgugcuuauggggcucggaaaggguuggccccuguccaaaauggacaucggcgucccguugcuggccauuggguguuacucucagguaaacccaaucaccuuaacagcagcccuacugcuccuuguggcucacuaugcaauuaucggaccuggccugcaggccaaggcgacucgggaggcucaaaaacgugccgcagccgguauuaugaagaaucccacgguugacgggaugaccgugaucgauuuggacccaauacccuacgauccuaaauuugaaaagcagcugggccaggucaugcuccuggugcuuugcgucacacagguguuaaugaugagaacuaccugggcucugugugaggcccucacauuggcaaccggaccgauuagcacucugugggaaggcaaccccgggagguucuggaauacgacaaucgcuguuuccauggccaacaucuuucgcggaucauaucuagcgggcgccggucugcucuucucuauuaugaagaacaccgcaaauacucggcgagggaccggaaacacaggcgagacucuuggugagaaauggaagaauagacugaacgcuuugggcaaaagugaauuucaaauauacaagaaaucggggauccaggagguggacaggacccuggccaaggaaggaauuaaacgcggcgagacagaucaucacgcaguaagccggggguccgcuaagcucagaugguucguggagcguaaucuggucacgccagaaggaaagguuguggacuuaggcugcgguagggggggauggucuuauuacuguggcggucuuaaaaacgucaaggaggugaaaggccugaccaaggggggaccuggccaugaagagcccaucccuaugucaacuuauggguggaaucucguacggcuacagagcggaguggauguuuucuuuacaccacccgaaaaaugcgacacccuguugugugauauuggcgaguccaguccuaacccaacuguggaggccggucgcacacugcgaguccucaaucuuguggaaaacuggcugaauaacaauacccaauucugcaucaaggucuugaaccccuacaugccgucugugauagagaagauggaagcccugcagagaaaauacgggggagcgcucguuaggaauccuuuaagccggaacucaacgcacgagauguauuggguauccaacgcuaguggcaauaucgugagcucugucaacaugauuucccgcaugcugaucaauagauuuaccaugaggcacaagaaagcaacauacgaaccagacguggaucuuggcucagggacucgaaacauuggaaucgagagcgagacccccaaucuggacauaauugguaagcggaucgaaaaaaucaagcaggagcaugaaacaucguggcacuaugaucaggaccauccuuacaagacuugggccuaucacggcucuuacgagaccaaacaaacagggagugcuuccagcaugguuaacggagugguccgucuacucaccaagccaugggacgugauucccaugguaacucagauggccaugacggauacaaccccguucggccagcagagaguguuuaaagaaaagguugacacucgcacccaagagccuaaagaggguacaaagaagcugaugaaaauaacggcagaaugguuguggaaggagcuggggaaaaagaaaacccccaggauguguacucgggaagaguucacaagaaagguccgcucaaaugccgcucucggagcgaucuuuaccgaugagaacaaauggaaguccgccagggaagcaguggaggacucuggcuucugggaacuuguggauaaggagcgaaaucugcacuuagaaggcaaaugcgagacuugugucuauaacaugauggggaagcgggagaaaaagcugggagaauuugguaaagcuaagggcagcagagccauuugguacaugugguugggggcaagguuccucgaguuugaagcccugggauuccuaaaugaggaccauugguuuagucgcgaaaacucccuuagcggcguugagggugaggggcugcacaagcucggauacauccugcgugaugugucuaaaaaggaaggcggcgcuauguaugccgacgauacagcggggugggacacccggauuacauuggaggaucugaaaaaugaagagaugguaacuaaccauauggaaggagagcacaagaaacucgcagaggccaucuucaagcuuaccuaccagaauaagguggucagagugcagaggccaacgccucgcgguaccguuauggacauaaucucacgacgggaccagagaggcagugggcaaguggucacauauggacugaacacuuucaccaacauggaagcucaguuaauuaggcagauggagggcgaagguguguuuaaauccauccaacagcugacaguaaaggaggagauugccguuaaaaauugguugauccgcguggggagagaacggcucagcaggauggcaauuucuggagaugacugcgucgugaagccccuggaugaccguuucgcuucggcccuaacugcucuuaacgauaugggcaaagugcgaaaggacauacagcagugggagccaucacgcggcuggaaugauuggacccaaguccccuuuugcagccaucacuuccacgaacugaucaugaaggacgggagaguucucgugguaccuugucggaaccaggaugagcugauuggaagggcccgcaucucccagggugcaggcuggaguuugagagaaacggcgugcuuagggaaaucuuacgcccagauguggagccugauguauuuucaucggagggaccuccgacuugcugccaaugcaaucuguuccgcugugccaucacacuggauuccgacaagucguaccacuuggucuauacaugccacacacgaguggaugaccacugaggauaugcugaccgucuggaacagaguguggauccaagaaaaucccuggauggaggacaagacaccuguugaaagcugggaggaaauuccauaccuaggaaaacgcgaggaucaguggugcggcucccugaucggucucacgucacgggcaaccugggccaagaacauucagacugcgaucaaucaggugaggagcuugauagggaacgaggaauauacagacuacaugcccucuaugaaaagauuccgcaucgaggaagaggaagcuggaguccugugguga

SEQ ID NO: 14357 - RNA, 9876 nt, Artificial Sequence
  derived and/or modified CDS sequence (opt3) from DENV-2__KM279595__SS-prME
accgccggcaucauuauaaugaugauccccacagugauggcuuuccaccugacuacgcgaaacggggagccucauaugauugucagcaggcaggaaaaggggaaaucccuccuuuuuaagaccgagaaugguguuaacaugugcacacugauggcaauggacuugggcgaauuaugugaggauacuaucaccuacaauugcccacuguuacggcaaaacgaaccggaggacauugauuguuggugcaauucuacaucaaccugggugacuuaugggacauguaccgccacgggagagcaccgccgagaaaaacguaguguagcgcucgugccccaugucggcaugggucuggagacuagaaccgaaacauggaugagcuccgagggggcuuggaagcacgcccagaggaucgagacuuggauacuucggcauccuggauucaccaucauggcagccauucuggcuuacacaaucggcaccacguauuuucagcgcguguugauuuucauccuccugacugcaguuacaccaucuauggccaugagaugcauaggcauuucgaacagggacuuuguggaaggggucucaggagguagcuggguggauaucguacuggagcacggcaguuguguuaccacuauggcuaaaaauaagcccacacucgacuucgaauuaauuaagaccgaggccaaacaccuggcgacgcuucggaaguacugcguggaagcaaaauugaccaacacaacuaccgccucccgcuguccuacacagggggagccaucucugaaugaggaacaagauaagcgauuugucugcaaacauagcaugguggacagaggauggggcaacgguugugggcuauucggaaagggcggcaucgugacuugcgcuauguuuaccugcaagaaaaauauggaggggaaggucguucagcccgaaaaccucgaguauacaaucgugauuaccccucacuccggagaagagaaugccguagguaacgauacuggcaaacaugggaaggagauaaaagugacgccacagucaaguaucacagaagcagagcugaccggauacggcacugucaccauggaauguagcccgaggacaggucuugacuucaaugagauggugcuguugcagauggaaaacaaggcuuggcucguucaccggcaaugguuucuggauuuaccccugccuuggcucccaggggccgacacccagggcucuaacuggauucagaaagagacucuugugacauucaagaauccccacgcgaagaaacaggaugucgugguacugggaucccaagagggcgccaugcauacggcauugaccggggcuacugaaauccagaugucaagcggaaaccuacuguuuacaggucaccucaagugccgucugcgcauggacaaacuucagcugaagggcaugaguuauucuauguguaccgggaaauucaagguugugaaggagauagccgaaacacaacauggaacuauugucaucagagugcaguacgagggcgacgguuccccuugcaaaaucccauucgagauuauggauuuggaaaagaggcacguccucgggcggcugaucaccgugaaucccauuguuacggagaaagacagcccggugaacauagaagcugagccucccuuuggcgauucguacaucauuaucggaguagaaccaggccaguuaaagcugucuugguucaaaaagggguccucaaucggacagauguuugagaccacaaugcgaggugccaagcgcauggcaauucuaggcgacacugccugggauuucgggagucucggaggcgucuuuaccagcauagguaaagcucugcaucaaguguucggggcgaucuauggcgcagccuuuuccggaguuucuuggacaaugaagauucuuaucggcguggucauuacuuggaucgggaugaauagcagaucaaccaguuuguccgugagccugguacucgugggaguugucacgcuguaccuuggcgugauggugcaggcugacucugguugugucguuucauggaaaaacaaggagcugaaaugcgggaguggaauauucaucacagauaaugugcacaccuggacugaacaguauaaguuucagccugagagccccuccaaguuggccucugcaauucaaaaagcccacgaagagggcaucugugguauuaggucggugacacggcucgaaaaccugauguggaagcagaucaccccagaguuaaaucauauacugacugagaacgaaguaaaacuaaccauuaugacaggcgacaucaaggggauuaugcaggcuggaaaacgcacgcucagaccccagccuaccgagcugaaguacagcuggaaagccuggggcaaggcaaagaugcuuuccacugaauugcacaaucauacauuccugaucgaugggccagagaccgcggaaugcccgaacacaaauagggcuuggaacucacucgaggucgaggacuauggauuuggcguguucacuaccaauauauggcugaaauuaaaggaacgucaagauguauuuugugacaguaaacugaugucugccgcaaucaaggacaaccgggccgugcacgcugauauggguuacuggauugagagcgcccuuaacgacacguggaaaaucgaaaaggcauccuucauugaggucaagucaugccacuggcccaaaagccauacauuguggucuaauggggugcucgaguccgaaaugaucauaccuaagaacuucgcuggaccaguuagucagcacaauuaucgacccggcuaccauacccagacugccgguccuuggcaccugggcagacuagagauggauuuugacuucugugaagggaccacagugguagucacugaggauugcggaaacaggggcccaagccugcgcaccacaacggcgucugggaaacucauuaccgaauggugcugucgguccugcacucugcccccgcuuagauacaggggagaggacggcuguugguaugguauggagauccgcccuuugaaggaaaaagaggaaaaucuggugaacucauuagugacagccgggcauggacagaucgauaauuuuagucucggcguccuggguauggcucuuuuccuggaggaaauguugcgaacccggguuggcacuaagcacgcaauucuccugguggccguuagcuuugugacacuaaucaccgggaacaugucguuccgugaccugggaagagucauggugaugguuggcgcuacgaugacugaugacauugggaugggagugaccuaccucgcccugcuugcagcguuuaaggucaggccaacauucgccgcuggcuugcuguuacgcaaacucaccuccaaggagcugaugaugacuacaauagguaucgugcuucugucucaaagcaccauucccgagucaauccuagaacucacagaugcccuggcauuggggaugaugguucugaaaauugugcggaauauggagaaguaucaguuagcugucacuaucauggccauacucugcguaccuaacgcagugauccugcagaaugccuggaaaguuaguuguaccacgcuugcuguggucuccgugucuccccuguugcucacaagcucccaacagaaggcggacuggauuccacuggcccuaaccaucaagggacugaacccuacugcaauuuuucuuaccacacucucaagaacuagcaaaaagaggaguuggccccugaaugaagcuaucauggccguaggcauggugucuauauuggccuccagccugcuaaagaaugauauuccaaugaccggcccgcucgucgcugggggacugcuuacgguuugcuacgugcugacaggucgaucggcagacuuggagcucgaacgcgccgcggacgugcggugggaggagcaggcugaaaucucaggcucuaguccuauccuguccauuaccauaagcgaggaugggucuaugagcaucaagaaugaagaggaggaacagacucuaacaauucugaucagaaccggacuucucgucauuuccggccuguuccccgugucaaucccaauaacugccgcagccugguauuugugggagguuaaaaagcaaagggcugguguauuaugggacgugcccaguccuccacccgucgggaaagcagaacuggaggauggagccuaccguaucaagcagaagggcauucucggcuauagccagaucggggcgggaguguacaaagaagguacauuucacaccauguggcauguuacgcgcggcgcugugcugaugcacaaggggaaacggauugagccuucuugggccgacgucaagaaagaucuuaucuccuacggaggcgguuggaagcuggagggggaauggaaggagggagaagaggugcagguauuggcacuagaaccgggcaaaaacccaagagccguccaaacuaagcccggccuguucaaaaccaacacagggaccauaggagcugugucacucgacuuuaguccugguacaagcggcuccccaauuguugauaagaaagggaagguggucggacuguauggcaauggugugguuacuaggucugggaccuacgugucggccaucgcacagacggagaagaacaucgaggacaaucccgaaauugaggaugacaucuuccggaaaaagagacuuacaauaauggauuuacauccuggagcuggcaaaacuaagcgcuaucugccggccauugucagagaagcgaucaaaaggggccuccggaccuugauucuggcccccacacgagugguagcagcugagauggaagaggcccucagagggcugccaauccgcuaccagaccccugcuauaagggcagagcacacuggacgugaaauuguggaccuuaugugucaugccaccuucacaaugcggcuguugagccccaucagaguuccaaacuauaaucuaaucauuauggaugaggcccacuuuacggacccugcuucaaucgcggcaagggguuacauuuccacucgcgucgaaaugggcgaggccgcugggauauucaugaccgccacacccccaggaagucgagacccguuuccucagucuaacgcacccaucauggaugaggaaaaggagauuccagaaagaagcuggaacuccggccacgagugggugaccgacuucaaggguaaaacugugugguuuguccccucaaucaaggccgggaacgauaucgcugcgugccugcggaaaaauggaaagaaaguaauucaacucucuaggaagacauucgacagcgaauauauaaagacccgcacgaacgauugggacuuugugguuacuacagauaucagugagaugggcgccaauuucaaagcagagcgugugauugacccuagacgguguaugaagccagucaucuuaaccgauggcgaagagagggugauucuggcugggcccaugccuguuacccauuccagcgccgcacagcgccgaggaagagugggucggaacccgaaaaaugaaaacgaccaguacaucuacaugggcgagccacuugaaaaugaugaggacugcgcccacuggaaggaggcuaaaaugcugcucgacaacauaaacacucccgaagggaucauuccuucuauguuugagcccgaaagggagaaggucgaugccaucgacggagaauaucgcuugagaggcgaggcgaggaaaacauucguggaucugaugcggcguggugaccucccaguauggcuggcauaccgcguggccgcugaggggauuaauuaugccgaucgaagaugguguuuugacggcguuaagaacaaucaaauccuugaagagaacgucgaaguggagauauggaccaaggagggagaaaggaaaaagcuaaaaccucgguggcuggaugcucgcauuuacucagaccccuuggcauuaaaggaguucaaagaguucgccgcuggcagaaagucccugacacucaaucugaucacugagauggggaggcuuccaacguuuaugacccagaaggccaaaaacgcacuggauaaucucgcgguguugcauacagccgaagcuggaggucgggccuauaaccacgcacugagugagcuaccugagacucuggaaacccuccuucuguuaacauugcuggcuaccgucacuggcgggauuuuccucuuucugaugagcggaaagggcaucgguaaaaugacgcuugggaugugcugcauaaucaccgccucgauucugcucugguacgcacagauccagccgcacuggauugccgcuucuaucauauuggaguucuuucugauuguuuuacuaauccccgaaccagagaagcaacgaacaccucaggacaaucagcugacuuaugugguaaucgcgauucucaccguggucgccgcaacaauggcuaacgaaaugggcuuccuugagaaaaccaagaaggauuuuggacugggcuccaucacuacacagcaacccgagagcaauauauuggacauugaucugagaccagccucagccuggacgcucuacgcaguggcuaccacuuucaucacaccuaugcugcgccauaguauugaaaacucuuccguuaaugugagccuuaccgccaucgcgaaccaggcuaccguccucauggggcugggaaaagguuggcccuugucaaagauggacauaggcguaccgcuguuagccaucggguguuacagucaggugaauccaauuacacuaacugcagcccugcuccuucugguugcucacuaugcaaucauuggaccuggcuugcaggccaaagcgacgagggaggcucaaaagcgggccgcagccgguaucaugaaaaaccccaccguggacgggaugacagucauugaucuggacccaauccccuacgauccuaaguuugaaaagcagcucggccaggugaugcugcuugucuuaugcgugacucagguucugaugaugcguaccacaugggcucucugugaggccuugacccuggcaacuggaccgauaagcacgcuaugggaaggcaaucccgggagauucuggaacacaaccauugcuguguccauggccaacaucuuuaggggaucuuaucuggcgggcgccggucuccuuuucagcaucaugaaaaauacugcaaacacccgccgggggacaggaaauacuggcgagacccugggugagaaguggaaaaaccgauugaaugcucugggcaaguccgaauuucaaauuuacaaaaagucagggauacaggagguagacagaacacucgccaaagaaggaaucaagaggggcgagacggaucaucacgcagugucucgcgggagugcuaagcugcggugguucgucgagagaaacuuaguuaccccagaaggaaaaguggucgaccuuggcugcggucgugggggauggucguauuacuguggcggucugaagaaugugaaagagguaaagggccucacuaaagggggaccuggccaugaagaacccauuccuaugagcacauauggguggaaccuagugaggcugcaguccggaguugauguguucuuuaccccacccgaaaagugcgacacuuugcugugugauaucggcgagucuucaccuaauccaacagucgaggccggucggacccuccgcgugcuuaaccuggucgaaaauugguugaacaauaacacgcaauucugcauuaaggugcugaaucccuacaugccgagcguuaucgagaaaauggaagcccuccagcgaaaguacgggggagcguuaguaagaaacccucuguccaggaacaguacccacgagauguauugggugucuaaugcuagcggcaacauagucucauccgugaauaugaucagucggaugcuuauuaaccgcuuuacaaugagacacaaaaaggcaacuuacgaaccagacguugaucugggcagcgggaccaggaauaucggaauugagucugagacacccaaccuagacaucauagguaaacgaauugaaaagaucaagcaggagcaugaaacuuccuggcacuaugaucaggaccauccuuacaaaaccugggccuaucacggcucauacgagacaaagcaaaccgggagcgcuucgucuauggugaauggagucgugcggcuccugacuaaaccaugggacguaauccccauggugacgcagauggccaugacagauaccacuccguucggccagcagcguguuuuuaaggaaaaagucgacaccagaacacaagagccuaaggaggguacgaagaaauugaugaagauuaccgcagaauggcuguggaaagagcucgggaagaaaaagacuccccgcauguguacaagggaagaguucacccggaaagugagaaguaacgccgcucuuggagcgauauuuacugaugagaauaaguggaaguccgcccgcgaagcaguggaggacagcggcuucugggaacuggucgauaaagagaggaacuuacaccuggaaggcaagugcgagacauguguuuauaauaugauggggaaacgagagaagaaauugggagaauuugguaaggcuaagggcucacgggccaucugguacauguggcucggggcaagauuccuggaguuugaagcccuaggauuccuuaacgaggaccauugguuuuccagggaaaauucucugagcggcguggagggugaggggcuccacaaacugggauacauuuugcgcgauguaaguaagaaagaaggcggcgcuauguaugccgacgauaccgcggggugggacacacguaucacucuggaggaucucaagaacgaagagauggugaccaaucauauggaaggagagcacaagaaacuugcagaggccauuuucaaacugacguaccagaacaaagucgugcggguucagagaccaaccccuagggguacagugauggacaucauaucccgccgagaccagcggggcagcgggcaagucgugacuuauggauuaaacaccuucacaaauauggaagcucagcugaucagacagauggagggcgaagguguauuuaagucuauucaacaguugacuguuaaagaggagaucgccgugaaggauuggcucauuagggucgggcgcgaaagacugucacggauggcaaucaguggagacgauugcguggugaaaccccuagacgauagguucgcuuccgcccuuaccgcucugaacgacaugggcaagguccguaaggauauucagcagugggagccaagccgaggcuggaaugacuggacgcaaguucccuuuugcucucaucacuuccacgaacucauaaugaaagaugggcgcgugcugguagugccuuguagaaaccaggacgaguugaucggacgggccaggauuucgcagggugcaggcuggucauuacgcgaaacagcgugccugggaaagagcuacgcccagauguggucccucauguauuuucauagacgggaucuuaggcuggcugccaaugcaaucuguagugcugucccaucucacuggaucccgaccagccgaacuacaugguccauucaugccacccacgaguggaugacuaccgaggacaugcuaacaguguggaaccguguuuggauacaagaaaaucccuggauggaggauaaaacgccuguggaaucaugggaggaaaucccauaccugggaaagagagaggaccaguggugcggcagucucauugguuugaccucucgcgcaacuugggccaaaaacauccagacagcgauuaaucagguccggagccugaucgggaacgaggaauauaccgacuacaugcccuccaugaagagguucagacgcgaggaagaggaagcuggagugcuuugguga

SEQ ID NO: 14358 - RNA, 9876 nt, Artificial Sequence
  derived and/or modified CDS sequence (opt3) from DENV-2__KM279566__SS-prME
accgccggcaucauuauaaugaugauccccacagugauggcuuuccaccugacuacgcgaaacggggagccucauaugauugucagcaggcaggaaaagggaaaaucccuccuuuuuaagaccgagaaugguguuaacaugugcacacugauggcaauggacuugggcgaauuaugugaggauacuaucaccuacaauugcccacuguuacggcaaaacgaaccggaggacauugauuguuggugcaauucuacaucaaccugggugacuuaugggacauguaccgccacgggagagcaccgccgagaaaaacguaguguagcgcucgugccccaugucggcaugggucuggagacuagaaccgaaacauggaugagcuccgagggggcuuggaagcacgcccagaggaucgagacuuggauacuucggcauccuggauucaccaucauggcagccauucuggcuuacacaaucggcaccacguauuuucagcgcguguugauuuucauccuccugacugcaguuacaccaucuauggccaugagaugcauaggcauuucgaacagggacuuuguggaaggggucucaggagguagcuggguggauaucguacuggagcacggcaguuguguuaccacuauggcuaaaaauaagcccacacucgacuucgaauuaauuaagaccgaggccaaacaccuggcgacgcuucggaaguacugcguggaagcaaaauugaccaacacaacuaccgccucccgcuguccuacacagggggagccaucucugaaugaggaacaagauaagcgauuugucugcaaacauagcaugguggacagaggauggggcaacgguugugggcuauucggaaagggcggcaucgugacuugcgcuauguuuaccugcaagaaaaauauggaggggaaggucguucagcccgaaaaccucgaguauacaaucgugauuaccccucacuccggagaagagaaugccguagguaacgauacuggcaaacaugggaaggagauaaaagugacgccacagucaaguaucacagaagcagagcugaccggauacggcacugucaccauggaauguagcccgaggacaggucuugacuucaaugagauggugcuguugcagauggaaaacaaggcuuggcucguucaccggcaaugguuucuggauuuaccccugccuuggcucccaggggccgacacccagggcucuaacuggauucagaaagagacucuugugacauucaagaauccccacgcgaagaaacaggaugucgugguacugggaucccaagagggcgccaugcauacggcauugaccggggcuacugaaauccagaugucaagcggaaaccuacuguuuacaggucaccucaagugccgucugcgcauggacaaacuucagcugaagggcaugaguuauucuauguguaccgggaaauucaagguugugaaggagauagccgaaacacaacauggaacuauugucaucagagugcaguacgagggcgacgguuccccuugcaaaaucccauucgagauuauggauuuggaaaagaggcacguccucgggcggcugaucaccgugaaucccauuguuacggagaaagacagcccggugaacauagaagcugagccucccuuuggcgauucguacaucauuaucggaguagaaccaggccaguuaaagcugucuugguucaaaaagggguccucaaucggacagauguuugagaccacaaugcgaggugccaagcgcauggcaauucuaggcgacacugccugggauuucgggagucucggaggcgucuuuaccagcauagguaaagcucugcaucaaguguucggggcgaucuauggcgcagccuuuuccggaguuucuuggacaaugaagauucuuaucggcguggucauuacuuggaucgggaugaauagcagaucaaccaguuuguccgugagccugguacucgugggaguugucacgcuguaccuuggcgugauggugcaggcugacucugguugugucguuucauggaaaaacaaggagcugaaaugcgggaguggaauauucaucacagauaaugugcacaccuggacugaacaguauaaguuucagccugagagccccuccaaguuggccucugcaauucaaaaagcccacgaagagggcaucugugguauuaggucggugacacggcucgaaaaccugauguggaagcagaucaccccagaguuaaaucauauacugacugagaacgaaguaaaacuaaccauuaugacaggcgacaucaaggggauuaugcaggcuggaaaacgcacgcucagaccccagccuaccgagcugaaguacagcuggaaagccuggggcaaggcaaagaugcuuuccacugaauugcacaaucauacauuccugaucgaugggccagagaccgcggaaugcccgaacacaaauagggcuuggaacucacucgaggucgaggacuauggauuuggcguguucacuaccaauauauggcugaaauuaaaggaacgucaagauguauuuugugacaguaaacugaugucugccgcaaucaaggacaaccgggccgugcacgcugauauggguuacuggauugagagcgcccuuaacgacacguggaaaaucgaaaaggcauccuucauugaggucaagucaugccacuggcccaaaagccauacauuguggucuaauggggugcucgaguccgaaaugaucauaccuaagaacuucgcuggaccaguuagucagcacaauuaucgacccggcuaccauacccagacugccgguccuuggcaccugggcagacuagagauggauuuugacuucugugaagggaccacagugguagucacugaggauugcggaaacaggggcccaagccugcgcaccacaacggcgucugggaaacucauuaccgaauggugcugucgguccugcacucugcccccgcuuagauacaggggagaggacggcuguugguaugguauggagauccgcccuuugaaggaaaaagaggaaaaucuggugaacucauuagugacagccgggcauggacagaucgauaauuuuagucucggcguccuggguauggcucuuuuccuggaggaaauguugcgaacccggguuggcacuaagcacgcaauucuccugguggccguuagcuuugugacacuaaucaccgggaacaugucguuccgugaccugggaagagucauggugaugguuggcgcuacgaugacugaugacauugggaugggagugaccuaccucgcccugcuugcagcguuuaaggucaggccaacauucgccgcuggcuugcuguuacgcaaacucaccuccaaggagcugaugaugacuacaauagguaucgugcuucugucucaaagcaccauucccgagucaauccuagaacucacagaugcccuggcauuggggaugaugguucugaaaauugugcggaauauggagaaguaucaguuagcugucacuaucauggccauacucugcguaccuaacgcagugauccugcagaaugccuggaaaguuaguuguaccacgcuugcuguggucuccgugucuccccuguugcucacaagcucccaacagaaggcggacuggauuccacuggcccuaaccaucaagggacugaacccuacugcaauuuuucuuaccacacucucaagaacuagcaaaaagaggaguuggccccugaaugaagcuaucauggccguaggcauggugucuauauuggccuccagccugcuaaagaacgauauuccaaugaccggcccgcucgucgcugggggacugcuuacgguuugcuacgugcugacaggucgaucggcagacuuggagcucgaacgcgccgcggacgugcggugggaggagcaggcugaaaucucaggcucuaguccuauccuguccauuaccauaagcgaggaugggucuaugagcaucaagaaugaagaggaggaacagacucuaacaauucugaucagaaccggacuucucgucauuuccggccuguuccccgugucaaucccaauaacugccgcagccugguauuugugggagguuaaaaagcaaagggcugguguauuaugggacgugcccaguccuccacccgucgggaaagcagaacuggaggauggagccuaccguaucaagcagaagggcauucucggcuauagccagaucggggcgggaguguacaaagaagguacauuucacaccauguggcauguuacgcgcggcgcugugcugaugcacaaggggaaacggauugagccuucuugggccgacgucaagaaagaucuuaucuccuacggaggcgguuggaagcuggagggggaauggaaggagggagaagaggugcagguauuggcacuagaaccgggcaaaaacccaagagccguccaaacuaagcccggccuguucaaaaccaacacagggaccauaggagcugugucacucgacuuuaguccugguacaagcggcuccccaauuguugauaagaaagggaagguggucggacuguauggcaauggugugguuacuaggucugggaccuacgugucggccaucgcacagacggaaaagagcaucgaggacaaccccgaaauugaggaugacaucuucagaaagaagcggcuuacaauaauggauuuacauccuggagcuggcaaaacuaagcgcuaucugccggccauugucagagaagcgaucaaaaggggccuccggaccuugauucuggcccccacacgagugguagcagcugagauggaagaggcccucagagggcugccaauccgcuaccagaccccugcuauaagggcagagcacacuggacgugaaauuguggaccuuaugugucaugccaccuucacaaugcggcuguugucacccaucagaguuccaaauuauaaccuaaucauuauggaugaggcccacuuuacggacccugcuuccaucgcggcaagggguuacauuaguacucgcgucgaaaugggcgaggccgcugggauauucaugaccgccacacccccaggaucucgagacccguuuccucagagcaaugcacccaucauggaugaggaaaaggagauuccagaaagauccuggaacucaggccacgagugggugaccgacuucaaggguaaaacugugugguuuguccccucuaucaaggccgggaaugauaucgcugcgugccugcggaaaaacggaaagaaaguaauucaacucagcaggaagacauucgacagugaauauauaaagacccgcacgaaugauugggacuuugugguuacuacagauaucuccgagaugggcgccaacuucaaagcagagcgugugauugacccuagacgguguaugaagccagucaucuuaaccgauggcgaagagagggugauucuggcugggcccaugccuguuacccauagcucugccgcacagcgccgaggaagagugggucggaauccgaaaaacgaaaaugaccaguacaucuacaugggcgagccacuugaaaacgaugaggacugcgcccacuggaaggaggcuaaaaugcugcucgacaauauaaacacucccgaagggaucauuccuucaauguuugagcccgaaagggagaaggucgaugccaucgacggagaauaucgcuugagaggcgaggcgaggaaaacauucguggaucugaugcggcguggugaccucccaguauggcuggcauaccgcguggccgcugaggggauuaacuaugccgaucgaagaugguguuuugacggcguuaagaauaaccaaauccuugaagagaaugucgaaguggagauauggaccaaggagggagaaaggaaaaagcuaaaaccucgguggcuggaugcucgcauuuacuccgaccccuuggcauuaaaggaguucaaagaguucgccgcuggcagaaagagucugacacucaaccugaucacugagauggggaggcuuccaacguuuaugacccagaaggccaaaaaugcacuggauaaccucgcgguguugcauacagccgaagcuggaggucgggccuauaaucacgcacugagcgagcuaccugagacucuggaaacccuccuucuguuaacauugcuggcuaccgucacuggcgggauuuuccucuuucugaugucgggaaagggcaucgguaaaaugacgcuugggaugugcugcauaaucaccgccucuauucugcucugguacgcacagauccagccgcacuggauugccgcuuccaucauauuggaguucuuucugauuguuuuacuaauccccgaaccagagaagcaacgaacaccucaggacaaccagcugacuuaugugguaaucgcgauucucaccguggucgccgcaacaauggcuaaugaaaugggcuuccuugagaaaaccaagaaggauuuuggacugggcagcaucacuacacagcaacccgagucaaacauauuggacauugaucugagaccagccagugccuggacgcucuacgcaguggcuaccacuuucaucacaccuaugcugcgccauucuauugaaaauuccagcguuaacgugucacuuaccgccaucgcgaaucaggcuaccguccucauggggcugggaaaagguuggcccuugaguaagauggacauaggcguaccgcuguuagccaucggguguuacagccaggugaacccaauuacacuaacugcagcccugcuccuucugguugcucacuaugcaaucauuggaccuggcuugcaggccaaagcgacgagggaggcucaaaagcgggccgcagccgguaucaugaaaaaucccaccguggacgggaugacagucauugaucuggacccaauccccuacgauccuaaguuugaaaagcagcucggccaggugaugcugcuugucuuaugcgugacucagguucugaugaugcguaccacaugggcucucugugaggccuugacccuggcaacuggaccgauauccacgcuaugggaaggcaaccccgggagauucuggaauacaaccauugcugugucuauggccaacaucuuuaggggaagcuaucuggcgggcgccggucuccuuuucuccaucaugaaaaacacugcaaauacccgccgggggacaggaaacacuggcgagacccugggugagaaguggaaaaaucgauugaacgcucugggcaagucagaauuucaaauuuacaaaaagucugggauacaggagguagacagaacacucgccaaagaaggaaucaagaggggcgagacggaucaucacgcagugagucgcgggucggcuaagcugcggugguucgucgagagaaauuuaguuaccccagaaggaaaaguggucgaccuuggcugcggucgugggggauggagcuauuacuguggcggucugaagaacgugaaagagguaaagggccucacuaaagggggaccuggccaugaggaacccauuccuauguccacauauggguggaaucuagugaggcugcagucuggaguugauguguucuuuaccccacccgaaaagugcgacacuuugcugugugauaucggcgagucaagcccuaacccaacagucgaggccggucggacccuccgcgugcuuaaucuggucgaaaacugguugaauaacaauacgcaauucugcauuaaggugcugaaccccuacaugccguccguuaucgagaaaauggaagcccuccagcgaaaguacgggggagcguuaguaagaaauccucugaguaggaacucuacccacgagauguauugggugagcaacgcuucaggcaauauagucuccagugugaacaugaucagccggaugcuuauuaaucgcuuuacaaugagacacaaaaaggcaacuuacgaaccagacguugaucugggcucugggaccaggaacaucggaauugaguccgagacacccaaucuagacaucauagguaaacgaauugaaaagaucaagcaggagcaugaaacuucauggcacuaugaucaggaccauccuuacaaaaccugggccuaucacggcagcuacgagacaaagcaaaccgggucggcuucuaguauggugaacggagucgugcggcuccugacuaaaccaugggacguaauccccauggugacgcagauggccaugacagauaccacuccguucggccagcagcguguuuuuaaggaaaaagucgacaccagaacacaagagccuaaggaggguacgaagaaauugaugaagauuaccgcagaauggcuguggaaagagcucgggaagaaaaagacuccccgcauguguacaagggaagaguucacccggaaagugagauccaaugccgcucuuggagcgauauuuacugaugagaacaaguggaaaagcgcccgcgaagcaguggaggacucaggcuucugggaacuggucgauaaagagaggaauuuacaccuggaaggcaagugcgagacauguguuuauaacaugauggggaaacgagagaagaaauugggagaauuugguaaggcuaagggcucccgggccaucugguacauguggcucggggcaagauuccuggaguuugaagcccuaggauuccuuaaugaggaccauugguuuucuagggaaaacagccugaguggcguggagggugaggggcuccacaaacugggauacauuuugcgcgauguauccaagaaagaaggcggcgcuauguaugccgacgauaccgcggggugggacacacguaucacucuggaggaucucaagaaugaagagauggugaccaaccauauggaaggagagcacaagaaacuugcagaggccauuuucaaacugacguaccagaauaaagucgugcggguucagagaccaaccccuagggguacagugauggacaucauaagccgccgagaccagcggggcucugggcaagucgugacuuauggauuaaacaccuucacaaacauggaagcucagcugaucagacagauggagggcgaagguguauuuaagucaauucaacaguugacuguuaaagaggagaucgccgugaagaauuggcucauuagggucgggcgcgaaagacugagucggauggcaaucuccggagaugacugcguggugaaaccccuagaugacagguucgcuagcgcccuuaccgcucugaacgauaugggcaagguccguaaggacauucagcagugggagccaucucgaggcuggaaugauuggacgcaaguucccuuuugcucgcaucacuuccacgaacucauaaugaaagacgggcgcgugcugguagugccuuguagaaaccaggaugaguugaucggacgggccaggauuucacagggugcaggcuggagcuuacgcgaaacagcgugccuggggaaguccuacgcccagauguggagucucauguauuuucauagacgggaccuuaggcuggcugccaaugcaaucuguucugcugucccaagccacuggaucccgaccucccgaacuacauggucaauucaugccacccacgaguggaugacuaccgaggauaugcuaacaguguggaaccguguuuggauacaagaaaaucccuggauggaggacaaaacgccuguggaaaguugggaggaaaucccauaccugggaaagagagaggaucaguggugcggcucucucauugguuugaccagccgcgcaacuugggccaaaaacauccagacagcgauuaaucagguccggucccugaucgggaacgaggaauauaccgacuacaugcccucaaugaagagguucagacgcgaggaagaggaagcuggagugcuuugguga

SEQ ID NO: 14359 - RNA, 9876 nt, Artificial Sequence
  derived and/or modified CDS sequence (opt3) from DENV-2__KM279574__SS-prME
accgccggcaucauuauaaugaugauccccacagugauggcuuuccaccugacuacgcgaaacggggagccucauaugauugucagcaggcaggaaaagggaaaaucccuccuuuuuaagaccgagaaugguguuaacaugugcacacugauggcaauggacuugggcgaauuaugugaggauacuaucaccuacaauugcccacuguuacggcaaaacgaaccggaggacauugauuguuggugcaauucuacaucaaccugggugacuuaugggacauguaccgccacgggagagcaccgccgagaaaaacguaguguagcgcucgugccccaugucggcaugggucuggagacuagaaccgaaacauggaugagcuccgagggggcuuggaagcacgcccagaggaucgagacuuggauacuucggcauccuggauucaccaucauggcagccauucuggcuuacacaaucggcaccacguauuuucagcgcguguugauuuucauccuccugacugcaguuacaccaucuauggccaugagaugcauaggcauuucgaacagggacuuuguggaaggggucucaggagguagcuggguggauaucguacuggagcacggcaguuguguuaccacuauggcuaaaaauaagcccacacucgacuucgaauuaauuaagaccgaggccaaacaccuggcgacgcuucggaaguacugcguggaagcaaaauugaccaacacaacuaccgccucccgcuguccuacacagggggagccaucucugaaugaggaacaagauaagcgauuugucugcaaacauagcaugguggacagaggauggggcaacgguugugggcuauucggaaagggcggcaucgugacuugcgcuauguuuaccugcaagaaaaauauggaggggaaggucguucagcccgaaaaccucgaguauacaaucgugauuaccccucacuccggagaagagaaugccguagguaacgauacuggcaaacaugggaaggagauaaaagugacgccacagucaaguaucacagaagcagagcugaccggauacggcacugucaccauggaauguagcccgaggacaggucuugacuucaaugagauggugcuguugcagauggaaaacaaggcuuggcucguucaccggcaaugguuucuggauuuaccccugccuuggcucccaggggccgacacccagggcucuaacuggauucagaaagagacucuugugacauucaagaauccccacgcgaagaaacaggaugucgugguacugggaucccaagagggcgccaugcauacggcauugaccggggcuacugaaauccagaugucaagcggaaaccuacuguuuacaggucaccucaagugccgucugcgcauggacaaacuucagcugaagggcaugaguuauucuauguguaccgggaaauucaagguugugaaggagauagccgaaacacaacauggaacuauugucaucagagugcaguacgagggcgacgguuccccuugcaaaaucccauucgagauuauggauuuggaaaagaggcacguccucgggcggcugaucaccgugaaucccauuguuacggagaaagacagcccggugaacauagaagcugagccucccuuuggcgauucguacaucauuaucggaguagaaccaggccaguuaaagcugucuugguucaaaaagggguccucaaucggacagauguuugagaccacaaugcgaggugccaagcgcauggcaauucuaggcgacacugccugggauuucgggagucucggaggcgucuuuaccagcauagguaaagcucugcaucaaguguucggggcgaucuauggcgcagccuuuuccggaguuucuuggacaaugaagauucuuaucggcguggucauuacuuggaucgggaugaauagcagaucaaccaguuuguccgugagccugguacucgugggaguugucacgcuguaccuuggcgugauggugcaggcugacucugguugugucguuucauggaaaaacaaggagcugaaaugcgggaguggaauauucaucacagauaaugugcacaccuggacugaacaguauaaguuucagccugagagccccuccaaguuggccucugcaauucaaaaagcccacgaagagggcaucugugguauuaggucggugacacggcucgaaaaccugauguggaagcagaucaccccagaguuaaaucauauacugacugagaacgaaguaaaacuaaccauuaugacaggcgacaucaaggggauuaugcaggcuggaaaacgcacgcucagaccccagccuaccgagcugaaguacagcuggaaagccuggggcaaggcaaagaugcuuuccacugaauugcacaaucauacauuccugaucgaugggccagagaccgcggaaugcccgaacacaaauagggcuuggaacucacucgaggucgaggacuauggauuuggcguguucacuaccaauauauggcugaaauuaaaggaacgucaagauguauuuugugacaguaaacugaugucugccgcaaucaaggacaaccgggccgugcacgcugauauggguuacuggauugagagcgcccuuaacgacacguggaaaaucgaaaaggcauccuucauugaggucaagucaugccacuggcccaaaagccauacauuguggucuaauggggugcucgaguccgaaaugaucauaccuaagaacuucgcuggaccaguuagucagcacaauuaucgacccggcuaccauacccagacugccgguccuuggcaccugggcagacuagagauggauuuugacuucugugaagggaccacagugguagucacugaggauugcggaaacaggggcccaagccugcgcaccacaacggcgucugggaaacucauuaccgaauggugcugucgguccugcacucugcccccgcuuagauacaggggagaggacggcuguugguaugguauggagauccgcccuuugaaggaaaaagaggaaaaucuggugaacucauuagugacagccgggcauggacagaucgauaauuuuagucucggcguccuggguauggcucuuuuccuggaggaaauguugcgaacccggguuggcacuaagcacgcaauucuccugguggccguuagcuuugugacacuaaucaccgggaacaugucguuccgugaccugggaagagucauggugaugguuggcgcuacgaugacugaugacauugggaugggagugaccuaccucgcccugcuugcagcguuuaagauaaggccaacauucgccgcuggcuugcuguuacgcaaacucaccuccaaggagcugaugaugacuacaaucgguauuguccuucugucucaaagcaccauccccgagucaauucuagaacucacagaugcccuggcauuggggaugauggugcugaaaaucguucggaauauggagaaguaucaguuagcugugacuauaauggccauccucugcgucccuaacgcaguaauucugcagaaugccuggaaagugaguuguaccacgcuugcuguuguguccgucucuccccuguugcucacaagcucccaacagaaggcggacuggaucccacuggcccuaaccauuaagggacugaacccuacugcaaucuuucuuaccacacucucaagaacuagcaaaaagaggaguuggccccugaaugaagcuauaauggccgugggcaugguaucuauuuuggccuccagccugcucaaaaacgauaucccaaugaccggcccgcuaguggcugggggacugcuuacggucugcuacguucugacaggucgaucggcagacuuggagcucgaacgcgccgcggacgugcggugggaggagcaggcugaaaucucaggcucuaguccuauucuguccauaaccaucagcgaggaugggucuaugagcauuaagaaugaagaggaggaacagacucuaacaauccugauuagaaccggacuucucgugaucuccggccuguuccccgucucaauaccaaucacugccgcagccugguauuugugggaggugaaaaagcaaagggcugguguuuuaugggacguacccaguccuccacccguggggaaagcagaacuggaggauggagccuaccguauuaagcagaagggcauccucggcuauagccagauuggggcgggagucuacaaagaagguacauuucacaccauguggcaugugacgcgcggcgcuguucugaugcacaaggggaaacggaucgagccuucuugggccgacgugaagaaagaucuuauauccuacggaggcgguuggaagcuggagggggaauggaaggagggagaagagguccagguguuggcacuagaaccgggcaaaaacccaagagccguacaaacuaagcccggccuguucaaaaccaacacagggaccauuggagcugucucacucgacuuuaguccugguacaagcggcuccccaaucguggauaagaaagggaagguugugggacuguauggcaauggugucgugacuaggucugggaccuacguuucggccaucgcacagacggaaaagagcauugaggacaaccccgaaaucgaggaugacauauuccggaaaaagagacuuacaauuauggauuuacauccuggagcuggcaaaacuaagcgcuaucugccggccaucgugagagaagcgauuaaaaggggccuccggaccuugauccuggcccccacacgagucguggcagcugagauggaagaggcccucagagggcugccaauacgcuaccagaccccugcuauuagggcagagcacacuggacgugaaaucguagaccuuaugugucaugccaccuucacaaugcggcuguugucacccaucagagugccaaauuauaaccuaauuaucauggaugaggcccacuuuacggacccugcuuccauugcggcaagggguuacauaaguacucgcguugaaaugggcgaggccgcugggaucuucaugaccgccacacccccaggaucucgagacccguuuccucagagcaaugcacccauuauggaugaggaaaaggagaucccagaaagauccuggaacucaggccacgagugggucaccgacuucaaggguaaaacugugugguuugugcccucuaucaaggccgggaaugauauugcugcgugccugcggaaaaacggaaagaaagucauacaacucagcaggaagacauucgacagugaauauaucaagacccgcacgaaugauugggacuuuguagugacuacagauauuuccgagaugggcgccaacuucaaagcagagcguguuaucgacccuagacgguguaugaagccagugauuuuaaccgauggcgaagagagggucauccuggcugggcccaugccugugacccauagcucugccgcacagcgccgaggaagaguuggucggaauccgaaaaacgaaaaugaccaguacauauacaugggcgagccacuugaaaacgaugaggacugcgcccacuggaaggaggcuaaaaugcugcucgacaauaucaacacucccgaagggauuaucccuucaauguuugagcccgaaagggagaagguggaugccauugacggagaauaucgcuugagaggcgaggcgaggaaaacauucgucgaucugaugcggcguggugaccucccaguguggcuggcauaccgcguagccgcugaggggaucaacuaugccgaucgaagaugguguuuugacggcgugaagaauaaccaaauacuugaagagaauguugaagucgagauuuggaccaaggagggagaaaggaaaaagcuaaaaccucgguggcuggaugcucgcaucuacuccgaccccuuggcauuaaaggaguucaaagaguucgccgcuggcagaaagagucugacacucaaccugauuacugagauggggaggcuuccaacguuuaugacccagaaggccaaaaaugcacuggauaaccucgcgguguugcauacagccgaagcuggaggucgggccuauaaucacgcacugagcgagcuaccugagacucuggaaacccuccuucuguuaacauugcuggcuaccgugacuggcgggaucuuccucuuucugaugucgggaaagggcauagguaaaaugacgcuugggaugugcugcaucauuaccgccucuauccugcucugguacgcacagauucagccgcacuggaucgccgcuuccauaauuuuggaguucuuucugaucgucuuacuaauccccgaaccagagaagcaacgaacaccucaggacaaccagcugacuuauguugugauugcgauccucaccguaguggccgcaacaauggcuaaugaaaugggcuuccuugagaaaaccaagaaggauuuuggacugggcagcauaacuacacagcaacccgagucaaacauuuuggacaucgaucugagaccagccagugccuggacgcucuacgcagucgcuaccacuuucauuacaccuaugcugcgccauucuaucgaaaauuccagcgugaacguuucacuuaccgccauagcgaaucaggcuaccgugcucauggggcugggaaaagguuggcccuugaguaagauggacaucggcgucccgcuguuagccauuggguguuacagccagguaaacccaaucacacuaacugcagcccugcuccuucugguggcucacuaugcaauuaucggaccuggcuugcaggccaaagcgacgagggaggcucaaaagcgggccgcagccgguauuaugaaaaaucccaccguugacgggaugacagugaucgaucuggacccaauacccuacgauccuaaguuugaaaagcagcucggccaggucaugcugcuuguguuaugcgucacucaggugcugaugaugcguaccacaugggcucucugugaggccuugacccuggcaacuggaccgauuuccacgcuaugggaaggcaaccccgggagauucuggaauacaaccaucgcuguuucuauggccaacaucuuuaggggaagcuaucuggcgggcgccggucuccuuuucuccauuaugaaaaacacugcaaauacccgccgggggacaggaaacacuggcgagacccugggugagaaguggaaaaaucgauugaacgcucugggcaagucagaauuucaaauauacaaaaagucugggauccaggagguggacagaacacucgccaaagaaggaauuaagaggggcgagacggaucaucacgcaguaagucgcgggucggcuaagcugcggugguucguggagagaaauuuagucaccccagaaggaaaaguuguggaccuuggcugcggucgugggggauggagcuauuacuguggcggucugaagaacgucaaagaggugaagggccucacuaaagggggaccuggccaugaggaacccaucccuauguccacauauggguggaaucuaguaaggcugcagucuggaguggauguuuucuuuaccucaccagaaaagugcgacacuuugcugugugauauuggcgagagcucccccaacccuacaguggaggccggucggacccuccgcguccuuaaucugguggaaaacugguugaauaacaauacgcaauucugcaucaagguccugaacccauacaugcccagugugauagagaaaauggaagcccuccagcgaaaguacgggggagcguuaguuagaaauccgcugucuaggaacagcacccacgagauguauuggguaucaaacgcuuccggcaauaucgugaguagcgucaacaugauuucucggaugcuuaucaaucgcuuuacaaugagacacaaaaaggcaacuuacgaaccugacguggaucugggcuccgggaccaggaacauuggaaucgagucagagacaccaaaucuagacauaauugguaaacgaaucgaaaagaucaagcaggagcaugaaacuagcuggcacuaugaucaggaccaucccuacaaaaccugggccuaucacggcucguacgagacaaagcaaaccgggucugcuaguuccaugguuaacggagugguccggcuccugacuaaaccuugggacgugauuccaaugguaacgcagauggccaugacagauaccacucccuucggccagcagcguguguuuaaggaaaaaguugacaccagaacacaagagccgaaggaggguacgaagaaauugaugaagauaaccgcagaauggcuguggaaagagcucgggaagaaaaagacuccucgcauguguacaagggaagaguucacccggaaagucagaagcaaugccgcucuuggagcgaucuuuacugaugagaacaaguggaagucagcccgcgaagcaguggaggacuccggcuucugggaacugguggauaaagagaggaauuuacaccuggaaggcaagugcgagacaugugucuauaacaugauggggaaacgagagaagaaauugggagaauuugguaaggcuaagggcucucgggccauuugguacauguggcucggggcaagauuccuggaguuugaagcccuaggauuccuuaaugaggaccauugguuuagcagggaaaacagucuguccggcguugagggugaggggcuccacaaacugggauacaucuugcgcgaugugagcaagaaagaaggcggcgcuauguaugccgacgauaccgcggggugggacacacguauuacucuggaggaucucgaaaaugaggaaaugguaaccaaccauauggagggagagcacaagaaacuugcagaagccaucuucaagcugacguaccagaauaaggugguccgggugcagagacccaccccaagggguacaguuauggacauaaucucucgccgagaccagcggggcucagggcaaguggucacuuauggauuaaacaccuucacaaacauggaggcucagcugauuagacagauggaaggcgaggguguguuuaaaaguauccaacaguugacuguaaaggaggaaauugccguuaaaaauuggcucaccaggguggggcgcgagagacugucccggauggcaaucagcggagaugacugcgucgugaagccucuagaugacagguucgcuucugcccuuacggcucugaacgauaugggcaaagugcguaaggacauucagcagugggaacccucgcgaggcuggaaugauuggacacaagucccauuuugcucacaucacuuccacgagcucauaaugaaggacgggcgcguucuggugguacccuguagaaaccaggaugaauugaucggacgggccaggauuagccagggugcaggcugguccuuacgcgagaccgcgugccuggggaaaaguuacgcccagauguggucucucauguauuuucauagacgggaccuuaggcuggcugccaaugcaaucuguagcgcugugccuucccacuggaucccaacuucacgaacaaccuggaguauucaugccacucacgaguggaugaccacagaagauaugcuaacggucuggaaccguguguggauacaagagaauccguggauggaagacaagacccccguugagucuugggaagagaucccuuaccugggaaaaagagaggaucaguggugcggcagccucauugguuugacuucccgcgcaacaugggccaagaacauccagaccgcgauuaaucaggugcggucacugaucgggaacgaagaguauacugacuacaugccaagcaugaaaagguucagacgcgaagaggaagaggcuggaguccuuugguga

SEQ ID NO: 14360 - RNA, 9876 nt, Artificial Sequence
  derived and/or modified CDS sequence (opt3) from DENV-2__KM279568__SS-prME
accgccggcaucauuauaaugaugauccccacagugauggcuuuccaccugacuacgagaaacggggagccucauaugauugucagcaggcaggaaaagggaaaaucccuccuuuuuaagaccgagaaugguguuaacaugugcacacugauggcaauggacuugggcgaauuaugugaggauacuaucaccuacaauugcccacugcuacggcaaaacgaaccggaggacauugauuguuggugcaauucuacaucaaccugggugacuuaugggacauguaccgccacgggagagcaccgccgagaaaaacguaguguagcgcucgugccccaugucggcaugggucuggagacuagaaccgaaacauggaugagcuccgagggggcuuggaagcacgcccagaggaucgagacuuggauacuucggcauccuggauucaccaucauggcagccauucuggcuuacacaaucggcaccacguauuuucagcgcguguugauuuucauccuccugacugcaguuacaccaucuauggccaugagaugcauaggcauuucgaacagggacuuuguggaaggggucucaggagguagcuggguggauaucguacuggagcacggcaguuguguuaccacuauggcuaaaaauaagcccacacucgacuucgaauuaauuaagaccgaggccaaacaccuggcgacgcuucggaaguacugcguggaagcaaaauugaccaacacaacuaccgccucccgcuguccuacacagggggagccaucucugaaugaggaacaagauaagcgauuugucugcaaacauagcaugguggacagaggauggggcaacgguugugggcuauucggaaagggcggcaucgugacuugcgcuauguuuaccugcaagaaaaauauggaggggaaggucguucagcccgaaaaccucgaguauacaaucgugauuaccccucacuccggagaagagaaugccguagguaacgauacuggcaaacaugggaaggagauaaaaaucacgccacagucaaguauuacagaagcagagcugaccggauacggcacugugaccauggaauguagcccgaggacaggucuugacuucaaugagaugguccuguugcagauggaaaacaaggcuuggcucgugcaccggcaaugguuucuggauuuaccccugccuuggcucccaggggccgacacccagggcucuaacuggauccagaaagagacucuuguuacauucaagaauccccacgcgaagaaacaggauauagugguccugggaucccaagagggcgccaugcauacggcauugaccggggcuacugaaauucagaugucaagcggaaaccuacuguuuacaggucaccucaagugccgucugcgcauggacaaacuucagcugaagggcaugaguuauucuauguguaccgggaaauucaaggugguaaaggagaucgccgaaacacaacauggaacuaucguuauuagagugcaguacgagggcgacgguuccccuugcaaaaucccauucgagauuauggauuuggaaaagaggcacguccucgggcggcugauaaccgugaaucccaucgucacggagaaagacagcccggugaacauugaagcugagccucccuuuggcgauucguacaucaucauuggaguugaaccaggccaguuaaagcugucuugguucaaaaagggguccucaauaggacagauguuugagaccacaaugcgaggugccaagcgcauggcaauccuaggcgacacugccugggauuucgggagucucggaggcguguuuaccagcauugguaaagcucugcaucaaguauucggggcgaucuauggcgcagccuuuuccggagucucuuggacaaugaagauucuuaucggcgugguuauaacuuggaucgggaugaauagcagaucaaccaguuuguccgugagccugguccucgugggaguagugacgcuguaccuuggcguuaugguccaggcugacucugguuguguggugucauggaaaaacaaggagcugaaaugcgggaguggaauuuucaucacagauaauguccacaccuggacugaacaguauaaguuucagccugagagccccuccaaguuggccucugcaauucaaaaagcccacgaagagggcaucugugguauaaggucgguuacacggcucgaaaaccugauguggaagcagauuaccccagaguuaaaucauauccugacugagaacgaagugaaacuaaccauuaugacaggcgacaucaaggggauaaugcaggcuggaaaacgcagccucagaccccagccuacggagcugaaguacuccuggaaagccuggggcaaggcaaagaugcuuucaaccgaauugcacaaucauacuuuccugaucgaugggccagagacagcggaaugcccgaacaccaauagggcuuggaacagucucgagguggaggacuauggauuuggcguauucacaacuaauauuuggcugaaauuaaaggaacgucaagaugucuuuugugacucuaaacugaugagcgccgcaaucaaggacaaccgggccgugcacgcugauauggguuacuggauugaguccgcccuuaacgacaccuggaaaaucgaaaaggcaucauucauagagguuaagagcugccacuggcccaaaucucauacguugugguccaauggggugcucgagagugaaaugauuaucccuaagaacuucgcuggaccagucagccagcacaauuaucgacccggcuaccauacacagaccgccgguccuuggcaccugggcagacuagagauggauuuugacuucugugaagggacuaccgugguugugacagaggauugcggaaacaggggcccaucucugcgcacuaccacagcguccgggaaacucaucacggaauggugcugucggucaugcacccugcccccgcuuagauacaggggagaggacggcuguugguaugguauggagauucgcccuuugaaggaaaaagaggaaaaucugguaaacaguuuagucacugccgggcauggacagaucgauaauuuuagccucggcgugcuggguauggcucuuuuccuggaggaaauguugcgaacacgggugggcaccaagcacgcaauucuccuggucgccguuucguuugugacucuaauaacagggaacauguccuuccgugaccugggaagaguaauggugauggucggcgcuaccaugacggaugacaucgggaugggagugacuuaccucgcccugcuugcagcguuuaagguuaggccaaccuucgccgcuggcuugcuguuacgcaaacucacaucuaaggagcugaugaugaccacuauugguaucgugcuucugagccaaucaacaauucccgagaguauccuagaacucaccgaugcccuggcauuggggaugaugguccugaaaauagugcggaauauggagaaguaucaguuagcuguuacaaucauggccauuuccugcgugccuaacgcagucauccuccagaaugccuggaaaguaucuuguacuacccuggcugugguuagcguguccccccuucuguugacgucaagccaacagaaggcggacuggauuccacucgcccugacaaucaagggacuaaacccuaccgcaauauuucugacuacccuuaguagaacaucuaaaaagagguccuggccccucaaugaagcuauuauggccgucggcauggugagcauccuggccucgucauugcugaaaaacgauaucccaaugacuggcccguuaguagcugggggacuccugaccgugugcuacguccuuacgggucgaucugcagaccuggaguuggaacgcgccgcggacguucggugggaggagcaggcugaaauuaguggcuccagcccuauacucucuaucacaauuagcgaggauggguccaugucaaucaagaaugaagaggaggaacagacccugacuauucuaaucagaacaggacugcuugugauaaguggccucuuccccgugagcaucccaauuaccgccgcagccugguaucugugggaggucaaaaagcaaagggcugguguguugugggacguucccucuccuccacccguagggaaagcagaauuagaggauggagccuaccguaucaagcagaagggcauucugggcuauucccagaucggggcgggaguguacaaagaagguacuuuucacacaauguggcaugucacccgcggcgcugugcucaugcacaaggggaaacggauagagccuucaugggccgacguuaagaaagaucugauuaguuacggaggcgguuggaagcuugagggggaauggaaggagggagaagaggugcagguccuggcauuggaaccgggcaaaaacccaagagccgugcaaacgaagcccggccuauucaaaacuaacaccgggacaaucggagcuguaagccuggacuuuuccccugguaccucuggcucgccaaucgucgauaagaaagggaaggugguuggacucuauggcaaugguguggucacaaggagcgggacuuacgugucagccauugcacagaccgagaaguccaucgaggacaaccccgaaauagaggaugacauuuuccgaaaaaagcggcugacgaucauggaucuucauccuggagcuggcaaaacaaagcgcuauuuaccggccauuguuagagaagcgaucaaaaggggccugcggacucucauauuggcccccacccgaguggucgcagcugagauggaagaggcccugagagggcucccaauucgcuaccagacaccugcuaucagggcagagcacaccggacgugaaaucguggaccugaugugucaugccacuuucaccaugcggcuucugagucccauuagaguaccaaauuauaacuugaucauuauggaugaggcccacuuuacagacccugcuucuauagcggcaagggguuacaucagcacgcgcguggaaaugggcgaggccgcugggauuuucaugacugccacccccccaggaucccgagacccguuuccucagucaaaugcacccaucauggaugaggaaagagagaucccagaacggucuuggaacagcggccacgaguggguuacagacuucaaggguaagaccgucugguuugugcccaguauuaaagccgggaaugauauagcugcgugccuaaggaagaacggaaaaaaggugauccaacugucccgcaaaacuuucgacagcgaauauauuaagacacguaccaaugauugggacuuugucguaacgacugauaucucugagaugggcgccaacuucaaggcagagagagugauugacccucggagguguaugaaaccaguuauccucacagauggcgaagagcgcgugauauuagcugggcccaugccugucacccauucauccgccgcacagcgaagaggacggguggguaggaauccgaagaacgaaaaugaccaguacaucuacaugggcgagccacuggaaaacgaugaggacugcgcccacuggaaagaggcuaagaugcuucuggacaauauuaacacccccgaagggaucauuccuaguauguuugagcccgaacgcgagaaaguugaugccaucgacggagaauauagacucaggggcgaggcgcggaagacuuucguggauuugaugcgucgcggugaccugccagucuggcucgcauaccgaguggccgcugaggggauaaacuaugccgauagaaggugguguuuugacggcguaaaaaauaaccaaauucuggaagagaauguggaaguugagaucuggacaaaggagggagaacggaagaaacuuaagccucgcuggcuagaugcuagaauuuacagcgacccccuggcauugaaagaguucaaggaauucgccgcuggcaggaaaucguuaacccugaaccucaucacagagauggggcggcugccaacuuuuaugacgcagaaggccaagaaugcacuugauaaccuggcgguccuccauaccgccgaagcuggaggucgagccuauaaucacgcauugucugagcugccugagacacuagaaacucugcuccuucugaccuuauuggcuacagugaccggcgggauauuccuguuucucauguccggaaaaggcaucgguaagaugacucuggggaugugcugcauuaucacggccagcauucuucugugguacgcacagauccagccgcacuggauagccgcuucaauuauccucgaguucuuuuugaucgugcuguuaauucccgaaccagagaaacaaagaaccccucaggacaaccagcuaacauaugucguuaucgcgauacugacugugguagccgcaaccauggcuaaugaaaugggcuuccucgagaagacaaaaaaggauuuuggacuuggcaguauuaccacucagcaacccgagucuaacauccuggacauugauuugcgcccagccuccgccuggacacuguacgcaguggcuacgaccuucaucacuccuaugcucaggcauagcauagaaaauucaagugucaacgugagccugacagccaucgcgaaucaggcuaccguucuuauggggcucggaaaggguuggccccuguccaaaauggacauuggcgugccguugcuggccaucggguguuacucucaggucaacccaauuaccuuaacagcagcccuacugcuccuuguagcucacuaugcaaucauuggaccuggccugcaggccaaggcgacucgggaggcucaaaaacgugccgcagccgguaucaugaagaaucccacgguggacgggaugaccguuauagauuuggacccaauucccuacgauccuaaauuugaaaagcagcugggccaggugaugcuccugguccuuugcgugacacaggucuuaaugaugagaacuaccugggcucugugugaggcccucacauuggcaaccggaccgaucagcacucugugggaaggcaaccccgggagguucuggaauacgacaaucgcuguguccauggccaacauuuuucgcggaucauaucuagcgggcgccggucugcucuucucuauaaugaagaacaccgcaaauacucggcgagggaccggaaacacaggcgagacucuuggugagaaauggaagaauagacugaacgcuuugggcaaaagugaauuucaaaucuacaagaaaucggggauucaggagguugacaggacccuggccaaggaaggaaucaaacgcggcgagacagaucaucacgcagugagccggggguccgcuaagcucagaugguucguagagcguaaucuggugacgccagaaggaaaggucguugacuuaggcugcgguagggggggauggucuuauuacuguggcggucuuaaaaacgugaaggaggucaaaggccugaccaaggggggaccuggccaugaagagcccauuccuaugucaacuuauggguggaaucucgugcggcuacagagcggaguagauguguucuuuacaccacccgaaaaaugcgacacccuguugugugauaucggcgaguccaguccuaacccaacuguugaggccggucgcacacugcgagugcucaaucuugucgaaaacuggcugaauaacaauacccaauucugcauaaagguguugaaccccuacaugccgucugucaucgagaagauggaagcccugcagagaaaauacgggggagcgcucgugaggaauccuuuaagccggaacucaacgcacgagauguauuggguuuccaacgcuaguggcaauauuguaagcucugugaacaugaucucccgcaugcugauuaauagauuuaccaugaggcacaagaaagcaacauacgaaccagacgucgaucuuggcucagggacucgaaacaucggaauagagagcgagacccccaaucuggacauuaucgguaagcggaucgaaaaaauuaagcaggagcaugaaacaucguggcacuaugaucaggaccauccuuacaagacuugggccuaucacggcucuuacgagaccaaacaaacagggagugcuuccagcauggugaacggaguugugcgucuacucaccaagccaugggacgucauacccauggugacucagauggccaugacggauacaaccccguucggccagcagagaguauuuaaagaaaagguggacacucgcacccaagagccuaaagaggguacaaagaagcugaugaaaaucacggcagaaugguuguggaaggagcuggggaaaaagaaaacccccaggauguguacucgggaagaguucacaagaaagguucgcucaaaugccgcucucggagcgauuuuuaccgaugagaacaaauggaaguccgccagggaagcagucgaggacucuggcuucugggaacuuguggauaaggagcgaaaucugcacuuagaaggcaaaugcgagacuuguguguauaacaugauggggaagcgggagaaaaagcugggagaauuugguaaagcuaagggcagcagagccaucugguacaugugguugggggcaagguuccucgaguuugaagcccugggauuccuaaaugaggaccauugguuuagucgcgaaaacucccuuagcggcgucgagggugaggggcugcacaagcucggauacauucugcgugauguuucuaaaaaggaaggcggcgcuauguaugccgacgauacagcggggugggacacccggaucacauuggaggaucugaaaaaugaagagauggugacuaaccauauggaaggagagcacaagaaacucgcagaggccauauucaagcuuaccuaccagaauaagguagugagaguccagaggccaacgccucgcgguaccgugauggacaucauuucacgacgggaccagagaggcagugggcaaguugugacauauggacugaacacuuucaccaacauggaagcucaguuaaucaggcagauggagggcgaaggugucuuuaaauccauucaacagcugacagugaaggaggagaucgccguaaaaaauugguugauucgcguugggagagaacggcucagcaggauggcaauaucuggagaugacugcguggucaagccccuggaugaccguuucgcuucggcccuaacugcucuuaacgauaugggcaaagugcgaaaggacauccagcagugggagccaucacgcggcuggaaugauuggacccaagugcccuuuugcagccaucacuuccacgaacugauuaugaaggacgggagaguccucguugugccuugucggaaccaggaugagcugaucggaagggcccgcaucucccagggugcaggcuggaguuugagagaaacggcgugcuuagggaaaucuuacgcccagauguggagccugauguauuuucaucggagggaccuccgacuugcugccaaugcaauuuguuccgcuguaccaucacacuggauaccgacaagucguaccacuuggucuauccaugccacacacgaguggaugaccacugaggauaugcugaccguguggaacagagucuggauucaagaaaaucccuggauggaggacaagacaccuguggaaagcugggaggaaaucccauaccuaggaaaacgcgaggaucaguggugcggcucccugauuggucucacgucacgggcaaccugggccaagaacauccagacugcgauaaaucagguuaggagcuugaucgggaacgaggaauauacagacuacaugcccucuaugaaaagauuccgccgggaggaagaggaagcuggagugcugugguga

SEQ ID NO: 14361 - RNA, 9876 nt, Artificial Sequence
  derived and/or modified CDS sequence (opt3) from DENV-2__KM279569__SS-prME
accgccggcaucauuauaaugaugauccccacagugauggcuuuccaccugacuacgcgaaacggggagccucauaugauugucagcaggcaggaaaagggaaaaucccuccuuuuuaagaccgagaaugguguuaacaugugcacacugauggcaauggacuugggcgaauuaugugaggauacuaucaccuacaauugcccacuguuacggcaaaacgaaccggaggacauugauuguuggugcaauucuacaucaaccugggugacuuaugggacauguaccgccacgggagagcaccgccgagaaaaacguaguguagcgcucgugccccaugucggcaugggucuggagacuagaaccgaaacauggaugagcuccgagggggcuuggaagcacgcccagaggaucgagacuuggauacuucggcauccuggauucaccaucauggcagccauucuggcuuacacaaucggcaccacguauuuucagcgcguguugauuuucauccuccugacugcaguuacaccaucuauggccaugagaugcauaggcauuucgaacagggacuuuguggaaggggucucaggagguagcuggguggauaucguacuggagcacggcaguuguguuaccacuauggcuaaaaauaagcccacacucgacuucgaauuaauuaagaccgaggccaaacaccuggcgacgcuucggaaguacugcguggaagcaaaauugaccaacacaacuaccgccucccgcuguccuacacagggggagccaucucugaaugaggaacaagauaagcgauuugucugcaaacauagcaugguggacagaggauggggcaacgguugugggcuauucggaaagggcggcaucgugacuugcgcuauguuuaccugcaagaaaaauauggaggggaaggucguucagcccgaaaaccucgaguauacaaucgugauuaccccucacuccggagaagagaaugccguagguaacgauacuggcaaacaugggaaggagauaaaagugacgccacagucaaguaucacagaagcagagcugaccggauacggcacugucaccauggaauguagcccgaggacaggucuugacuucaaugagauggugcuguugcagauggaaaacaaggcuuggcucguucaccggcaaugguuucuggauuuaccccugccuuggcucccaggggccgacacccagggcucuaacuggauucagaaagagacucuugugacauucaagaauccccacgcgaagaaacaggaugucgugguacugggaucccaagagggcgccaugcauacggcauugaccggggcuacugaaauccagaugucaagcggaaaccuacuguuuacaggucaccucaagugccgucugcgcauggacaaacuucagcugaagggcaugaguuauucuauguguaccgggaaauucaagguugugaaggagauagccgaaacacaacauggaacuauugucaucagagugcaguacgagggcgacgguuccccuugcaaaaucccauucgagauuauggauuuggaaaagaggcacguccucgggcggcugaucaccgugaaucccauuguuacggagaaagacagcccggugaacauagaagcugagccucccuuuggcgauucguacaucauuaucggaguagaaccaggccaguuaaagcugucuugguucaaaaagggguccucaaucggacagauguuugagaccacaaugcgaggugccaagcgcauggcaauucuaggcgacacugccugggauuucgggagucucggaggcgucuuuaccagcauagguaaagcucugcaucaaguguucggggcgaucuauggcgcagccuuuuccggaguuucuuggacaaugaagauucuuaucggcguggucauuacuuggaucgggaugaauagcagaucaaccaguuuguccgugagccugguacucgugggaguugucacgcuguaccuuggcgugauggugcaggcugacucugguugugucguuucauggaaaaacaaggagcugaaaugcgggaguggaauauucaucacagauaaugugcacaccuggacugaacaguauaaguuucagccugagagccccuccaaguuggccucugcaauucaaaaagcccacgaagagggcaucugugguauuaggucggugacacggcucgaaaaccugauguggaagcagaucaccccagaguuaaaucauauacugacugagaacgaaguaaaacuaaccauuaugacaggcgacaucaaggggauuaugcaggcuggaaaacgcacgcucagaccccagccuaccgagcugaaguacagcuggaaagccuggggcaaggcaaagaugcuuuccacugaauugcacaaucauacauuccugaucgaugggccagagaccgcggaaugcccgaacacaaauagggcuuggaacucacucgaggucgaggacuauggauuuggcguguucacuaccaauauauggcugaaauuaaaggaacgucaagauguauuuugugacaguaaacugaugucugccgcaaucaaggacaaccgggccgugcacgcugauauggguuacuggauugagagcgcccuuaacgacacguggaaaaucgaaaaggcauccuucauugaggucaagucaugccacuggcccaaaagccauacauuguggucuaauggggugcucgaguccgaaaugaucauaccuaagaacuucgcuggaccaguuagucagcacaauuaucgacccggcuaccauacccagacugccgguccuuggcaccugggcagacuagagauggauuuugacuucugugaagggaccacagugguagucacugaggauugcggaaacaggggcccaagccugcgcaccacaacggcgucugggaaacucauuaccgaauggugcugucgguccugcacucugcccccgcuuagauacaggggagaggacggcuguugguaugguauggagauccgcccuuugaaggaaaaagaggaaaaucuggugaacucauuagugacagccgggcauggacagaucgauaauuuuagucucggcguccuggguauggcucuuuuccuggaggaaauguugcgaacccggguuggcacuaagcacgcaauucuccugguggccguuagcuuugugacacuaaucaccgggaacaugucguuccgugaccugggaagagucauggugaugguuggcgcuacgaugacugaugacauugggaugggagugaccuaccucgcccugcuugcagcguuuaaggucaggccaacauucgccgcuggcuugcuguuacgcaaacucaccuccaaggagcugaugaugacuacaauagguaucgugcuucugucucaaagcaccauucccgagucaauccuagaacucacagaugcccuggcauuggggaugaugguucugaaaauugugcggaauauggagaaguaucaguuagcugucacuaucauggccauacucugcguaccuaacgcagugauccugcagaaugccuggaaaguuaguuguaccacgcuugcuguggucuccgugucuccccuguugcucacaagcucccaacagaaggcggacuggauuccacuggcccuaaccaucaagggacugaacccuacugcaauuuuucuuaccacacucucaagaacuagcaaaaagaggaguuggccccugaaugaagcuaucauggccguaggcauggugucuauauuggccuccagccugcuaaagaacgauauuccaaugaccggcccgcucgucgcugggggacugcuuacgguuugcuacgugcugacaggucgaucggcagacuuggagcucgaacgcgccgcggacgugcggugggaggagcaggcugaaaucucaggcucuaguccuauccuguccauuaccauaagcgaggaugggucuaugagcaucaagaaugaagaggaggaacagacucuaacaauucugaucagaaccggacuucucgucauuuccggccuguuccccgugucaaucccaauaacugccgcagccugguauuugugggagguuaaaaagcaaagggcugguguauuaugggacgugcccaguccuccacccgucgggaaagcagaacuggaggauggagccuaccguaucaagcagaagggcauucucggcuauagccagaucggggcgggaguguacaaagaagguacauuucacaccauguggcauguuacgcgcggcgcugugcugaugcacaaggggaaacggauugagccuucuugggccgacgucaagaaagaucuuaucuccuacggaggcgguuggaagcuggagggggaauggaaggagggagaagaggugcagguauuggcacuagaaccgggcaaaaacccaagagccguccaaacuaagcccggccuguucaaaaccaacacagggaccauaggagcugugucacucgacuuuaguccugguacaagcggcuccccaauuguugauaagaaagggaagguggucggacuguauggcaauggugugguuacuaggucugggaccuacgugucggccaucgcacagacggaaaagagcaucgaggacaaccccgaaauugaggaugacaucuucagaaagaagcggcuuacaauaauggauuuacauccuggagcuggcaaaacuaagcgcuaucugccggccauugucagagaagcgaucaaaaggggccuccggaccuugauucuggcccccacacgagugguagcagcugagauggaagaggcccucagagggcugccaauccgcuaccagaccccugcuauaagggcagagcacacuggacgugaaauuguggaccuuaugugucaugccaccuucacaaugcggcuguugucacccaucagaguuccaaauuauaaccuaaucauuauggaugaggcccacuuuacggacccugcuuccaucgcggcaagggguuacauuaguacucgcgucgaaaugggcgaggccgcugggauauucaugaccgccacacccccaggaucucgagacccguuuccucagagcaaugcacccaucauggaugaggaaaaggagauuccagaaagauccuggaacucaggccacgagugggugaccgacuucaaggguaaaacugugugguuuguccccucuaucaaggccgggaaugauaucgcugcgugccugcggaaaaacggaaagaaaguaauucaacucagcaggaagacauucgacagugaauauauaaagacccgcacgaaugauugggacuuugugguuacuacagauaucuccgagaugggcgccaacuucaaagcagagcgugugauugacccuagacgguguaugaagccagucaucuuaaccgauggcgaagagagggugauucuggcugggcccaugccuguuacccauagcucugccgcacagcgccgaggaagagugggucggaauccgaaaaacgaaaaugaccaguacaucuacaugggcgagccacuugaaaacgaugaggacugcgcccacuggaaggaggcuaaaaugcugcucgacaauauaaacacucccgaagggaucauuccuucaauguuugagcccgaaagggagaaggucgaugccaucgacggagaauaucgcuugagaggcgaggcgaggaaaacauucguggaucugaugcggcguggugaccucccaguauggcuggcauaccgcguggccgcugaggggauuaacuaugccgaucgaagaugguguuuugacggcguuaagaauaaccaaauccuugaagagaaugucgaaguggagauauggaccaaggagggagaaaggaaaaagcuaaaaccucgguggcuggaugcucgcauuuacuccgaccccuuggcauuaaaggaguucaaagaguucgccgcuggcagaaagagucugacacucaaccugaucacugagauggggaggcuuccaacguuuaugacccagaaggccaaaaaugcacuggauaaccucgcgguguugcauacagccgaagcuggaggucgggccuauaaucacgcacugagcgagcuaccugagacucuggaaacccuccuucuguuaacauugcuggcuaccgucacuggcgggauuuuccucuuucugaugucgggaaagggcaucgguaaaaugacgcuugggaugugcugcauaaucaccgccucuauucugcucugguacgcacagauccagccgcacuggauugccgcuuccaucauauuggaguucuuucugauuguuuuacuaauccccgaaccagagaagcaacgaacaccucaggacaaccagcugacuuaugugguaaucgcgauucucaccguggucgccgcaacaauggcuaaugaaaugggcuuccuugagaaaaccaagaaggauuuuggacugggcagcaucacuacacagcaacccgagucaaacauauuggacauugaucugagaccagccagugccuggacgcucuacgcaguggcuaccacuuucaucacaccuaugcugcgccauucuauugaaaauuccagcguuaacgugucacuuaccgccaucgcgaaucaggcuaccguccucauggggcugggaaaagguuggcccuugaguaagauggacauaggcguaccgcuguuagccaucggguguuacagccaggugaacccaauuacacuaacugcagcccugcuccuucugguugcucacuaugcaaucauuggaccuggcuugcaggccaaagcgacgagggaggcucaaaagcgggccgcagccgguaucaugaaaaaucccaccguggacgggaugacagucauugaucuggacccaauccccuacgauccuaaguuugaaaagcagcucggccaggugaugcugcuugucuuaugcgugacucagguucugaugaugcguaccacaugggcucucugugaggccuugacccuggcaacuggaccgauauccacgcuaugggaaggcaaccccgggagauucuggaauacaaccauugcugugucuauggccaacaucuuuaggggaagcuaucuggcgggcgccggucuccuuuucuccaucaugaaaaacacugcaaauacccgccgggggacaggaaacacuggcgagacccugggugagaaguggaaaaaucgauugaacgcucugggcaagucagaauuucaaauuuacaaaaagucugggauacaggagguagacagaacacucgccaaagaaggaaucaagaggggcgagacggaucaucacgcagugagucgcgggucggcuaagcugcggugguucgucgagagaaauuuaguuaccccagaaggaaaaguggucgaccuuggcugcggucgugggggauggagcuauuacuguggcggucugaagaacgugaaagagguaaagggccucacuaaagggggaccuggccaugaggaacccauuccuauguccacauauggguggaaucuagugaggcugcagucuggaguugauguguucuuuaccccacccgaaaagugcgacacuuugcugugugauaucggcgagucaagcccuaacccaacagucgaggccggucggacccuccgcgugcuuaaucuggucgaaaacugguugaauaacaauacgcaauucugcauuaaggugcugaaccccuacaugccguccguuaucgagaaaauggaagcccuccagcgaaaguacgggggagcguuaguaagaaauccucugaguaggaacucuacccacgagauguauugggugagcaacgcuucaggcaauauagucuccagugugaacaugaucagccggaugcuuauuaaucgcuuuacaaugagacacaaaaaggcaacuuacgaaccagacguugaucugggcucugggaccaggaacaucggaauugaguccgagacacccaaucuagacaucauagguaaacgaauugaaaagaucaagcaggagcaugaaacuucauggcacuaugaucaggaccauccuuacaaaaccugggccuaucacggcagcuacgagacaaagcaaaccgggucggcuucuaguauggugaacggagucgugcggcuccugacuaaaccaugggacguaauccccauggugacgcagauggccaugacagauaccacuccguucggccagcagcguguuuuuaaggaaaaagucgacaccagaacacaagagccuaaggaggguacgaagaaauugaugaagauuaccgcagaauggcuguggaaagagcucgggaagaaaaagacuccccgcauguguacaagggaagaguucacccggaaagugagauccaaugccgcucuuggagcgauauuuacugaugagaacaaguggaaaagcgcccgcgaagcaguggaggacucaggcuucugggaacuggucgauaaagagaggaauuuacaccuggaaggcaagugcgagacauguguuuauaacaugauggggaaacgagagaagaaauugggagaauuugguaaggcuaagggcucccgggccaucugguacauguggcucggggcaagauuccuggaguuugaagcccuaggauuccuuaaugaggaccauugguuuucuagggaaaacagccugaguggcguggagggugaggggcuccacaaacugggauacauuuugcgcgauguauccaagaaagaaggcggcgcuauguaugccgacgauaccgcggggugggacacacguaucacucuggaggaucucaagaaugaagagauggugaccaaccauauggaaggagagcacaagaaacuugcagaggccauuuucaaacugacguaccagaauaaagucgugcggguucagagaccaaccccuagggguacagugauggacaucauaagccgccgagaccagcggggcucugggcaagucgugacuuauggauuaaacaccuucacaaacauggaagcucagcugaucagacagauggagggcgaagguguauuuaagucaauucaacaguugacuguuaaagaggagaucgccgugaaggauuggcucauuagggucgggcgcgaaagacugagucggauggcaaucuccggagacgauugcguggugaaaccccuagacgauagguucgcuagcgcccuuaccgcucugaaugacaugggcaagguccguaaggauauucagcagugggagccaucucgaggcuggaacgacuggacgcaaguucccuuuugcucgcaucacuuccacgaacucauaaugaaagaugggcgcgugcugguagugccuuguagaaaucaggacgaguugaucggacgggccaggauuucacagggugcaggcuggagcuuacgcgaaacagcgugccuggggaaguccuacgcccagauguggagucucauguauuuucauagacgggaucuuaggcuggcugccaacgcaaucuguucugcugucccaagccacuggaucccgaccucccgaacuacauggucaauucaugccacccacgaguggaugacuaccgaggacaugcuaacaguguggaaucguguuuggauacaagaaaaccccuggauggaggauaaaacgccuguggaaaguugggaggaaaucccauaccugggaaagagagaggaccaguggugcggcucucucauugguuugaccagccgcgcaacuugggccaaaaauauccagacagcgauuaaccagguccggucccugaucgggaaugaggaauauaccgacuacaugcccucaaugaagagguucagacgcgaggaagaggaagcuggagugcuuugguga

SEQ ID NO: 14362 - RNA, 9876 nt, Artificial Sequence
  derived and/or modified CDS sequence (opt3) from DENV-2__KM279570__SS-prME
accgcaggaaucauuauaaugaugauccccacagugauggcuuuccaccugacuacgcgaaacggggagccucauaugauugucagcaggcaggaaaagggaaaaucccuccuuuuuaagaccgagaaugguguuaacaugugcacacugauggcaauggacuugggcgaauuaugugaggauacuaucaccuacaauugcccacuguuacggcaaaacgaaccggaggacauugauuguuggugcaauucuacaucaaccugggugacuuaugggacauguaccgccacgggagagcaccgccgagaaaaacguaguguugcgcucgugccccaugucggcaugggucuggagacuagaaccgaaacauggaugagcuccgagggggcuuggaagcacgcccagaggaucgagacuuggauacuucggcauccuggauucaccaucauggcagccauucuggcuuacacaaucggcaccacguauuuucagcgcguguugauuuucauccuccugacugcaguuacaccaucuauggccaugaggugcauaggcauuucgaacagggacuuuguggaaggggucucaggagguagcuggguggauaucguacuggagcacggcaguuguguuaccacuauggcuaaaaauaagcccacacucgacuucgaauuaauuaagaccgaggccaaacaccuggcgacgcuucggaaguacugcguggaagcaaaauugaccaacacaacuaccgccucccgcuguccuacacagggggagccaucucugaaugaggaacaagauaagcgauuugucugcaaacauagcaugguggacagaggauggggcaacgguugugggcuauucggaaagggcggcaucgugacuugcgcuauguuuaccugcaagaaaaauauggaggggaaggucguucagcccgaaaaccucgaguauacaaucgugauuaccccucacuccggagaagagaaugccguagguaacgauacuggcaaacaugggaaggagauaaaagugacgccacagucaaguaucacagaagcagagcugaccggauacggcacugucaccauggaauguagcccgaggacaggucuugacuucaaugagauggugcuguugcagauggaaaacaaggcuuggcucguucaccggcaaugguuucuggauuuaccccugccuuggcucccaggggccgacacccagggcucuaacuggauucagaaagagacucuugugacauucaagaauccccacgcgaagaaacaggaugucgugguacugggaucccaagagggcgccaugcauacggcauugaccggggcuacugaaauccagaugucaagcggaaaccuacuguuuacaggucaccucaagugccgucugcgcauggacaaacuucagcugaagggcaugaguuauucuauguguaccgggaaauucaagguugugaaggagauagccgaaacacaacauggaacuauugucaucagagugcaguacgagggcgacgguuccccuugcaaaaucccauucgagauuauggauuuggaaaagaggcacguccucgggcggcugaucaccgugaaucccauuguuacggagaaagacagcccggugaacauagaagcugagccucccuuuggcgauucguacaucauuaucggaguagaaccaggccaguuaaagcugucuugguucaaaaagggguccucaaucggacagauguuugagaccacaaugcgaggugccaagcgcauggcaauucuaggcgacacugccugggauuucgggagucucggaggcgucuuuaccagcauagguaaagcucugcaucaaguguucggggcgaucuauggcgcagccuuuuccggaguuucuuggacaaugaagauucuuaucggcguggucauuacuuggaucgggaugaauagcagaucaaccaguuuguccgugagccugguacucgugggaguugucacgcuguaccuuggcgugauggugcaggcugacucugguugugucguuucauggaaaaacaaggagcugaaaugcgggaguggaauauucaucacagauaaugugcacaccuggacugaacaguauaaguuucagccugagagccccuccaaguuggccucugcaauucaaaaagcccacgaagagggcaucugugguauuaggucggugacacggcucgaaaaccugauguggaagcagaucaccccagaguuaaaucauauacugacugagaacgaaguaaaacuaaccauuaugacaggcgacaucaaggggauuaugcaggcuggaaaacgcagccucagaccccagccuacggagcugaaguacuccuggaaagccuggggcaaggcaaagaugcuuucaaccgaauugcacaaucauacuuuccugaucgaugggccagagacagcggaaugcccgaacaccaauagggcuuggaacagucucgaggucgaggacuauggauuuggcguguucacaacuaauauauggcugaaauuaaaggaacgucaagauguauuuugugacucuaaacugaugagcgccgcaaucaaggacaaccgggccgugcacgcugauauggguuacuggauugaguccgcccuuaacgacaccuggaaaaucgaaaaggcaucauucauugaggucaagagcugccacuggcccaaaucucauacguugugguccaauggggugcucgagagugaaaugaucauaccuaagaacuucgcuggaccaguuagccagcacaauuaucgacccggcuaccauacacagaccgccgguccuuggcaccugggcagacuagagauggauuuugacuucugugaagggacuaccguggcgguaacagaggauugcggaaacaggggcccaucucugcgcacuaccacagccuccgggaaacucauuacggaauggugcugucggucaugcacccugcccccgcuuagauacaggggagaggacggcuguugguaugguauggagauccgcccuuugaaggaaaaagaggaaaaucuggucaacaguuuagugacugcugggcauggacagaucgauaauuuuagccucggcgugcuggguauggcacuuuuccuggaggaaauguugcgaacacgggucggcaccaagcacgccauucuccugguugcugugucguuuguaacucuaaucacagggaacauguccuuccgugaccugggaagagugauggucauggugggcgccaccaugacggaugacauugggaugggaguuacuuaccucgcacugcuugcggccuuuaaggugaggccaaccuucgcugccggcuugcuguuacgcaaacucacaucuaaggagcugaugaugaccacuauagguaucguccuucugagccaaucaacaauucccgagaguauccuagaacucaccgaugcacuggcuuuggggaugauggugcugaaaauuguucggaauauggagaaguaucaguuagccgugacaaucauggcaauacucugcgucccuaacgccguaauccugcagaaugcuuggaaaguguccuguacuacccuugcgguugugucugucagcccccuguugcucacguccucacaacagaaggccgacuggauuccacuggcacuaacaaucaagggacugaacccuaccgcuauuuuucuuacuacccucagcagaacaaguaaaaagaggucuuggccccugaaugaagccaucauggccgugggcaugguauccauauuggcuagcucgcugcuaaagaacgauauuccaaugacuggcccgcucguggcagggggacugcuuaccgucugcuacguucugacgggucgaucagccgacuuggagcucgaacgcgcggcugacgugcggugggaggagcaggccgaaaucucuggcaguuccccuauccugagcauuacaauaucugaggaugggagcauguccaucaagaaugaagaggaggaacagacccuaacuauucugaucagaacaggacuucucgugauuucaggccuguuccccgucaguaucccaauaaccgcagccgcuugguauuugugggaggugaaaaagcaaagggccgguguuuuaugggacguacccagcccuccacccguggggaaagccgaacuggaggauggagcguaccguaucaagcagaagggcauucucggcuauucucagaucggggcuggagucuacaaagaagguacuuuucacacaauguggcaugugacccgcggcgccguucugaugcacaaggggaaacggauugagccuuccugggcagacgugaagaaagaucuuaucucauacggaggcgguuggaagcuggagggggaauggaaggagggagaagagguccagguguuggcccuagaaccgggcaaaaacccaagagcuguacaaacgaagcccggccuguucaaaacuaacaccgggacaauaggagccgucagucucgacuuuagcccugguaccuccggcucuccaauuguggauaagaaagggaagguugugggacuguauggcaauggugucgugacaaggucggggacuuacguuagcgcaaucgcucagaccgagaagucaaucgaggacaaccccgaaauugaggaugacaucuuccggaaaaagagacuuacgauaauggauuuacauccuggagccggcaaaacaaagcgcuaucugccggcgauugugagagaagccaucaaaaggggccuccggacuuugauucuggcacccacccgagucguggcugccgagauggaagaggcucucagagggcugccaauccgcuaccagaccccugcaauaagggccgagcacaccggacgugaaauuguagaccuuaugugucaugccacuuucaccaugcggcuguugucccccaucagagugccaaauuauaaccuaaucauuauggaugaggcucacuuuacagacccugcgaguaucgcagccagggguuacauuucuacgcgcguugaaaugggcgaggcugccgggauauucaugacugcaacacccccaggaagccgagacccguuuccucaguccaaugcccccaucauggaugaggaaagagagauuccagaacggucauggaacucuggccacgagugggucacagacuucaaggguaagaccgugugguuugugcccagcaucaaagcugggaaugauaucgcggccugccugaggaagaacggcaaaaaggucauucaacucagucgcaaaacuuucgacuccgaauauauaaagacacguaccaaugauugggacuuuguagugacgacugauaucagcgagaugggcgcaaacuucaaggcugagagaguuauugacccucggagguguaugaaaccagugaucuuaacagauggcgaagaacgcgucauucuggccgggcccaugccugugacccauucuucagcagcccagcgaagaggacggguugguaggaauccgaagaacgaaaaugaccaguacaucuacaugggcgagccacuugaaaacgaugaggacugcgcucacuggaaagaggccaagaugcugcucgacaauauaaacacccccgaagggaucauuccuuccauguuugagcccgaacgcgagaaaguggaugcgaucgacggagaauauagauugaggggcgaggcacggaagacuuucgucgaucugaugcgucgcggugaccucccaguguggcuggccuaccgaguagcugccgaggggauuaacuaugcugauagaaggugguguuuugacggcgugaaaaauaaccaaauccuugaagagaauguugaagucgagauauggacaaaggagggagaacggaagaaacuaaagccucgcuggcuggaugcaagaauuuacagugaccccuuggccuuaaaagaguucaaggaguucgcugccggcaggaaaagccugacccucaaccugaucacagagauggggcggcuuccaacuuuuaugacgcagaaggcaaagaaugcgcuggauaaccucgccguguugcauaccgcugaagccggaggucgagcauauaaucacgcucugucggagcuaccugagacacuggaaacucuccuucuguuaaccuugcuggccacagugaccggcgggauuuuccucuuucugaugucuggaaaaggcaucgguaagaugacucuugggaugugcugcauaaucacggcauccauucugcucugguacgcccagauccagccgcacuggauugcugcgagcaucauauuggaguucuuucugauugucuuacuaauccccgaaccagagaaacaaagaaccccucaggacaaccagcugacauauguugugaucgccauucucacuguaguggcagcuaccauggccaaugaaaugggcuuccuugagaagaccaaaaaggauuuuggacugggcucaaucaccacucagcaacccgagaguaacauauuggacauugaucugcgcccagccucugcauggacacucuacgcugucgccacgaccuucaucacuccuaugcugaggcauuccauugaaaauagcucagugaacguuagucuuacagcgaucgcuaaucaggccaccgugcucauggggcugggaaaggguuggcccuugagcaaaauggacauaggcgucccgcuguuagcaaucggguguuacucccagguaaacccaauuacccuaacagccgcucugcuccuucugguggcacacuaugccaucauuggaccuggcuugcaggcgaaggcuacucgggaggcccaaaaacgugcagccgcugguaucaugaagaaucccacgguugacgggaugaccgugauugaucuggacccaauccccuacgauccuaaauuugaaaagcagcucggccaggucaugcugcuuguguuaugcgucacacaggugcugaugaugagaacuaccugggcccucugugaggcauugacacuggcuaccggaccgauaucuacucuaugggaaggcaaccccgggagguucuggaauacgacaauugccguuagcauggcgaacaucuuucgcggauccuaucuggccggcgcaggucuccuuuucucaaucaugaagaacaccgcuaauacucggcgagggaccggaaacacaggcgagacucugggugagaaauggaagaauagauugaacgcccugggcaaaucugaauuucaaauuuacaagaaaagugggauacaggagguggacaggacccucgcaaaggaaggaaucaaacgcggcgagacagaucaucacgcuguaucgcgggggagcgccaagcugagaugguucguggagcguaauuuagucacgccagaaggaaagguuguggaccuuggcugcgguagagggggaugguccuauuacuguggcggucugaaaaacgucaaggaggugaaaggccucaccaaagggggaccuggccaugaagaacccauuccuaugucuacuuauggguggaaucuaguacggcugcagucaggaguggauguuuucuuuacaccacccgaaaaaugcgacaccuugcugugugauaucggcgagagcuccccuaacccaacuguggaggccggucgcacacuccgaguccuuaaucugguggaaaacugguugaauaacaauacccaauucugcauuaagguccugaaccccuacaugccgagugugaucgagaagauggaagcgcuccagagaaaauacgggggagcuuuaguuaggaauccucugucucggaacagcacgcacgagauguauuggguaucaaacgcauccggcaauauagugaguagcgucaacaugaucucucgcaugcuuauuaauagauuuaccaugaggcacaagaaagccacauacgaaccagacguggaucugggcuccgggacucgaaacaucggaauugagucagagacccccaaucuagacaucauagguaagcggauugagaaaaucaagcaggagcaugaaacaagcuggcacuaugaucaggaccauccuuacaagacuugggcuuaucacggcucguacgagaccaaacaaacagggucugccaguuccaugguuaacggagugguccgucuccugaccaagccaugggacgugauccccaugguaacucagauggcaaugacggauacaaccccguucggccagcagagaguguuuaaagaaaagguugacacucgcacccaagagccuaaagaggguacaaagaaguugaugaaaauuacggccgaauggcuguggaaggagcucgggaaaaagaaaacccccaggauguguacucgggaagaguucacaagaaagguccgcagcaaugcugcgcuuggagccauauuuaccgaugagaacaaauggaagucagcaagggaagcuguggaggacuccggcuucugggaacugguggauaaggagcgaaauuuacaccuggaaggcaaaugcgagacuugugucuauaacaugauggggaagcgggagaaaaaguugggagaauuugguaaagccaagggcucuagagcaaucugguacauguggcucggggccagguuccuggaguuugaagcucuaggauuccuuaaugaggaccauugguuuagccgcgaaaacagucuguccggcguugagggugaggggcuccacaagcugggauacauuuugcgugaugugagcaaaaaggaaggcggcgccauguaugcggacgauacagcagggugggacacccggaucacacuggaggaucucaaaaaugaagagaugguaacuaaccauauggaaggagagcacaagaaacuugccgaggcuauuuucaagcugaccuaccagaauaagguggucagagugcagaggccaacgccucgcgguaccguuauggacaucauaucucgacgggaccagagaggcucagggcaaguggucacauauggauuaaacacuuucaccaacauggaagcccagcugaucaggcagauggagggcgaagguguguuuaaaaguauucaacaguugacaguaaaggaggagaucgcaguuaaaaauuggcucauucgcguggggagagaacggcuguccaggauggcuaucagcggagaugacugcgucgugaagccccuagaugaccguuucgccucugcucuuacugcccugaacgauaugggcaaagugcgaaaggacauucagcagugggagccaucgcgcggcuggaaugauuggacccaaguccccuuuugcucacaucacuuccacgaacucauaaugaaggacgggagaguucuggugguaccuugucggaaccaggaugaguugaucggaagggcacgcauuagccagggugcgggcugguccuuaagagaaacggccugccuggggaaaaguuacgcucagauguggucucucauguauuuucaucggagggaccuucgacuggccgcaaaugcuaucuguagcgccgugccaucccacuggaucccgacaucacguaccacuuggaguauucaugcaacacacgaguggaugaccacugaggauaugcuaaccgucuggaacagaguguggauacaagaaaaucccuggauggaggacaagacaccuguugaaucuugggaggaaaucccauaccugggaaaacgcgaggaucaguggugcggcagccucauugguuugacgucccgggccaccugggcgaagaacauccagacugcuauuaaucaggugaggucacugaucgggaacgaggaauauacagacuacaugcccagcaugaaaagauuccgccgggaggaagaggaagccggaguccuuugguga

SEQ ID NO: 14363 - RNA, 9876 nt, Artificial Sequence
  derived and/or modified CDS sequence (opt3) from DENV-2__KM279596__SS-prME
accgcaggaaucauuauaaugaugauccccacagugauggcuuuccaccugacuacgcgaaacggggagccucauaugauugucagcaggcaggaaaagggaaaaucccuccuuuuuaagaccgagaaugguguuaacaugugcacacugauggcaauggacuugggcgaauuaugugaggauacuaucaccuacaauugcccacuguuacggcaaaacgaaccggaggacauugauuguuggugcaauucuacaucaaccugggugacuuaugggacauguaccgccacgggagagcaccgccgagaaaaacguaguguugcgcucgugccccaugucggcaugggucuggagacuagaaccgaaacauggaugagcuccgagggggcuuggaagcacgcccagaggaucgagacuuggauacuucggcauccuggauucaccaucauggcagccauucuggcuuacacaaucggcaccacguauuuucagcgcguguugauuuucauccuccugacugcaguuacaccaucuauggccaugaggugcauaggcauuucgaacagggacuuuguggaaggggucucaggagguagcuggguggauaucguacuggagcacggcaguuguguuaccacuauggcuaaaaauaagcccacacucgacuucgaauuaauuaagaccgaggccaaacaccuggcgacgcuucggaaguacugcguggaagcaaaauugaccaacacaacuaccgccucccgcuguccuacacagggggagccaucucugaaugaggaacaagauaagcgauuugucugcaaacauagcaugguggacagaggauggggcaacgguugugggcuauucggaaagggcggcaucgugacuugcgcuauguuuaccugcaagaaaaauauggaggggaaggucguucagcccgaaaaccucgaguauacaaucgugauuaccccucacuccggagaagagaaugccguagguaacgauacuggcaaacaugggaaggagauaaaagugacgccacagucaaguaucacagaagcagagcugaccggauacggcacugucaccauggaauguagcccgaggacaggucuugacuucaaugagauggugcuguugcagauggaaaacaaggcuuggcucguucaccggcaaugguuucuggauuuaccccugccuuggcucccaggggccgacacccagggcucuaacuggauucagaaagagacucuugugacauucaagaauccccacgcgaagaaacaggaugucgugguacugggaucccaagagggcgccaugcauacggcauugaccggggcuacugaaauccagaugucaagcggaaaccuacuguuuacaggucaccucaagugccgucugcgcauggacaaacuucagcugaagggcaugaguuauucuauguguaccgggaaauucaagguugugaaggagauagccgaaacacaacauggaacuauugucaucagagugcaguacgagggcgacgguuccccuugcaaaaucccauucgagauuauggauuuggaaaagaggcacguccucgggcggcugaucaccgugaaucccauuguuacggagaaagacagcccggugaacauagaagcugagccucccuuuggcgauucguacaucauuaucggaguagaaccaggccaguuaaagcugucuugguucaaaaagggguccucaaucggacagauguuugagaccacaaugcgaggugccaagcgcauggcaauucuaggcgacacugccugggauuucgggagucucggaggcgucuuuaccagcauagguaaagcucugcaucaaguguucggggcgaucuauggcgcagccuuuuccggaguuucuuggacaaugaagauucuuaucggcguggucauuacuuggaucgggaugaauagcagaucaaccaguuuguccgugagccugguacucgugggaguugucacgcuguaccuuggcgugauggugcaggcugacucugguugugucguuucauggaaaaacaaggagcugaaaugcgggaguggaauauucaucacagauaaugugcacaccuggacugaacaguauaaguuucagccugagagccccuccaaguuggccucugcaauucaaaaagcccacgaagagggcaucugugguauuaggucggugacacggcucgaaaaccugauguggaagcagaucaccccagaguuaaaucauauacugacugagaacgaaguaaaacuaaccauuaugacaggcgacaucaaggggauuaugcaggcuggaaaacgcagccucagaccccagccuacggagcugaaguacuccuggaaagccuggggcaaggcaaagaugcuuucaaccgaauugcacaaucauacuuuccugaucgaugggccagagacagcggaaugcccgaacaccaauagggcuuggaacagucucgaggucgaggacuauggauuuggcguguucacaacuaauauauggcugaaauuaaaggaacgucaagauguauuuugugacucuaaacugaugagcgccgcaaucaaggacaaccgggccgugcacgcugauauggguuacuggauugaguccgcccuuaacgacaccuggaaaaucgaaaaggcaucauucauugaggucaagagcugccacuggcccaaaucucauacguugugguccaauggggugcucgagagugaaaugaucauaccuaagaacuucgcuggaccaguuagccagcacaauuaucgacccggcuaccauacacagaccgccgguccuuggcaccugggcagacuagagauggauuuugacuucugugaagggacuaccguggcgguaacagaggauugcggaaacaggggcccaucucugcgcacuaccacagccuccgggaaacucauuacggaauggugcugucggucaugcacccugcccccgcuuagauacaggggagaggacggcuguugguaugguauggagauccgcccuuugaaggaaaaagaggaaaaucuggucaacaguuuagugacugcugggcauggacagaucgauaauuuuagccucggcgugcuggguauggcacuuuuccuggaggaaauguugcgaacacgggucggcaccaagcacgccauucuccugguugcugugucguuuguaacucuaaucacagggaacauguccuuccgugaccugggaagagugauggucauggugggcgccaccaugacggaugacauugggaugggaguuacuuaccucgcacugcuugcggccuuuaaggugaggccaaccuucgcugccggcuugcuguuacgcaaacucacaucuaaggagcugaugaugaccacuauagguaucguccuucugagccaaucaacaauucccgagaguauccuagaacucaccgaugcacuggcuuuggggaugauggugcugaaaauuguucggaauauggagaaguaucaguuagccgugacaaucauggcaauacucugcgucccuaacgccguaauccugcagaaugcuuggaaaguguccuguacuacccuugcgguugugucugucagcccccuguugcucacguccucacaacagaaggccgacuggauuccacuggcacuaacaaucaagggacugaacccuaccgcuauuuuucuuacuacccucagcagaacaaguaaaaagaggucuuggccccugaaugaagccaucauggccgugggcaugguauccauauuggcuagcucgcugcuaaagaacgauauuccaaugacuggcccgcucguggcagggggacugcuuaccgucugcuacguucugacgggucgaucagccgacuuggagcucgaacgcgcggcugacgugcggugggaggagcaggccgaaaucucuggcaguuccccuauccugagcauuacaauaucugaggaugggagcauguccaucaagaaugaagaggaggaacagacccuaacuauucugaucagaacaggacuucucgugauuucaggccuguuccccgucaguaucccaauaaccgcagccgcuugguauuugugggaggugaaaaagcaaagggccgguguuuuaugggacguacccagcccuccacccguggggaaagccgaacuggaggauggagcguaccguaucaagcagaagggcauucucggcuauucucagaucggggcuggagucuacaaagaagguacuuuucacacaauguggcaugugacccgcggcgccguucugaugcacaaggggaaacggauugagccuuccugggcagacgugaagaaagaucuuaucucauacggaggcgguuggaagcuggagggggaauggaaggagggagaagagguccagguguuggcccuagaaccgggcaaaaacccaagagcuguacaaacgaagcccggccuguucaaaacuaacaccgggacaauaggagccgucagucucgacuuuagcccugguaccuccggcucuccaauuguggauaagaaagggaagguugugggacuguauggcaauggugucgugacaaggucggggacuuacguuagcgcaaucgcucagaccgagaagucaaucgaggacaaccccgaaauugaggaugacaucuuccggaaaaagagacuuacgauaauggauuuacauccuggagccggcaaaacaaagcgcuaucugccggcgauugugagagaagccaucaaaaggggccuccggacuuugauucuggcacccacccgagucguggcugccgagauggaagaggcucucagagggcugccaauccgcuaccagaccccugcaauaagggccgagcacaccggacgugaaauuguagaccuuaugugucaugccacuuucaccaugcggcuguugucccccaucagagugccaaauuauaaccuaaucauuauggaugaggcucacuuuacagacccugcgaguaucgcagccagggguuacauuucuacgcgcguugaaaugggcgaggcugccgggauauucaugacugcaacacccccaggaagccgagacccguuuccucaguccaaugcccccaucauggaugaggaaagagagauuccagaacggucauggaacucuggccacgagugggucacagacuucaaggguaagaccgugugguuugugcccagcaucaaagcugggaaugauaucgcggccugccugaggaagaacggcaaaaaggucauucaacucagucgcaaaacuuucgacuccgaauauauaaagacacguaccaaugauugggacuuuguagugacgacugauaucagcgagaugggcgcaaacuucaaggcugagagaguuauugacccucggagguguaugaaaccagugaucuuaacagauggcgaagaacgcgucauucuggccgggcccaugccugugacccauucuucagcagcccagcgaagaggacggguugguaggaauccgaagaacgaaaaugaccaguacaucuacaugggcgagccacuugaaaacgaugaggacugcgcucacuggaaagaggccaagaugcugcucgacaauauaaacacccccgaagggaucauuccuuccauguuugagcccgaacgcgagaaaguggaugcgaucgacggagaauauagauugaggggcgaggcacggaagacuuucgucgaucugaugcgucgcggugaccucccaguguggcuggccuaccgaguagcugccgaggggauuaacuaugcugauagaaggugguguuuugacggcgugaaaaauaaccaaauccuugaagagaauguugaagucgagauauggacaaaggagggagaacggaagaaacuaaagccucgcuggcuggaugcaagaauuuacagugaccccuuggccuuaaaagaguucaaggaguucgcugccggcaggaaaagccugacccucaaccugaucacagagauggggcggcuuccaacuuuuaugacgcagaaggcaaagaaugcgcuggauaaccucgccguguugcauaccgcugaagccggaggucgagcauauaaucacgcucugucggagcuaccugagacacuggaaacucuccuucuguuaaccuugcuggccacagugaccggcgggauuuuccucuuucugaugucuggaaaaggcaucgguaagaugacucuugggaugugcugcauaaucacggcauccauucugcucugguacgcccagauccagccgcacuggauugcugcgagcaucauauuggaguucuuucugauugucuuacuaauccccgaaccagagaaacaaagaaccccucaggacaaccagcugacauauguugugaucgccauucucacuguaguggcagcuaccauggccaaugaaaugggcuuccuugagaagaccaaaaaggauuuuggacugggcucaaucgccacccagcaacccgagaguaacauauuggacauugaucugcgcccagcaucugcuuggacucucuacgccgucgcgacaacguucaucaccccuaugcugaggcauuccauugaaaauagcucagugaacguuagucuuacugcuaucgccaaucaggcaacagugcucauggggcugggaaaggguuggcccuugagcaaaauggacauaggcgucccgcuguuagccaucggguguuacucccagguaaacccaauuacccuaaccgcugcacugcuccuucugguggcccacuaugcgaucauuggaccuggcuugcaggcuaaggccacacgggaggcacaaaaacgugccgcugccgguaucaugaagaaucccacuguugacgggaugacggugauugaucuggacccaauccccuacgauccuaaauuugaaaagcagcucggccaggucaugcugcuuguguuaugcgucacccaggugcugaugaugagaacaacuugggcacucugugaggcuuugacccuggccacaggaccgauaucuacccuaugggaaggcaaccccgggagguucuggaauacuacgauugcgguuagcauggccaacaucuuucgcggauccuaucuggcaggcgcuggucuccuuuucucaaucaugaagaacacagccaauacccggcgagggacuggaaacaccggcgagacacugggugagaaauggaagaauagauugaacgcacugggcaaaucugaauuucaaauuuacaagaaaagugggauacaggagguggacaggacucucgcuaaggaaggaaucaaacgcggcgagaccgaucaucacgccguaucgcgggggagcgccaagcugagaugguucguggagcguaauuuagucacaccagaaggaaagguuguggaccuuggcugcgguagagggggaugguccuauuacuguggcggucugaaaaacgucaaggaggugaaaggccucacgaaagggggaccuggccaugaagaacccauuccuaugucuaccuauggguggaaucuaguacggcugcagucaggaguggauguuuucuuuacuccacccgaaaaaugcgacacauugcugugugauaucggcgagagcuccccuaacccaaccguggaggcgggucgcacucuccgaguccuuaaucugguggaaaacugguugaauaacaauacacaauucugcauuaagguccugaaccccuacaugccgagugugaucgagaagauggaagcucuccagagaaaauacgggggagcauuaguuaggaauccucugucucggaacagcacccacgagauguauuggguaucaaacgccuccggcaauauagugaguagcgucaacaugaucucucgcaugcuuauuaauagauuuacgaugaggcacaagaaagcuaccuacgaaccagacguggaucugggcuccgggacacgaaacaucggaauugagucagagacucccaaucuagacaucauagguaagcggauugagaaaaucaagcaggagcaugaaaccagcuggcacuaugaucaggaccauccuuacaagacaugggccuaucacggcucguacgagacuaaacaaaccgggucugcaaguuccaugguuaacggagugguccgucuccugacaaagccaugggacgugauccccaugguaacccagauggccaugacugauacgacaccguucggccagcagagaguguuuaaagaaaagguugacacccgcacucaagagccuaaagaggguaccaagaaguugaugaaaauuacagcugaauggcuguggaaggagcucgggaaaaagaaaacgcccaggauguguacccgggaagaguucacuagaaagguccgcagcaaugcggcccuuggagcaauauuuacagaugagaacaaauggaagucagcuagggaagccguggaggacuccggcuucugggaacugguggauaaggagcgaaauuuacaccuggaaggcaaaugcgagaccugugucuauaacaugauggggaagcgggagaaaaaguugggagaauuugguaaagcaaagggcucuagagccaucugguacauguggcucggggcuagguuccuggaguuugaagcccuaggauuccuuaaugaggaccauugguuuagccgcgaaaacagucuguccggcguugagggugaggggcuccacaagcugggauacauuuugcgugaugugagcaaaaaggaaggcggcgcgauguaugcagacgauacugccgggugggacacacggaucacccuggaggaucucaaaaaugaagagaugguaacaaaccauauggaaggagagcacaagaaacuugcugaggccauuuucaagcugacuuaccagaauaagguggucagagugcagaggccaaccccucgcgguacgguuauggacaucauaucucgacgggaccagagaggcucagggcaaguggucaccuauggauuaaacacauucacuaacauggaagcacagcugaucaggcagauggagggcgaagguguguuuaaaaguauucaacaguugaccguaaaggaggagaucgcuguuaaaaauuggcucauucgcguggggagagaacggcuguccaggauggccaucagcggagaugacugcgucgugaagccccuagaugaccguuucgcuucugcccuuacagcacugaacgauaugggcaaagugcgaaaggacauucagcagugggagccaucgcgcggcuggaaugauuggacucaaguccccuuuugcucacaucacuuccacgaacucauaaugaaggacgggagaguucuggugguaccuugucggaaccaggaugaguugaucggaagggcgcgcauuagccagggugccggcugguccuuaagagaaaccgcuugccuggggaaaaguuacgcccagauguggucucucauguauuuucaucggagggaccuucgacuggcagcuaaugccaucuguagcgcagugccaucccacuggaucccgacgucacguacaaccuggaguauucaugccacucacgaguggaugacaaccgaggauaugcuaacugucuggaacagaguguggauacaagaaaaucccuggauggaggacaagaccccuguugaaucuugggaggaaaucccauaccugggaaaacgcgaggaucaguggugcggcagccucauugguuugacaucccgggcgacgugggcuaagaacauccagaccgccauuaaucaggugaggucacugaucgggaacgaggaauauacugacuacaugcccagcaugaaaagauuccgccgggaggaagaggaagcaggaguccuuugguga

SEQ ID NO: 14364 - RNA, 9876 nt, Artificial Sequence
  derived and/or modified CDS sequence (opt3) from DENV-2__FJ850072__SS-prME
accgccggcgugauaauuaugcugauacccacugcuauggcauuccaccucacuacgagaaauggggagccucauaugaucgucggaagacaggaaaaggguaaaagccuucuguuuaagaccgaggacggcguuaauaugugcaccuugauggccauggauuuaggggaacugugugaggacacuauuaccuacaaaugcccacuacuccggcaaaacgaaccggaggauaucgacuguuggugcaauuccacaucuaccugggugacuuauggaacauguaccacgacuggcgagcaccgccgagaaaagcguucaguagcgcuggugccccaugucgguauggggcuugagaccagaacagaaacuuggaugaguagcgagggagcuuggaaacacgugcagaggauugagaccuggauccugcggcauccuggcuucgccauaauggcagccaucuuggcuuacacaauuggcaccacgcacuuucagcgcgcacucaucuucauucugcugacugccguugcuccauccaugacaaugagaugcaucgggauaucuaacagggauuuuguggaaggagucucggguggcucauggguggacauuguacucgagcacgggagcuguguuaccacuauggccaagaauaagcccacauuagauuucgaacugaucaaaaccgaggcgaagcagccugcaacgcuucggaaauauugcauugaagccaaguugaccaacacaacuaccgagagucgcuguccaacacaaggagagcccucccugaaugaagaacaggacaaacgauuuaucugcaagcauucuaugguggauagaggcugggguaacggguguggacuauucggcaagggcgggaucgucacuugcgcuauguuuaccugcaaaaagaauauggaaggaaaaguggugcucccugagaaccuggaauacacaauugucauaaccccacacagcggugaggagcaugccguuggcaaugacacugggaagcacggagaagagaucaaaauuacgccgcaguccucaaucacagaagcagagcuuaccggcuaugguacugugaccauggaauguagucccaggacagggcuggauuucaacgagaugguauugcuccagauggaggaaaaggcuuggcuggugcaccggcaaugguuuuuagaccugccucucccauggcuucccggcgccgauacccagggaagcaauuggauacagaaagagacucuggucacauucaagaacccucaugcgaagaaacaggacgugguuguguugggcucucaagaaggggccaugcacacggcacuaaccggagcuacugagauucagauguccucagguaaucugcucuuuacaggccaucugaagugccgucuucgcauggacaaacugcaguugaaggggaugagcuacaguauguguaccggaaaauucaagaucgucaaggagaucgccgaaacacaacacggcacuauugugaucagaguacaguaugagggugaugggucuccaugcaaaauucccuucgaaauaauggaccucgagaagaggcaugcucugggccgguuaaucaccguuaacccgauugugacggaaaaagauuccccugucaacaucgaggccgagcccccauuuggagacagcuacaucauuauaggcguggaaccugggcagcugaagcuaaauugguucaaaaagggaucgucuaucggucagauguuugagaccacaaugcgaggcgcaaagcgcauggccauucucggggauacugcuugggacuucggaucccugggcggugucuuuaccucaaucgggaaagcgcuucaccaaguguucggcgcaauuuacggagccgcuuuuaguggcguuagcuggacaaugaagaucuugauaggggugaucauuacuuggaucggaaugaacuccagaucuaccagccugucaguaagucucguccuggugggcguugugacgcuuuaucugggugccaugguccaggcagauuccgggugugugguaagcuggaaaaauaaggaauugaaaugcggaucuggcauuuucaucacagacaacgugcacaccuggacugagcaguacaaguuucagcccgaaucaccaaguaagcucgccagcgcuauacaaaaagcccaugaggaggguauuuguggcaucagguccguuacacggcuggaaaauuuaauguggaagcagauuacccccgagcugaaccacauccuaucugaaaaugaggucaaacucacuauaaugaccggggauaucaagggaauuaugcaggcaggcaaacgcucgcugagaccucagccaacagaacuuaaguauagcuggaaaacgugggggaaggcgaagauguuguccaccgagucacauaaccaaacuuuccugaucgacggaccggagacagcugaaugccccaauaccaacagggccuggaauagucucgagguggaagauuacggcuuugguguguucacaacuaacauuuggcugaaauuacgugagaagcaggacgucuuuugugacucuaaacugaugagcgcagccaucaaggauaaucgggcuguucacgccgacaugggguauuggauagaguccgcacuuaacgauaccuggaaaauggaaaaggcuucauucauugaggugaagucaugccacuggccuaaaucucauacguugugguccaauggagugcucgaaagugagaugaucaucccaaagaacuucgccggccccguaagccagcacaacuaccgaccugguuaucauacacagaccgcgggcccauggcaccuggggaaacuagaaauggacuuugauuucugugagggaacuaccgucgugguuacagaggacugcggcaauagagggcccucucugaggacuaccacagccuccggaaagcucauuacggaauggugcugucgcucaugcacccugccgccucuucgguacagaggcgaggaugguuguugguacgggauggaaaucaggccauugaaagagaaggaagagaaccuggugaauaguuuagucacugcuggacauggccaaauugacaacuuuagccucggugugcugggcauggcacuuuuccuggaggaaauguugcgcacacgaguugggaccaagcacgccauacuccugguggcuguaucguuugucacucuaaucacaggaaauauguccuuccgggaucugggccgugugauggugauggucgggguugccaugaccgacgauauuggaaugggcgugacguaucucgcacugcuugcggccuuuaaaguaagacccacuuucgcugccgguuugcuguuaaggaagcucaccucuaaagagcugaugauggcaacaaucgggauuacccuucugagccagucaacuaucccugaaacaauacuagagcucaccgacgcucuggccuugggaaugauggugcugaagaucguccgcaacauggaaaaauaccaguuagcagugacaauuaugacuaucaguugcguucccaaugccaugauucuccugaacgcuuggaagguguccuguaccauccuugcggucgugucuguuagcccacuguugcucacguccucacaacagaagacagauuggauaccucuggcccuaaccauuaaaggccugaaucccacugcaaucuuucuuaccacacucagccggacaaguaagaaaagaucuuggccacugaacgaggcugugauggccgucggcaugguauccaucuuggccagcucgcuguuaaagaaugacauuccgaugaccgggccucucguggcuggaggucugcuuacgguuugcuaugugcugacaggcaggucagcagacuuggagcucgaacgagccaccgaugucaaaugggaggaccaggcggaaauaucugggaguucccccauccugagcauuacuaucucugaggauggaagcauguccauuaagaacgaggaagaggaacagacacuaaccauccugauacgcacuggccuucucgugaucucagguguauucccagugaguauucccaucacagcugccgcaugguaccugugggaggucaaaaagcaacgggccgggguuuugugggacgugccuagcccacccccuguggaaaaggcugaguuagaggauggagcauauagaauuaaacagaggggcauccugggcuacucucagauaggggccggagucuauaaggaagguaccuuucacacgauguggcaugugacucguggcgcgguucucaugcaccgcgggaaacggauugagccguccugggcugacguaaagaaagaucugaucucauacggaggcgguuggaaacuugaaggggaguggaaggaaggagaggaggugcagguccuggccuuggaaccaggcaaaaaucccagagcagugcaaaccaagccuggccuauucaaaacaaacaccgggacaaucggagccguuagucuggacuuuagcccagguacuuccggcucucccauuguggauaggaaggggaaagucgugggacucuacggcaaugguguagucacccgaucgggggcuuaugugagcgccaucgcacagacggagaagucaauagaagacaacccugagauugaagaugacaucuuccggaagaaacgccugacaauuauggaucuucauccgggagcuggcaagacuaaaagauacuuacccgccaucguuagggaggcgauaaagcggggccugcgaacccucauuuuggccccaacaagaguggucgcagcugagauggaagaggcccugcgcgggcucccuaucagguaucagacccccgcuauccgugcagaacacacuggacgggagauuguggaccugaugugucaugccaccuucacaaugagacuucuguccccaguuagggugccuaacuacaauuugaucauuauggacgaggcccacuuuacggaucccgcuaguauagcggcacgcgguuauaucucuacucgagucgaaaugggcgaggccgcugggauuuucaugaccgccacaccaccgggaagcagagacccuuuuccccaguccaacgcaccaaucauggaugaagaacgggaaauccccgagaggucauggaacucuggccacgagugggugaccgacuucaaagguaagacuguaugguuugugccuagcauuaaggccgggaacgauauagcugcgugccuacgcaaaaauggaaagaaaguuauccaacugagucguaagacauucgacuccgaauacgucaaaaccagagccaacgauugggacuuuguggugacgacugauauuagcgagaugggcgcaaauuuccgggcugaaagggucaucgacccacgccgauguaugaagcccguaauucucacagauggcgaggaaagagugaucuuagccgggccuaugccgguuacccauucuucagcagcccagcggaggggacgcguggguagaaacccaaagaaugagaacgaccaguauauauacaugggcgagccccuggaaaaugacgaggauugcgcucacuggaaagaagccaagaugcuucuggacaacaucaauaccccugaggggauuauccccuccauguuugaaccagagagggagaaagucgaugcgauugacggagaauaccggcuccguggcgaggcacgcaagacuuucguggauuugaugcgaagaggugaccugccuguuuggcucgccuauaggguggcugccgaagggaucaacuacgcugaucggcgcugguguuuugacggcaucaagaauaaccaaauucuggaggagaacgucgaaguggagaucuggacaaaggaaggagagaggaagaaacuuaagcccagguggcuagaugcacggauuuauagugacccacuggccuugaaagaguucaaggaguucgcugccggccgaaagagcuuaacccugaaucucaucacagagauggggagacugccuacuuuuaugacgcagaaggcacgcaacgcgcuugauaaucuggccguacuccauaccgcugaagccggagguagggcauacaaccacgcuuugucggagcugccggaaacacuagagacucugcuccuucugaccuuauuggccacagugaccggcgggauauuccuguuucucaugucuggaaaaggcaucgguaagaugacucuggggaugugcugcauuaucacggcauccauucuucugugguaugcccagauccagccccacuggauagcugcgagcauuauccucgaguucuuuuugaucguucuguuaauuccagagccugagaagcaacggacaccccaggacaaucagcuaacauacgucgugaucgccauacugacuguggucgcagcuaccauggccaacgaaaugggcuuccucgagaaaacaaagaaagaucuuggacugggcucaauuaccacucaggaaagugagucuaauaucuuggacauugaccugcguccagccuccgcauggacacucuaugcuguugccacgaccuuuaucacuccuaugcugagacauagcauagaaaacucaagugugaauguaagccuuacagcgaucgcuaaccaagccaccgugcucauggggcugggaaaggguuggcccuuguccaaaauggauauuggcgucccgcuguuagcaaucggguguuacucucaggugaauccaauuacccuaacagccgcucugcucagccuuguugcacacuacgccaucauuggaccuggccugcaggcgaaggcuacuagggaggcccagaagcgcgcagccgcugguaucaugaaaaaccccacgguggacgggauaaccgucauugauuuggagccaauccccuaugacccuaaguucgaaaaacaacugggccagguaaugcuccugauccuuugcgugacacagguuuuaaugaugcggacuaccugggcccugugugaggcacucacauuggcuaccggaccgauuuccacucugugggaaggcaaucccgggcgauuuuggaacacgacaauagccgugucaauggcgaauaucuucagaggaucuuaccuagccggcgcaggucugcucuuuaguauuaugaagaacaccacuaauaccaggcgcgggacaggaaacaucggcgagacucuuggugagaaauggaagucgcggcugaacgcuuugggcaagagcgaguuccagauuuauaaaagauccgggauccaagaggucgaucguacccuggccaaggaaggaauaaaaaggggcgagacagaccaucacgcagugucucgggggucagcuaagcuccgcugguuugucgaacgaaauauggugacgccagagggaaaaguuguggaucugggcugcgguagagggggauggagcuacuauuguggcgguuuaaagaacguaagggaggugaaaggccuuaccaaaggcgggccugggcaugaagaacccaucccuauguccacuuacggguggaaucugguccggcuccagaguggaguugacguguucuucacaccacccgaaaagugcgauacccuacugugugacauuggcgagucuagcccuaacccaacuaucgaagccggucgcacauugagaguccugaaucucguggagaacuggcuuaauaacaauacccaguuuugcauuaaaguacugaaccccuauaugccgucagugaucgagaagauggaaacguugcaaaggaaauacgggggagcccugguucgaaauccucucucccggaacaguacccacgagauguacugggugagcaaugcgacaggcaacauagucucuuccgugaauaugauuucacguauguuaaucaacagauucacuaugaagcacaaaaaggcuaccuaugaaccagaugucgaccugggcagcgggacacgcaacaucggaauugagucggaaauacccaaucuugauaucauugguaagaggaucgagaaaauuaagcaggagcaugaaacuucuuggcacuacgaccaggaccauccuuauaaaaccugggcauaccacggcaguuaugagacaaagcagaccggguccgccagcucaauggugaacggaguuguacggcugcuaacuaaaccaugggaugugguccccauggugacgcaaauggcuaugacagacaccacuccguuuggccagcagagaguuuucaaggaaaagguggauacccgcacacaggagccuaaagaggguacgaagaaacucaugaggaucaccgccgaauggcuguggaaggaguuggggaaaaagaagacuccccgaauguguacacgggaagaguuuaccagaaaagucagguccaaugcagcccugggagcuauauucacugacgaaaacaaguggaaaucugcgcgcgaggccguggaggauagccguuuuugggaacucguagaccgggagagaaaucuucaccuggaaggcaagugcgagacauguguguacaacaugaugggcaaaagggaaaagaaauuaggggaguucggaaaggcaaaggguagucgcgcuaucugguauauguggcugggcgcccgauuuuuggaguucgaagcacucggguuucugaaugaggaucauugguucucccggggaaacagccuaucuggcguugaaggugaggggcuucacagacugggauacauucucagggacgucagcaaaaaggaaggcggcgccauguacgcugaugacaccgccgggugggauacacgcaucacucuggaggacuugaaaaaugaggaaauggugaccaaccauaugaagggagagcacaaaaagcuggcggaagcaguguuuaagcucacguaucaaaauaaagucguuagagugcagcggccaaccccuagggguacaguaauggacauuaucagucgucgagaucagcgcggcuccggacaggugggaacuuacggccuuaacaccuucacaaauauggaggcccaacugauuagacagauggagggugaagggauauucaagagcauccagcauuuaacugucaccgaggaaauugcugugcaaaacuggcuggcccggguuggaagggagcgcuugucuagaauggcaaucucgggcgacgauugcguggucaaaccccucgacgaucgguuugcuucagcccugacggcucuaaaugacaugggcaaggugaggaaagauauccagcagugggaaccaagccgaggguggaacgacuggacacagguacccuucugcucccaccacuuucaugagcuuguuaugaaggauggacguaugcugguggucccuuguagaaaccaagacgagcucauuggucgcgcccggauaagucagggcgcaggguggucucugaaggaaaccgcgugcuugggaaaaagcuaugcccagauguggacuuuaauguacuuccacaggagagaucugcgccucgcugccaaugcaaucuguuccgcugugccaucacauugggugccgacaagucggaccacuuggucuauucacgccaagcacgaguggaugaccacagaagacaugcuugcagucuggaacaggguuuggauccaggagaaucccuggauggaagauaaaacgccuguggagagcugggaggaaguaccauaucugggcaagcgagaggaccaauggugcgguucccuaauugggcugaccucaagagccacuugggcgaaaaacauccagacagcuauaaaucaggugcggagccucaucggaaacgaagaguacaccgacuauaugcccucuaugaagagguuucgccgugaagaggaggaagccggcgucuugugguga

SEQ ID NO: 14365 - RNA, 9876 nt, Artificial Sequence
  derived and/or modified CDS sequence (opt3) from DENV-2__JN819419__SS-prME
accgccggagugaucgucaugcugauucccacagcuauggcauuccaccucacuacgaggaacggggagccucauaugauaguuggaaggcaggaaaaggguaaaagccuucuguuuaagaccgaggacggcgugaauaugugcacauugauggccaucgauuuaggggaacugugugaggacacuauuaccuacaaaugcccacuacuccggcaaaacgaaccggaggauaucgacuguuggugcaauuccacaucuaccuggguaacuuauggaacauguaccacgacuggcgagcaccgccgagaaaagcguucaguggcgcuggucccccauguggguauggggcuugagaccaggacagaaacuuggaugaguagcgagggagcuuggaaacacguucagaggauugagaccuggauccugcggcauccuggcuucacaauaauggccgcaaucuuggccuacaccauuggcacgacucacuuucagcgcgcucucaucuucauucugcugacagcaguggccccauccaugaccaugcggugcaucgggauaucuaacagggauuuugucgaaggagugucggguggcucauggguagacauuguucucgagcacgggagcugugugacuacaauggcuaagaauaagcccaccuuagauuucgaacugaucaaaacggaggccaagcagccugcgacccuucggaaauauugcgucgaagcaaaguugacaaacacuaccacagagagucgcuguccaacucaaggagagcccucccugaaugaggaacaggacaaacgauuuauuugcaagcauucuaugguggauagaggcugggguaacggguguggacuauucggcaagggcgggaucgugaccugcgccauguuuacaugcaaaaagaauauggaaggaaaagucguucagccugagaaccucgaauacaccaucgugauuacuccacacagcggugaggagcaugcuguaggcaaugacacggggaagcacggaaaagaaauaaagaucacaccgcaguccucaauuaccgaggccgaacugacuggcuaugguaccgugacaauggaguguagucccaggaccgggcuugauuucaacgaaaugguccuguugcaaauggaggacaaagcauggcucgugcaccggcagugguuucuggauuuaccucugccauggcuccccggcgcugacacucagggaagcaauuggauccagaaggagacacuuguuacguucaagaacccucaugccaaaaagcaagacguggucgugcugggcucucaggaaggggcgaugcacaccgccuugacuggagcaacagagauacagauguccucagguaaucuacuguuuaccggccaucucaaaugccgucugcgcauggauaaacuucaacugaaagggaugagcuacaguauguguacaggaaaguucaagauuguaaaagaaaucgcugagacucagcacggcaccaucguuauuagagugcaguaugagggugacgggucuccaugcaagauccccuucgaaauuauggauuuggagaaaaggcauguccucggccggcugauaacggugaacccgaucgucaccgaaaaggacuccccugugaacauugaggccgaacccccauuuggagauagcuacaucaucauuggcguugagccugggcaguuaaaacugaauugguucaagaagggaucgucuauaggucaaauguuugagacaacuaugcgaggcgcuaaacgcauggccauccuaggggacaccgcaugggauuucggaucccucggcgguguguuuacaucaauugggaaggcccugcaccagguauucggcgcuaucuacggagcggcauuuaguggcgucagcuggacuaugaaaauucuuaucggggugauaaucaccuggauuggaaugaacuccagaucuacgagcuugucaguuagucuggugcucgucggcgugguaacacuguaucuuggugccauggugcaggcugacuccggguguguugucagcuggaagaauaaagaacugaagugcggaucuggcaucuucauuaccgauaacgugcacacuuggacagagcaguacaaguuucaacccgaaucaccaaguaaauuggccagcgcaauccagaaggcccaugaggaagguauauguggcauuagguccgugacccggcucgagaaucugauguggaaacagaucacucccgaguuaaaccacauucugucugaaaaugaggucaagcuaaccaucaugacaggggacauaaaaggaaucaugcaggcuggcaagcgcucgcucagaccucaaccaacggaacugaaauauagcuggaagaccugggggaaggccaaaaugcuuuccacugagucacauaaccagacauucuugauugauggaccggaaaccgcagagugccccaauacaaacagggcguggaauagucuggagguugaagacuacggcuuugguguguucacuaccaacaucuggcucaagcugcgugagaaacaggacguguuuugugauucuaaguuaaugagcgcugccauuaaagacaaucgggcaguacacgccgauaugggguauuggaucgaauccgcucugaacgacacguggaagauggagaaggccucauucauagaggucaaaagcugccacuggccuaagucucauacacuuugguccaauggaguguuggaaagugagaugauuauccccaagaacuucgcaggccccguuagccagcacaacuaccgaccugguuaucauacccaaacugcuggcccauggcaccucgggaagcuggaaauggauuuugacuucugugagggaaccacaguggucgugacugaagauugcggcaauagagggcccucucuaaggaccacaacggccuccggaaaacugaucaccgaguggugcugucgcucaugcacucucccgccucugcgguacagaggcgaggacgguuguugguacgggauggaaauuaggccacuuaaggagaaggaagagaacuugguuaauagucuggugacagcgggacauggccagaucgauaacuuuagcuuagguguacucggcauggcccuguuccuugaagagaugcugcgcacccgagucgggacuaaacacgcuauuuugcucguggcagugucguuugucacacugauaaccggaaauauguccuuccgggaccuaggccguguuauggugaugguaggggccacgaugacugaugacaucggaaugggcgugaccuaucuggcucuccuggccgcauuuaaggucagacccacauucgcggccggucuuuugcugaggaaauuaaccucuaaggagcucaugauggcuacuauugggguggcccugcuuagccagucaacaaucccugaaaccauucuggagcuaacagaugcacucgcucugggaaugauggccuugaaaaucguuaagaacauggaaaaguaccaacuggcagugacuauaauggccaucaguugcguccccaaugcugugauuuuacagaacgcguggaaaguuuccuguaccauccucgccgcagugucugucagcccacugcuucugacguccucacagcagaaggcugacuggauuccuuuggcccucacaaucaaaggccugaaucccaccgccauauuucuaacuacccugagccgcacaaguaagaaacggucuuggccacuuaacgaggcuauuauggcaguaggcaugguguccauccucgccagcucgcuguugaagaaugacaucccgaugacugggccucugguugcgggagguuuacucaccgugugcuauguccugacgggcagaucagcugaucuugaacuggagagggccgcagacgugaaaugggaggaucaagccgaaauuucugggaguucccccauauugagcaucacaauuucugaggacggaagcauguccaucaagaacgaagaggaggaacagacccucacuauucugauccgaacaggccuacugguaauaucagguguguucccagucaguauccccauuaccgcugcagccugguaccuuugggagguuaagaaacagcgcgcgggggugcucugggaugugccuagcccacccccugucggaaaggcugaacuggaggacggcgccuaucggaucaaacagagaggcauuuugggguacucucaaaucggagccgguguguauaaggaaggcacuuuucacacaauguggcauguuaccagaggggcaguauuaaugcaccguggaaaacgcauagagccguccugggcugaugugaagaaggaccuggucucauacggcgguggguggaaacucgagggagaauggaaggagggcgaagaggugcagguucuggcccuugaaccaggcaaaaauccccgggcagugcagacgaagccugggauuuucaaaacuaacaccggaaauaucggugcugucagucuggauuuuagcccaggcacauccgggucucccaucguggacagaaagggaaagguagucggcuuguacgguaacggggugguuaccaggucgggagccuaugugagcgcgauugcccagacagagaaaucaaucgaggauaacccugaaauagaggacgauauuuuccgaaagaaacggcuaacuaucauggaccugcauccgggcgcaggcaagaccaaacgcuaccuccccgcuauugucagagaagccaucaagagggggcugcggacgcuuauauuagcuccaacacgagugguugcagccgagauggaagaggcccugagaggacucccuauucgcuaucaaacucccgcuaucagggcggagcacaccggucgugaaaucguggacuugaugugucaugcaacauucaccaugcggcugcucuccccagucagagugccuaauuacaaccugauuaucauggaugaggcccacuuuacugaccccgcuaguauugccgcaaggggcuauauaucuacccgcguagaaaugggggaggccgcuggaaucuucaugacagcgacgccaccgggcagccgagauccuuuuccccaguccaaugccccaauuauggacgaggaaagagagauccccgaacggucauggaacucuggucacgagugggugacugauuucaaggggaaaaccguuugguuugucccuagcaucaaggcaggaaaugacauugcugccugccuuaggaaaaacggcaagaaagugauacagcugagucgcaagacauucgauuccgaauacgugaagacccgugcaaaugacugggauuuugucguaacuacagacaucagcgagaugggcgccaacuucaaagcugagagagugauugauccacggagguguaugaagcccguuaucuugaccgacggggaggaacgcgugauucuagccggaccuaugccggucacgcauucuucagcggcacaacgaagaggucggaucggcaggaaucccaaaaacgaaaaugaccaguauauauacaugggggagccccuggaaaacgaugaggacugcgcccacuggaaggaggcuaaaaugcucuuagauaauaucaacacuccugaaggaauuauccccuccauguuugagccagaacgcgagaagguggacgccauugauggcgaauacagacugaggggugaggcucggaaaacauucguugaccuuaugcgucgcggggaucugccuguguggcucgcauauaaggucgccgcugagggcaucaauuacgccgaccgaagaugguguuuugauggaauaaagaacaaccagauuuuggaagagaauguggaaguagagaucuggaccaaagagggcgaaaggaagaaacugaagccccgguggcucgacgcacgcauuuauagugauccacuggcgcuuaaagaguucaaggaguucgccgcugggagaaagagccuaacccugaacuugaucacugagaugggaagguuaccuacauuuaugacccagaaagcccggaaugcacuggacaaccucgcugugcugcauacagccgaagccgguggaaaggcauacaaucacgcucuuucggagcugccggagacucucgaaacguugcugcuacugacccuccuugcgacaguuacugggggaauauuccuguuuuuaaugucuggcaaagguaucgggaagaugaccuugggcaugugcugcauuaucacagccuccauucugcucugguaugcacaaauccagccccacuggauagcugccagcauuauccuggaguucuuucuuaucguccugcucauuccagaaccugagaaacagcgaaccccacaggauaaccaauugacuuacguggugaucgccauacugacggucguugcagcuaccauggccaaugaaaugggauucuuagagaagacaaagaaagaccuaggccuggggucaauuacuacccaggagagugaaucuaacauccucgacauugaucuuagaccagcguccgcuuggacacuguaugccguggcaaccacuuuuguaacaccuauguugcgccauagcaucgaaaauucaagugugaacgucagccugacggccauagcuaaucaggcaaccgugcucaugggacuggguaagggcuggccccuuuccaaaauggacaucggggccccgcuccuggcgauuggauguuacucucagguuaacccaaucacuuugacagcugcccuguuacuacugguggcacacuacgccauuaucggcccuggucuccaagcuaaggccaccagggaagcacagaaacgggcugccgcggggauuaugaagaaucccaccgucgauggcaucacaguaauagaccuugagccaauucccuaugauccuaaguucgaaaaacagcugggacaggugauguugcugauccucugcguuacucaagugcugaugaugcguacgaccugggcccuuugugaggcauuaacacuggcuacuggcccgaucagcacccucugggaggggaaccccggaagauuuuggaauacaaccauugccgucuccauggcaaacauauucaggggcucauacuuggcuggugccgggcugcuauuuucuaucaugaagaauacuacgaacacacgccggggaaccggcaacauuggugaaacucugggcgagaaauggaagagucgacucaaugcccuugggaaaucggaguuccagaucuauaagaaaagcggcauucaggagguggacagaacccuggcgaaggagggcaucaagagaggggaaacagaucaucacgcugucucccgcggaucugcaaaauugcggugguuuguggagagaaacaugguuacuccagaaggcaaggugguagaccuggguugcgggcguggaggcuggucauacuauugugguggccucaaaaaugugagggaggucaaggggcugaccaaaggaggcccugggcaugaagaaccaauaccuaugagcacauacggauggaacuuaguucggcuucaauccggcguggaugucuucuucacgccacccgagaagugcgacacccugcucugugauaucggugaaaguucuccuaauccaacuauugaggccgggcgcacacuacgagugcugaacuugguagaaaauuggcugaacaauaacacccaguuuugcaucaaggugcucaaucccuauaugccgagcguuauugagaaaauggaaacucuucagagaaaguacggaggcgcucuggugaggaacccuuugucaagaaauuccacacacgagauguacugggucaguaacgccaccggcaauaucgugagcucugucaacaugauaucccgcaugcugauuaacagauucacgaugaaacacaagaaagcaaccuaugagccagacguggaucucgggucaggaacaaggaauaucgguaucgaaagcgagauucccaacuuagacauaaucggcaagcgaauugaaaagaucaaacaggagcaugaaacuucguggcacuacgaccaagaucauccuuauaagaccugggccuaccacgggucuuaugagacaaaacagacuggaagugcuuccagcaugguuaauggcguagugcggcugcuuaccaagccaugggacgucgugcccaugguuacacagauggcgaugaccgauacuacgccguuuggucagcaacguguguucaaagagaaggucgacacaagaacccaggaaccuaaggaggggacuaaaaagcugaugaaaauuaccgccgaauggcuauggaaggagcucggcaaaaagaaaaucccccgcauguguacaagggaggaauuuacgcggaaggugagaucaaacgcagcucugggcgccauauucaccgaugagaauaaguggaaauccgcacgcgaagccguagaggacggcagguuuugggaauugguggaucgagagcggaaccugcaccucgaggggaagugcgaaacuuguguuuacaauaugaugggaaaaagagagaagaaacuuggugaguucggcaaggcuaaggggucuagggccaucugguauauguggcugggagcgcgcuuuuuagaguucgaagcacugggcuuuuugaacgaggaccauugguucagccgugguaauagucucuccggggucgagggagaaggccugcaccggcuaggcuacauucuuagagaugugagcaaaaaggaagggggagccauguacgcugacgauacagccgguugggacaccaggaucacucuggaagaccucaaaaacgaggaaauggugacaaaucauaugaagggcgagcacaaaaagcuggcagaggcuauuuuuaaguugaccuaucagaacaaagucguucgcgugcagcgaccaacaccucgggggacuguaauggauaucauuucuagaagggaccaacgcggaucaggccagguggguaccuacgggcugaauacguucaccaacauggaagcccagcucauaagacaaauggagggagaaggcaucuucaagaguauucagcaucuuacagucacugaggagaucgcugugcagaauuggcuggcccggguuggcagggaacguuuaacccgaauggcaaucuccggggaugacugcguggucaaacccauugaugaccgcuuugcgaacgcccugacagcuuugaacgauaugggaaaggugagaaaagacauacagcaaugggagccaagccgggguuggaaugauuggacucagguacccuucugcucucaccacuuucaugaacucguuaugaaggacggcagggugcuggucgugccuugucgcaaccaggaugagcuaaucgggagagcccggauuucgcagggagcaggcuggucacuuaaggaaaccgcuugccuggguaaaagcuaugcccaaauguggacgcucauguacuuccacaggcgagaccugcguuuggcagccaaugcgaucuguuccgcugugccaagucauugggucccgacaucuagaaccacuuggagcauucacgccaagcacgaguggaugacaaccgaggauauguuagcaguuuggaaccgcguguggauccaggaaaaucccuggauggaggacaaaacuccuguagaauccugggaggaagugccauaucuggggaagcgggaggaccaguggugcggaucacucauaggccuuaccaguagggccacaugggcuaaaaacauccagacggccauuaaucaagucagaucucugaucggcaacgaggaauacaccgauuauaugcccagcaugaagcgcuuucggagggaggaagaggaagcaggggugcuaugguga

SEQ ID NO: 14366 - RNA, 9876 nt, Artificial Sequence
  derived and/or modified CDS sequence (opt3) from DENV-2__FJ850074__SS-prME
accgccggcgugaucgucaugcugauucccacaguuauggcuuuccaccucacuacgagaaacggggagccucauaugauagugggaaggcaggaaaaggguaaaagccuucuguuuaagaccgaggacggcguaaauaugugcacauugauggcaaucgauuuaggggaacugugugaggacacuauuaccuacaaaugcccacuacuccggcaaaacgaaccggaggauaucgacuguuggugcaauuccacaucuaccugggugacuuauggaacauguaccacgacuggcgagcaccgccgagaaaagcguucagucgcccuggugccccauguugguauggggcuugagaccagaacagaaacuuggaugaguagcgagggagcguggaaacacgugcagaggauugagaccuggauccugcggcauccuggcuucacaaugauggcugccauauuggcauacaccaucggcacgacucacuuucagcgcgcccucauuuucauccugcugacagcugucgcaccauccaugaccaugagaugcauugggaucucuaacagggauuuuguggaaggaguaucggguggcucauggguugacauagugcucgagcacgggagcugugucacuacaauggccaagaauaagcccaccuuagauuucgaacugauuaaaacggaggcuaagcagccugccacccuucggaaauauugcguggaagcgaaguugacaaacacuaccacagagagucgcuguccaacucaaggagagcccucccugaaugaagagcaggacaaacgauuuaucugcaagcauucuaugguggauagaggcugggguaacggguguggacuauucggcaagggcgggauugucaccugcgcaauguuuacaugcaaaaagaauauggaaggaaaaguugugcagccugagaaccucgaauacaccaucguaaucacuccacacagcggugaggagcaugccgugggcaaugacacggggaagcacggaaaagaaauuaagauaacaccgcaguccucaaucaccgaggcugaacugacuggcuaugguaccgucacaauggaguguagucccaggaccgggcuugauuucaacgaaauggugcuguugcaaauggaggacaaagccuggcucguucaccggcagugguuucuggauuuaccucugccauggcuccccggcgcagacacucagggaagcaauuggauucagaaggagacacuugugacguucaagaacccucaugcuaaaaagcaagacgucgugguacugggcucucaggaaggggccaugcacaccgcguugacuggagccacagagauccagauguccucagguaaucuacuguuuaccggccaucucaaaugccgucugcgcauggauaagcuucaacugaaagggaugagcuacaguauguguacaggaaaguucaagauaguuaaagaaauugcagagacucagcacggcaccaucgugaucagaguccaguaugagggugacgggucuccaugcaagauucccuucgaaaucauggauuuggagaaaaggcaugugcucggccggcugauuacggucaacccgauagugaccgaaaaggacuccccuguuaacaucgaggcugaacccccauuuggagauagcuacauuaucaucggcguggagccugggcaguuaaaacugaauugguucaagaagggaucgucuauuggucaaauguuugagacaacuaugcgaggcgccaaacgcauggcuauacuaggggacaccgccugggauuucggaucccucggcgguguauuuacaucaaucgggaaggcacugcaccaggucuucggcgccauuuacggagcugcguuuaguggcgugagcuggacuaugaaaauccuuauugggguuaucauaaccuggaucggaaugaacuccagaucuacgagcuugucagugagucugguccucgugggcguagugacacuguaucuuggugcaaugguucaggccgacuccgggugugucgugagcuggaagaauaaagaacugaagugcggaucuggcauuuucaucaccgauaacgugcacacuuggacagagcaguacaaguuucaacccgaaucaccaaguaaauuggcuagcgccauucagaaggcacaugaggaagguaucuguggcauaagguccgucacccggcucgagaaucugauguggaaacagauuacucccgaguuaaaccacauccugucugaaaaugagguuaagcuaaccauuaugacaggggacaucaaaggaauaaugcaggccggcaagcgcucgcucagaccucaaccaacggaacugaaauauagcuggaagaccugggggaaggcuaaaaugcuuccgacugagucccauaaccagacauucuugaucgauggacccgaaaccgccgagugcccuaauacaaacagggcauggaauucacuggagguggaagacuacggcuuugguguguucacuaccaacauuuggcucaagcugcgugagaaacaggacguauuuugugauaguaaguuaaugucugcggcuaucaaagacaaucgggccguccacgcagauaugggguauuggauugaaagcgcccugaacgacacguggaagauggagaaggcuuccuucaucgaggugaaaucaugccacuggccaaagagccauacacuuuggucuaauggaguuuuggaauccgagaugauaauucccaaaaacuucgccggcccugugagucagcacaacuaccgaccagguuaucauacccaaacugcaggccccuggcaccucgggaagcuggaaauggauuuugacuucugugagggaaccacagucgugguuacugaagauugcggcaauagagggccgagccuaaggaccacaacggcuucuggaaaacugaucaccgaguggugcugucgcuccugcacucucccuccacugcgguacagaggcgaggacgguuguugguacgggauggaaaucaggccccuuaaggagaaggaagagaacuuggugaauucacugguaacagccggacauggccagauugauaacuuuaguuuagguguccucggcauggcgcuguuccuugaagagaugcugcgcacccgaguggggacuaaacacgccaucuugcucguggcugucagcuuuguuacacugauuaccggaaauaugucguuccgggaccuaggccgugugaugguaauggugggggcaacgaugacugaugacauaggaaugggcgucaccuaucuggcccuccuggcugccuuuaaggugagaccuacauucgcagcgggucuuuugcugaggaaauuaaccuccaaggagcucaugauggccacuaucgggguugcucugcuuucucagagcacaauucccgaaaccauccuggagcuaacagaugcccucgcacugggaaugauggcuuugaaaauugugaagaacauggaaaaguaccaacuggccgucacuaucauggcaauaucaugcgugccaaaugccguuaucuuacagaacgcuuggaaagugaguuguaccauucucgcggccgucuccguaucuccucugcuucugacgagcucccagcagaaggcagacuggauccccuuggcucucacaauuaaaggccugaauccaaccgccaucuuucuaacuacccugucacgcacaagcaagaaacggaguuggccgcuuaacgaggccauaauggcugugggcaugguuucuauucucgcauccagccuguugaagaaugacaucccuaugacugggccccugguggccggagguuuacucaccgucugcuaugugcugacgggcagaucggcggaucuugaacuggagagggcugccgacguaaaaugggaggaucaagcagaaaucucagggucuaguccaauuuuguccauaacaaucagcgaggacggaucuaugagcauuaagaacgaagaggaggaacagacccucacuauccugauucgaacaggccuacuggugaucuccggugucuuccccguuucaauaccuaucaccgccgcugcaugguaccuuugggaggugaagaaacagcgcgccggggugcucugggaugucccaagucccccuccggugggaaaggcggaacuggaggacggcgcuuaucggauuaaacagagaggcaucuugggguacagccaaauuggagccgguguuuauaaggaaggcacuuuucacacaauguggcauguaaccaggggggcaguguuaaugcaccguggaaaacgcaucgagccaucuugggccgaugucaagaaggaccugguguccuacggcgguggguggaaacucgagggagaauggaaggagggcgaagagguucaggugcuggcucuugaacccggcaaaaauccucgggccguccagacgaagccagggauauucaaaacuaacaccggaacaauuggugcagugucacuggauuuuagucccggcaccagcggguccccuaucguagacagaaagggaaaggucgugggcuuguacgguaaugggguugugacaaggucuggagcuuaugucucggccaucgcgcagacugagaaaagcauugaggauaacccggaaaucgaggacgauauauuccgaaagaaacggcuaaccauuauggaccugcaucccggcgccggcaagacgaaacgcuaccucccagcaaucgugagagaagcuauuaagagggggcugcggacacuuaucuuagccccuacucgaguuguggcugcagagauggaagaggcccugagaggacuccccauacgcuaucaaaccccagccauuagggcugagcacacaggucgugaaaucgucgacuugaugugucaugcgaccuucacuaugcggcugcucucaccugugagaguacccaacuacaaucugaucauuauggaugaggcacacuuuaccgacccagccuccaucgcugccaggggcuauauuaguacacgcguggaaaugggggaggcagccggaauauucaugacggcuacuccgccuggcucucgagaucccuuuccacagagcaacgcgcccaucauggacgaggaaagagagauuccugaacgguccuggaauucaggucacgaguggguuaccgauuucaaggggaaaacagucugguuugugccaucuaucaaggccggaaacgacaucgcagcuugccuuaggaaaaauggcaagaaagugauucagcugagccgcaagaccuucgauagugaauacgucaagacucguuccaacgacugggauuuuguagugacaaccgacauaagcgagaugggcgccaauuucaaagcagagagaguuaucgauccccggagguguaugaagccugugauuuugacggacggggaagagcgcgucauccuagccggaccgaugccagugacucauucuucagcugcccaacgaagaggucggauuggcaggaaccccaaaaaugaaaacgaccaguauaucuacaugggggagccucuggaaaaugaugaggacugcgcgcacuggaaggaggcaaaaaugcucuuagauaacauaaauacacccgaaggaaucauuccauccauguuugagccugaacgcgagaagguugacgccaucgauggcgaauacagacugaggggugaggcucggaaaaccuucguggaccuuaugcgucgcggggaucugcccgucuggcucgccuauaagguggcugcagagggcauuaacuacgccgaccgaagaugguguuuugauggaaucaagaauaaccagauauuggaagagaacguagaaguggagauuuggaccaaagagggcgaaaggaagaaacugaagccacgguggcucgacgcucgcaucuauagugauccucuggcccuuaaagaguucaaggaauucgcagcggggagaaagagccuaacucugaauuugauuacagagaugggaagguuaccgaccuuuaugacacagaaagcccggaacgcucuggacaaucucgccguucugcauacugcagaagcugguggcaaggccuacaaccacgcacuuucggagcugcccgagacgcucgaaaccuugcugcuacugacacuccuugccacugucaccgggggaaucuuccuguuuuuaaugucuggcaaagguauagggaagaugacauugggcaugugcugcaucauuaccgcuuccauccugcucugguaugcgcaaauucagccacacuggaucgccgcaagcauaauucuggaguucuuucuuaucgugcugcucaucccugaacccgagaaacagcgaacuccacaggauaaucaauugacguacguggucauugcuauccugaccguuguggccgccacaauggcaaacgaaaugggauucuuagagaagacuaagaaagaccuaggccuggggucaauaaccacacaggagagugaaucuaauauucucgacaucgaucuuagaccugcuuccgccuggacccuguaugcgguagcuacuacauuugugacgcccauguugcgccauagcauugagaacucaagugucaaugugagccugaccgccaucgcaaaccaggccacuguucucaugggacuggguaagggcuggccgcuuuccaaaauggacauaggggugccacuccuggcuaucggauguuacucucaggucaauccuauuacauugaccgcagcccuguuacuacugguagcgcacuacgcuaucauuggccccggucuccaagccaaggcaaccagggaagcccagaaacgggcugccgcagggaucaugaagaacccaacaguggauggcauuacuguuaucgaccuugagcccauaccuuaugauccgaaguucgaaaaacagcugggacaggugauguugcugauucucugcgucacgcaagugcugaugaugcguaccacaugggcucuuugugaggccuuaacucuggcgaccggccccaucagcacacucugggaggggaauccaggaagauuuuggaacaccacuaucgccgucuccauggcaaauauuuucaggggcucauacuuggcuggugccgggcugcuauuuucuauaaugaagaacacgacaaauacccgccggggaacuggcaacaucggugaaacccugggcgagaaauggaagagucgacucaacgcacuugggaaaucggaauuccagauuuauaagaaaagcggaauccaggagguggacagaacacuggcuaaggagggcauuaagaggggggaaacugaucaucacgccguuucccgcggaucugccaaauugcggugguuuguggagagaaauaugguaaccccugaaggcaagguggucgaccuggguugcgggcguggaggcuggucauacuauugugguggccucaaaaacguuagggaggugaaggggcugacaaaaggaggccccgggcaugaagagccuaucccaaugagcacguacggauggaauuuaguccggcuucaauccggcguggauguauucuucacccccccugagaagugcgacacucugcucugugauauaggugaaaguucuccaaaccccacaaucgaggcggggcgcacccuacgagugcugaauuugguugaaaacuggcugaauaacaauacucaguuuugcauuaaggugcucaacccguauaugccuagcgucaucgagaaaauggaaacacuucagagaaaguacggaggcgcucuggugaggaauccauugucacggaacuccacccacgagauguacugggucaguaaugcaacgggcaacauugugagcucuguuaauaugaucucccgcaugcugauaaacagauucaccaugaaacacaagaaagccacauaugagcccgacguagaucucgggucaggaacuaggaacauugguaucgaaagcgagaucccuaauuuagacauuauaggcaagcgaaucgaaaagauuaaacaggagcaugaaaccucguggcacuacgaccaagaucauccauauaagacaugggcuuaccacgggucuuaugagacuaaacagaccggaagugccuccagcauggugaacggcgucgugcggcugcuuacaaagcccugggacguugugccgauggucacccagauggcaaugacugauacgacaccuuuuggucagcaacguguguucaaagagaagguagacaccagaacucaggaacccaaggaggggaccaaaaagcugaugaaaaucacagccgaauggcuauggaaggagcucggaaaaaagaaaacgccacgcauguguaccagggaggaauuuacucggaaggugagaucaaaugcugcgcugggcgccauuuucacagaugagaacaaguggaaauccgcacgcgaagcuguugaggacggcagguuuugggaauuggucgaucgagagcggaaucugcaccucgaggggaagugcgaaaccuguguguacaacaugaugggaaaaagagagaagaaacuuggugaauucggcaaggccaaggggucuagggcaaucugguauauguggcugggagcccgcuuuuuagaguucgaagcucugggcuuuuugaaugaggaccauugguucagccgugguaacagucucuccgggguggagggagaaggccugcaccggcuaggcuacauacuuagagaugucagcaaaaaggaggggggagccauguacgcggacgauacugcagguugggacacaaggaucacccuggaagaccucaaaaaugaggaaaugguuacaaaccauaugaagggcgagcacaaaaagcuggccgaggcuauuuuuaaguugacuuaucagaauaaagugguacgcgugcagcgaccuaccccccgggggacggucauggauaucauuucuagaagggaccaacgcggaucaggccagguggguaccuacgggcugaacacauucacuaauauggaagcccagcucaucagacaaauggagggagaaggcauuuucaagaguauacagcaucuuaccguuacagaggagaucgcagugcagaacuggcuggcucgggucggcagggaacguuuaacucgaauggccauuuccggggaugacugcgugguaaaaccaaucgaugaccgcuuugcuaaugcccugaccgcauugaacgauaugggaaagguuagaaaagacauccagcaaugggagcccagccgggguuggaacgauuggacgcaggugccuuucugcucucaccacuuucaugaacucgucaugaaggacggcagggugcugguggucccaugucgcaaucaggaugagcuaauugggagagcgcggauaucgcagggagccggcuggucacuuaaggaaacagcuugccuggguaaaagcuaugcccaaauguggacccucauguacuuccacaggcgagaccugcguuuggcagcuaacgccaucuguuccgcaguuccgagucauugggugcccacuucuagaacaaccuggagcauucacgccaagcacgaguggaugacuaccgaggauauguuagcgguauggaaucgcguguggauccaggaaaacccuuggauggaggacaaaacaccagucgaauccugggaggaagugcccuaucuggggaagcgggaggaccaguggugcggaucacucauuggccuuacgaguagggcuaccugggccaaaaauauccagacugcaauaaaccaaguuagaucucugaucggcaaugaggaauacacagauuauaugccuagcaugaagcgcuuucggagggaggaagaggaagccggggugcuaugguga

SEQ ID NO: 14367 - RNA, 9876 nt, Artificial Sequence
  derived and/or modified CDS sequence (opt3) from DENV-2__FJ850076__SS-prME
accgccggagcuaucgugaugcugauucccaccgucauggcauuccaccucacuacgaggaauggggagccucauaugauaguuggaaggcaggaaaaggguaaaagccuucuguuuaagaccgaggacggagugaauaugugcaccuugauggccaucgauuuaggggaacugugugaggacacuauuaccuacaaaugcccacuacuccggcaaaaugaaccggaggauaucgacuguuggugcaauuccacgucuaccuggguaacuuauggaacauguaccacgacuggcgagcaccgccgagaaaagcguucaguggcgcuggucccccauguggguauggggcuugagaccagaacagaaacuuggaugaguagcgagggagcuuggaaacacguucagaggauugagaccuggauccugcggcauccuggcuucacaaugauggccgcaauauuggccuacaccaucggcacgacucacuuucagcgcgcucucauuuucauccugcugacagcaguggccccauccaugaccaugagaugcauugggaucucuaacagggauuuugucgaaggagugucggguggcucauggguagacauaguucucgagcacgggagcugugugacuacaauggcuaagaauaagcccaccuuagauuucgaacugauuaaaacggaggccaagcagccugcgacccuucggaaauauugcgucgaagcaaaguugacaaacacuaccacagagagucgcuguccaacucaaggagagcccucccugaaugaggaacaggacaaacgauuuaucugcaagcauucuaugguggauagaggcugggguaacggguguggacuauucggcaagggcgggauugugaccugcgccauguuuacaugcaaaaagaauauggaaggaaaagucguucagccugagaaccucgaauacaccaucgugaucacuccacacagcggugaggagcaugcuguaggcaaugacacggggaagcacggaaaagaaauuaagauaacaccgcaguccucaaucaccgaggccgaacugacuggcuaugguaccgugacaauggaguguagucccaggaccgggcuugauuucaacgaaaugguccuguugcaaauggaggacaaagcauggcucgugcaccggcagugguuucuggauuuaccucugccauggcuccccggcgcugacacucagggaagcaauuggauucagaaggagacacuuguuacguucaagaacccucaugccaaaaagcaagacguggucgugcugggcucucaggaaggggcgaugcacaccgccuugacuggagcaacagagauccagauguccucagguaaucuacuguuuaccggccaucucaaaugccgucugcgcauggauaaacuucaacugaaagggaugagcuacaguauguguacaggaaaguucaagauaguaaaagaaauugcugagacucagcacggcaccaucguuaucagagugcaguaugagggugacgggucuccaugcaagauucccuucgaaaucauggauuuggagaaaaggcauguccucggccggcugauuacggugaacccgauagucaccgaaaaggacuccccugugaacaucgaggccgaacccccauuuggagauagcuacauuaucaucggcguugagccugggcaguuaaaacugaauugguucaagaagggaucgucuauuggucaaauguuugagacaacuaugcgaggcgcuaaacgcauggccauacuaggggacaccgcaugggauuucggaucccucggcgguguguuuacaucaaucgggaaggcccugcaccagguauucggcgcuauuuacggagcggcauuuaguggcgucagcuggacuaugaaaauccuuauuggggugaucauaaccuggaucggaaugaacuccagaucuacgagcuugucaguuagucuggugcucgucggcgugguaacacuguaucuuggugccauggugcaggcugacuccggguguguugucagcuggaagaauaaagaacugaagugcggaucuggcauuuucaucaccgauaacgugcacacuuggacagagcaguacaaguuucaacccgaaucaccaaguaaauuggccagcgcaauucagaaggcccaugaggaagguaucuguggcauaagguccgugacccggcucgagaaucugauguggaaacagauuacucccgaguuaaaccacauccugucugaaaaugaggucaagcuaaccauuaugacaggggacaucaaaggaauaaugcaggcuggcaagcgcucgcucagaccucaaccaacggaacugaaauauagcuggaagaccugggggaaggccaaaaugcuuccgacugagucccauaaccagacauucuugaucgauggacccgaaaccgcagagugcccuaauacaaacagggcguggaacucacuggagguugaagacuacggcuuugguguguucacuaccaacauuuggcucaagcugcgugagaaacaggacguguuuugugauaguaaguuaaugucugcugccaucaaagacaaucgggcaguacacgccgauaugggguauuggauugaaagcgcucugaacgacacguggaagauggagaaggccuccuucaucgaggucaaaucaugccacuggccaaagagccauacacuuuggucuaauggaguguuggaauccgagaugauaauucccaaaaacuucgcaggcccuguuagucagcacaacuaccgaccagguuaucauacccaaacugcuggccccuggcaccucgggaagcuggaaauggauuuugacuucugugagggaaccacaguggucgugacugaagauugcggcaauagagggccgagccuaaggaccacaacggccucuggaaaacugaucaccgaguggugcugucgcuccugcacucucccuccacugcgguacagaggcgaggacgguuguugguacgggauggaaaucaggccccuuaaggagaaggaagagaacuugguuaauucacuggugacagcgggacauggccagauugauaacuuuaguuuagguguacucggcauggcccuguuccuugaagagaugcugcgcacccgagucgggacuaaacacgcuaucuugcucguggcagugagcuuugucacacugauuaccggaaauaugucguuccgggaccuaggccguguuauggugaugguaggggccacgaugacugaugacauaggaaugggcgugaccuaucuggcucuccuggccgcauuuaaggucagaccuacauucgcggccggucuuuugcugaggaaauuaaccuccaaggagcucaugauggcuacuaucgggguggcccugcuuucucagagcacaauucccgaaaccauccuggagcuaacagaugcacucgcucugggaaugauggccuugaaaauuguuaagaacauggaaaaguaccaacuggcagugacuaucauggccauaucaugcgucccaaaugcugugaucuuacagaacgcguggaaaguuaguuguaccauucucgccgcaguguccgucucuccucugcuucugacgagcucccagcagaaggcugacuggauccccuuggcccucacaauuaaaggccugaauccaaccgccaucuuucuaacuacccugucacgcacaagcaagaaacggaguuggccgcuuaacgaggcuauaauggcaguaggcauggugucuauucucgccuccagccuguugaagaaugacguuccuaugacugggccccugguggcgggagguuuacucaccgucugcuaugugcugacgggcagaucggcugaucuugaacuggagagggccgcagacguaaaaugggaggaucaagccgaaaucucagggucuaguccaaucuuguccauuacaauaagcgaggacggaucuaugagcaucaagaacgaagaggaggaacagacccucacuauucugauccgaacaggccuacuggugauuuccggugucuuccccguuucaaucccuauaaccgcugcagccugguaccuuugggaggugaagaaacagcgcgcgggggugcucugggaugucccaagucccccuccggugggaaaggcugaacuggaggacggcgccuaucggaucaaacagagaggcauuuugggguacagccaaaucggagcagggguuuauaaggaaggcacuuuucacacaauguggcauguaaccaggggugcaguguuaaugcaccguggaaaacgcauugagccaucuugggcugaugucaagaaggaccugguguccuacggcgguggguggaaacucgagggagaauggaaggagggcgaagagguucaggugcuggcccuugaacccggcaaaaauccucgggcaguccagacgaagccagggaucuucaaaacuaacaccggaacaauaggugcugugucacuggauuuuagucccggcaccagcggguccccuauuguagacagaaagggaaaggucgugggcuuguacgguaaugggguugugacaaggucuggagccuaugucucggcgaucgcccagacugagaaaagcaucgaggauaacccggaaauugaggacgauaucuuccgaaagaaacggcuaaccauaauggaccugcaucccggcgcaggcaagacgaaacgcuaccucccagcuauugugagagaagccaucaagagggggcugcggacacuuauuuuagcuccuacucgaguuguggcagccgagauggaagaggcccugagaggacuccccauccgcuaucaaaccccagcuauaagggcggagcacacaggucgugaaauugucgacuugaugugucaugcaaccuucacuaugcggcugcucucaccugugagaguacccaacuacaaucugaucaucauggaugaggcccacuuuaccgacccagcuuccauugccgcaaggggcuauaucaguacacgcguggaaaugggggaggccgcuggaauuuucaugacggcgacuccgccuggcucucgagaucccuuuccacagagcaacgcccccauaauggacgaggaaagagagaucccugaacgguccuggaacucaggucacgaguggguuaccgauuucaaggggaaaacagucugguuugugccaucuauuaaggcaggaaacgacaucgcugccugccuuaggaaaaauggcaagaaagugauccagcugagccgcaagaccuucgauagugaauacgucaagacucguuccaacgacugggauuuuguagugacaaccgacauuagcgagaugggcgcaaauuucaaagccgagagaguuauagauccccggagguguaugaagccugugaucuugacggacggggaagaacgcgucauucuagcuggaccgaugccagugacucauucuucagccgcgcaacgaagaggucggaucggcaggaaccccaaaaaugaaaacgaccaguauauuuacaugggggagccucuggaaaaugaugaggacugcgcacacuggaaggaggccaaaaugcucuuagauaacaucaauacacccgaaggaauaaucccauccauguuugagccugaacgcgagaagguugacgcuauugauggcgaauacagacugaggggugaggcccggaaaaccuucguggaccuuaugcgucgcggggaucugcccgucuggcucgcuuauaagguggcagccgagggcaucaacuacgcugaccgaagaugguguuuugauggaauuaagaauaaccagaucuuggaagagaacguagaaguggagauauggaccaaagagggcgaaaggaagaaacugaagccacgguggcucgacgcccgcauuuauagugauccucuggcacuuaaagaguucaaggaguucgcggccgggagaaagagccuaacucugaauuugaucacagagaugggaagguuaccgaccuuuaugacacagaaagcucggaacgcccuggacaaucucgcaguucugcauacugcugaagccgguggcaaggcauacaaccacgcccuuucggagcugcccgagacgcucgaaaccuugcugcuacugacacuccuugcuacugucaccgggggaauuuuccuguuuuuaaugucuggcaaagguaucgggaagaugacauugggcaugugcugcauaaucaccgcguccauucugcucugguaugcccaaauccagccacacuggauugcagcuagcaucauacuggaguucuuucuuauugugcugcucaucccugaacccgagaaacagcgaacuccacaggauaaucaauugacguacguggucaucgccauucugaccguuguggccgcaacaauggcuaacgaaaugggauucuuagagaagacuaagaaagaccuaggccuggggucaaucaccacacaggagagugaaucuaauauacucgacauugaucuuagaccugccuccgcguggacccuguaugcuguagccacuacauuugugacgcccauguugcgccauagcaucgagaacucaagugucaaugugagccugaccgcaauugccaaccaggcuacuguucucaugggacuggguaagggcuggccgcuuuccaaaauggacaucggggugccacuccuggcaauaggauguuacucucaggucaauccuaucacauugaccgccgcgcuguuacuacugguagcucacuacgccauuaucggccccggucuccaagcaaaggccaccagggaagcucagaaacgggccgcagcugggauuaugaagaacccaacaguggauggcaucacuguuauugaccuugagcccaucccuuaugauccgaaguucgaaaaacagcugggacaggugauguugcugauacucugcgucacgcaagugcugaugaugcguaccacaugggcccuuugugaggcguuaacucuggccaccggccccauuagcacacucugggaggggaauccaggaagauuuuggaacaccacuaucgcagucuccauggcuaauaucuucaggggcucauacuuggccggugcagggcugcuauuuucuauuaugaagaacacgacaaauacccgccggggaacuggcaacauaggugaaacccugggcgagaaauggaagagucgacucaacgcucuugggaaaucggaguuccagaucuauaagaaaagcggcauucaggagguggacagaacacuggccaaggagggcaucaagagaggggaaacugaucaucacgccguuucccgcggaucugcgaaauugcggugguuuguggagagaaauaugguaaccccugaaggcaagguggucgaccuggguugcgggcguggaggcuggucauacuauugugguggccucaaaaacguuagggaggugaaggggcugacaaaaggaggccccgggcaugaagaaccuauuccaaugagcacguacggauggaauuuaguccggcuucaauccggcguggauguauucuucacacccccugagaagugcgacacucugcucugugauaucggugaaaguucuccaaaccccacaauagaggcugggcgcacccuacgagugcugaauuugguugaaaacuggcugaauaacaauacucaguuuugcaucaaggugcucaacccguauaugccuagcgucauugagaaaauggaaacacuucagagaaaguacggaggcgcacuggugaggaauccauugucacggaacuccacccacgagauguacugggucaguaaugccacgggcaacaucgugagcucuguuaauaugauuucccgcaugcugaucaacagauucaccaugaaacacaagaaagcuacauaugagcccgacguagaucucgggucaggaacuaggaacauagguauugaaagcgagaucccuaauuuagacaucauuggcaagcgaauagaaaagaucaaacaggagcaugaaaccucguggcacuacgaccaagaucauccauauaagacaugggccuaccacgggucuuaugagacuaaacagaccggaagugcauccagcauggugaacggcgucgugcggcugcuuacaaagcccugggacguugugccgauggucacccagauggccaugacugauacgacaccuuuuggucagcaacguguguucaaagagaagguagacaccagaacucaggaacccaaggaggggaccaaaaagcugaugaaaauuacagcugaauggcuauggaaggagcucggcaagaagaaaacgccacgcauguguaccagggaggaauuuacucggaaggugagaucaaaugcggcccugggcgcaaucuucacagaugagaacaaguggaaauccgcucgcgaagccguugaggacggcagguuuugggaauuggucgaucgagagcggaaucugcaccucgaggggaagugcgaaaccuguguguacaacaugaugggaaaaagagagaagaaacuuggugaguucggcaaggcaaaggggucuagggccauuugguauauguggcugggagcucgcuuuuuagaguucgaagcccugggcuuuuugaaugaggaccauugguucagccgugguaacagucucuccgggguggagggagaaggccugcaccggcuaggcuacauccuuagagaugucagcaaaaaggaagggggagcgauguacgcagacgauacugccgguugggacacaaggauaacccuggaagaccucaaaaaugaggaaaugguuacaaaccauaugaagggcgagcacaaaaagcuggcugaggccaucuuuaaguugacuuaucagaauaaagugguacgcgugcagcgaccuacaccccgggggacggucauggauauuaucucuagaagggaccaacgcggaucaggccagguggguaccuacgggcugaacacauucacuaauauggaagcacagcucauuagacaaauggagggagaaggcaucuucaagaguauucagcaucuuaccguuacagaggagauagcugugcagaacuggcuggcccgggucggcagggaacguuuaacucgaauggcuaucuccggggaugacugcgugguaaaaccaauugaugaccgcuuugccaaugcacugaccgcguugaacgauaugggaaagguuagaaaagacauccagcaaugggagcccagccgggguuggaacgauuggacacaggugccuuucugcucucaccacuuucaugaacucgucaugaaggacggcagggugcugguggucccaugucgcaaucaggaugagcuaaucgggagagcccggauuucgcagggagcuggcuggucacuuaaggaaacagccugccuggguaaaagcuaugcacaaauguggacccucauguacuuccacaggcgagaccugcguuuggcugccaacgcaauauguuccgccguuccgagucauugggugcccacuucuagaacaaccuggagcauccacgcgaagcacgaguggaugacuaccgaggauauguuagcuguauggaaucgcguguggauucaggaaaacccuuggauggaggacaaaacaccagucgaauccugggaggaagugcccuaucuggggaagcgggaggaccaguggugcggaucacucaucggccuuacgaguagggccaccugggccaaaaauauucagacugccaucaaccaaguuagaucucugauaggcaaugaggaauacacagauuauaugccuagcaugaagcgcuuucggagggaggaagaggaagcuggggugcuaugguga

SEQ ID NO: 14368 - RNA, 9876 nt, Artificial Sequence
  derived and/or modified CDS sequence (opt3) from DENV-2__GQ868640__SS-prME
accgccggagcuaucgugaugcugauucccaccgucauggcauuccaccucacuacgaggaauggggagccucauaugauaguuggaaggcaggaaaaggguaaaagccuucuguuuaagaccgaggacggcgugaauaugugcaccuugauggccaucgauuuaggggaacugugugaggacacuauuaccuacaaaugcccacuacuccggcaaaaugaaccggaggauaucgacuguuggugcaauuccacgucuaccuggguaacuuauggaacauguaccacgacuggcgagcaccgccgagaaaagcguucaguggcgcuggucccccauguggguauggggcuugagaccagaacagaaacuuggaugaguagcgagggagcuuggaaacacguucagaggauugagaccuggauccugcggcauccuggcuucacaaugauggccgcaauauuggccuacaccaucggcacgacucacuuucagcgcgcucucauuuucauccugcugacagcaguggccccauccaugaccaugagaugcauugggaucucuaacagggauuuugucgaaggagugucggguggcucauggguagacauaguucucgagcacgggagcugugugacuacaauggcuaagaauaagcccaccuuagauuucgaacugauuaaaacggaggccaagcagccugcgacccuucggaaauauugcgucgaagcaaaguugacaaacacuaccacagagagucgcuguccaacucaaggagagcccucccugaaugaggaacaggacaaacgauuuaucugcaagcauucuaugguggauagaggcugggguaacggguguggacuauucggcaagggcgggauugugaccugcgccauguuuacaugcaaaaagaauauggaaggaaaagucguucagccugagaaccucgaauacaccaucgugaucacuccacacagcggugaggagcaugcuguaggcaaugacacggggaagcacggaaaagaaauuaagauaacaccgcaguccucaaucaccgaggccgaacugacuggcuaugguaccgugacaauggaguguagucccaggaccgggcuugauuucaacgaaaugguccuguugcaaauggaggacaaagcauggcucgugcaccggcagugguuucuggauuuaccucugccauggcuccccggcgcugacacucagggaagcaauuggauucagaaggagacacuuguuacguucaagaacccucaugccaaaaagcaagacguggucgugcugggcucucaggaaggggcgaugcacaccgccuugacuggagcaacagagauccagauguccucagguaaucuacuguuuaccggccaucucaaaugccgucugcgcauggauaaacuucaacugaaagggaugagcuacaguauguguacaggaaaguucaagauaguaaaagaaauugcugagacucagcacggcaccaucguuaucagagugcaguaugagggugacgggucuccaugcaagauucccuucgaaaucauggauuuggagaaaaggcauguccucggccggcugauuacggugaacccgauagucaccgaaaaggacuccccugugaacaucgaggccgaacccccauuuggagauagcuacauuaucaucggcguugagccugggcaguuaaaacugaauugguucaagaagggaucgucuauuggucaaauguuugagacaacuaugcgaggcgcuaaacgcauggccauacuaggggacaccgcaugggauuucggaucccucggcgguguguuuacaucaaucgggaaggcccugcaccagguauucggcgcuauuuacggagcggcauuuaguggcgucagcuggacuaugaaaauccuuauuggggugaucauaaccuggaucggaaugaacuccagaucuacgagcuugucaguuagucuggugcucgucggcgugguaacacuguaucuuggugccauggugcaggcugacuccggguguguugucagcuggaagaauaaagaacugaagugcggaucuggcauuuucaucaccgauaacgugcacacuuggacagagcaguacaaguuucaacccgaaucaccaaguaaauuggccagcgcaauucagaaggcccaugaggaagguaucuguggcauaagguccgugacccggcucgagaaucugauguggaaacagauuacucccgaguuaaaccacauccugucugaaaaugaggucaagcuaaccauuaugacaggggacaucaaaggaauaaugcaggcuggcaagcgcucgcucagaccucaaccaacggaacugaaauauagcuggaagaccugggggaaggccaaaaugcuuccgacugagucccauaaccagacauucuugaucgauggacccgaaaccgcagagugcccuaauacaaacagggcguggaacucacuggagguugaagacuacggcuuugguguguucacuaccaacauuuggcucaagcugcgugagaaacaggacguguuuugugauaguaaguuaaugucugcugccaucaaagacaaucgggcaguacacgccgauaugggguauuggauugaaagcgcucugaacgacacguggaagauggagaaggccuccuucaucgaggucaaaucaugccacuggccaaagagccauacacuuuggucuaauggaguguuggaauccgagaugauaauucccaaaaacuucgcaggcccuguuagucagcacaacuaccgaccagguuaucauacccaaacugcuggccccuggcaccucgggaagcuggaaauggauuuugacuucugugagggaaccacaguggucgugacugaagauugcggcaauagagggccgagccuaaggaccacaacggccucuggaaaacugaucaccgaguggugcugucgcuccugcacucucccuccacugcgguacagaggcgaggacgguuguugguacgggauggaaaucaggccccuuaaggagaaggaagagaacuugguuaauucacuggugacagcgggacauggccagauugauaacuuuaguuuagguguacucggcauggcccuguuccuugaagagaugcugcgcacccgagucgggacuaaacacgcuaucuugcucguggcagugagcuuugucacacugauuaccggaaauaugucguuccgggaccuaggccguguuauggugaugguaggggccacgauaacugaugacaucggaaugggcgugaccuaucuggcucuccuggccgcauuuaaggucagaccuacauucgcggccggucuuuugcugaggaaauuaaccuccaaggagcucaugauggcuacuauugggguggcccugcuuucucagagcacaauccccgaaaccauucuggagcuaacagaugcacucgcucugggaaugauggccuugaaaaucguuaagaacauggaaaaguaccaacuggcagugacuauaauggccaucucaugcgucccaaaugcugugauuuuacagaacgcguggaaaguuaguuguaccauccucgccgcaguguccgucucuccucugcuucugacgagcucccagcagaaggcugacuggauucccuuggcccucacaaucaaaggccugaauccaaccgccauauuucuaacuacccugucacgcacaagcaagaaacggaguuggccgcuuaacgaggcuauuauggcaguaggcauggugucuauccucgccuccagccuguugaagaaugacguuccuaugacugggccccugguggcgggagguuuacucaccgucugcuaugugcugacgggcagaucggcugaucuugaacuggagagggccgcagacguaaaaugggaggaucaagccgaaaucucagggucuaguccaauuuuguccauaacaaucagcgaggacggaucuaugagcauuaagaacgaagaggaggaacagacccucacuauccugauucgaacaggccuacuggugaucuccggugucuuccccguuucaauaccuaucaccgcugcagccugguaccuuugggaggugaagaaacagcgcgcgggggugcucugggaugucccaagucccccuccggugggaaaggcugaacuggaggacggcgccuaucggauuaaacagagaggcaucuugggguacagccaaauuggagcagggguuuauaaggaaggcacuuuucacacaauguggcauguaaccaggggugcaguguuaaugcaccguggaaaacgcaucgagccaucuugggcugaugucaagaaggaccugguguccuacggcgguggguggaaacucgagggagaauggaaggagggcgaagagguucaggugcuggcccuugaacccggcaaaaauccucgggcaguccagacgaagccagggauauucaaaacuaacaccggaacaauuggugcugugucacuggauuuuagucccggcaccagcggguccccuaucguagacagaaagggaaaggucgugggcuuguacgguaaugggguugugacaaggucuggagccuaugucucggcgaucgcccagacugagaaaagcauugaggauaacccggaaaucgaggacgauauauuccgaaagaaacggcuaaccauuauggaccugcaucccggcgcaggcaagacgaaacgcuaccucccagcuaucgugagagaagccauuaagagggggcugcggacacuuaucuuagcuccuacucgaguuguggcagccgagauggaagaggcccugagaggacuccccauacgcuaucaaaccccagcuauuagggcggagcacacaggucgugaaaucgucgacuugaugugucaugcaaccuucacuaugcggcugcucucaccugugagaguacccaacuacaaucugaucauuauggaugaggcccacuuuaccgacccagcuuccaucgccgcaaggggcuauauuaguacacgcguggaaaugggggaggccgcuggaauauucaugacggcgacuccgccuggcucucgagaucccuuuccacagagcaacgcccccaucauggacgaggaaagagagauuccugaacgguccuggaacucaggucacgaguggguuaccgauuucaaggggaaaacagucugguuugugccaucuaucaaggcaggaaacgacaucgcugccugccuuaggaaaaauggcaagaaagugauucagcugagccgcaagaccuucgauagugaauacgucaagacucguuccaacgacugggauuuuguagugacaaccgacauaagcgagaugggcgcaaauuucaaagccgagagaguuaucgauccccggagguguaugaagccugugauuuugacggacggggaagaacgcgucauccuagcuggaccgaugccagugacucauucuucagccgcgcaacgaagaggucggauuggcaggaaccccaaaaaugaaaacgaccaguauaucuacaugggggagccucuggaaaaugaugaggacugcgcacacuggaaggaggccaaaaugcucuuagauaacauaaauacacccgaaggaaucauuccauccauguuugagccugaacgcgagaagguugacgcuaucgauggcgaauacagacugaggggugaggcccggaaaaccuucguggaccuuaugcgucgcggggaucugcccgucuggcucgcuuauaagguggcagccgagggcauuaacuacgcugaccgaagaugguguuuugauggaaucaagaauaaccagauauuggaagagaacguagaaguggagauuuggaccaaagagggcgaaaggaagaaacugaagccacgguggcucgacgcccgcaucuauagugauccucuggcacuuaaagaguucaaggaguucgcggccgggagaaagagccuaacucugaauuugauuacagagaugggaagguuaccgaccuuuaugacacagaaagcucggaacgcccuggacaaucucgcaguucugcauacugcugaagccgguggcaaggcauacaaccacgcccuuucggagcugcccgagacgcucgaaaccuugcugcuacugacacuccuugcuacugucaccgggggaaucuuccuguuuuuaaugucuggcaaagguauagggaagaugacauugggcaugugcugcaucauuaccgcguccauccugcucugguaugcccaaauucagccacacuggaucgcagcuagcauaauucuggaguucuuucuuaucgugcugcucaucccugaacccgagaaacagcgaacuccacaggauaaucaauugacguacguggucauugccauccugaccguuguggccgcaacaauggcuaacgaaaugggauucuuagagaagacuaagaaagaccuaggccuggggucaauaaccacacaggagagugaaucuaauauucucgacaucgaucuuagaccugccuccgcguggacccuguaugcuguagccacuacauuugugacgcccauguugcgccauagcauugagaacucaagugucaaugugagccugaccgcaaucgccaaccaggcuacuguucucaugggacuggguaagggcuggccgcuuuccaaaauggacauaggggugccacuccuggcaaucggauguuacucucaggucaauccuauuacauugaccgccgcgcuguuacuacugguagcucacuacgccaucauuggccccggucuccaagcaaaggccaccagggaagcucagaaacgggccgcagcugggaucaugaagaacccaacaguggauggcauuacuguuaucgaccuugagcccauaccuuaugauccgaaguucgaaaaacagcugggacaggugauguugcugauucucugcgucacgcaagugcugaugaugcguaccacaugggcccuuugugaggcguuaacucuggccaccggccccaucagcacacucugggaggggaauccaggaagauuuuggaacaccacuaucgcagucuccauggcuaauauuuucaggggcucauacuuggccggugcagggcugcuauuuucuauaaugaagaacacgacaaauacccgccggggaacuggcaacaucggugaaacccugggcgagaaauggaagagucgacucaacgcucuugggaaaucggaguuccagauuuauaagaaaagcggaauccaggagguggacagaacacuggccaaggagggcauuaagagaggggaaacugaucaucacgccguuucccgcggaucugcgaaauugcggugguuuguggagagaaauaugguaaccccugaaggcaagguggucgaccuggguugcgggcguggaggcuggucauacuauugugguggccucaaaaacguuagggaggugaaggggcugacaaaaggaggccccgggcaugaagaaccuaucccaaugagcacguacggauggaauuuaguccggcuucaauccggcguggauguauucuucacacccccugagaagugcgacacucugcucugugauauaggugaaaguucuccaaaccccacaaucgaggcugggcgcacccuacgagugcugaauuugguugaaaacuggcugaauaacaauacucaguuuugcauuaaggugcucaacccguauaugccuagcgucaucgagaaaauggaaacacuucagagaaaguacggaggcgcacuggugaggaauccauugucacggaacuccacccacgagauguacugggucaguaaugccacgggcaacauugugagcucuguuaauaugaucucccgcaugcugauaaacagauucaccaugaaacacaagaaagcuacauaugagcccgacguagaucucgggucaggaacuaggaacauugguaucgaaagcgagaucccuaauuuagacauuauaggcaagcgaaucgaaaagauuaaacaggagcaugaaaccucguggcacuacgaccaagaucauccauauaagacaugggccuaccacgggucuuaugagacuaaacagaccggaagugcauccagcauggugaacggcgucgugcggcugcuuacaaagcccugggacguugugccgauggucacccagauggccaugacugauacgacaccuuuuggucagcaacguguguucaaagagaagguagacaccagaacucaggaacccaaggaggggaccaaaaagcugaugaaaaucacagcugaauggcuauggaaggagcucggcaagaagaaaacgccacgcauguguaccagggaggaauuuacucggaaggugagaucaaaugcggcccugggcgcaauuuucacagaugagaacaaguggaaauccgcucgcgaagccguugaggacggcagguuuugggaauuggucgaucgagagcggaaucugcaccucgaggggaagugcgaaaccuguguguacaacaugaugggaaaaagagagaagaaacuuggugaguucggcaaggcaaaggggucuagggccaucugguauauguggcugggagcucgcuuuuuagaguucgaagcccugggcuuuuugaaugaggaccauugguucagccgugguaacagucucuccgggguggagggagaaggccugcaccggcuaggcuacauacuuagagaugucagcaaaaaggaagggggagcgauguacgcagacgauacugccgguugggacacaaggaucacccuggaagaccucaaaaaugaggaaaugguuacaaaccauaugaagggcgagcacaaaaagcuggcugaggccauuuuuaaguugacuuaucagaauaaagugguacgcgugcagcgaccuacaccccgggggacggucauggauaucauuucuagaagggaccaacgcggaucaggccagguggguaccuacgggcugaacacauucacuaauauggaagcacagcucaucagacaaauggagggagaaggcauuuucaagaguauacagcaucuuaccguuacagaggagaucgcugugcagaacuggcuggcccgggucggcagggaacguuuaacucgaauggcuauuuccggggaugacugcgugguaaaaccaaucgaugaccgcuuugccaaugcacugaccgcguugaacgauaugggaaagguuagaaaagacauccagcaaugggagcccagccgggguuggaacgauuggacacaggugccuuucugcucucaccacuuucaugaacucgucaugaaggacggcagggugcugguggucccaugucgcaaucaggaugagcuaauugggagagcccggauaucgcagggagcuggcuggucacuuaaggaaacagccugccuggguaaaagcuaugcacaaauguggacccucauguacuuccacaggcgagaccugcguuuggcugccaacgcaaucuguuccgccguuccgagucauugggugcccacuucuagaacaaccuggagcauucacgcgaagcacgaguggaugacuaccgaggauauguuagcuguauggaaucgcguguggauccaggaaaacccuuggauggaggacaaaacaccagucgaauccugggaggaagugcccuaucuggggaagcgggaggaccaguggugcggaucacucauuggccuuacgaguagggccaccugggccaaaaauauccagacugccauaaaccaaguuagaucucugaucggcaaugaggaauacacagauuauaugccuagcaugaagcgcuuucggagggaggaagaggaagcuggggugcuaugguga

SEQ ID NO: 14369 - RNA, 9876 nt, Artificial Sequence
  derived and/or modified CDS sequence (opt3) from DENV-2__FJ850078__SS-prME
accgccggcgugaucgucaugcugauucccacaguuauggcuuuccaccucacuacgagaaacggggagccucauaugauagugggaaggcaggaaaaggguaaaagccuucuguuuaagaccgaggacggcguaaauaugugcacauugauggcaaucgauuuaggggaacugugugaggacacuauuaccuacaaaugcccacuacuccggcaaaacgaaccggaggauaucgacuguuggugcaauuccacaucuaccugggugacuuauggaacauguaccacgacuggcgagcaccgccgagaaaagcguucagucgcccuggugccccauguugguauggggcuugagaccagaacagaaacuuggaugaguagcgagggagcguggaaacacgugcagaggauugagaccuggauccugcggcauccuggcuucacaaugauggcugccauauuggcauacaccaucggcacgacucacuuucagcgcgcccucauuuucauccugcugacagcugucgcaccauccaugaccaugagaugcauugggaucucuaacagggauuuuguggaaggaguaucggguggcucauggguugacauagugcucgagcacgggagcugugucacuacaauggccaagaauaagcccaccuuagauuucgaacugauuaaaacggaggcuaagcagccugccacccuucggaaauauugcguggaagcgaaguugacaaacacuaccacagagagucgcuguccaacucaaggagagcccucccugaaugaagagcaggacaaacgauuuaucugcaagcauucuaugguggauagaggcugggguaacggguguggacuauucggcaagggcgggauugucaccugcgcaauguuuacaugcaaaaagaauauggaaggaaaaguugugcagccugagaaccucgaauacaccaucguaaucacuccacacagcggugaggagcaugccgugggcaaugacacggggaagcacggaaaagaaauuaagauaacaccgcaguccucaaucaccgaggcugaacugacuggcuaugguaccgucacaauggaguguagucccaggaccgggcuugauuucaacgaaauggugcuguugcaaauggaggacaaagccuggcucguucaccggcagugguuucuggauuuaccucugccauggcuccccggcgcagacacucagggaagcaauuggauucagaaggagacacuugugacguucaagaacccucaugcuaaaaagcaagacgucgugguacugggcucucaggaaggggccaugcacaccgcguugacuggagccacagagauccagauguccucagguaaucuacuguuuaccggccaucucaaaugccgucugcgcauggauaagcuucaacugaaagggaugagcuacaguauguguacaggaaaguucaagauaguuaaagaaauugcagagacucagcacggcaccaucgugaucagaguccaguaugagggugacgggucuccaugcaagauucccuucgaaaucauggauuuggagaaaaggcaugugcucggccggcugauuacggucaacccgauagugaccgaaaaggacuccccuguuaacaucgaggcugaacccccauuuggagauagcuacauuaucgugggcguagagccugggcaguuaaaacugaauugguucaagaagggaucgucuaucggucaaauguuugagacaacuaugcgaggcgccaaacgcauggcuauucuaggggacaccgccugggauuucggaucccucggcggugucuuuacaucaauagggaaggcacugcaccagguguucggcgccaucuacggagcugcguuuaacggcguuaguuggacuaugaaaauucuuaucggggugauuaucaccuggauaggaaugaauagcagauccacgucuuugagcgucucacuggugcucguaggcgugguuacacuguaucuuggugcaaugguccaggccgacagugggugugugguguccuggaagaacaaagaacugaagugcggaagcggcaucuucauuaccgauaauguccacacuuggacagagcaguacaaguuucaacccgaaucuccaucaaaauuggcuagugccauccagaaggcacaugaggaagguauuuguggcaucaggagcguuacccggcucgagaaccugauguggaaacagauaacucccgaguuaaaucacauucuguccgaaaacgaggugaagcuaaccaucaugacaggggacauuaaaggaaucaugcaggccggcaagcgcucucucagaccucaaccaacggaacugaaauauucguggaagaccugggggaaggcuaaaaugcuuccgacugagagccauaaucagacauucuugauagauggacccgaaaccgccgagugcccuaacgcaaauagggcguggaacucccuggagguggaagacuacggcuuugguguauucacaacuaauaucuggcucaagcugcgugagaaacaggacgucuuuugugauucaaaguuaaugagugcugccauuaaagacaaccgggcagugcacgccgauaugggguauuggaucgaaucugcucugaaugacaccuggaagauggagaaggccagcuucauugagguuaaauccugccacuggccaaagucacauacgcuuuggagcaacggaguguuggaaucugagaugaucauacccaaaaacuucgcaggcccugucucccagcacaauuaccgaccagguuaucauacacaaaccgcuggccccuggcaccucgggaagcuggaaauggauuuugacuucugugagggaacuaccgugguugugacagaagauugcggcaacagagggccgagucuaaggacuaccacagccagcggaaaacugauuacggaguggugcugucgcucuugcacccucccuccacugcgguacagaggcgaggacgguuguugguacgggauggaaaucaggccccuuaaggagaaggaagagaauuugguaaacucccuggucacugcgggacauggccagaucgauaauuuuucauuaggugugcucggcauggcccuguuccuugaagagaugcugcgcacacgaguggggaccaaacacgcuauuuugcucgucgcaguuaguuuugugacucugaucacaggaaacaugagcuuccgggaccuaggccguguaauggugauggucggggccaccaugacggaugacauuggaaugggcgugacuuaucuggcucuccuggccgcauuuaagguuagaccuaccuucgcggccggucuuuugcugaggaaauuaacaucgaaggagcucaugauggcuaccauagggguggcccugcuuucccagucuacuauccccgaaacaauucuggagcuaaccgaugcacucgcucugggaaugauggccuugaaaaucgucaagaauauggaaaaguaccaacuggcagugacaauuauggccaucagcugcguuccaaacgcugugauauuacagaaugcguggaaagucucauguacuauccucgccgcaguaaguguguccccucugcuucugaccucuagccagcagaaggcugacuggauucccuuggcccucacgaucaaaggccugaacccaacagccauuuuucuaaccacucugucccgcaccucaaagaaacggagcuggccgcuuaaugaggcuguuauggcagugggcauggucaguauccucgccucuucccuguugaagaacgacauaccuaugacagggccccugguggcgggagguuuacucacuguaugcuaugugcugaccggcagaagcgcugaucuugaacuggagagggccgcagacgucaaaugggaggaucaagccgaaauuucggggucaucuccaaucuugaguaucacgauuuccgaggacggaagcaugucuauaaagaaugaagaggaggaacagacacucaccauccugauucgaacuggccuacugguuaucagcgguguguuccccguguccauuccuaucacagcugcagccugguaccuuugggaggucaagaaacagcgcgcgggggugcucugggauguuccaucacccccuccgguagaaaaggcugagcuggaagacggagccuaucggauaaaacagagaggcaucuugggcuacagucaaauuggggcaggaguguauaaggaggguaccuuucacacuauguggcaugucacaaggggcgccguguuaaugcaccgugggaaacgcaucgagccaagcugggcugauguuaagaaggaccuggugucuuacggaggcgguuggaaacucgaaggggaguggaaggaaggagaggaaguccaggugcuggcccuugagcccggcaaaaacccucgggcaguacagaccaagccaggcauuuucaaaacgaauacugggaccaucggagcugucucccuggauuuuucacccgguacaaguggcagcccuauaguggacagaaaggggaagguugugggauuguacggcaacggugucgugaccagguccggggccuauguuucugcgauugcccagacagagaaaucgaucgaagauaacccggagaucgaagacgauauuuuccgaaagaaacggcuaacuaucauggaccugcaucccggagcaggcaagaccaaacgcuaccucccagcuauagugagagaggccauuaagaggggccugcggacgcuuaucuuagcuccuacacgagucguggcagccgaaauggaggaggcccugagagggcuccccauucgcuaucaaacuccagcuaucagggcggaacacaccggacgugagauaguagacuugaugugucaugcaacauucaccaugcggcugcucagcccugugagaguucccaauuacaaccugauuaucauggaugaagcccacuuuacugacccagcuucaaucgccgcaagggguuauauuuccacccgcgucgagaugggcgaggccgcugggaucuucaugacagcgacgccgccuggaagucgagaucccuuuccacagucuaaugcccccauuauggacgaagagagagaaauaccugagcggagcuggaacuccggccacgaaugggugacugauuucaaggguaaaaccgugugguuugucccaucaaucaaggcagggaaugacauugcugccugccuuaggaaaaacggaaagaaaguaauccagcugucucgcaagacauucgauagcgaguacgugaagacccguaguaaugacugggauuuuguugugacuacagacaucuccgagaugggcgcaaacuucaaagccgaaagagucauugauccccggagguguaugaagccugugauauugaccgacggcgaggaacgcguuauccuagcugggccgaugccagugacgcauagcucugccgcgcaacgaagaggacggauugguaggaaucccaaaaacgagaaugaccaguauaucuacaugggcgaaccucuggagaacgaugaggacugcgcacacuggaaggaagccaaaaugcucuuagauaauauuaacacucccgaggggaucauaccaucaauguuugaaccugagcgcgaaaaggucgacgcuaucgauggagaguacagacugaggggcgaggcccggaaaacauucguggaccuuaugcgucgcggugaucugcccguauggcucgcuuauaagguggcagccgaagggauuaauuacgcugaccgaagaugguguuuugauggcaucaagaacaaccagauuuuggaggaaaauguugaggucgagaucuggaccaaagaaggagagaggaagaaacugaagccacgguggcucgacgcccgcauauauuccgauccucuggcacuuaaagaauucaaggaguucgcggccggcagaaagagucuaacccugaacuugauuacugaaauggggagguuaccgacauuuaugacccagaaagcucggaaugcccuggacaaccucgcagugcugcauacagcugaggccggagguaaggcauacaaucacgcccuuagcgagcugcccgaaacucucgagacguugcugcuacugacccuccuugcuacagugacuggcgggaucuuccuguuuuuaaugucgggaaaaggcauugguaagaugaccuuggggaugugcugcaucauaacagcgucuauccugcucugguaugcccaaauucagccacacuggaucgcagcuuccauuauccuggaauucuuucuuauaguccugcucauuccugagcccgaaaaacagcgaaccccacaggauaaccaauugacuuacguugugaucgccauccugacgguaguggccgcaaccauggcuaaugagaugggcuucuuagagaagacaaagaaagaccuaggacugggcagcauuacuacccaggaaucagagaguaacauccucgacauagaucuuagaccugccucugcguggacacuguaugcugucgccaccacuuuugugacacccauguugcgccauuccauugaaaauagcucaguuaacgugagucugacggcaaucgccaaucaggcuaccguccucauggggcugggaaaggguuggccgcuuagcaaaauggacauuggcguaccacuccuggcaaucggguguuacucccaggugaacccuauaacuuugacagccgcgcuguuacuacugguugcucacuacgccaucauuggacccggccuccaagcaaaggccaccagggaggcucagaaacgggccgcagcugguaucaugaagaauccaaccguggaugggauuacagucaucgaccuugaacccauuccuuaugauccgaaguucgagaaacagcugggccaggugauguugcugauccucugcgucacucaagugcugaugaugcguacgaccugggcccuuugugaggcguuaacacuggccacuggacccauaucuacccucugggaaggcaacccagggagauuuuggaauacaaccauugcaguuagcauggcuaacaucuucaggggauccuacuuggccggcgcaggucugcuauuuucaaucaugaagaauacuacgaacacacgccgggggaccggaaacauuggcgagacucugggugaaaaauggaagucucgacucaaugcucuuggcaaaagugaguuccagauauauaagaaaucggggauccaggagguggacagaacccuggccaaggaaggaauuaagaggggcgagacagaucaucacgccguaagccgcggguccgcgaaauugcggugguuuguggaaagaaacauggucacuccugagggaaagguuguggaccugggcugcggucgugggggauggucuuacuauuguggcggucucaaaaaugucagggaagugaagggccugacccgggggggacccggccaugaggagccuaucccaaugucaacauacggguggaacuuaguacgccuucaaagcggaguggauguuuucuucacgcccccugaaaaaugcgacacccugcucugugauauuggcgaguccaguccaaaucccacuaucgaagcuggucgaacacuaagagugcugaacuuggucgagaauuggcugaacaauaacacccaguuuugcauaaaggugcucaauccguauaugccuucugucaucgaaaagauggagacucuucagaggaaauacgggggagcacuggugcggaacccauugagccgcaauucaacacacgagauguacuggguuuccaacgccaccggcaauauuguaaguagcgugaacaugaucucuagaaugcugauuaacagguucacgaugaagcacaaaaaggcuaccuaugaacccgacgucgaucucggcuccgggacacgaaauaucggaauagagucagaaauuccuaacuuagacaucaucgguaaacggauugagaagauaaagcaggaacaugagacuagcuggcacuacgaccaagaucauccauauaaaaccugggccuaccacggcucguaugagacaaagcagacugggucugcaaguuccauggugaauggaguugugcgucugcuuaccaaacccugggacgucgugccgaugguaacacagauggccaugaccgauacuacgccuuuuggccagcaaagaguguucaaggaaaaaguugacacacgcacccaggagcccaaggaagguacuaagaaacugaugaagaucaccgcugaguggcuauggaaagagcucgggaagaaaaagacaccaaggauguguacgcgggaagaguuuaccagaaaaguccgcagcaacgcggcccugggagcaauuuucacugaugaaaauaaguggaagucagcuagggaggccguggaagacggccgauuuugggaguugguggaucgggagagaaaccugcaccucgaaggcaaaugcgagacaugugucuacaauaugauggggaagagggaaaaaaagcuuggagaguucgguaaagcaaagggcucccgcgccaucugguauauguggcugggggcucguuuuuuagaauucgaggcccugggauuuuugaacgaggaccauugguucucucggggcaauagccucagugguguugaaggggagggacugcacagacuaggcuacauucuuagggauguguccaagaaagaaggcggggcgauguacgcagacgauaccgccggaugggacacucgcaucacacuggaggaccucaagaacgaagagaugguaaccaaucauaugaaaggugagcacaagaaacuggcugaagccauauuuaaguugacauaucagaacaaggugguccgagugcagcggccuacucccagaggcaccguuauggauaucauuagcaggcgcgaccaaagagggucuggacaggugggcacguacggucugaauaccuucacaaacauggaggcacagcucauccggcaaauggaaggggagggaauuuucaaaucaauccagcaucuuacugucaccgaggaaauugcugugcagaauuggcuggccaggguaggccgugagcgauuaacacgcauggcuauaaguggcgaugacugcguugugaagccaaucgaugacagauuugccaacgcacugacugcguugaacgauauggggaaaguccggaaggacauucagcaaugggaacccuccaggggauggaaugauuggacccaggugccuuucugcagccaccacuuucaugagcucgugaugaaagacggucgcguccugguugugccauguagaaaccaggaugaacuaaucggccgggccaggaucucucagggggcuggauggucgcuuaaggagacggccugccugggcaagucauaugcacaaauguggacacucauguacuuccaccgacgugaccugagauuggcugccaaugcaauuuguagcgccguaccgucccauugggugcccaccagucgcacuacauggucuauacacgcgaaacacgaguggaugaccacugaagauauguuagcugucuggaaccggguguggauccaggagaauccuuggauggaagacaagaccccaguugagagcugggaagaggugcccuaucuggguaaaagggaggaccaguggugcgggucccucauuggacuuacaucaagagccacgugggcaaagaacauccagaccgccauuaaucaaguccgcagucugaucggcaacgaagaguacacugauuauaugccuucuaugaaacgguuuaggcgagaagaggaagaggcuggcgugcuaugguga

SEQ ID NO: 14370 - RNA, 9876 nt, Artificial Sequence
  derived and/or modified CDS sequence (opt3) from DENV-2__FJ850082__SS-prME
accgugggcgucaucguuaugcugauucccacagccauggcuuuccaccucacuacgagaaacggggagccucauaugauagugggaaggcaggaaaaggguaaaagccuucuguuuaagaccgagaauggcguaaacaugugcacauugauggcaaucgacuuaggggaacugugugaggauacuauuaccuacaaaugcccacuacuccggcaaaaugaaccggaggacaucgauuguuggugcaacuccacaucuaccugggugacuuauggaacauguaccacgacuggcgagcaccgccgagaaaagcguucagucgcccuggugccccauguugguauggggcuugagaccagaacagaaacuuggaugaguagcgagggagcguggaaacacgugcagaggauugagaccuggauccugcggcauccuggcuucacaauaauggcugccaucuuggcauacaccauuggcacgacucacuuucagcgcgcccucaucuucauucugcugacagcugucgcaccauccaugaccaugagaugcaucgggauaucuaauagggacuuuguggaaggaguaucggguggcucauggguugauauugugcucgagcacgggagcugugucacuacaauggccaagaacaagcccaccuuagacuucgaacugaucaaaacggaggcuaagcagccugccacccuucggaaauauugcguggaagcgaaguugacaaauacuaccacagagagucgcuguccaacucaaggagagcccucccugaacgaagagcaggauaaacgauuuauuugcaagcauucuaugguggacagaggcugggguaauggguguggacuauucggcaagggcgggaucgucaccugcgcaauguuuacaugcaaaaagaacauggaaggaaaaguugugcagccugagaaucucgaauacaccaucguaauuacuccacacagcggugaggagcaugccgugggcaacgauacggggaagcacggaaaagaaauaaagaucacaccgcaguccucaauuaccgaggcugaacugacuggcuaugguaccgucacaauggaguguagucccaggaccgggcuugacuucaaugaaauggugcuguugcaaauggaggauaaagccuggcucguucaccggcagugguuucuggacuuaccucugccauggcuccccggcgcagauacucagggaagcaacuggauccagaaggagacacuugugacguucaagaauccucaugcuaaaaagcaagacgucgugguacugggcucucaggaaggggccaugcacaccgcguugacuggagccacagagauacagauguccucagguaaccuacuguuuaccggccaucucaaaugccgucugcgcauggacaagcuucaacugaaagggaugagcuacaguauguguacaggaaaguucaagauuguuaaagaaaucgcagagacucagcacggcaccaucgugauuagaguccaguaugagggugaugggucuccaugcaagauccccuucgaaauuauggacuuggagaaaaggcaugugcucggccggcugauaacggucaacccgaucgugaccgaaaaggauuccccuguuaauauugaggcugaacccccauuuggagacagcuacaucaucauuggcguggagccugggcaguuaaaacugaacugguucaagaagggaucgucuauaggucaaauguuugagacaacuaugcgaggcgccaaacgcauggcuauccuaggggauaccgccugggacuucggaucccucggcgguguauuuacaucaauugggaaggcacugcaccaggucuucggcgccaucuacggagcugcguuuaguggcgugagcuggacuaugaaaauucuuaucgggguuauaaucaccuggauuggaaugaauuccagaucuacgagcuugucagugagucugguccucgugggcguagugacacuguaucuuggugcaaugguucaggccgauuccgggugugucgugagcuggaagaacaaagaacugaagugcggaucuggcaucuucauuaccgacaaugugcacacuuggacagagcaguacaaguuucaacccgaaucaccaaguaaauuggcuagcgccauccagaaggcacaugaggaagguauauguggcauuagguccgucacccggcucgagaaccugauguggaaacagaucacucccgaguuaaaucacauucugucugaaaacgagguuaagcuaaccaucaugacaggggauauaaaaggaaucaugcaggccggcaagcgcucgcucagaccucaaccaacggaacugaaauauagcuggaagaccugggggaaggcuaaaaugcuuuccacugagucacauaaucagacauucuugauugacggaccggaaaccgccgagugccccaacacaaauagggcauggaacagucuggagguggaagauuacggcuuugguguguucacuaccaauaucuggcucaagcugcgugagaaacaggacguauuuugugacucuaaguuaaugagcgcggcugucaaagauaaccgggccgugcacgcagacaugggguauuggauugaauccgcccugaaugauacguggaagauggagaaggcuucauucaucgagguuaaaagcugccacuggccuaagucucauacacuuugguccaacggaguguuggaaagugagaugauaauuccaaaaaacuucgccggccccgucagccagcacaauuaccgaccugguuaucauacccaaacugcaggcccauggcaccucgggaagcuggaaauggacuuugauuucugugagggaaccacagugguugugacugaagacugcggcaacagagggcccucucuaaggaccacaacggcuuccggaaaacugaucaccgaguggugcugucgcucaugcacucucccgccucugcgguacagaggcgaggaugguuguugguacgggauggaaaucaggccacuuaaggagaaggaagagaauuugguaaacagucuggucacagccggacauggccagauugacaauuuuagcuuaggugugcucggcauggcgcuguuccuugaagagaugcugcgcacccgaguggggacuaaacacgccaucuugcucgucgcuguuucguuugugacacugauuaccggaaacauguccuuccgggaucuaggccguguaauggugauggucggggcaacgaugacugacgauauaggaaugggcgugaccuaucuggcccuccuggcugccuuuaagguuagacccacauucgcagcgggucuuuugcugaggaaauuaaccucuaaggagcucaugauggccacuaucgggguggcucugcuuagccagucaacaauuccugaaaccauccuggagcuaacagacgcccucgcacugggaaugauggcuuugaaaauugucaagaauauggaaaaguaccaacuggccgugacuaucauggcaauaaguugcguucccaacgccgugaucuuacagaaugcuuggaaagucuccuguaccauucucgcggccguaucugugagcccacugcuucugacguccucacagcagaaggcagauuggaucccuuuggcucucacaauuaaaggccugaaccccaccgccaucuuucuaacuacccugagccgcacaaguaagaaacggucuuggccacuuaaugaggccauaauggcuguuggcaugguguccauucucgcaagcucgcuguugaagaacgacaucccgaugacugggccucuggucgccggagguuuacucaccgugugcuauguacugacgggcagaucagcggaccuugaacuggagagggcugccgaugugaaaugggaggaccaagcagaaaucucugggaguucccccauuuugagcauaacaaucucugaggauggaagcauguccauuaagaaugaagaggaggaacagacccucacuauccugauucgaacaggccuacuggucaucucagguguuuucccagugaguauacccaucaccgccgcugcaugguaccuuugggaggugaagaaacagcgcgccgggguccucugggacgugccuagcccacccccuguuggaaaggcggaacuggaggaaggcgcuuaucggauuaaacagagaggcaucuugggguacucucaaauuggagccgguguauauaaggagggcacuuuucacacaauguggcaugugaccaggggggcagucuuaaugcaccguggaaaacgcaucgagccguccugggccgaugugaagaaggaccugguuucauacggcgguggguggaaacucgaaggagaguggaaggaaggcgaggaagugcagguccuggcucuugagccaggcaaaaacccccgggccgugcagacgaagccugggauauucaaaacuaauaccggaacaauuggugcaguaagucuggauuuuagcccaggcaccuccgggucucccaucgucgacagaaagggaaaggugguuggcuuguacgguaacgggguggucacaaggucgggagcuuaugugagcgccaucgcgcagacugauaaaucaauugaggacaacccugaaaucgaggaugacauauuccgaaagaaacggcuaaccauuauggaucugcauccgggcgccggcaagacgaaacgcuaccuccccgcaaucguuagagaagcuauuaagagggggcugcggacacuuaucuuagccccaacucgaguggucgcugcagagauggaagaggcccugagaggacucccuauacgcuaucaaacccccgccauuagggcugagcacacaggucgugaaaucguggacuugaugugucaugcgaccuucacuaugcggcugcucuccccaguaagagugccuaauuacaaccugaucauuauggacgaggcacacuuuaccgaucccgccaguaucgcugccaggggcuauauuucuacacgcguugaaaugggggaggcagccggaauauucaugacggcuacuccaccgggcagccgagacccuuuuccccaguccaaugcgccaaucauggaugaggaaagagagauucccgaacggucauggaacucuggucacgagugggucaccgacuucaaggggaaaacagugugguuugugccuagcaucaaggccggaaaugauaucgcagcuugccuuaggaaaaacggcaagaaagucauucagcugagucgcaagaccuucgacuccgaauacguaaagacucgugccaaugauugggacuuugugguuacaaccgauauaagcgagaugggcgcaaacuucaaagccgagagagugaucgacccacggagguguaugaagcccgucauuuugacggauggggaagagcgcgugauccuagcuggaccuaugccgguuacucauucuucagccgcgcaacgaagaggucggauuggcaggaauccaaaaaacgaaaaugaccaguauaucuacaugggggagccccuggaaaacgacgaggauugcgcacacuggaaggaggccaaaaugcucuuagacaauauaaacacaccugaaggaaucauucccuccauguuugagccagaacgcgagaagguggaugcuaucgacggcgaauacagacugaggggugaggcccggaaaaccuucgucgaucuuaugcgucgcggggaccugccuguguggcucgcuuauaagguagcagccgagggcauuaauuacgcugaucgaagaugguguuuugacggaaucaagaacaaccagauauuggaagagaauguggaaguugagauuuggaccaaagagggcgaaaggaagaaacugaagccccgguggcucgaugcccgcaucuauagugacccacuggcacuuaaagaguucaaggaauucgcggccgggagaaagagccuaacucugaacuugauuacagagaugggaagguuaccuaccuuuaugacacagaaagcucggaaugcccuggauaaccucgcaguccugcauacugcugaagccgguggcaaggcauacaaucacgcccuuucggagcugccggagacgcucgaaaccuugcugcuacugacacuccuugcuacugugaccgggggaaucuuccuguuuuuaaugucuggcaaagguauagggaagaugacauugggcaugugcugcaucauuaccgcguccauccugcucugguaugcccaaauucagccccacuggaucgcagcuagcauaauucuggaguucuuucuuaucgugcugcucaucccagaaccugagaaacagcgaacuccccaggacaaccaauugacguacgucguuauugccauccugaccgugguagccgcaacaauggcuaaugaaaugggauucuuagagaagacuaagaaagaucuaggccuggggucaauaaccacacaggagagugaaucuaacauucucgacaucgaccuuagaccagccuccgcguggacccuguaugcuguggccacuacauuugucacgccuauguugcgccauagcauugagaauucaagugugaacguuagccugaccgcaaucgccaaucaggcuacugugcucaugggacuggguaagggcuggccccuuuccaaaauggauauaggggucccgcuccuggcaaucggauguuacucucagguaaacccaauuacauugaccgccgcgcuguuacuacugguggcucacuacgccaucauuggcccuggucuccaagcaaaggccaccagggaagcucagaaacgggccgcagcugggaucaugaagaaucccacaguugacggcauuacugugaucgaucuugagccaauacccuaugacccuaaguucgaaaaacagcugggacaggucauguugcugauucucugcgugacgcaaguccugaugaugcguaccacaugggcccuuugugaggcguuaacucuggccaccggcccgaucagcacacucugggaggggaaccccggaagauuuuggaauaccacuaucgcaguguccauggcuaacauuuucaggggcucauacuuggccggugcagggcugcuauuuucuauaaugaagaauacgacaaacacccgccggggaacuggcaacaucggugaaacccugggcgagaaauggaagagucgacucaaugcucuugggaaaucggaauuccagauuuauaagaaaagcggaauccaggagguugauagaacacuggccaaggagggcauuaagaggggggaaacugaccaucacgccgugucccgcggaucugcgaaauugcggugguuuguagagagaaacauggugaccccagaaggcaaggucguugaucuggguugcgggcguggaggcuggucauacuauugugguggccucaaaaaugugagggaggucaaggggcugacaaaaggaggcccugggcaugaagagcccaucccuaugagcacguacggauggaacuuagugcggcuucaauccggcguagacguguucuucaccccacccgagaagugcgauacucugcucugugacauaggugaaaguucuccuaauccaacaaucgaggcugggcgcacccuacgaguucugaacuugguggaaaauuggcugaacaauaacacucaguuuugcauuaagguccucaaucccuauaugccgagcgugaucgagaaaauggaaacacuucagagaaaguacggaggcgcacuggucaggaacccuuugucacggaauuccacccacgagauguacugggugaguaacgccacgggcaauauuguuagcucuguaaacaugaucucccgcaugcugauaaacagauucaccaugaaacacaagaaagcuacauaugagccagauguggaccucgggucaggaacuaggaauauugguaucgaaagcgagguccccaacuuagauaucauuggcaagcgaauagaaaagaucaaacaggagcaugaaaccucguggcacuacgaccaagaccauccuuauaagacaugggccuaccacgggucuuaugagacuaaacagaccggaagugcauccagcauggugaauggcguugugcggcugcuuacaaagccaugggaugucgugcccaugguaacccagauggccaugacugacacgacaccguuuggucagcaacguguguucaaagagaagguugauaccagaacucaggaaccuaaggaggggaccaaaaagcugaugaaaauuacagcugaauggcuauggaaggagcucggaaaaaagaaaaucccccgcauguguacgagggaggaauuuacccggaaggucagaucaaacgcggcccugggcgcaauuuucacugacgagaauaaguggaaauccgcucgcgaagccguggaggauggcagguuuugggaauugguggaccgagagcggaaccugcaccucgaggggaagugcgaaacaugugucuacaauaugaugggaaaaagagagaagaaacuuggugaauucggcaaggcaaaggggucuagggccaucugguauauguggcugggagcucgcuuuuuagaguucgaagcccugggcuuuuugaacgaggaucauugguucagccgugguaauagucucuccgggguugagggagaaggccugcaccggcuaggcuacauacuuagagacgugagcaaaaaggaggggggagcgauguacgcagaugacaccgccgguugggauacuaggaucacacuggaagaccucaaaaacgaggaaaugauuaccaaucauaugaagggcgagcacaaaaagcuggcugaggccaucuuuaaguugacauaucagaacaaaguagugcgcguccagcgaccaacuccucgggggaccgugauggacauuaucucuagaagggaucaacgcggaucaggccagguugguacguacgggcugaauaccuucacaaacauggaagcacagcucauuagacaaauggagggagaaggcauauucaagaguauccagcaucuuacugugaccgaggagauugcuguccagaauuggcuggcccgggugggcagggaacguuuaacacgaauggcuaucuccggggacgauugcguaguuaaacccaucgacgaucgcuuugccaacgcacugacugcguugaacgacaugggaaaggugagaaaagauauucagcaaugggagccaagccgggguuggaaugacuggacccagguccccuucugcucucaccacuuucaugaacucgugaugaaggauggcagggugcuggucguuccuugucgcaaccaggacgagcuaauagggagagcccggaucucgcagggagcuggcuggucacuuaaggaaacggccugccuggguaaaagcuaugcacaaauguggacacucauguacuuccacaggcgagaucugcguuuggcugccaaugcaauuuguuccgccgugccaagucauuggguaccgaccucuagaacuacauggagcauccacgcgaagcacgaguggaugaccacugaggacauguuagcuguguggaaccgcgucuggauucaggaaaaucccuggauggaggauaaaaccccuguggaauccugggaggaaguuccauaucuggggaagcgggaggaccaguggugcggaucacucaucggccuuacaaguagggccacgugggcaaaaaacauacagaccgccaucaaucaagugagaucucugauuggcaacgagggguacacugacuauaugcccagcaugaagcgcuuucggagggaagaggaagaggcuggaguccuaugguga

SEQ ID NO: 14371 - RNA, 9876 nt, Artificial Sequence
  derived and/or modified CDS sequence (opt3) from DENV-2__FJ850085__SS-prME
accgugggcgucaucguuaugcugauucccacagccauggcuuuccaccucacuacgaggaacggggagccucauaugauagugggaaggcaggaaaaggguaaaagccuucuguuuaagaccgagaauggcgucaacaugugcacauugauggcaaucgacuuaggggaacugugugaggauacuauuaccuacaaaugcccacuacuccggcaaaaugaaccggaggacaucgauuguuggugcaacuccacaucuaccugggugacuuauggaacauguaccacgacuggcgagcaccgccgagaaaagcguucagucgcccuggugccccauguugguauggggcuugagaccaggacagaaacuuggaugaguagcgagggagcguggaaacacgugcagaggauugagaccuggauccugcggcauccuggcuucacaauaauggcugccaucuuggcauacaccauuggcacgacucacuuucagcgcgcccucaucuucauucugcugacagcugucgcaccauccaugaccaugcggugcaucgggauaucuaauagggacuuuguggaaggaguaucggguggcucauggguugauauugugcucgagcacgggagcugugucacuacaauggccaagaacaagcccaccuuagacuucgaacugaucaaaacggaggcuaagcagccugccacccuucggaaauauugcguggaagcgaaguugacaaauacuaccacagagagucgcuguccaacucaaggagagcccucccugaacgaggaacaggauaaacgauuuauuugcaagcauucuaugguggacagaggcugggguaauggguguggacuauucggcaagggcgggaucguaaccugcgcaauguuuacaugcaaaaagaacauggaaggaaaaguugugcagccugagaaucucgaauacaccaucguaauuacuccacacagcggugaggagcaugccgugggcaacgauacggggaagcacggaaaagaaauaaagaucacaccgcaguccucaauuaccgaggcugaacugacuggcuaugguaccgucacaauggaguguagucccaggaccgggcuugacuucaaugaaauggugcuguugcaaauggaggauaaagccuggcucguucaccggcagugguuucuggacuuaccucugccauggcuccccggcgcagauacucagggaagcaacuggauccagaaggagacacuugugacguucaagaauccucaugcuaaaaagcaagacgucgugguacugggcucucaggaaggggccaugcacaccgcguugacuggagccacagagauacagauguccucagguaaccuacuguuuaccggccaucucaaaugccgucugcgcauggacaaacuucaacugaaagggaugagcuacaguauguguacaggaaaguucaagauuguuaaagaaaucgcagagacucagcacggcaccaucgugauuagaguccaguaugagggugaugggucuccaugcaagauccccuucgaaauuauggacuuggagaaaaggcaugugcucggccggcugauaacggucaacccgaucguggcugaaaaggauuccccuguuaauauugaggccgaacccccauuuggagacagcuacaucaucauuggcguggagccugggcaguuaaaacugaacugguucaagaagggaucgucuauaggucaaauguuugagaccacaaugcgaggcgcuaaacgcauggccauccuaggggauacugcaugggacuucggaucccucggcgguguauuuaccucaauugggaaggcccugcaccaggucuucggcgcuaucuacggagcggcauuuaguggcgugagcuggacaaugaaaauucuuaucgggguuauaaucacuuggauuggaaugaacuccagaucuaccagcuugucagugagucugguccucgugggcguagugacgcuguaucuuggugccaugguucaggcugauuccgggugugucgugagcuggaagaacaaagaacugaagugcggaucuggcaucuucauuacagacaaugugcacaccuggacugagcaguacaaguuucaacccgaaucaccaaguaaauuggccagcgcaauccagaaggcccaugaggaagguauauguggcauuagguccgucacacggcucgagaaccugauguggaaacagaucacccccgaguuaaaucacauucugucugaaaacgagguuaagcuaacuaucaugaccggggauauaaaaggaaucaugcaggcuggcaagcgcucgcucagaccucaaccaacagaacugaaauauagcuggaagacgugggggaaggccaaaaugcuuuccaccgagucacauaaucagacuuucuugauugacggaccggaaacagcagagugccccaacaccaauagggcguggaacagucuggagguggaagauuacggcuuugguguguucacaacuaauaucuggcucaagcugcgugagaaacaggacguauuuugugacucuaaguuaaugagcgcugccgucaaagauaaccgggcagugcacgccgacaugggguauuggauugaauccgcucugaaugauaccuggaagauggagaaggccucauucaucgagguuaaaagcugccacuggccuaagucucauacgcuuugguccaacggaguguuggaaagugagaugauaauucccaagaauuucgcaggccccgucagccagcacaauuaccgaccugguuaucauacacaaaccgcuggcccauggcaccucgggaagcuggaaauggacuuugauuucugugagggaacuaccgugguugugacagaagacugcggcaacagagggcccucucuaaggacuaccacagccuccggaaaacugaucacggaguggugcugucgcucaugcacccucccgccucugcgguacagaggcgaggaugguuguugguacgggauggaaaucaggccacuuaaggagaaggaagagaauuugguaaacagucuggucacugcgggacauggccagauugacaauuuuagcuuaggugugcucggcauggcccuguuccuugaagagaugcugcgcacacgaguggggaccaaacacgcuaucuugcucgucgcaguuucguuugugacucugauuacaggaaacauguccuuccgggaucuaggccguguaauggugauggucggggccaccaugacggacgauauaggaaugggcgugacuuaucuggcucuccuggccgcauuuaagguuagacccaccuucgcggccggucuuuugcugaggaaauuaacaucuaaggagcucaugauggcuaccaucgggguggcccugcuuagccagucaacuauuccugaaacaauccuggagcuaaccgacgcacucgcucugggaaugauggccuugaaaauugucaagaauauggaaaaguaccaacuggcagugacaaucauggccauaaguugcguucccaacgcugugaucuuacagaaugcguggaaagucuccuguacuauucucgccgcaguaucugugagcccacugcuucugaccuccucacagcagaaggcugauuggaucccuuuggcccucacgauuaaaggccugaaccccacagccaucuuucuaaccacucugagccgcaccaguaagaaacggucuuggccacuuaaugaggcuauaauggcaguuggcaugguguccauucucgccagcucgcuguugaagaacgacaucccgaugacagggccucuggucgcgggagguuuacucacugugugcuauguacugaccggcagaucagcugaccuugaacuggagagggccgcagaugugaaaugggaggaccaagccgaaaucucugggaguucccccauuuugagcauaacgaucucugaggauggaagcauguccauuaagaaugaagaggaggaacagacacucaccauccugauucgaacuggccuacuggucaucucagguguuuucccagugaguauacccaucacagcugcagccugguaccuuugggaggugaagaaacagcgcgcggggguccucugggacgugccuagcccacccccuguuggaaaggcugaacuggaggaaggcgccuaucggauuaaacagagaggcaucuugggguacucucaaauuggagcugguguauauaaggagggcaccuuucacacuauguggcaugugacaagaggggcagucuuaaugcaccguggaaaacgcaucgagccguccugggcagaugugaagaaggaccugguuucauacggcgguggguggaaacucgaaggagaguggaaggaaggcgaggaagugcagguccuggcccuugagccaggcaaaaacccccgggcagugcagaccaagccugggauauucaaaacgaauacuggaaccauuggugcuguaagucuggauuuuagcccaggcacauccgggucucccaucgucgacagaaagggaaaggugguuggcuuguacgguaacgggguggucaccaggucgggagccuaugugagcgcgaucgcccagacagauaaaucaauugaggacaacccugaaaucgaggaugacauauuccgaaagaaacggcuaacuauuauggaucugcauccgggcgcaggcaagaccaaacgcuaccuccccgcuaucguuagagaagccauuaagagggggcugcggacgcuuaucuuagcuccaacacgaguggucgcagccgagauggaagaggcccugagaggacucccuauacgcuaucaaacucccgcuauuagggcggagcacaccggucgugaaaucguggacuugaugugucaugcaacauucaccaugcggcugcucuccccaguaagagugccuaauuacaaccugaucauuauggacgaggcccacuuuacugaucccgcuaguaucgccgcaaggggcuauauuucuacccgcguugaaaugggggaggccgcuggaauauucaugacagcgacgccaccgggcagccgagacccuuuuccccaguccaaugccccaaucauggaugaggaaagagagauucccgaacggucauggaacucuggucacgagugggucacugacuucaaggggaaaaccgugugguuugugccuagcaucaaggcaggaaaugauaucgcugccugccuuaggaaaaacggcaagaaagucauucagcugagucgcaagacauucgacuccgaauacguaaagacccgugcaaaugauugggacuuugugguuacuacagauauaagcgagaugggcgccaacuucaaagcugagagagugaucgacccacggagguguaugaagcccgucauuuugaccgauggggaggaacgcgugauccuagccggaccuaugccgguuacgcauucuucagcggcacaacgaagaggucggauuggcaggaaucccaaaaacgaaaaugaccaguauaucuacaugggggagccccuggaaaacgacgaggauugcgcccacuggaaggaggcuaaaaugcucuuagacaauauaaacacuccugaaggaaucauucccuccauguuugagccagaacgcgagaagguggaugccaucgacggcgaauacagacugaggggugaggcucggaaaacauucgucgaucuuaugcgucgcggggaccugccuguguggcucgcauauaagguagccgcugagggcauuaauuacgccgaucgaagaugguguuuugacggaaucaagaacaaccagauauuggaagagaauguggaaguugagauuuggaccaaagagggcgaaaggaagaaacugaagccccgguggcucgaugcacgcaucuauagugacccacuggcgcuuaaagaguucaaggaguucgccgcugggagaaagagccuaacccugaacuugauuacugagaugggaagguuaccuacauuuaugacccagaaagcccggaaugcacuggauaaccucgcuguccugcauacagccgaagccgguggaaaggcauacaaucacgcucuuucggagcugccggagacucucgaaacguugcugcuacugacccuccuugcgacagugacugggggaaucuuccuguuuuuaaugucuggcaaagguauagggaagaugaccuugggcaugugcugcaucauuacagccuccauccugcucugguaugcacaaauucagccccacuggaucgcugccagcauaauucuggaguucuuucuuaucgugcugcucaucccagaaccugagaaacagcgaaccccacaggacaaccaauugacuuacgucguuauugccauccugacggugguagcagcuaccauggccaaugaaaugggauucuuagagaagacaaagaaagaucuaggccuggggucaauaacuacccaggagagugaaucuaacauucucgacaucgaccuuagaccagcguccgcuuggacacuguaugccguggcaaccacuuuugucacaccuauguugcgccauagcauugaaaauucaagugugaacguuagccugacggccaucgcuaaucaggcaaccgugcucaugggacuggguaagggcuggccccuuuccaaaauggauauaggggucccgcuccuggccaucggauguuacucucagguaaacccaauuacuuugacagcggcucuguuacuacugguggcccacuacgcaaucauuggcccuggucuccaagccaaggcuaccagggaagcccagaaacgggcagcugccgggaucaugaagaaucccaccguugacggcauuacagugaucgaucuugagccaauacccuaugacccuaaguucgaaaaacagcugggacaggucauguugcugauucucugcgugacucaaguccugaugaugcguacgaccugggcgcuuugugaggccuuaacacuggcaacuggcccgaucagcacccucugggaggggaaccccggaagauuuuggaauacaaccaucgcuguguccauggccaacauuuucaggggcucauacuuggccggugcugggcugcuauuuucuauaaugaagaauacuacgaacacacgccggggaaccggcaacaucggugaaacucugggcgagaaauggaagagucgacucaaugcccuugggaaaucggaguuccagauuuauaagaaaagcggaauccaggagguugauagaacccuggccaaggagggcauuaagagaggggaaacagaccaucacgcggugucccgcggaucugcuaaauugcggugguuuguagagagaaacauggugacuccagaaggcaaggucguugaucuggguugcgggcguggaggcuggucauacuauugugguggccucaaaaaugugagggaggucaaggggcugaccaaaggaggcccugggcaugaagaaccaaucccuaugagcacauacggauggaacuuagugcggcuucaauccggcguagacguguucuucacgccacccgagaagugcgauacccugcucugugacauaggugaaaguucuccuaauccaacuaucgaggcagggcgcacacuacgaguucugaacuugguggaaaauuggcugaacaauaacacccaguuuugcauuaagguccucaaucccuauaugccgagcgugaucgagaaaauggaaacucuucagagaaaguacggaggcgcccuggucaggaacccuuugucaagaaauuccacacacgagauguacugggugaguaacgcuaccggcaauauuguuagcucuguaaacaugaucucccgcaugcugauaaacagauucacgaugaaacacaagaaagccaccuaugagccagauguggaccucgggucaggaacaaggaauauugguaucgaaagcgagguccccaacuuagauaucauuggcaagcgaauagaaaagaucaaacaggagcaugaaacuucguggcacuacgaccaagaccauccuuauaagaccugggcauaccacgggucuuaugagacaaaacagacuggaagugccuccagcauggugaauggcguugugcggcugcuuaccaagccaugggaugucgugcccaugguaacacagauggcuaugaccgacacuacgccguuuggucagcaacguguguucaaagagaagguugauacaagaacccaggaaccuaaggaggggacuaaaaagcugaugaaaauuaccgcggaauggcuauggaaggagcucggcaaaaagaaaaucccccgcauguguacaagggaggaauuuacgcggaaggucagaucaaacgccgcacugggcgcuauuuucaccgacgagaauaaguggaaauccgcccgcgaagcaguggaggauggcagguuuugggaauugguggaccgagagcggaaccugcaccucgaggggaagugcgaaacuugugucuacaauaugaugggaaaaagagagaagaaacuuggugaguucggcaaggccaaggggucuagggcuaucugguauauguggcugggagcccgcuuuuuagaguucgaagcgcugggcuuuuugaacgaggaucauugguucagccgugguaauagucucuccgggguugagggagaaggccugcaccggcuaggcuacauacuuagagacgugagcaaaaaggaagggggagcaauguacgccgaugacacagcugguugggauaccaggaucacucuggaagaccucaaaaacgaggaaaugauuacaaaucauaugaagggcgagcacaaaaagcuggccgaggcaaucuuuaaguugaccuaucagaacaaaguagugcgcguccagcgaccaacaccucgggggacugugauggacauuaucucuagaagggaucaacgcggaucaggccagguugguaccuacgggcugaauacguucaccaacauggaagcucagcucauuagacaaauggagggagaaggcauauucaagaguauccagcaucuuacagugacugaggagauugccguccagaauuggcuggcucgggugggcagggaacguuuaacccgaauggccaucuccggggacgauugcguaguuaaacccaucgacgaucgcuuugcaaacgcgcugacagccuugaacgacaugggaaaggugagaaaagauauucagcaaugggagccaagccgggguuggaaugacuggacucagguccccuucugcucucaccacuuucaugaacucgugaugaaggauggcagggugcuggucguuccuugucgcaaccaggacgagcuaauagggagagcucggaucucgcagggagccggcuggucacuuaaggaaaccgcaugccuggguaaaagcuaugcucaaauguggacgcucauguacuuccacaggcgagaucugcguuuggccgcaaaugccauuuguuccgcggugccaagucauuggguaccgacaucuagaaccacuuggagcauccacgcuaagcacgaguggaugacaaccgaggacauguuagccguguggaaccgcgucuggauucaggaaaaucccuggauggaggauaaaacuccuguggaauccugggaggaaguuccauaucuggggaagcgggaggaccaguggugcggaucacucaucggccuuaccaguagggcaacaugggccaaaaacauacagacggcuaucaaucaagugagaucucugauuggcaacgagggguacaccgacuauaugcccagcaugaagcgcuuucggagggaagaggaagaggccggaguccuaugguga

SEQ ID NO: 14372 - RNA, 9876 nt, Artificial Sequence
  derived and/or modified CDS sequence (opt3) from DENV-2__FJ850088__SS-prME
accgccggcgugaucgucaugcugauucccacaguuauggcuuuccaccucacuacgagaaacggggagccucauaugauagugggaaggcaggaaaaggguaaaagccuucuguuuaagaccgaggacggcguaaauaugugcacauugauggcaaucgauuuaggggaacugugugaggacacuauuaccuacaaaugcccacuacuccggcaaaacgaaccggaggauaucgacuguuggugcaauuccacaucuaccugggugacuuauggaacauguaccacgacuggcgagcaccgccgagaaaagcguucagucgcccuggugccccauguugguauggggcuugagaccagaacagaaacuuggaugaguagcgagggagcguggaaacacgugcagaggauugagaccuggauccugcggcauccuggcuucacaaugauggcugccauauuggcauacaccaucggcacgacucacuuucagcgcgcccucauuuucauccugcugacagcugucgcaccauccaugaccaugagaugcauugggaucucuaacagggauuuuguggaaggaguaucggguggcucauggguugacauagugcucgagcacgggagcugugucacuacaauggccaagaauaagcccaccuuagauuucgaacugauuaaaacggaggcuaagcagccugccacccuucggaaauauugcguggaagcgaaguugacaaacacuaccacagagagucgcuguccaacucaaggagagcccucccugaaugaagagcaggacaaacgauuuaucugcaagcauucuaugguggauagaggcugggguaacggguguggacuauucggcaagggcgggauugucaccugcgcaauguuuacaugcaaaaagaauauggaaggaaaaguugugcagccugagaaccucgaauacaccaucguaaucacuccacacagcggugaggagcaugccgugggcaaugacacggggaagcacggaaaagaagucaagauuacaccgcaguccucaauaaccgaggcugaacugacuggcuaugguaccgugacaauggaguguagucccaggaccgggcuugauuucaacgaaaugguucuguugcaaauggaggacaaagccuggcucgugcaccggcagugguuucuggauuuaccucugccauggcuccccggcgcagacacucagggaagcaauuggauccagaaggagacacuugucacguucaagaacccucaugcuaaaaagcaagacgugguaguucugggcucucaggaaggggccaugcacaccgcguugacuggagccacagagauucagauguccucagguaaucuacuguuuaccggccaucucaaaugccgucugcgcauggauaagcuucaacugaaagggaugagcuacaguauguguacaggaaaguucaagaucgugaaagaaauagcagagacucagcacggcaccauugucaucagagugcaguaugagggugacgggucuccaugcaagauccccuucgaaauuauggauuuggagaaaaggcauguccucggccggcugaucacggugaacccgauuguuaccgaaaaggacuccccugugaacauagaggcugaacccccauuuggagauagcuacaucauuguaggcgucgagccugggcaguuaaaacugaauugguucaagaagggaucgucuaucggucaaauguuugagacaacuaugcgaggcgccaaacgcauggcuauccuaggggacaccgccugggauuucggaucccucggcgguguguuuacaucaauugggaaggcacugcaccagguuuucggcgccauauacggagcugcguuuaacggcgugaguuggacuaugaaaauccuuauuggggucaucauuaccuggaucggaaugaauagcagauccacgucuuugagcgugucacugguacucgugggcguugucacacuguaucuuggugcaauggugcaggccgacaguggguguguggucuccuggaagaacaaagaacugaagugcggaagcggcauauucaucaccgauaauguucacacuuggacagagcaguacaaguuucaacccgaaucuccaucaaaauuggcuagugccauucagaaggcacaugaggaagguaucuguggcauuaggagcgugacccggcucgagaaccugauguggaaacagaucacucccgaguuaaaucacauacuguccgaaaacgaggugaagcuaaccauuaugacaggggacaucaaaggaauuaugcaggccggcaagcgcucucucagaccucaaccaacggaacugaaauauucguggaagaccugggggaaggcuaaaaugcuuccgacugagagccauaaucagacauucuugaucgauggacccgaaaccgccgagugcccuaacgcaaauagggcguggaacucccuggagguagaagacuacggcuuuggugucuucacaacuaauauauggcucaagcugcgugagaaacaggacguguuuugugauucaaaguuaaugagugcugccaucaaagacaaccgggcaguucacgccgauaugggguauuggauugaaucugcucugaaugacaccuggaagauggagaaggccagcuucaucgaggugaaauccugccacuggccaaagucacauacgcuuuggagcaacggagucuuggaaucugagaugauuauccccaaaaacuucgcaggcccugugucccagcacaauuaccgaccagguuaucauacacaaaccgcuggccccuggcaccucgggaagcuggaaauggauuuugacuucugugagggaacuaccguugugguaacagaagauugcggcaacagagggccgagucuaaggacuaccacagccagcggaaaacugauaacggaguggugcugucgcucuugcacccucccuccacugcgguacagaggcgaggacgguuguugguacgggauggaaauuaggccccuuaaggagaaggaagagaauuuggucaacucccuggugacugcgggacauggccagaucgauaauuuuucauuaggugugcucggcauggcccuguuccuugaagagaugcugcgcacacgagucgggaccaaacacgcuaucuugcucguugcagugagucugguaacucuaauuacaggaaacaugagcuuucgggaccugggccgugugauggucauggugggggccaccaugacggaugacaucggaaugggcguuacuuaucucgcucugcuugccgcauucaaggugagaccuaccuuugcggccgguuugcuguuaaggaaacucacaucgaaggagcugaugauggcuaccauuggggucgcccuucugucccagucuacuauacccgaaacaauccuagagcucaccgaugcacuggcuuugggaaugauggcccugaaagugguuaagaauauggaaaaguaccaauuagcagugacaauuauggccaucagcugcgucccaaacgcuguaauucuccagaaugcguggaaagugucauguacuauccuggccgcaguuaguguguccccucuucuguugaccucuagccagcagaaggcugacuggauaccccucgcccugacgaucaaaggccuaaacccaacagccauuuuccugaccacucuuucccgcaccucaaagaaacggagcuggccgcucaaugaggcugucauggcagugggcaugguaaguauccuggccucuuccuugcugaagaacgacauuccuaugacagggcccuuaguggcgggaggucuccugacugucugcuauguucuuaccggcagaagcgcugaucuggaauuggagagggccgcagacgugaaaugggaggaucaagccgaaaucucggggucaucuccaauacucaguauuacgaucuccgaggacggaagcaugucuaucaagaaugaagaggaggaacagacacugaccauucuaauacgaacuggccugcuugugaucagcggugucuuucccguguccauuccuaucacagcugcagccugguaccucugggagguuaagaaacagcgcgcggggguacugugggaugugccaucacccccuccggucgaaaaggcugaguuggaagacggagccuaucggauuaaacagagaggcaucuuaggcuacagucaaauaggggcaggaguguauaaggaggguaccuuccacacuauguggcauguuacaaggggcgccgugcugaugcaccgugggaaacgcaucgagccaagcugggcugaugucaagaaggaccucgugucuuacggaggcgguuggaaacuggaaggggaguggaaggaaggagaggaaguacagguccuugcccuggagcccggcaaaaacccucgggcagugcagaccaagccaggcauuuuuaaaacgaauacugggaccaucggagcuguuuccuuggauuucucacccgguacaaguggcagcccuauuguggacagaaaggggaaggucgugggacuauacggcaacgguguugugaccagguccggggccuaugucucugcgaucgcccagacagagaaaucgauagaagauaacccggagauugaagacgauaucuuucgaaagaaacggcugacuaucauggaccuccaucccggagcaggcaagaccaaacgcuaccugccagcuauugugagagaggccaucaagaggggccuucggacguuaauacuggcuccuacacgaguaguggcagccgaaauggaggaggcccucagaggguugcccauucgcuaucaaacuccagcuaucagggcggaacacaccggacgugagauuguugaccugaugugucaugcaacauucaccaugcggcuccugagcccugucagagugcccaauuacaaccuuaucauaauggaugaagcccacuucacugacccagcuucaauugccgcaagggguuauaucuccacccgcguggagaugggcgaggccgcugggaucuuuaugacagcgacgccgccuggaagucgagaucccuucccacagucuaaugcccccauuauggacgaagagagagaaaucccugagcggagcuggaacuccggccacgaaugggucacugauuuuaaggguaaaaccguaugguucgugccaucaauuaaggcagggaaugacauagcugccugccugaggaaaaacggaaagaaaguuauccaguugucucgcaagacauuugauagcgaguacgugaagacccguaguaaugacugggauuucgucgugacuacagacauuuccgagaugggcgcaaacuuuaaagccgaaagaguuaucgauccccggagguguaugaagccugugauccuaaccgacggcgaggaacgcgucauucuggcugggccgaugccagugacgcauagcucugccgcgcaacgaagaggacggauagguaggaaucccaaaaacgagaaugaccaguauaucuacaugggcgaaccucucgagaacgaugaggacugcgcacacuggaaggaagccaaaauguuacuggauaauauuaacacucccgaggggaucauuccaucaauguucgaaccugagcgcgaaaagguagacgcuaucgauggagaguacagacuuaggggcgaggcccggaaaacauuuguggaccugaugcgucgcggugaucuccccguuugguuggcuuauaaggucgcagccgaagggauaaauuacgcugaccgaagaugguguuucgauggcaucaagaacaaccagauucuggaggaaaauguggagguggagaucuggaccaaagaaggagagaggaagaaacucaagccacgguggcuggacgcccgcauuuauuccgauccucuugcacuaaaagaauuuaaggaguucgcggccggcagaaagagucugaccuugaacuuaaucacugaaauggggaggcugccgacauucaugacccagaaagcucggaaugcccucgacaaccuggcaguccuucauacagcugaggccggagguaaggcauacaaucacgcccugagcgagcuccccgaaacuuuggagacgcugcuacugcucgcucuucuggcgaccguuacaggcgggauauuuuuauucuugaugucgggaaaaggcauugguaagaugacucuggggaugugcugcaucauuaccgccucuauccuccugugguaugcacaaauacagccacacuggaucgcugccuccauuauccuugaauuuuuccugauugugcucuugaucccugagcccgaaaaacagcgaacaccacaggauaaccaacugaccuacguagugauagccauuuuaacugucguggcagcuacgauggccaaugagaugggcuuucuagagaagaccaagaaagaccugggacucggcagcaucacaacucaggaaucagagaguaacauccuugacauugaucugagaccugcgucugcuuggaccuuguaugccguugcaacaaccuucgugacucccaugcugcgccauuccaucgaaaauagcucagucaacguaagucucacagccauagcuaaucaggcaacggugcugauggggcuuggaaaggguuggccgcucagcaaaauggacauuggcguuccacuguuggccaucggguguuacucccaggugaacccuauuacccugacugcggcuuuacuacugcucgucgcccacuacgcaaucauaggacccggccuucaagccaaggcuacaagggaggcccagaaacgggcagcugccgguaucaugaagaauccaaccguggaugggauuaccgucaucgaccuggaacccauuccuuaugauccgaaguuugagaaacaguugggccaggugaugcugcucauccugugcguuacacaagugcuuaugaugcguacuacgugggcguuaugugaggcccugacccucgcaacaggacccauuucuacuuugugggaaggcaacccagggagauucuggaauaccacaaucgcuguaagcauggccaacauauuuaggggauccuaccuggcaggcgcuggucuacuguucucagugaugaagaauaccacuaacacgcgccgggggacaggaaacauuggcgagacccucggugaaaaauggaagucucgacuuaaugcccugggcaaaagugaguuucagaucuauaagaaaucggggauccaggaggucgacagaacuuuggccaaggaaggaauuaagaggggcgagaccgaucaucacgcgguuagccgcggguccgcuaaacugcggugguucguggaaagaaacauggucacaccugagggaaaggugguagaccucggcugcggucgugggggauggucuuacuauuguggcggucugaaaaaugugagggaaguuaagggcuuaacucgggggggacccggccaugaggagccuauaccaaugucaaccuacggguggaaccuugugcgccugcaaagcggagucgauguguuuuucacacccccugaaaaaugcgacacgcuccuaugugauaucggcgaguccaguccaaaucccaccauugaagcaggucgaacucugagagucuugaaccugguggagaauuggcucaacaauaacacacaguucugcaucaagguucuuaauccguauaugccuucuguaauugaaaagauggagacccugcagaggacuuacgggggagccuuggugcggaacccacugagccgcaauucaacacacgagauguacugggucuccaacgcuaccggcaauaucgugaguagcguuaacaugauaucuagaaugcucaucaacagguuuacgaugaaacacaagaaagccaccuaugaacccgacguggauuuaggcuccgggacacgaaauauuggaaucgagucagaaauuccuaaccuggacaucauagguaagcggauugagaaaaucaagcaggaacaugagacuagcuggcacuacgaccaagaucauccauauaagaccugggcauaccacggcucguaugagacaaaacagacugggucugccaguuccauggucaauggagugguacgucuucugaccaagcccugggacgugguuccgauggucacacagauggcuaugaccgauacuacgccuuucggccagcaaagaguguuuaaagaaaagguggacacacgcacccaggagcccaaagaagguacuaagaagcuaaugaaaaucaccgcggaguggcucuggaaggagcuggggaaaaagaaaacaccaaggauguguacgcgggaagaguucaccagaaagguccgcagcaacgccgcauugggagcuauuuuuacugaugaaaauaaauggaagucagccagggaggcaguugaagacggccgauucugggagcugguggaucgggagagaaaccuccaccuugaaggcaagugcgagacauguguauacaauaugauggggaaaagggaaaagaaacugggagaguuugguaaggccaaaggcucccgcgcuauaugguauaugugguuaggggcccguuuccuggaauuugaggcguugggauuccucaacgaggaccauugguuuucucggggcaauagccugagugguguggaaggggagggacuacacagacuuggcuacauccugagggaugucucccgcaaggaaggcggggcaauguacgccgacgauaccgcuggaugggacacucgaauuacacucgaggaccugaagaacgaagagauggugaccaaucauaugaaaggugagcacaagaaauuggccgaagcaaucuucaagcugacauaucagaacaaaguugugcggguccagagaccuacucccaggggcaccgugauggauauuaucagccgcagagaccaacgggggucuggacagguaggcacguacggucucaauaccuuuacaaacauggaggcucagcuuauaaggcaaauggaaggggagggaaucuucaagucaauucagcaucugacuguuaccgaggaaaucgccgugcagaauugguuagcucgugucggccgagagcgccugacaagaauggccauuaguggcgaugacugcguggugaagccaaucgaugaccgguucgcaaacgcguugacugcccucaacgauauggggaaagucaggaaggacauucagcaaugggaacccucccgcggauggaaugauuggacccagguuccuuuuugcagccaccacuuccaugagcuggugaugaaagacgguagaguacuaguggucccaugucggaaccaggaugaacuuauaggcagggcucgaaucucucagggggccggauggucgcugaaggagacggcaugccucggcaaaucauaugcucaaauguggacacugauguacuuucaccguagagacuugcgcuuagccgcaaaugccauuuguagcgcggugccgucccauuggguucccaccagucggacuacauggucuauccacgcuaagcacgaguggaugaccacugaagauaugcuggccguguggaacagggucuggauccaggagaauccuuggauggaagacaagaccccaguggagagcugggaagagguacccuaucucgguaaaagagaggaccaguggugcgggucccuuauuggacugacaucacgcgcaacgugggccaagaacauacagaccgcuaucaaucaaguucggagucuaauuggcaacgaagaguacacugauuauaugccuucuaugaaaagguuccgaagagaagaggaagaggccggcgugcugugguga

SEQ ID NO: 14373 - RNA, 9876 nt, Artificial Sequence
  derived and/or modified CDS sequence (opt3) from DENV-2__FJ850091__SS-prME
accgccggcgugaucgucaugcugauucccacagcuauggcauuccaccucacuacgagaaacggggagccucauaugauaguuggaaggcaggaaaaggguaaaagccuucuguuuaagaccgaggacggcgugaauaugugcacauugauggccauggauuuaggggaacugugugaggacacuaucaccuacaaaugcccacuacuccggcaaaacgaaccggaggauauugacuguuggugcaauuccacaucuaccuggguaacuuauggaacauguaccacgacuggcgagcaccgccgagaaaagcguucaguggcgcuggucccccauguggguauggggcuugagaccagaacagaaacuuggaugaguagcgagggagcuuggaaacacguucagaggaucgagaccuggauucugcggcauccuggcuucacaaucauggccgcaauauuggccuacaccaucggcacgacucacuuucagcgcgcucucauuuucauccugcugacagcaguggccccauccaugaccaugagaugcauugggaucucuaacagggauuuugucgaaggagugucggguggcucauggguagacauaguucucgagcacgggagcugugugacuacaauggcuaagaauaagcccaccuuagauuucgaacugauuaaaacggaggccaagcagccugcgacccuucggaaauauugcaucgaagcaaaguugacaaacacuaccacagagagucgcuguccaacucaaggagagcccucccugaaugaagagcaggacaaacgauuuauuugcaagcauucuauggucgauagaggcugggguaacggguguggacuauucggcaagggcgggaucgugaccugcgccauguuuacaugcaaaaagaauauggaaggaaaaaucgugcagccugagaaccucgaauacaccauugucauaacuccacacagcggugaggagcaugcuguuggcaaugacacggggaagcacggaaaagaaaucaagauuacaccgcaguccucaaccacugaggccgaacugaccggcuaugguacagugaccauggaguguagucccaggacugggcuugauuucaacgaaaugguacuguugcaaauggaggacaaagcauggcucgugcaccggcagugguuucuggauuuaccucugccauggcuccccggcgcugacacacagggaagcaauuggauccagaaggagacgcuugucaccuucaagaacccucaugccaaaaagcaagacgugguugugcugggcucucaggaaggggcgaugcacacugccuugacaggagcaaccgagauacagauguccucagguaaucuacuguuuacaggccaucucaaaugccgucugcgcauggauaagcuucaacugaaagggaugagcuacaguauguguacuggaaaguucaagauugucaaagaaaucgcugagacccagcacggcacgaucgugauuagaguacaguaugagggugacgggucuccaugcaagauccccuucgaaauuaccgauuuggagaaaaggcauguucucggccggcugauaacagugaacccgaucgucacugaaaaggacuccccugugaacauugaggccgaacccccauuuggagauagcuacaucaucgucggcguggagccugggcaguuaaaacugaauugguucaagaagggaucgucuauuggucaaauguuugagaccacaaugcgaggcgcuaaacgcauggccauacuaggggacacugcaugggauuucggaucccucggcgguguuuuuaccucaaucgggaaggcccugcaccagguguucggcgcuauuuacggagcggcauuuaguggcguaagcuggacgaugaaaauccuuauuggggucaucauaacauggaucggaaugaacuccagaucuaccagcuugucagugagucugguucucgugggcgucgugacucuguaucuuggugccaugguacaggcugacuccggguguauugugagcuggaagaauaaagaacugaagugcggaucuggcaucuucauuacagauaacguucacaccuggacugagcaguacaaguuucaacccgaaucaccaaguaaauuggccagcgcaauccagaaggcccaugaggaagguauauguggcauuagguccgucacccggcucgagaaucugauguggaaacagaucacacccgaguuaaaccacauucugucugaaaaugaggugaagcuaacgaucaugaccggggacauaaaaggaaucaugcaggcuggcaagcgcucgcucagaccucaaccaacugaacugaaauauagcuggaagacaugggggaaggccaaaaugcuuuccaccgagucacauaaccagacauucuugauugauggaccggaaacugcagagugccccaauaccaacagggcguggaauagucuggagguggaagacuacggcuuuggugucuucacgacaaacaucuggcucaagcugcgugagaaacaggacguuuuuugugauucuaaguuaaugagcgcugccauuaaagacaaucgggcagugcacgccgauaugggguauuggaucgaauccgcucugaacgacaccuggaagauggagaaggccucauucauagaggugaaaagcugccacuggccuaagucucauacucuuugguccaauggaguauuggaaagugagaugauuaucccaaaaaacuucgcaggccccgucagccagcacaacuaccgaccugguuaucauacccaaacagcuggcccauggcaccucgggaagcuggaaauggauuuugacuucugugagggaacuaccgugguugugacagaagauugcggcaauagagggcccucucuaaggacgaccacugccuccggaaaacugaucacagaguggugcugucgcucaugcacccucccgccucugcgguacagaggcgaggacgguuguugguacgggauggaaauuaggccacuuaaggagaaggaagagaacuuggucaauagucuggugacugcgggacauggccagaucgauaacuuuagcuuagguguucucggcauggcccuguuccuugaagagaugcugcgcacacgaguggggaccaaacacgcuauuuugcucguagcacugucguuugucacgcuaauaacuggaaauauguccuuccgggaccugggccgugugauggugauggucggggccaccaugacagaugacaucggaaugggcguuaccuaucucgcucugcuugccgcauuuaaggugagacccacuuucgcggccgguuugcuguuaaggaaacucacaucuaaggagcugaugauggcuaccauugggaucgcccuucugagccagucaacacuaccugaaacuauucucgagcugaccgaugcauuggcucugggaaugauggccuuaaaaaucguacgcaacauggaaaaguaccaacucgcagugacgauaauggccaucaguugcguccccaaugcugugauucugcagaacgcguggaagguuuccuguacaauccuugccgcagugucugucagcccacuguugcucaccuccucacagcagaaagcugacuggauuccucuggcccuaacuaucaagggccugaaucccaccgccauauuucuuacaacucucagccggaccaguaaaaagagaucuuggccacugaacgaggcuauuauggcagugggcaugguuuccaucuuggccagcucgcuguuaaaaaaugacaucccgaugacggggccucucguggcgggaggucugcuuacagucugcuauguacugaccggcagggcugccgauuuggaacucgagcgagcagccgacgugaagugggaggaucaagcugaaauuucagggucuagucccauacuguccaucacuauuagcgaggacggaucuaugagcaucaaaaacgaagaggaggaacagacacuaaccauucugauccgcacuggccuucucguuauauccgguguguucccagucucaauccccauuacagcagccgcgugguaccugugggaggugaagaagcagcgggcugggguauugugggaugugccuaguccacccccugucggaaaagccgaauuagaggacggcgcauauagaaucaagcagaggggcauucugggguacagccaaaucggagccgguguuuauaaagaaggcaccuuucacacgauguggcaugugacucguggggcugugcucaugcaccgcggaaagcggauagagccgucuugggccgaugucaaaaaggaccugauuuccuacggcgguggguggaagcuugagggagaauggaaagagggcgaagaggugcagguucuggcauuggaaccaggcaagaaucccagagcuguacagaccaaaccugggaucuucaagacaaacaccggaacaaucggugccgugucacuagauuuuaguccaggcacuagcgggucccccauugucgacaggaaaggaaaggugguuggccuguacgguaaugggguggucacccgaucuggagcguaugugucggccaucgcacagacggagaagagcauagaggauaacccugaaauugaggacgauaucuuccggaaaaagcgccucacaauuauggaccugcauccgggcgcuggcaaaacuaagagauaccuucccgccaucguaagggaagcuauaaaacggggguuacgaacccugauucucgcaccaacaagagucguggccgccgagauggaagaggcuuugcgcggacugccuaucagguaucaaacccccgcgauccgugcagagcacacuggucgggaaauuguugaccucaugugucaugccaccuucacaaugagacugcuuucaccagugagggucccuaacuacaaucugaucauuauggaugaggcucacuuuacggaccccgccuccauagcagcccgcggcuauaucaguacucgaguggaaaugggggaggcugcgggaauuuucaugaccgccacaccaccgggcucuagagauccuuuuccccagagcaacgcaccaaucauggacgaggaacgggagauccccgaaagguccuggaauucaggucacgaguggguuaccgauuucaaggggaagacugugugguuugucccuucuauuaaagcuggaaacgacauagccgcaugcuugcgcaagaauggcaaaaaggugauccagcuaagccguaaaacauucgauagugaauacgccaagaccagagcuaacgacugggauuuuguagugacgacugacauuuccgagaugggcgccaauuucaaggcggagcggguuaucgauccaaggcgcuguaugaaacccgucauucugacagacggggaagagcgagugauccucgcaggaccuaugccggugacccauagcucugccgcucaaagacgggguaggauaggccgcaacccaaagaaugaaaacgaccaguauaucuacaugggggagcccuuagaaaaugaugaggacugcgcccacuggaaagaggcuaagaugcugcuugauaacauuaauaccccugaaggaaucauucccucaauguuugagccagaaagagagaaagucgacgcaaucgauggcgaauacaggcugcggggugaggcccguaagacuuucguagaccucaugcgccgaggggauuugccuguguggcuggcuuauaaaguugccgcagagggcauaaacuacgcggacagaaagugguguuuugauggaauuaagaauaaccagauccucgaagagaacguggaagucgagauuuggacaaaagagggcgaaaggaagaaacugaagccccgguggcuugacgcccgcaucuauuccgauccacuagcucugaaagaguucaaggaauucgccgcagggagaaagaguuugaccuuaaaucugauaacagagaugggaaggcucccuacuuuuaugacgcagaaagcucggaacgcccuggacaaucuugcagugcugcauaccgccgaaguugguggcaaggcuuacacacacgcgcucagcgaguugccggagacucuggaaacccuacugcuccuuacacuguuagccgcagugaccgggggaaucuucuuguuucugaugucgggcaaagguauugggaagaugacucucggcaugugcugcaucauuacggcuucuauccugcuuugguaugcccaaauacagccccacuggauugccgcauccaucauccuggaguucuuucucauugucuugcugaucccagaaccugagaaacagcgaaccccccaggauaaccaauuaacauacgugguaauagcuauucuaacugugguugccgcgaccauggcuaaugaaaugggauuccuggagaagacaaagaaagaccucggcuuugggagcaucaccacucaggagucagaaaguaacauucuugacaucgaucugagaccagccucugcauggacauuguaugccgucgcuacgaccuucgugacuccuaugcugcgccauuccauagagaauagcucagugaacgucagucucacagcaaucgccaaucaggcgaccguucugaugggacuugguaagggcuggccccucagcaaaauggacauuggggugccgcuguuggcuaucggauguuacucccagguaaacccaauuacccugacagccgcauuacuacugcucguggcccacuacgcuaucauuggcccuggucuucaagccaaggcaacuagggaagcucagaaacgggccgcggccgggaucaugaagaaucccacggucgauggcauaaccgugauugaccuggagccaauccccuaugauccuaaguuugaaaaacaguugggacagguuaugcugcucauccugugcgugacacaaguccuuaugaugcguacuaccugggcauuaugugaggcucugacacucgccaccggcccgauuucuacuuugugggaggggaaccccggaagauucuggaauacgacaauagcaguaagcauggcuaacaucuuuaggggcuccuaccuggccggugccgggcuacuguucucaauuaugaagaauaccacuaacacccgccggggaacaggcaaugugggugaaacucucggcgagaaauggaagucucgacuuaacgcgcuggggaaaagugaauuucagaucuauaagaaaucgggaauucaggagguugacagaaccuuggcuaaggagggcaucaagaggggggaaacagaucaucacgcagugagccgcggauccgccaaacugcggugguucgucgagagaaacauggugacgccagaaggcaaggucguggaccucgguugcgggcguggaggcuggucuuacuauugugguggccugaaaaauguuagggaggugaagggguuaaccaaaggaggcccugggcaugaagagcccauaccuaugucaacuuacggauggaaccuuguacggcugcaaagcggcguggaugucuucuuuacaccacccgagaagugcgacacccuccuaugugauaucggugaauccaguccuaauccaacuauugaggcugggcgcacacugcgaguuuugaaccugguggaaaauuggcucaacaauaacacccaguucugcaucaagguccuuaaucccuauaugccgucugugauugagaaaauggaaacgcugcagagaaaguacggaggcgccuugguaaggaacccucugagccggaauucaacccacgagauguacuggguguccaacgcaacaggcaauaucguuaguagcgugaacaugauaucucgcaugcucauuaauagauuuacuaugaaacacaagaaagccaccuaugagccagacgucgauuuaggguccggaacaaggaacaucgguaucgaaucagagauucccaaccuggacauaaucggcaagcgaauugaaaagaucaaacaggagcaugaaacuagcuggcacuacgaccaagaucauccuuauaagaccugggcuuaccacgggucguaugagacaaaacagaccggaucugcgaguuccauggugaauggcgucgugcggcuucugacuaagccaugggacguuguacccauggugacgcagauggccaugacagauaccacuccguucggucagcaacgugucuuuaaagagaagguggacaccagaacacaggaaccuaaggaggggacgaaaaagcuaaugaaaauuaccgcagaauggcucuggaaggagcugggaaaagagaagacuccccgcauguguacaagggaagaguucacccggaaaguuagaagcaacgcugccuugggcgcaguguuuacugaugaaaauaaguggaagucagcccgcgaggcugucgaagacggcagguucugggagcugguggaucgagagcggaaccuccaccuugaagggaaaugcgagacauguguauacaauaugaugggaaagagagaaaaaaagcugggugaguuuggcaaagccaagggguccagggcgaucugguauaugugguuaggagcacgcuuccuggaauuugaggccuugggcuuccucaacgaggaccauugguuuucucgugguaauagccugagugggguggaaggagagggccuacaccggcuuggcuacauacugagagaaguugggaagaaagagggaggugcuauguacgccgaugacaccgcaggcugggauacaaggaucacucucgaagaccugaagaacgaggagauggucaccaaucauaugaaaggggaacacaagaaauuggcugaggccauuuucaagcugacguaucagaacaagguggugcgcguccagcgaccaaccccucggggaacaguuauggacaucauuuccagaaaagaucaaaggggcagcggucagguggggacuuacggacucaauaccuucacaaacauggaagcucagcuuauccgccaaauggagggcgagggcauuuuuaagucuauacagcaucugacugccaccgaagagaucgcaguacagaauugguuagcgagaguggggcgggaaaggcugucacguauggccauuaguggagacgauugcgucgugaaacccaucgacgaucgauucgcuuccgccuugacggcacucaacgacauggguaagguucgcaaagauauccagcaaugggagccaagcagaggcuggaaugacuggacacaggugcccuuuugcucucaccacuuccaugaacuggucaugaaggaugggcgggugcuaguaguuccuuguaggaaccaggacgagcuuauuggacgcgcuagaauaucgcagggcgccgguuggucacugaaggagaccgcaugccucgggaaaagcuaugcccaaauguggacucugauguacuuucaccggagggauuugcgauuagcggcuaacgccaucuguuccgcagugccaagucauugggucccgacaucucguaccacuuggagcauucacgccaagcacgaauggaugaccacagaggacaugcuggcuguguggaauagaguguggauccaggaaaaccccuggauggaggauaaaacgccugucgaauccugggaggagguuccauaucucggaaagcgcgaagaccaguggugcggcucacuuauuggccugaccagucgggccacuugggcaaaaaauauccagacagcuauaaaccaagugaggucucuaaucgggaaugagggauacaccgacuauaugcccagcaugaagagauuccgccgggaagaggaagaggccgguguacugugguga

SEQ ID NO: 14374 - RNA, 9876 nt, Artificial Sequence
  derived and/or modified CDS sequence (opt3) from DENV-2__GQ199890__SS-prME
accgccggcgugaucgucaugcugauucccacugcuauggcauuccaccucacuacgagaaacggggagccucauaugauaguuggaaggcaggaaaaggguaaaagccuucuguuuaagaccgaggacggcgugaauaugugcacauugauggccaucgauuuaggggaacugugugaggacacuauuaccuacaaaugcccauuacuccggcaaaacgaaccggaggauaucgacuguuggugcaauuccacaucuaccuggguuacuuauggaacauguaccacgauuggcgagcaccgccgagaaaagcguucaguggcgcuggucccccauguggguauggggcuugagacuagaaccgaaacauggaugaguagcgagggagcuuggaaacacguucagaggaucgagacuuggauacugcggcauccuggcuucaccaucauggccgcaauuuuggccuacacaaucggcaccacgcacuuucagcgcgcucucauuuucauccugcugacugcaguggccccauccaugacaaugagaugcauagggauuucuaacagggauuuugucgaaggagugucggguggcucauggguagacaucguucucgagcacgggagcugugugaccacuauggcuaagaauaagcccacauuagauuucgaacugauuaaaaccgaggccaagcagccugcgacgcuucggaaauauugcaucgaagcaaaguugaccaacacaacuaccgagagucgcuguccaacacaaggagagcccucccugaaugaagaacaggacaaacgauuuaucugcaagcauucuauggucgauagaggcugggguaacggguguggacuauucggcaagggcgggauugugacuugcgccauguuuaccugcaaaaagaauauggaaggaaaaauagugcagccugagaaccucgaauacacaaucgucauuaccccacacagcggugaggagagggcuguuggcaaugacacugggaagcauggaaaagaaaucaagauaacgccgcaguccucaacaaccgaggccgaacugacuggcuaugguaccgugacaauggaguguaguccccggaccgggcuugauuucaacgaaaugguacuguugcaaauggaggacaaagcauggcucgugcaccgucagugguuucuggauuuaccucugccauggcuccccggcgcugacacucagggaagcaauuggauucagaaggagacacuugucacguucaagaacccucacgccaaaaagcaagacgugguugugcugggcucucaggaaggggcgaugcauaccgccuugacuggagcaacagagauccagauguccucagguaaucuacuguuuaccggccaccucaaaugccgccugagaauggauaaacuucaacugaaagggaugagcuacaguauguguacaggaaaguucaagaucgucaaagaaauugcugagacucagcauggcaccaucgugauuaggguacaguaugagggugacgggucuccaugcaagauacccuucgaaaucacggauuuggagaaacggcacguucucggccgacugauuaccgugaacccgaucgucacagaaaaggacuccccugugaacaucgaggccgaacccccauuuggagauagcuacauuauagucggcguggagccugggcaguuaaaacugaauugguucaagaagggaucgucuaucggucaaauguuugagacuaccaugcgcggcgcuaaaagaauggccauucuaggggacacagcaugggauuucggaucccucggcgguguuuuuacuucaaucgggaaggcccugcaucagguguucggcgcuauuuacggagcggcauuuaguggcguaagcuggaccaugaaaauccuuauaggggucaucauuacguggaucggaaugaacuccaggucuacuagcuugucagugagucugguucucgugggcgucgugacccuguaucuuggugccaugguacaggcugacuccggguguauugugagcuggaagaauaaagaacugaagugcggaucuggcaucuucauaacugauaacguucacacauggaccgagcaguacaaguuucaacccgaaucaccaaguaaauuggccagcgcaauucagaaggcccacgaggaagguaucuguggcauucgguccgucacucgccucgagaaucugauguggaaacagaucacccccgaguuaaaccauauacugucugaaaaugaggugaagcuaacaaucaugacgggggacauuaaaggaaucaugcaggcuggcaagagaucgcucaggccucaaccaaccgaacugaaauauagcuggaagacuugggggaaggccaaaaugcuuuccacagagucacacaaccagaccuucuugauugauggaccggaaacagcagagugccccaauacuaaccgugcguggaauagucuggagguggaagacuacggcuuuggugucuucaccacgaacaucuggcucaagcugcgggagaaacaggacguauuuugugauucuaaguuaaugagcgcugccauaaaagacaaucgagcagugcaugccgauaugggguauuggauugaauccgcucugaacgacacauggaagauggagaaggccucauucaucgaggugaaaagcugccacuggccuaagucucacacccuuugguccaauggaguauuggaaagugagaugaucauucccaagaauuucgcaggccccgucagccagcauaacuacagaccugguuaucacacucaaaccgcuggcccauggcaucucgggaagcuggaaauggauuuugacuucugugagggaacaacugugguugugaccgaagauugcggcaauagggggcccucucuacgcacaacgaccgccuccggaaaacugaucacugaguggugcugucggucaugcacacucccgccucugagauacaggggcgaggacgguuguugguacgggauggaaauucgcccacuuaaggagaaggaagagaacuuggucaauagucuggugaccgcgggacacggccagauagauaacuuuagcuuagguguucucggcauggcccuguuccuugaagagaugcugcgaacucggguggggacaaaacaugcuaucuugcucguagcacugucguuugucacccuaauuacgggaaauauguccuuccgugaccugggcagagugauggugauggucggggccacuaugaccgaugacaucggaaugggcguuacauaucucgcucugcuugccgcauuuaaggugaggcccaccuucgcggccgguuugcuguuacgcaaacucacuucuaaggagcugaugauggcuacaauugggaucgcccuucugagccagucaacccuaccugaaacaauacucgagcugacugaugcauuggcucugggaaugauggccuuaaaaaucguacggaacauggaaaaguaccaacucgcagugaccauuauggccaucaguugcguccccaaugcugugauucugcagaacgcguggaagguuuccuguacgauccuugccgcagugucugucagcccacuguugcucacauccucacagcagaaagcugacuggauaccucuggcccuaaccauuaagggccugaaucccacugccaucuuucuuaccacacucagcagaacaaguaaaaagaggucuuggccacugaacgaggcuaucauggcagugggcaugguuuccauuuuggccagcucgcugcuaaagaaugacauaccgaugaccgggccucucguggcgggaggucugcuuacggucugcuauguacugacaggccgaucagcugauuuggaacucgagcgcgccgcagacgugaagugggaggaucaagccgaaaucucugggaguucccccauucugagcaucaccauuucugaggacggaagcauguccaucaaaaacgaagaggaggaacagacucuaacaauacugauccggaccggccuucucguuauuucagguguguucccagucaguauccccauuacugcugcagccugguaccugugggaggugaagaagcagagagcggggguauugugggaugugccuagcccacccccugucggaaaagcugaauuagaggacggcgccuauaggaucaagcagcguggcauacugggguacucucaaauuggagccgguguuuauaaagaaggcacauuucacaccauguggcacgugacgcgcggggcagugcucaugcaucggggaaagagaaucgagccguccugggcugaugucaaaaaggaccugaucucauacggcgguggguggaaacuugagggagaauggaaagagggcgaagaggugcagguucuggccuuggaaccaggcaagaaucccagggcaguacagacuaaaccugggauuuucaagaccaacacaggaaccaucggugcugugagucuagauuuuagcccaggcacauccgggucucccauagucgaccgaaaaggaaaggugguuggccuguacgguaaugggguggucacucggucgggagccuaugugagcgcgauugcccagaccgagaagucaaucgaggauaacccugaaauugaggacgauaucuuccgcaaaaagagacucacgauaauggaccugcacccgggcgcaggcaaaacaaagagguaccuucccgcuauuguacgggaagccaucaaacgaggguuaagaacucugauccucgcuccaacccgcgucguggcagccgagauggaagaggccuugaggggacugccuauucguuaucaaacacccgcuauccgggcggagcauaccgguagagaaauuguugaccucaugugucacgcaacuuucaccaugaggcugcuuuccccagugcgcgucccuaacuacaaucugauaaucauggaugaggcccauuuuacagaccccgcuaguauugccgcacgaggcuauaucucuacgagaguggaaaugggggaggccgcuggaaucuucaugacugcgaccccaccgggcagccgggauccuuuuccccaguccaacgccccaauuauggacgaggaaagggagauacccgaacgcucauggaacucuggucacgaguggguuacagauuucaaggggaagaccgugugguuugucccuagcaucaaagcaggaaacgacauugcugccugcuugcguaagaauggcaaaaaggugauccagcuaaguagaaaaacuuucgauuccgaauacguaaagacacgggcaaacgacugggauuuugugguuaccacggacauuagcgagaugggcgccaauuucaaggcugagagggucaucgauccacgccgauguaugaaacccgugauacugacugacggggaagagagagugauccucgccggaccuaugccggucacacacucuucagcggcacaacggaggggucgcauuggcagaaacccaaagaaugaaaacgaccaguauaucuacaugggggagcccuuagaaaaugaugaggacugcgcccauuggaaagaggcuaagaugcugcuugauaacauuaauaccccugaaggaaucauacccuccauguuugagccagaaagggagaaaguagacgccauugauggcgaauaccggcugcguggugaggcucgcaagaccuucguggaccucaugcgaagaggggauuugccuguuuggcuggcauauaaaguggccgcugagggcaucaacuacgccgacaggaagugguguuuugauggaauuaagaauaaccagauccucgaagagaacgucgaaguggagauauggacuaaagagggcgaacggaagaaacugaagccccgcuggcuugacgcaagaaucuauagugauccacuagcgcugaaagaguucaaggaguucgccgcugggagaaagagcuugacauuaaaucugauuaccgagaugggacggcucccuacauuuaugacucagaaagcccgaaacgcacuggacaaucuugcuguucugcacacggccgaaguggguggcaaggcauacacccaugcccucucggaguugccggagacacuggaaacucuacugcuccuuacccuguuagcuacaaucaccgggggaauuuucuuguuucugaugucuggcaaagguaucgggaagaugacucucggcaugugcugcauaauuacggcguccauccugcuuugguaugcccaaauccagccccacuggauugcagcuagcaucauacuggaguucuuucucauugucuugcugaucccagaaccugagaaacagagaaccccacaggauaaccaauuaacauacgugguaauugccauccuaacugugguugccgcaaccauggcuaaugaaaugggauuccuggagaagacaaagaaagaccucggcuuugggaccauaacuacacaggagucagaaaguaacauccuugacauugaucugcgcccagccucugcguggacguuguaugcugucgccaccacuuucgugacaccuaugcugaggcacuccaucgagaauagcucagugaacgucagucucaccgcaauugccaaucaggcuaccguucugaugggacuugguaagggcuggccccucagcaaaauggacaucggggugccgcuguuggcaauuggauguuacucccagguaaacccaaucacacugacugccgcguuacuacugcucguggcucauuacgccauaauuggcccuggucuucaagcaaaggccacgcgggaagcucagaaacgugccgcagcugggaucaugaagaaucccaccgucgauggcaucacagugauugaccuggagccaauacccuaugauccuaaguuugaaaaacaguugggacagguuaugcugcucauccugugcgugacucaaguccuuaugaugagaaccacaugggccuuaugugaggcgcugacccucgccacuggcccgauuucuacguugugggaggggaaccccggaagguucuggaauacaaccaucgcaguaagcauggcuaacauuuuucgcggcuccuaccuggccggugcagggcuacuguucucaaucaugaagaauacuaccaacacacggcgaggaacuggcaaugugggugaaacccucggcgagaaauggaagucuagacuuaacgcucuggggaaaagugaauuucagauauauaagaaaucgggaauccaggagguugacaggacauuggccaaggagggcauuaagcgcggggaaacggaucaccaugccgugagccggggauccgcgaaacugagaugguucgucgagcguaacauggugaccccagaaggcaaggucguggaccucgguugcgggaggggaggcuggucuuacuauugugguggccugaaaaauguucgggaggugaagggguuaacuaaaggaggcccugggcacgaagaacccaucccuaugucaacauacggauggaaccuuguacgccugcaaagcggcguggaugucuucuuuaccccacccgagaagugcgacacucuccuaugugauauuggugaauccaguccuaauccaacaaucgaggcugggcgaacccugagaguuuugaaccugguggaaaauuggcucaacaauaacacgcaguucugcauaaagguccuuaaucccuauaugccgucugugauugagaaaauggaaacccugcagaggaaguacggaggcgcauugguacggaacccucugagccgcaauucaacacaugagauguacuggguguccaacgccacuggcaauaucguuaguagcgugaacaugaucucuagaaugcucauuaauagguuuaccaugaaacacaagaaagcuacauaugagccagacgucgauuuaggguccggaacucgaaacauagguaucgaaucagagauucccaaccuggacaucauuggcaagcggaucgaaaagauaaaacaggagcacgaaaccagcuggcauuacgaccaagaucacccuuauaagacaugggccuaccaugggucguaugagaccaaacagacuggaucugcaaguuccauggugaauggcgucgugcgucuucugacgaagccaugggacguuguacccauggugacacagauggccaugaccgauacuaccccguucggucagcaaagagucuuuaaagagaagguggacacacgcacgcaggaaccuaaggaggggaccaaaaagcuaaugaaaaucacugcugaauggcucuggaaggagcugggaaaagagaagacacccaggauguguacccgggaagaguucacuagaaaaguucgcagcaacgcggccuugggcgcaauuuuuacagaugaaaauaaguggaagucagcuagggaggccguggaagacggccgauucugggagcuggucgaucgggagagaaaccuccaccuugaagggaaaugcgagaccuguguguacaauaugaugggaaagagggagaaaaagcugggugaguuuggcaaagcaaaggggucccgcgccaucugguauaugugguuaggagcucguuuccuggaauuugaggccuugggcuuccucaacgaggaccacugguuuucucgggguaauagccugagugggguagaaggagagggccuacauagacuuggcuacauucugagggaaguggggaagaaagagggaggugcgauguacgcagaugacacagccggcugggauacucgcaucacccucgaagaccugaagaacgaggagaugguuacgaaucacaugaaaggggaacauaagaaauuggcugaggccauuuucaagcugaccuaucagaacaaggucgugcgagugcagcggccaacaccuagaggaacugucauggacauaaucuccaggaaagaucaacgcggcagcggucagguugggaccuacggacucaauacauucacuaacauggaagcacagcuuauuagacaaauggagggcgagggcaucuuuaagucuauccagcaccugaccgcuacggaagagauugccgugcagaauugguuagcucggguagggagggaacgucugucacgaauggccauaaguggagacgauugcguggucaaacccaucgacgaucgcuucgcauccgcguugacagcccucaacgacauggguaaggugagaaaagauauucagcaaugggagccaagccggggcuggaaugacuggacccagguucccuuuugcucucaucacuuccacgaacuggugaugaaggaugggaggguccuagugguaccuugucgcaaccaggacgagcuuaucggaagggcucggauuucgcagggcgccgguuggucacugaaggagacugcaugccucgggaaaagcuaugcucaaauguggacacugauguacuuucauaggcgagauuugcguuuagccgcaaacgccaucuguuccgcgguuccaagucacugggugccgaccucuagaacuaccuggagcauacaugcuaagcacgaauggaugacaacggaggacaugcuggccgucuggaaucgcguguggauccaggaaaaccccuggauggaggauaaaaccccuguggaauccugggaggaggucccauaucucggaaagcgggaagaccaguggugcggcucacuuauuggccugacaaguagggcaacaugggccaaaaauauccagaccgcuauuaaccaaguuagaucucuaaucgggaaugagggauacacugacuauaugcccagcaugaagcgcuuccggaaggaagaggaagaggccggugugcugugguga

SEQ ID NO: 14375 - RNA, 9876 nt, Artificial Sequence
  derived and/or modified CDS sequence (opt3) from DENV-2__GQ868549__SS-prME
accgcaggcgugaucguaaugcugauucccacagcuauggcauuccaccucacuacgaggaacggggagccucauaugauaguuggaaggcaggaaaaggguaaaagccuucuguuuaagaccgaggacggcgugaauaugugcacauugauggcaaucgauuuaggggaacugugugaggacacuauuaccuacaaaugcccacuacuccggcaaaacgaaccggaggauaucgacuguuggugcaauuccacaucuaccuggguuacuuauggaacauguaccacgacuggcgagcaccgccgagaaaagcguucaguggcgcuggucccccauguggguauggggcuugagacccggacagaaacuuggaugaguagcgagggagcuuggaaacacguucagaggauugagaccuggauccugcggcauccuggcuucacaauaauggccgcaaucuuggccuacaccauuggcacgacucacuuucagcgcgcucucaucuucauucugcugacagcaguggccccauccaugaccaugagaugcaucgggauaucuaacagggauuuugucgaaggagugucggguggcucauggguagacauuguucucgagcacgggagcugugugacuacaauggcuaagaauaagcccaccuuagauuucgaacugaucaaaacggaggccaagcagccugcgacccuucggaaauauugcauugaagcaaaguugacaaacacuaccacagagagucgcuguccaacucaaggagagcccucccugaaugaggaacaggacaaacgauuuaucugcaagcauucuauggucgauagaggcugggguaacggguguggacuauucggcaagggcgggaucgugaccugcgccauguuuacaugcaaaaagaauauggaaggaaaaauugugcagccugagaaccucgaauacaccauagucaucacuccacacagcggugaggagcaugcuguuggcaaugacacggggaagcacggaaaagaaauuaagaucacaccgcaguccucaaccacugaggccgaacugaccggcuaugguacagugaccauggaguguagucccaggacugggcuugauuucaacgaaaugguacuguugcaaauggaggacaaagcauggcucgugcaccggcagugguuucuggauuuaccucugccauggcuccccggcgcugacacacagggaagcaauuggauacagaaggagacgcuugucaccuucaagaacccucaugccaaaaagcaagacgugguugugcugggcucucaggaaggggcgaugcacacugccuugacaggagcaaccgagauucagauguccucagguaaucuacuguuuacaggccaucucaaaugccgucugcgcauggauaaacuucaacugaaagggaugagcuacaguauguguacuggaaaguucaagaucgucaaagaaaucgcugagacccagcacggcacgauugugaucagaguacaguaugagggugacgggucuccaugcaagauucccuucgaaauaaccgauuuggagaaaaggcauguucucggccggcugaucacagugaacccgauugucacugaaaaggacuccccugugaacaucgaggccgaacccccauuuggagauagcuacaucauugucggcguggagccugggcaguuaaaacugaauugguucaagaagggaucgucuauaggucaaauguuugagaccacaaugcgaggcgcuaaacgcauggccauccuaggggacacugcaugggauuucggaucccucggcgguguuuuuaccucaauugggaaggcccugcaccagguguucggcgcuaucuacggagcggcauuuaguggcguaagcuggacgaugaaaauucuuaucggggucauaaucacauggauuggaaugaacuccagaucuaccagcuugucagugagucugguucucgugggcgucgugacucuguaucuuggugccaugguacaggcugacuccggguguaucgugagcuggaagaauaaagaacugaagugcggaucuggcauuuucaucacagauaacguucacaccuggacugagcaguacaaguuucaacccgaaucaccaaguaaauuggccagcgcaauacagaaggcccaugaggaagguauuuguggcaucagguccgucacccggcucgagaaucugauguggaaacagauuacacccgaguuaaaccacauccugucugaaaaugaggugaagcuaacgauaaugaccggggacaucaaaggaauuaugcaggcuggcaagcgcucgcucagaccucaaccaacugaacugaaauauagcuggaagacaugggggaaggccaaaaugcuuuccaccgagucacauaaccagacauucuugaucgauggaccggaaacugcagagugccccaauaccaacagggcguggaauagucuggagguggaagacuacggcuuuggugucuucacgacaaacauuuggcucaagcugcgugagaaacaggacguauuuugugauucuaaguuaaugagcgcugccaucaaagacaaucgggcagugcacgccgauaugggguauuggauagaauccgcucugaacgacaccuggaagauggagaaggccucauucauugaggugaaaagcugccacuggccuaagucucauacucuuugguccaauggaguauuggaaagugagaugaucauccccaagaauuucgcaggccccgucagccagcacaacuaccgaccugguuaucauacccaaacagcuggcccauggcaccucgggaagcuggaaauggauuuugacuucugugagggaacuaccgugguugugacagaagauugcggcaauagagggcccucucuaaggacgaccacugccuccggaaaacugauuacagaguggugcugucgcucaugcacccucccgccucugcgguacagaggcgaggacgguuguugguacgggauggaaaucaggccacuuaaggagaaggaagagaacuuggucaauagucuggugacugcgggacauggccagauugauaacuuuagcuuagguguucucggcauggcccuguuccuugaagagaugcugcgcacacgaguggggaccaaacacgcuauauugcucguagcacugucguuugucacgcuaaucacuggaaauauguccuuccgggaccugggccgugugauggugauggucggggccaccaugacagaugacauuggaaugggcguuaccuaucucgcucugcuugccgcauuuaaggugagacccacuuucgcggccgguuugcuguuaaggaaacucacaucuaaggagcugaugauggcuaccaucgggauugcccuucugagccagucaacacuaccugaaacuauccucgagcugaccgaugcauuggcucugggaaugauggccuuaaaaauaguacgcaacauggaaaaguaccaacucgcagugacgaucauggccauuaguugcguccccaaugcugugauccugcagaacgcguggaagguuuccuguacaauucuugccgcagugucugucagcccacuguugcucaccuccucacagcagaaagcugacuggaucccucuggcccuaacuauaaagggccugaaucccaccgccauuuuucuuacaacucucagccggaccaguaaaaagagaucuuggccacugaacgaggcuaucauggcagugggcaugguuuccaucuuggccagcucgcugcuaaagaaugacauuccgaugacggggccucucguggcgggaggucugcuuacagucugcuauguacugaccggcaggucagcugauuuggaacucgagcgagccgcagacgugaagugggaggaucaagccgaaauaucugggaguucccccauccugagcauuacuaucucugaggacggaagcauguccauuaaaaacgaagaggaggaacagacacuaaccauccugauacgcacuggccuucucguuaucucagguguguucccagucaguauucccaucacagcugcagccugguaccugugggaggugaagaagcagcgggcggggguauugugggaugugccuagcccacccccugucggaaaagcugaauuagaggacggcgccuauagaauuaagcagaggggcauccugggguacucucaaauaggagccgguguuuauaaagaaggcaccuuucacacgauguggcaugugacucguggggcagugcucaugcaccgcggaaagcggauugagccguccugggcugaugucaaaaaggaccugaucucauacggcgguggguggaaacuugagggagaauggaaagagggcgaagaggugcagguucuggccuuggaaccaggcaagaaucccagagcaguacagaccaaaccugggaucuucaagacaaacaccggaacaauuggugcugugagucuagauuuuagcccaggcacuuccgggucucccaucgucgacaggaaaggaaaggugguuggccuguacgguaaugggguggucacccgaucgggagccuaugugagcgcgauagcccagacggagaagucaauugaggauaacccugaaaucgaggacgauauuuuccggaaaaagcgccucacaaucauggaccugcauccgggcgcaggcaaaacuaagagauaccuucccgcuauaguaagggaagccauuaaacggggguuacgaacccugauccucgcuccaacaagagucguggcagccgagauggaagaggccuugcgcggacugccuaucagguaucaaacccccgcuauucgugcggagcacacuggucgggaaaucguugaccucaugugucaugcaaccuucacaaugagacugcuuuccccagugagggucccuaacuacaaucugauuauaauggaugaggcccacuuuacggaccccgcuaguaucgccgcacgcggcuauauuucuacucgaguggaaaugggggaggccgcuggaaucuucaugaccgcgacaccaccgggcagcagagauccuuuuccccaguccaacgccccaaucauggacgaggaacgggagauucccgaaaggucauggaacucuggucacgaguggguuaccgauuucaaggggaagacugugugguuugucccuagcauaaaagcaggaaacgacaucgcugccugcuugcgcaagaauggcaaaaaggugauucagcuaagucguaaaacauucgauuccgaauacguaaagaccagagcaaacgacugggauuuugugguuacgacugacaucagcgagaugggcgccaauuucaaggcugagcgggucauugauccaaggcgcuguaugaaacccgugauccugacagacggggaagaacgagugauacucgccggaccuaugccggucacccauucuucagcggcacaaagacgggguaggaucggccgcaacccaaagaaugaaaacgaccaguauauuuacaugggggagcccuuagaaaaugaugaggacugcgcccacuggaaagaggcuaagaugcugcuugauaacaucaauaccccugaaggaauuauccccuccauguuugagccagaaagagagaaaguagacgccauagauggcgaauacaggcugcggggugaggcucguaagacuuucguggaccucaugcgccgaggggauuugccuguuuggcuggcauauaaaguggccgcugagggcauuaacuacgccgacagaaagugguguuuugauggaaucaagaauaaccagauucucgaagagaacgucgaaguggagaucuggacaaaagagggcgaaaggaagaaacugaagccccgguggcuugacgcacgcauauauagugauccacuagcgcugaaagaguucaaggaguucgccgcugggagaaagagcuugaccuuaaaucugaucacagagaugggaaggcucccuacuuuuaugacgcagaaagcccggaacgcacuggacaaucuugcuguucugcauaccgccgaaguggguggcaaggcauacacacacgcccucucggaguugccggagacucuggaaacccuacugcuccuuacacuguuagcugcggucaccgggggaauuuucuuguuucugaugucuggcaaagguaucgggaagaugacucucggcaugugcugcauuaucacggccuccauacugcuuugguaugcacaaauucagccccacuggaucgcugccagcaucauucuggaguucuuucucaucguguugcugauaccagaaccugagaaacagcgaaccccacaggauaaccaauuaacauacguagugauugccauccuaacuguugucgcagcuaccauggccaaugaaaugggauuccuggagaagacaaagaaagaccucggcuuugggucaauuaccacucaggagagugaaucuaacauccuugacauagaucugagaccagcguccgcuuggacauuguaugccguggcaacgaccuucgugacuccuaugcugcgccauagcaucgaaaauucaagugucaacguuagccucacagccauugcuaaucaggcaaccgugcugaugggacuugguaagggcuggccccucuccaaaauggacaucgggguaccgcuguuggccauuggauguuacucucaggugaacccaaucacccugacagcggcuuuacuacugcucgucgcccacuacgcaauuaucggcccuggucuucaagccaaggcuacuagggaagcccagaaacgggcagcugccgggauaaugaagaaucccacgguggauggcauuaccguuaucgaccuggagccaauccccuaugauccuaaguuugaaaaacaguugggacaggugaugcugcucauucugugcgucacacaaguacuuaugaugcguacuaccugggcguuaugugaggcccugacacucgcaaccggcccgauaagcacuuugugggaggggaaccccggaagauucuggaauacgacaaucgcuguguccauggccaacauuuuuaggggcucauaccuggccggugcugggcuacuguucucuaucaugaagaauaccacuaacacccgccggggaacaggcaauguuggugaaacucucggcgagaaauggaagagucgacuuaacgcccuggggaaaucggaauuucagauuuauaagaaaagcggaauccaggagguggacagaaccuuggccaaggagggcauaaagagaggggaaacagaucaucacgcggucucccgcggaucugcuaaacugcggugguucguggagagaaacauggucacgccagaaggcaaggugguugaccucgguugcgggcguggaggcuggucauacuauugugguggccugaaaaaugugagggagguaaagggguuaaccaaaggaggcccugggcaugaggaacccaucccuaugagcacuuacggauggaaccuugugcggcugcaauccggcgucgauguuuucuuuacaccacccgagaagugcgacacccuccuaugugauauuggugaaaguucuccuaauccaacuaucgaggcagggcgcacacugcgaguguugaaccuggucgaaaauuggcucaacaauaacacccaguucugcauuaaggugcuuaaucccuauaugccgagcguaaucgagaaaauggaaacgcugcagagaaaguacggaggcgccuuggugaggaacccucugucaagaaauuccacccacgagauguacuggguuaguaacgcuacaggcaauauagugagcucugucaacaugauuucccgcaugcucaucaauagauuuacuaugaaacacaagaaagccaccuaugagccagacguggauuuagggucaggaacaaggaacaucgguauugaaagcgagauacccaaccuggacaucauuggcaagcgaaucgaaaagauuaaacaggagcaugaaacuucguggcacuacgaccaagaucauccuuauaagaccugggcauaccacgggucuuaugagacaaaacagaccggaagugccuccagcauggucaauggcgugguucggcuucugacuaagccaugggacguagugcccauggucacgcagauggcuaugacagauaccacuccguucggucagcaacguguguuuaaagagaagguugacaccagaacacaggaaccuaaggaggggacgaaaaagcuaaugaaaaucaccgcggaauggcucuggaaggagcugggaaaagagaagacuccccgcauguguacaagggaagaguucacccggaaagugagaucaaacgccgcauugggcgcugucuuuacugaugaaaauaaguggaaguccgcccgcgaggcaguggaagacggcagguucugggagcugguagaucgagagcggaaccuccaccuugaagggaaaugcgagacauguguguacaauaugaugggaaagagagagaaaaagcugggugaguuuggcaaagccaaggggucuagggcuauaugguauaugugguuaggagcccgcuuccuggaauuugaggcguugggcuuccucaacgaggaccauugguuuagccgugguaauagucuguccgggguugaaggagagggccuacaccggcuuggcuacauccugagagaagucgggaagaaagagggaggugcaauguacgccgaugacaccgcuggcugggauacaaggauuacucucgaagaccugaagaacgaggagauggugaccaaucauaugaaaggggaacacaagaaauuggccgaggcaaucuucaagcugacguaucagaacaaggugguccgcguucagcgaccaaccccucggggaacagugauggacauuaucagcagaaaagaucaaaggggcucuggucagguagggacuuacggacucaauaccuucacaaacauggaagcucagcuuauucgccaaauggagggcgagggcauauuuaagucaauccagcaucugacugccaccgaagagauugcugugcagaauugguuagccagagucgggcgggaaaggcugagucguauggcaaucuccggagacgauugcgugguuaaacccaucgacgaucgauucgcgagcgccuugacggcucucaacgacauggguaaggugcgcaaagauauucagcaaugggagccaucuagaggcuggaaugacuggacacagguccccuuuugcucgcaccacuuccaugaacuggugaugaaggaugggcgggucuuaguugugccuuguaggaaccaggacgagcuuauaggacgcgccagaaucucacagggcgcagguuggagccugaaggagaccgcuugccucgggaaauccuaugcccaaauguggacucugauguacuuucaccggagggauuugcgauuagcagccaacgcgauuuguagugcugucccaucucauugggugccgacaagccguaccacuugguccauccacgccaagcacgaauggaugaccacagaggacaugcuggcaguguggaauagagucuggauucaggaaaaccccuggauggaggauaaaacgccuguugaaucaugggaggaggugccauaucucggaaagcgcgaagaccaguggugcggcagucuuaucggccugaccucucgggccacuugggcuaaaaauauacagacagccaucaaccaaguaaggagccuaauggggaaugagggauacaccgacuauaugcccuccaugaagagauuccgccgggaagaggaagaggccggugugcugugguga

SEQ ID NO: 14376 - RNA, 9876 nt, Artificial Sequence
  derived and/or modified CDS sequence (opt3) from DENV-2__GQ868551__SS-prME
accgccggcgugaucgucaugcugauucccacagcuauggcauuccaccucacuacgagaaacggggagccucauaugauaguuggaaggcaggaaaaggguaaaagccuucuguuuaagaccgaggacggcgugaauaugugcacauugauggccaucgauuuaggggaacugugugaggacacuauuaccuacaaaugcccacuacuccggcaaaacgaaccggaggauaucgacuguuggugcaauuccacaucuaccuggguaacuuauggaacauguaccacgacuggcgagcaccgccgagaaaagcguucaguggcgcuggucccccauguggguauggggcuugagaccagaacagaaacuuggaugaguagcgagggagcuuggaaacacguucagaggauugagaccuggauccugcggcauccuggcuucacaauaauggccgcaaucuuggccuacaccauuggcacgacucacuuucagcgcgcucucaucuucauucugcugacagcaguggccccauccaugaccaugagaugcaucgggauaucuaacagggauuuugucgaaggagugucggguggcucauggguagacauuguucucgagcacgggagcugugugacuacaauggcuaagaauaagcccaccuuagauuucgaacugaucaaaacggaggccaagcagccugcgacccuucggaaauauugcauugaagcaaaguugacaaacacuaccacagagagucgcuguccaacucaaggagagcccucccugaaugaagagcaggacaaacgauuuaucugcaagcauucuauggucgauagaggcugggguaacggguguggacuauucggcaagggcgggaucgugaccugcgccauguuuacaugcaaaaagaauauggaaggaaaaauugugcagccugagaaccucgaauacaccauagucaucacuccacacagcggugaggagcaugcuguuggcaaugacacggggaagcacggaaaagaaauuaagaucacaccgcaguccucaaccacugaggccgaacugaccggcuaugguacagugaccauggaguguagucccaggacugggcuugauuucaacgaaaugguacuguugcaaauggaggacaaagcauggcucgugcaccggcagugguuucuggauuuaccucugccauggcuccccggcgcugacacacagggaagcaauuggauacagaaggagacgcuugucaccuucaagaacccucaugccaaaaagcaagacgugguugugcugggcucucaggaaggggcgaugcacacugccuugacaggagcaaccgagauucagauguccucagguaaucuacuguuuacaggccaucucaaaugccgucugcgcauggauaagcuucaacugaaagggaugagcuacaguauguguacuggaaaguucaagaucgucaaagaaaucgcugagacccagcacggcacgauugugaucagaguacaguaugagggugacgggucuccaugcaagauucccuucgaaauaaccgauuuggagaaaaggcauguucucggccggcugaucacagugaacccgauugucacugaaaaggacuccccugugaacaucgaggccgaacccccauuuggagauagcuacaucauugucggcguggagccugggcaguuaaaacugaauugguucaagaagggaucgucuauaggucaaauguuugagaccacaaugcgaggcgcuaaacgcauggccauccuaggggacacugcaugggauuucggaucccucggcgguguuuuuaccucaauugggaaggcccugcaccagguguucggcgcuaucuacggagcggcauuuaguggcguaagcuggacgaugaaaauucuuaucggggucauaaucacauggauuggaaugaacuccagaucuaccagcuugucagugagucugguucucgugggcgucgugacucuguaucuuggugccaugguacaggcugacuccggguguaucgugagcuggaagaauaaagaacugaagugcggaucuggcauuuucaucacagauaacguucacaccuggacugagcaguacaaguuucaacccgaaucaccaaguaaauuggccagcgcaauacagaaggcccaugaggaagguauuuguggcaucagguccgucacccggcucgagaaucugauguggaaacagauuacacccgaguuaaaccacauccugucugaaaaugaggugaagcuaacgauaaugaccggggacaucaaaggaauuaugcaggcuggcaagcgcucgcucagaccucaaccaacugaacugaaauauagcuggaagacaugggggaaggugaaaaugcuuuccaccgagucacauaaccagacauucuugaucgauggaccggaaacugccgagugccccaauaccaacagggcauggaauagucuggaggucgaagacuacggcuuugguguuuucacgacaaacauuuggcucaagcugcgugagaaacaggacguguuuugugauucuaaguuaaugagcgcggcuaucaaagacaaucgggccgugcacgcagauaugggguauuggauagaauccgcccugaacgacaccuggaagauggagaaggcuucauucauugagguaaaaagcugccacuggccuaagucucauacucuuugguccaauggagucuuggaaagugagaugaucaucccaaaaaacuucgccggccccgugagccagcacaacuaccgaccugguuaucauacccaaacagcaggcccauggcaccucgggaagcuggaaauggauuuugacuucugugagggaacuaccguuguggucacagaagauugcggcaauagagggcccucucuaaggacgaccacugcuuccggaaaacugauuacagaguggugcugucgcucaugcacccucccgccucugcgguacagaggcgaggacgguuguugguacgggauggaaaucaggccacuuaaggagaaggaagagaacuuggugaauagucugguuacugccggacauggccagauugauaacuuuagcuuaggugugcucggcauggcgcuguuccuugaagagaugcugcgcacacgaguagggaccaaacacgccauauugcucgucgcucugucguuugugacgcuaaucacuggaaauauguccuuccgggaccugggccgugugauggucaugguuggggcaaccaugacagaugacauuggaaugggcgugaccuaucucgcccugcuugcugccuuuaagguaagacccacuuucgcagcggguuugcuguuaaggaaacucacaucuaaggagcugaugauggccaccaucgggauugcucuucugagccagucaacacuaccugaaacuauccucgagcugaccgaugccuuggcacugggaaugauggcuuuaaaaauagugcgcaacauggaaaaguaccaacucgccgucacgaucauggcaauuaguugcgugcccaaugccguuauccugcagaacgcuuggaagguguccuguacaauucuugcggccgucucugugagcccacuguugcucaccuccucacagcagaaagcagacuggaucccucuggcucuaacuauaaagggccugaaucccaccgccauuuuucuuacaacucucagccggaccaguaaaaagagaucuuggccacugaacgaggccaucauggcuguuggcaugguguccaucuuggcaagcucgcuguuaaaaaaugacauuccgaugacggggccucucgucgccggaggucugcuuacaguaugcuaugugcugaccggcaggucagcggauuuggaacucgagcgagcugccgacguuaagugggaggaucaagcagaaauaucugggaguucccccauccugagcauuacuaucucugaggacggaagcauguccauuaaaaacgaagaggaggaacagacacuaaccauccugauacgcacuggccuucucgugaucucaggugucuucccagugaguauucccaucacagccgcugcaugguaccugugggagguaaagaagcagcgggccgggguguugugggaugucccuagcccacccccuguuggaaaagcggaauuagaggacggcgcuuauagaauuaagcagaggggcauccugggguacucucaaauaggagccgguguguauaaagaaggcaccuuucacacgauguggcaugugacucguggggcaguccucaugcaccgcggaaagcggauugagccguccugggccgaugugaaaaaggaccugaucucauacggcgguggguggaagcuugagggagaauggaaagagggcgaagagguucagguacuggcuuuggaaccaggcaagaaucccagagccgugcagaccaaaccugggaucuucaagacaaacaccggaacaauuggugcagucagucuagauuuuagcccaggcacuuccgggucucccaucguggacaggaaaggaaagguugugggccuguacgguaauggggucgugacccgaucgggagcuuauguaagcgccauagcgcagacggagaagucaauugaggauaacccugaaaucgaggacgauauuuuccggaaaaagcgccucacaaucauggaccugcauccgggcgccggcaaaacuaagagauaccuucccgcaauagucagggaagcuauuaaacggggguuacgaacccugauccucgccccaacaagagugguugcugcagagauggaagaggccuugcgcggacugccuaucagguaucaaacccccgccauucgugcugagcacacuggucgggaaaucguggaccucaugugucaugcgaccuucacaaugagacugcuuuccccagucagggugccuaacuacaaucugauuauaauggaugaggcacacuuuacggaccccgccaguaucgcugcccgcggcuauauuucuacucgaguugaaaugggggaggcagccggaaucuucaugaccgcuacaccaccgggcagcagagauccuuuuccccaguccaacgcgccaaucauggacgaggaacgggagauucccgaaaggucauggaauucuggucacgagugggugaccgauuucaaggggaagacugucugguuugugccuagcauaaaagccggaaacgacaucgcagcuugcuugcgcaagaauggcaaaaagguaauucagcuaagucguaaaacauucgauuccgaauacgugaagaccagagccaacgacugggauuuuguugucacgacugacaucagcgagaugggcgcaaauuucaaggccgagcgggugauugauccaaggcgcuguaugaaacccgugauccugacagacggggaagagcgagucauacucgcuggaccuaugccgguaacccauucuucagccgcgcaaagacgggguaggaucggccgcaacccaaagaaugaaaacgaccaguauauuuacaugggggagcccuuagaaaaugaugaggacugcgcacacuggaaagaggccaagaugcugcuugauaacaucaauaccccugaaggaauuauccccuccauguuugagccagaaagagagaaaguggacgcuauagauggcgaauacaggcugcggggugaggcccguaagacuuucguugaccucaugcgccgaggggauuugccuguguggcuggcuuauaaagucgcagccgagggcauuaacuacgcugacagaaagugguguuuugauggaaucaagaauaaccagauucucgaagagaacguggaaguugagaucuggacaaaagagggcgaaaggaagaaacugaagccccgguggcuugacgcccgcauauauagugauccacuagcacugaaagaguucaaggaauucgcggccgggagaaagagcuugaccuuaaaucugaucacagagaugggaaggcucccuacuuuuaugacgcagaaagcucggaacgcccuggacaaucuugcagugcugcauaccgcugaagucgguggcaaggccuacacacacgcacucucggaguugccggagacucuggaaacccuacugcuccuuacacuguuagccgcugugaccgggggaauuuucuuguuucugaugucuggcaaagguaucgggaagaugacucucggcaugugcugcauuaucacggcguccauacugcuuugguaugcccaaauucagccccacuggaucgcagcuagcaucauucuggaguucuuucucaucguauugcugauaccagaaccugagaaacagcgaaccccccaggauaaccaauuaacauacgugguuauugccauccuaacugucguggccgcaaccauggcuaaugaaaugggauuccuggagaagacaaagaaagaccucggcuuugggucaauuaccacucaggagagugaaucuaacauccuugacauagaucugagaccagccuccgcguggacauuguaugcuguggccacgaccuucgucacuccuaugcugcgccauagcaucgagaauucaaguguuaacgugagccucacagcaauugccaaucaggcuaccguacugaugggacuugguaagggcuggccccucuccaaaauggacaucggggugccgcuguuggcaauuggauguuacucucaggucaacccaaucacccugacagccgcguuacuacugcucguggcucacuacgccauuaucggcccuggucuucaagcaaaggccacuagggaagcucagaaacgggccgcagcugggauaaugaagaaucccacgguugauggcauuaccgugaucgaccuggagccaauccccuaugauccuaaguuugaaaaacaguugggacaggucaugcugcucauucugugcguaacacaagugcuuaugaugcguacuaccugggccuuaugugaggcgcugacacucgccaccggcccgauaagcacuuugugggaggggaaccccggaagauucuggaauacgacaaucgcaguuuccauggcuaacauuuuuaggggcucauaccuggccggugcagggcuacuguucucuaucaugaagaauaccacuaacacccgccggggaacaggcaaugugggugaaacucucggcgagaaauggaagagucgacuuaacgcucuggggaaaucggaauuucagauuuauaagaaaagcggaauccaggaggucgacagaaccuuggccaaggagggcauaaagaggggggaaacagaucaucacgccgugucccgcggaucugcgaaacugcggugguucgucgagagaaacauggugacgccagaaggcaagguuguggaccucgguugcgggcguggaggcuggucauacuauugugguggccugaaaaauguaagggaggugaagggguuaaccaaaggaggcccugggcaugaagagcccaucccuaugagcacuuacggauggaaccuuguccggcugcaauccggcguugauguguucuuuacaccacccgagaagugcgacacccuccuaugugauauuggugaaaguucuccuaauccaacuaucgaggcugggcgcacacugcgagucuugaaccugguggaaaauuggcucaacaauaacacccaguucugcauuaagguacuuaaucccuauaugccgagcgugaucgagaaaauggaaacgcugcagagaaaguacggaggcgcauugguuaggaacccucugucacggaauuccacccacgagauguacugggugaguaacgccacaggcaauauagucagcucugugaacaugauuucccgcaugcucaucaauagauuuacuaugaaacacaagaaagcuaccuaugagccagacgucgauuuagggucaggaacaaggaacaucgguauugaaagcgagauacccaaccuggacaucauuggcaagcgaaucgaaaagauuaaacaggagcaugaaacuucguggcacuacgaccaagaucauccuuauaagaccugggccuaccacgggucuuaugagacaaaacagaccggaagugcauccagcauggugaauggcguuguacggcuucugacuaagccaugggacgugguccccauggugacgcagauggccaugacagauaccacuccguucggucagcaacguguuuuuaaagagaagguggacaccagaacacaggaaccuaaggaggggacgaaaaagcuaaugaaaaucaccgcugaauggcucuggaaggagcugggaaaagagaagacuccccgcauguguacaagggaagaguucacccggaaagucagaucaaacgcggccuugggcgcaguguuuacugaugaaaauaaguggaaguccgcucgcgaggccguagaagacggcagguucugggagcugguggaucgagagcggaaccuccaccuugaagggaaaugcgagacauguguuuacaauaugaugggaaagagagaaaaaaagcugggugaguuuggcaaagcaaaggggucuagggccauaugguauaugugguuaggagcucgcuuccuggaauuugaggccuugggcuuccucaacgaggaccauugguuuagccgugguaauagucuguccggggucgaaggagagggccuacaccggcuuggcuacauccugagagaaguggggaagaaagagggaggugcgauguacgcagaugacaccgccggcugggauacaaggauuacucucgaagaccugaagaacgaggagauggugaccaaucauaugaaaggggaacacaagaaauuggcugaggccaucuucaagcugacguaucagaacaaggucguucgcgugcagcgaccaaccccucggggaacaguaauggacauuaucagcagaaaagaucaaaggggcucuggucagguggggacuuacggacucaauaccuucacaaacauggaagcacagcuuauucgccaaauggagggcgagggcauauuuaagucaauccagcaucugacugcuaccgaagagauugccguccagaauugguuagcuagaguggggcgggaaaggcugagucguauggccaucuccggagacgauugcguugugaaacccaucgacgaucgauucgcaagcgcguugacggcccucaacgacauggguaagguccgcaaagauauucagcaaugggagccaucuagaggcuggaaugacuggacacaggugcccuuuugcucgcaccacuuccaugaacugguaaugaaggaugggcggguucuaguggucccuuguaggaaccaggacgagcuuauaggacgcgcuagaaucucacagggcgccgguuggagccugaaggagaccgcaugccucgggaaauccuaugcucaaauguggacucugauguacuuucaccggagggauuugcgauuagccgcaaacgccauuuguagugcggugccaucucauugggugccgacaagccguaccacuugguccauccacgcuaagcacgaauggaugaccacagaggacaugcuggccgucuggaauagaguuuggauucaggaaaaccccuggauggaggauaaaacgccuguggaaucaugggaggagguaccauaucucggaaagcgcgaagaccaguggugcggcagucuuaucggccugaccucucgggcaacuugggccaaaaauauacagacagcuaucaaccaagugaggagccuaauggggaaugagggauacaccgacuauaugcccuccaugaagagauuccgccgggaagaggaagaggccgguguccugugguga

SEQ ID NO: 14377 - RNA, 9876 nt, Artificial Sequence
  derived and/or modified CDS sequence (opt3) from DENV-2__HM181971__SS-prME
accgcaggcgugaucguaaugcugauucccacagcuauggcauuccaccucacuacgaggaacggggagccucauaugauaguuggaaggcaggaaaaggguaaaagccuucuguuuaagaccgaggacggcgugaauaugugcacauugauggcaaucgauuuaggggaacugugugaggacacuauuaccuacaaaugcccacuacuccggcaaaacgaaccggaggauaucgacuguuggugcaauuccacaucuaccuggguuacuuauggaacauguaccacgacuggcgagcaccgccgagaaaagcguucaguggcgcuggucccccauguggguauggggcuugagacccggacagaaacuuggaugaguagcgagggagcuuggaaacacguucagaggauugagaccuggauccugcggcauccuggcuucacaauaauggccgcaaucuuggccuacaccauuggcacgacucacuuucagcgcgcucucaucuucauucugcugacagcaguggccccauccaugaccaugagaugcaucgggauaucuaacagggauuuugucgaaggagugucggguggcucauggguagacauuguucucgagcacgggagcugugugacuacaauggcuaagaauaagcccaccuuagauuucgaacugaucaaaacggaggccaagcagccugcgacccuucggaaauauugcauugaagcaaaguugacaaacacuaccacagagagucgcuguccaacucaaggagagcccucccugaaugaggaacaggacaaacgauuuaucugcaagcauucuauggucgauagaggcugggguaacggguguggacuauucggcaagggcgggaucgugaccugcgccauguuuacaugcaaaaagaauauggaaggaaaaauugugcagccugagaaccucgaauacaccauagucaucacuccacacagcggugaggagcaugcuguuggcaaugacacggggaagcacggaaaagaaauuaagaucacaccgcaguccucaaccacugaggccgaacugaccggcuaugguacagugaccauggaguguagucccaggacugggcuugauuucaacgaaaugguacuguugcaaauggaggacaaagcauggcucgugcaccggcagugguuucuggauuuaccucugccauggcuccccggcgcugacacacagggaagcaauuggauacagaaggagacgcuugucaccuucaagaacccucaugccaaaaagcaagacgugguugugcugggcucucaggaaggggcgaugcacacugccuugacaggagcaaccgagauucagauguccucagguaaucuacuguuuacaggccaucucaaaugccgucugcgcauggauaaacuucaacugaaagggaugagcuacaguauguguacuggaaaguucaagaucgucaaagaaaucgcugagacccagcacggcacgauugugaucagaguacaguaugagggugacgggucuccaugcaagauucccuucgaaauaaccgauuuggagaaaaggcauguucucggccggcugaucacagugaacccgauugucacugaaaaggacuccccugugaacaucgaggccgaacccccauuuggagauagcuacaucauugucggcguggagccugggcaguuaaaacugaauugguucaagaagggaucgucuauaggucaaauguuugagaccacaaugcgaggcgcuaaacgcauggccauccuaggggacacugcaugggauuucggaucccucggcgguguuuuuaccucaauugggaaggcccugcaccagguguucggcgcuaucuacggagcggcauuuaguggcguaagcuggacgaugaaaauucuuaucggggucauaaucacauggauuggaaugaacuccagaucuaccagcuugucagugagucugguucucgugggcgucgugacucuguaucuuggugccaugguacaggcugacuccggguguaucgugagcuggaagaauaaagaacugaagugcggaucuggcauuuucaucacagauaacguucacaccuggacugagcaguacaaguuucaacccgaaucaccaaguaaauuggccagcgcaauacagaaggcccaugaggaagguauuuguggcaucagguccgucacccggcucgagaaucugauguggaaacagauuacacccgaguuaaaccacauccugucugaaaaugaggugaagcuaacgauaaugaccggggacaucaaaggaauuaugcaggcuggcaagcgcucgcucagaccucaaccaacugaacugaaauauagcuggaagacaugggggaaggccaaaaugcuuuccaccgagucacauaaccagacauucuugaucgauggaccggaaacugcagagugccccaauaccaacagggcguggaauagucuggagguggaagacuacggcuuuggugucuucacgacaaacauuuggcucaagcugcgugagaaacaggacguauuuugugauucuaaguuaaugagcgcugccaucaaagacaaucgggcagugcacgccgauaugggguauuggauagaauccgcucugaacgacaccuggaagauggagaaggccucauucauugaggugaaaagcugccacuggccuaagucucauacucuuugguccaauggaguauuggaaagugagaugaucauccccaagaauuucgcaggccccgucagccagcacaacuaccgaccugguuaucauacccaaacagcuggcccauggcaccucgggaagcuggaaauugauuuugacuucugugagggaacuaccgugguugugacagaagauugcggcaauagagggcccucucuaaggacgaccacugccuccggaaaacugaucacagaguggugcugucgcucaugcacccucccgccucugcgguacagaggcgaggacgguuguugguacgggauggaaauuaggccacuuaaggagaaggaagagaacuuggucaauagucuggugacugcgggacauggccagauagauaacuuuagcuuagguguucucggcauggcccuguuccuugaagagaugcugcgcacacgaguggggaccaaacacgcuaucuugcucguagcacugucguuugucacgcuaauuacuggaaauauguccuuccgggaccugggccgugugauggugauggucggggccaccaugacagaugacaucggaaugggcguuaccuaucucgcucugcuugccgcauuuaaggugagacccacuuucgcggccgguuugcuguuaaggaaacucacaucuaaggagcugaugauggcuaccauugggaucgcccuucugagccagucaacacuaccugaaacuauacucgagcugaccgaugcauuggcucugggaaugauggccuuaaaaaucguacgcaacauggaaaaguaccaacucgcagugacgauuauggccaucaguugcguccccaaugcugugauucugcagaacgcguggaagguuuccuguacaauccuugccgcagugucugucagcccacuguugcucaccuccucacagcagaaagcugacuggauaccucuggcccuaacuauuaagggccugaaucccaccgccaucuuucuuacaacucucagccggaccaguaaaaagagaucuuggccacugaacgaggcuaucauggcagugggcaugguuuccauuuuggccagcucgcugcuaaagaaugacauaccgaugacggggccucucguggcgggaggucugcuuacagucugcuauguacugaccggcaggucagcugauuuggaacucgagcgagccgcagacgugaagugggaggaucaagccgaaaucucugggaguucccccauucugagcaucacuauuucugaggacggaagcauguccaucaaaaacgaagaggaggaacagacacuaaccauacugauccgcacuggccuucucguuauuucagguguguucccagucaguauccccauuacagcugcagccugguaccugugggaggugaagaagcagcgggcggggguauugugggaugugccuagcccacccccugucggaaaagcugaauuagaggacggcgccuauagaaucaagcagaggggcauacugggguacucucaaauuggagccgguguuuauaaagaaggcaccuuucacacgauguggcaugugacucguggggcagugcucaugcaccgcggaaagcggaucgagccguccugggcugaugucaaaaaggaccugaucucauacggcgguggguggaaacuugagggagaauggaaagagggcgaagaggugcagguucuggccuuggaaccaggcaagaaucccagagcaguacagaccaaaccugggauuuucaagacaaacaccggaacaaucggugcugugagucuagauuuuagcccaggcacuuccgggucucccauagucgacaggaaaggaaaggugguuggccuguacgguaaugggguggucacccgaucgggagccuaugugagcgcgauugcccagacggagaagucaaucgaggauaacccugaaauugaggacgauaucuuccggaaaaagcgccucacaauaauggaccugcauccgggcgcaggcaaaacuaagagauaccuucccgcuauuguaagggaagccaucaaacggggguuacgaacccugauccucgcuccaacaagagucguggcagccgagauggaagaggccuugcgcggacugccuauuagguaucaaacccccgcuauccgugcggagcacacuggucgggaaauuguugaccucaugugucaugcaaccuucacaaugagacugcuuuccccagugagggucccuaacuacaaucugauaaucauggaugaggcccacuuuacggaccccgcuaguauugccgcacgcggcuauaucucuacucgaguggaaaugggggaggccgcuggaaucuucaugaccgcgacaccaccgggcagcagagauccuuuuccccaguccaacgccccaauuauggacgaggaacgggagauacccgaaaggucauggaacucuggucacgaguggguuaccgauuucaaggggaagacugugugguuugucccuagcaucaaagcaggaaacgacauugcugccugcuugcgcaagaauggcaaaaaggugauccagcuaagucguaaaacauucgauuccgaauacguaaagaccagagcaaacgacugggauuuugugguuacgacugacauuagcgagaugggcgccaauuucaaggcugagcgggucaucgauccaaggcgcuguaugaaacccgugauacugacagacggggaagaacgagugauccucgccggaccuaugccggucacccauucuucagcggcacaaagacgggguaggauuggccgcaacccaaagaaugaaaacgaccaguauaucuacaugggggagcccuuagaaaaugaugaggacugcgcccacuggaaagaggcuaagaugcugcuugauaacauuaauaccccugaaggaaucauacccuccauguuugagccagaaagagagaaaguagacgccauugauggcgaauacaggcugcggggugaggcucguaagacuuucguggaccucaugcgccgaggggauuugccuguuuggcuggcauauaaaguggccgcugagggcaucaacuacgccgacagaaagugguguuuugauggaauuaagaauaaccagauccucgaagagaacgucgaaguggagauauggacaaaagagggcgaaaggaagaaacugaagccccgguggcuugacgcacgcaucuauagugauccacuagcgcugaaagaguucaaggaguucgccgcugggagaaagagcuugaccuuaaaucugauuacagagaugggaaggcucccuacuuuuaugacgcagaaagcccggaacgcacuggacaaucuugcuguucugcauaccgccgaaguggguggcaaggcauacacacacgcccucucggaguugccggagacucuggaaacccuacugcuccuuacacuguuagcugcggucaccgggggaaucuucuuguuucugaugucuggcaaagguauugggaagaugacucucggcaugugcugcaucauaacggccuccauucugcuuugguaugcacaaauccagccccacuggaucgcugccagcauuauccuggaguucuuucucauaguguugcugauuccagaaccugagaaacagcgaaccccacaggauaaccaauuaacauacguagugaucgccauucuaacuguugucgcagcuaccauggccaaugaaaugggauuccuggagaagacaaagaaagaccucggcuuugggucaaucaccacucaggagagugaaucuaacauacuugacaucgaucugagaccagcguccgcuuggacauuguaugccguggcaacgaccuucgugacuccuaugcugcgccauagcauugaaaauucaagugucaacguuagccucacagccaucgcuaaucaggcaaccgugcugaugggacuugguaagggcuggccccucuccaaaauggacauugggguaccgcuguuggccaucggauguuacucucaggugaacccaauuacccugacagcggcuuuacuacugcucgucgcccacuacgcaaucauaggcccuggucuucaagccaaggcuacuagggaagcccagaaacgggcagcugccgggauuaugaagaaucccacgguggauggcaucaccguuaucgaccuggagccaauucccuaugauccuaaguuugaaaaacaguugggacaggugaugcugcucauacugugcgucacacaaguacuuaugaugcguacuaccugggcguuaugugaggcccugacacucgcaaccggcccgaucagcacuuugugggaggggaaccccggaagauucuggaauacgacaauugcuguguccauggccaacaucuuuaggggcucauaccuggccggugcugggcuacuguucucuauuaugaagaauaccacuaacacccgccggggaacaggcaauguuggugaaacucucggcgagaaauggaagagucgacuuaacgcccuggggaaaucggaauuucagaucuauaagaaaagcggaauacaggagguggacagaaccuuggccaaggagggcaucaagagaggggaaacagaucaucacgcggucucccgcggaucugcuaaacugcggugguucguggagagaaacauggucacgccagaaggcaaggugguugaccucgguugcgggcguggaggcuggucauacuauugugguggccugaaaaaugugagggagguaaagggguuaaccaaaggaggcccugggcaugaggaacccauuccuaugagcacuuacggauggaaccuugugcggcugcaauccggcgucgauguuuucuuuacaccacccgagaagugcgacacccuccuaugugauaucggugaaaguucuccuaauccaacuauugaggcagggcgcacacugcgaguguugaaccuggucgaaaauuggcucaacaauaacacccaguucugcaucaaggugcuuaaucccuauaugccgagcguaauagagaaaauggaaacgcugcagagaaaguacggaggcgccuuggugaggaacccucugucaagaaauuccacccacgagauguacuggguuaguaacgcuacaggcaauauugugagcucugucaacaugaucucccgcaugcucaucaauagauuuacuaugaaacacaagaaagccaccuaugagccagacguggauuuagggucaggaacaaggaacauugguauagaaagcgagauccccaaccuggacauuaucggcaagcgaauugaaaagaucaaacaggagcaugaaacuucguggcacuacgaccaagaucauccuuauaagaccugggcauaccacgggucuuaugagacaaaacagaccggaagugccuccagcauggucaauggcgugguucggcuucugacuaagccaugggacguagugcccauggucacgcagauggcuaugacagauaccacuccguucggucagcaacguguguuuaaagagaagguugacaccagaacacaggaaccuaaggaggggacgaaaaagcuaaugaaaauaaccgcggaauggcucuggaaggagcugggaaaagagaagacuccccgcauguguacaagggaagaguucacccggaaagugagaucaaacgccgcauugggcgcugucuuuacugaugaaaauaaguggaaguccgcccgcgaggcaguggaagacggcagguucugggagcugguagaucgagagcggaaccuccaccuugaagggaaaugcgagacauguguguacaauaugaugggaaagagagagaaaaagcugggugaguuuggcaaagccaaggggucuagggcuaucugguauaugugguuaggagcccgcuuccuggaauuugaggcguugggcuuccucaacgaggaccauugguuuagccgugguaauagucuguccgggguugaaggagagggccuacaccggcuuggcuacauucugagagaagucgggaagaaagagggaggugcaauguacgccgaugacaccgcuggcugggauacaaggaucacucucgaagaccugaagaacgaggagauggugaccaaucauaugaaaggggaacacaagaaauuggccgaggcaauuuucaagcugacguaucagaacaaggugguccgcguucagcgaccaaccccucggggaacagugauggacaucauuagcagaaaagaucaaaggggcucuggucagguagggacuuacggacucaauaccuucacaaacauggaagcucagcuuauacgccaaauggagggcgagggcaucuuuaagucaauucagcaucugacugccaccgaagagaucgcugugcagaauugguuagccagagucgggcgggaaaggcugagucguauggcaaucuccggagacgauugcgugguuaaacccauugacgaucgauucgcgagcgccuugacggcucucaacgacauggguaaggugcgcaaagauauacagcaaugggagccaucuagaggcuggaaugacuggacacagguccccuuuugcucgcaccacuuccaugaacuggugaugaaggaugggcgggucuuaguugugccuuguaggaaccaggacgagcuuaucggacgcgccagaauuucacagggcgcagguuggagccugaaggagaccgcuugccucgggaaauccuaugcccaaauguggacucugauguacuuucaccggagggauuugcgauuagcagccaacgcgaucuguagugcugucccaucucauugggugccgacaagccguaccacuugguccauucacgccaagcacgaauggaugaccacagaggacaugcuggcaguguggaauagagucuggauccaggaaaaccccuggauggaggauaaaacgccuguugaaucaugggaggaggugccauaucucggaaagcgcgaagaccaguggugcggcagucuuauaggccugaccucucgggccacuugggcuaaaaauauccagacagccauuaaccaaguaaggagccuaauggggaaugagggauacaccgacuauaugcccuccaugaagagauuccgccgggaagaggaagaggccggugugcugugguga

SEQ ID NO: 14378 - RNA, 9876 nt, Artificial Sequence
  derived and/or modified CDS sequence (opt3) from DENV-2__GU131881__SS-prME
accgcaggcgugaucguaaugcugauucccacagcuauggcauuccaccucacuacgaggaacggggagccucauaugauaguuggaaggcaggaaaaggguaaaagccuucuguuuaagaccgaggacggcgugaauaugugcacauugauggcaaucgauuuaggggaacugugugaggacacuauuaccuacaaaugcccacuacuccggcaaaacgaaccggaggauaucgacuguuggugcaauuccacaucuaccuggguuacuuauggaacauguaccacgacuggcgagcaccgccgagaaaagcguucaguggcgcuggucccccauguggguauggggcuugagaccagaacagaaacuuggaugaguagcgagggagcuuggaaacacguucagaggauugagaccuggauccugcggcauccuggcuucacaauaauggccgcaaucuuggccuacaccauuggcacgacucacuuucagcgcgcucucaucuucauucugcugacagcaguggccccauccaugaccaugagaugcaucgggauaucuaacagggauuuugucgaaggagugucggguggcucauggguagacauuguucucgagcacgggagcugugugacuacaauggcuaagaauaagcccaccuuagauuucgaacugaucaaaacggaggccaagcagccugcgacccuucggaaauauugcauugaagcaaaguugacaaacacuaccacagagagucgcuguccaacucaaggagagcccucccugaaugaagaacaggacaaacgauuuaucugcaagcauucuauggucgauagaggcugggguaacggguguggacuauucggcaagggcgggaucgugaccugcgccauguuuacaugcaaaaagaauauggaaggaaaaauugugcagccugagaaccucgaauacaccauagucaucacuccacacagcggugaggagcaugcuguuggcaaugacacggggaagcacggaaaagaaauuaagaucacaccgcaguccucaaccacugaggccgaacugaccggcuaugguacagugaccauggaguguagucccaggacugggcuugauuucaacgaaaugguacuguugcaaauggaggacaaagcauggcucgugcaccggcagugguuucuggauuuaccucugccauggcuccccggcgcugacacacagggaagcaauuggauacagaaggagacgcuugucaccuucaagaacccucaugccaaaaagcaagacgugguugugcugggcucucaggaaggggcgaugcacacugccuugacaggagcaaccgagauucagauguccucagguaaucuacuguuuacaggccaucucaaaugccgucugcgcauggauaaacuucaacugaaagggaugagcuacaguauguguacuggaaaguucaagaucgucaaagaaaucgcugagacccagcacggcacgauugugaucagaguacaguaugagggugacgggucuccaugcaagauucccuucgaaauaaccgauuuggagaaaaggcauguucucggccggcugaucacagugaacccgauugucacugaaaaggacuccccugugaacaucgaggccgaacccccauuuggagauagcuacaucauugucggcguggagccugggcaguuaaaacugaauugguucaagaagggaucgucuauaggucaaauguuugagaccacaaugcgaggcgcuaaacgcauggccauccuaggggacacugcaugggauuucggaucccucggcgguguuuuuaccucaauugggaaggcccugcaccagguguucggcgcuaucuacggagcggcauuuaguggcguaagcuggacgaugaaaauucuuaucggggucauaaucacauggauuggaaugaacuccagaucuaccagcuugucagugagucugguucucgugggcgucgugacucuguaucuuggugccaugguacaggcugacuccggguguaucgugagcuggaagaauaaagaacugaagugcggaucuggcauuuucaucacagauaacguucacaccuggacugagcaguacaaguuucaacccgaaucaccaaguaaauuggccagcgcaauacagaaggcccaugaggaagguauuuguggcaucagguccgucacccggcucgagaaucugauguggaaacagauuacacccgaguuaaaccacauccugucugaaaaugaggugaagcuaacgauaaugaccggggacaucaaaggaauuaugcaggcuggcaagcgcucgcucagaccucaaccaacugaacugaaauauagcuggaagacaugggggaaggccaaaaugcuuuccaccgagucacauaaccagacauucuugaucgauggaccggaaacugcagagugccccaauaccaacagggcguggaauagucuggagguggaagacuacggcuuuggugucuucacgacaaacauuuggcucaagcugcgugagaaacaggacguauuuugugauucuaaguuaaugagcgcugccaucaaaaauaaccgggcagugcacgccgacaugggguauuggauagaauccgcucugaaugauaccuggaagauggagaaggccucauucauugaggugaaaagcugccacuggccuaagucucauacucuuugguccaacggaguauuggaaagugagaugaucauccccaagaacuucgcaggccccgucagccagcacaauuaccgaccugguuaucauacccaaacagcuggcccauggcaccucgggaagcuggaaauggacuuugauuucugugagggaacuaccgugguugugacagaagacugcggcaacagagggcccucucuaaggacgaccacugccuccggaaaacugauuacagaguggugcugucgcucaugcacccucccgccucugcgguacagaggcgaggaugguuguugguacgggauggaaaucaggccacuuaaggagaaggaagagaauuuggucaacagucuggugacugcgggacauggccagauugacaauuuuagcuuagguguucucggcauggcccuguuccuugaagagaugcugcgcacacgaguggggaccaaacacgcuauauugcucguagcacugucguuugucacgcuaaucacuggaaacauguccuuccgggaucugggccgugugauggugauggucggggccaccaugacagacgauauuggaaugggcguuaccuaucucgcucugcuugccgcauuuaaggugagacccacuuucgcggccgguuugcuguuaaggaaacucacaucuaaggagcugaugauggcuaccaucgggauugcccuucugagccagucaacacuaccugaaacuauccucgagcugaccgacgcauuggcucugggaaugauggccuuaaaaauaguacgcaauauggaaaaguaccaacucgcagugacgaucauggccauuaguugcguccccaacgcugugauccugcagaaugcguggaagguuuccuguacaauucuugccgcagugucugucagcccacuguugcucaccuccucacagcagaaagcugauuggaucccucuggcccuaacuauaaagggccugaaccccaccgccauuuuucuuacaacucucagccggaccaguaaaaagagaucuuggccacugaaugaggcuaucauggcagugggcaugguuuccaucuuggccagcucgcugcuaaagaacgacauuccgaugacggggccucucguggcgggaggucugcuuacagucugcuauguacugaccggcaggucagcugacuuggaacucgagcgagccgcagaugugaagugggaggaccaagccgaaauaucugggaguucccccauccugagcauuacuaucucugaggauggaagcauguccauuaaaaaugaagaggaggaacagacacuaaccauccugauacgcacuggccuucucguuaucucagguguguucccagucaguauucccaucacagcugcagccugguaccugugggaggugaagaagcagcgggcggggguauugugggacgugccuagcccacccccugucggaaaagcugaauuagaggauggcgccuauagaauuaagcagaggggcauccugggguacucucaaauaggagccgguguuuauaaagaaggcaccuuucacacgauguggcaugugacucguggggcagugcucaugcaccgcggaaagcggauugagccguccugggcugacgucaaaaaggaucugaucucauacggcgguggguggaaacuugagggagaauggaaagagggcgaagaggugcagguucuggccuuggaaccaggcaagaaccccagagcaguacagaccaaaccugggaucuucaagacaaauaccggaacaauuggugcugugagucuagacuuuagcccaggcacuuccgggucucccaucgucgauaggaaaggaaaggugguuggccuguacgguaacgggguggucacccgaucgggagccuaugugagcgcgauagcccagacggagaagucaauugaggacaacccugaaaucgaggaugacauuuuccggaaaaagcgccucacaaucauggaucugcauccgggcgcaggcaaaacuaagagauaccuucccgcuauaguaagggaagccauuaaacggggguuacgaacccugauccucgcuccaacaagagucguggcagccgagauggaagaggccuugcgcggacugccuaucagguaucaaacccccgcuauucgugcggagcacacuggucgggaaaucguugaccucaugugucaugcaaccuucacaaugagacugcuuuccccagugagggucccuaauuacaaccugauuauaauggacgaggcccacuuuacggaucccgcuaguaucgccgcacgcggcuauauuucuacucgaguggaaaugggggaggccgcuggaaucuucaugaccgcgacaccaccgggcagcagagacccuuuuccccaguccaaugccccaaucauggaugaggaacgggagauucccgaaaggucauggaacucuggucacgaguggguuaccgacuucaaggggaagacugugugguuugucccuagcauaaaagcaggaaaugauaucgcugccugcuugcgcaagaacggcaaaaaggugauucagcuaagucguaaaacauucgacuccgaauacguaaagaccagagcaaaugauugggacuuugugguuacgacugauaucagcgagaugggcgccaacuucaaggcugagcgggucauugacccaaggcgcuguaugaaacccgugauccugacagauggggaagaacgagugauacucgccggaccuaugccggucacccauucuucagcggcacaaagacgggguaggaucggccgcaauccaaagaacgaaaaugaccaguauauuuacaugggggagcccuuagaaaacgacgaggauugcgcccacuggaaagaggcuaagaugcugcuugacaauaucaacaccccugaaggaauuauccccuccauguuugagccagaaagagagaaaguagaugccauagacggcgaauacaggcugcggggugaggcucguaagacuuucguggaucucaugcgccgaggggacuugccuguuuggcuggcauauaaaguggccgcugagggcauuaauuacgccgauagaaagugguguuuugacggaaucaagaacaaccagauucucgaagagaaugucgaaguggagaucuggacaaaagagggcgaaaggaagaaacugaagccccgguggcuugaugcacgcauauauagugacccacuagcgcugaaagaguucaaggaguucgccgcugggagaaagagcuugaccuuaaaccugaucacagagaugggaaggcucccuacuuuuaugacgcagaaagcccggaaugcacuggauaaccuugcuguucugcauaccgccgaaguggguggcaaggcauacacacacgcccucucggaguugccggagacucuggaaacccuacugcuccuuacacuguuagcugcggucaccgggggaauuuucuuguuucugaugucuggcaaagguaucgggaagaugacucucggcaugugcugcauuaucacggccuccauacugcuuugguaugcacaaauucagccccacuggaucgcugccagcaucauucuggaguucuuucucaucguguugcugauaccagaaccugagaaacagcgaaccccacaggacaaucaauuaacauacguagugauugccauccuaacuguugucgcagcuaccauggccaacgaaaugggauuccuggagaagacaaagaaagaucucggcuuugggucaauuaccacucaggagagugaaucuaauauccuugacauagaccugagaccagcguccgcuuggacauuguaugccguggcaacgaccuucgugacuccuaugcugcgccauagcaucgagaacucaagugucaauguuagccucacagccauugcuaaccaggcaaccgugcugaugggacuugguaagggcuggccccucuccaaaauggauaucgggguaccgcuguuggccauuggauguuacucucaggugaauccaaucacccugacagcggcuuuacuacugcucgucgcccacuacgcaauuaucggcccuggucuucaagccaaggcuacuagggaagcccagaaacgggcagcugccgggauaaugaagaaccccacgguggacggcauuaccguuaucgaucuggagccaauccccuaugacccuaaguuugaaaaacaguugggacaggugaugcugcucauucugugcgucacacaaguacuuaugaugcguacuaccugggcguuaugugaggcccugacacucgcaaccggcccgauaagcacuuugugggaggggaaucccggaagauucuggaacacgacaaucgcuguguccauggccaauauuuuuaggggcucauaccuggccggugcugggcuacuguucucuaucaugaagaacaccacuaauacccgccggggaacaggcaacguuggugaaacucucggcgagaaauggaagagucgacuuaacgcccuggggaaaucggaauuucagauuuauaagaaaagcggaauccaggagguggauagaaccuuggccaaggagggcauaaagagaggggaaacagaccaucacgcggucucccgcggaucugcuaaacugcggugguucguggagagaaauauggucacgccagaaggcaaggugguugaucucgguugcgggcguggaggcuggucauacuauugugguggccugaaaaacgugagggagguaaagggguuaaccaaaggaggcccugggcaugaggaacccaucccuaugagcacuuacggauggaaucuugugcggcugcaauccggcgucgacguuuucuuuacaccacccgagaagugcgauacccuccuaugugacauuggugaaaguucuccuaacccaacuaucgaggcagggcgcacacugcgaguguugaaucuggucgaaaacuggcucaauaacaauacccaguucugcauuaaggugcuuaaccccuauaugccgagcguaaucgagaaaauggaaacgcugcagagaaaguacggaggcgccuuggugaggaauccucugucacggaacuccacccacgagauguacuggguuaguaaugcuacaggcaacauagugagcucugucaauaugauuucccgcaugcucaucaacagauuuacuaugaaacacaagaaagccaccuaugagccagauguggacuuagggucaggaacaaggaacaucgguauugaaagcgagauacccaaucuggauaucauuggcaagcgaaucgaaaagauuaaacaggagcaugaaacuucguggcacuacgaccaagaccauccuuauaagaccugggcauaccacgggucuuaugagacaaaacagaccggaagugccuccagcauggucaacggcgugguucggcuucugacuaagccaugggauguagugcccauggucacgcagauggcuaugacagacaccacuccguucggucagcaacguguguuuaaagagaagguugauaccagaacacaggaaccuaaggaggggacgaaaaagcuaaugaaaaucaccgcggaauggcucuggaaggagcugggaaaagagaagacuccccgcauguguacaagggaagaguucacccggaaagugagaucaaaugccgcauugggcgcugucuuuacugacgaaaacaaguggaaguccgcccgcgaggcaguggaagauggcagguucugggagcugguagaccgagagcggaaucuccaccuugaagggaaaugcgagacauguguguacaacaugaugggaaagagagagaaaaagcugggugaguuuggcaaagccaaggggucuagggcuauaugguauaugugguuaggagcccgcuuccuggaauuugaggcguugggcuuccucaaugaggaucauugguuuagccgugguaacagucuguccgggguugaaggagagggccuacaccggcuuggcuacauccugagagaagucgggaagaaagagggaggugcaauguacgccgacgauaccgcuggcugggacacaaggauuacucucgaagaucugaagaaugaggagauggugaccaaccauaugaaaggggaacacaagaaauuggccgaggcaaucuucaagcugacguaucagaauaaggugguccgcguucagcgaccaaccccucggggaacagugauggacauuaucagcagaaaagaccaaaggggcucuggucagguagggacuuacggacucaacaccuucacaaauauggaagcucagcuuauucgccaaauggagggcgagggcauauuuaagucaauccagcaucugacugccaccgaagagauugcugugcagaacugguuagccagagucgggcgggaaaggcugagucguauggcaaucuccggagaugacugcgugguuaaacccaucgaugaccgauucgcgagcgccuugacggcucucaaugauauggguaaggugcgcaaagacauucagcaaugggagccaucuagaggcuggaacgauuggacacagguccccuuuugcucgcaccacuuccaugaacuggugaugaaggacgggcgggucuuaguugugccuuguaggaaccaggaugagcuuauaggacgcgccagaaucucacagggcgcagguuggagccugaaggagaccgcuugccucgggaaauccuaugcccaaauguggacucugauguacuuucaccggagggacuugcgauuagcagccaaugcgauuuguagugcugucccaucucauugggugccgacaagccguaccacuugguccauccacgccaagcacgaauggaugaccacagaggauaugcuggcaguguggaacagagucuggauucaggaaaaucccuggauggaggacaaaacgccuguugaaucaugggaggaggugccauaucucggaaagcgcgaagaucaguggugcggcagucuuaucggccugaccucucgggccacuugggcuaaaaacauacagacagccaucaaucaaguaaggagccuaauugggaacgagggauacaccgacuauaugcccuccaugaagagauuccgccgggaagaggaagaggccggugugcugugguga

SEQ ID NO: 14379 - RNA, 9876 nt, Artificial Sequence
  derived and/or modified CDS sequence (opt3) from DENV-2__FJ898461__SS-prME
accgccggcgugauagucaugcugauucccacagcuauggcuuuccaccucacuacgagaaacggggagccucauaugauaguuggaaggcaggaaaaggguaaaagccuucuguuuaagaccgaggacggcgugaauaugugcacauugauggccaucgauuuaggggaacugugugaggacacuauuaccuacaaaugcccacuacuccggcaaaacgaaccggaggauaucgacuguuggugcaauuccacaucuaccuggguaacuuauggaacauguaccacgacuggcgagcaccgccgagaaaagcguucaguggcgcuggucccccauguggguauggggcuugagaccagaacagaaacuuggaugaguagcgagggagcuuggaaacacguucagaggauugagaccuggauccugcggcauccuggcuucacaauuauggccgcaaucuuggccuacaccauuggcacgacucacuuucagcgcgcucucaucuucauucugcugacagcaguggccccauccaugaccaugagaugcaucgggauaucuaacagggauuuugucgaaggagugucggguggcucauggguagacauuguucucgagcacgggagcugugugacuacaauggcuaagaauaagcccaccuuagauuucgaacugaucaaaacggaggccaagcagccugcgacccuucggaaauauugcauugaagcaaaguugacaaacacuaccacagagagucgcuguccaacucaaggagagcccucccugaaugaggaacaggacaaacgauuuaucugcaagcauucuauggucgauagaggcugggguaacggguguggacuauucggcaagggcgggaucgugaccugcgccauguuuacaugcaaaaagaauauggaaggaaaagugguccagccugagaaccucgaauacaccauuguuauaacuccacacagcggugaggagcaugcugugggcaaugacacggggaagcacggaaaagaaaucaagauuacaccgcaguccucaaucaccgaggccgaacugacuggcuaugguaccguaacaauggaguguagucccaggaccgggcuugauuucaacgaaauggugcuguugcaaauggaggacaaagcauggcucguccaccggcagugguuucuggauuuaccucugccauggcuccccggcgcugacacucagggaagcaauuggauacagaaggagacacuugugacguucaagaacccucaugccaaaaagcaagacguugugguccugggcucucaggaaggggcgaugcacaccgccuugacuggagcaacagagauucagauguccucagguaaucuacuguuuaccggccaucucaaaugccgucugcgcauggauaaacuucaacugaaagggaugagcuacaguauguguacaggaaaguucaagaucgugaaagaaaucgcugagacucagcacggcaccauuguaaucagaguucaguaugagggugacgggucuccaugcaagauucccuucgaaauaacggauuuggagaaaaggcaugugcucggccggcugaucaccgucaacccgauugugacagaaaaggacuccccugucaacaucgaggccgaacccccauuuggagauagcuacaucauuauaggcguggagccugggcaguuaaaacugaauugguucaagaagggaucgucuaucggucaaauguuucagacuaccguucgaggcgcuaaacgcauggccauucuaggggacacagcaugggauuucggaucccucggcgguguguuuacuucaaucgggaaggcccugcaccagguauucggcgcuauuuacggagcggcauuuaguggcgucagcuggaccaugaaaauccuuauaggggugaucauuacguggaucggaaugaacuccagaucuacuagcuugucaguuagucuggugcucgucggcgugguaacccuguaucuuggugccauggugcaggcugacuccggguguguugucagcuggaagaauaaagagcugaagugcggaucuggcauuuucaucacugauaacgugcacacauggaccgaacaauacaaguuucagcccgagucaccaaguaaauuggccagcgcaauacagaaggcccaugaagaggguauuuguggcaucagguccgugacucggcucgaaaaucugauguggaaacagauuacccccgaguuaaaccacauccugucugagaaugaagucaagcuaacaauaaugacgggggacaucaaaggaauuaugcaagcuggcaagcgcucgcucagaccucagccaaccgagcugaaauauagcuggaagacuugggggaaggccaaaaugcuuuccacagaaucacauaaccagaccuucuugaucgauggaccggagacagcagaaugccccaauacuaacagggcguggaauagucuggagguugaggacuacggcuuugguguguucaccacgaacauuuggcucaagcugcgugaaaaacaggacguguuuugugauucuaaguuaaugagcgcugccaucaaagacaaucgggcaguacacgccgauaugggguauuggauagaguccgcucugaacgacacauggaagauggaaaaggccucauucauugaggucaaaagcugccacuggccuaagucucauacccuuugguccaauggaguguuggagagugaaaugaucauccccaagaauuucgcaggccccguuagccaacacaacuaccgaccugguuaucauacucagaccgcuggcccauggcaccucgggaagcuggagauggauuuugaccuaugugaaggaacaacuguggucgugaccgaggauugcggcaauagagggcccucucugaggacaacgaccgccuccggaaaacucauuacugaauggugcugucgcucaugcacacugccgccucuucgguacagaggcgaggacgguuguugguacgggauggagaucaggccauugaaggaaaaggaggaaaaccugguuaauaguuuagugaccgcgggacauggccagauugauaacuucagccucgguguacugggcauggcccuuuuucuggaggaaauguugcgcacucgaauagggacaaaacacgcuauccuccuggucguggugucguucgucacccuaauuacgggaaauauguccuuucgggaccugggccguguuauggugaugguaggggcaacuaugaccgaugacaucggaaugggcgugacauaucucgcccugcuugcugccuucaaggucagacccaccuuugcagcggguuugcuguuaaggaaacucacuucuaaggagcugaugauggccacaauugggaucgcacuucugagccaaucaaccauaccugagacaauccuagaacucacugaugcccuggcauugggaaugauggugcugaaaauuguucgcaacauggagaaguaccaguuagcugugaccaucauggccauuaguugcguccccaaugcagugauccuccagaacgccuggaagguuuccuguacgauacuggcugcggugucugucagcccacuucuguugacauccucacagcaaaaagccgacuggauuccucucgcacugaccaucaagggccuaaaucccacugcuaucuuccugaccacacuuagccggacaaguaaaaagagaucuuggccacucaacgaagccauuauggccguaggcaugguguccauacuggcuagcucguugcugaaaaaugacaucccgaugaccgggccuuuaguugcaggaggucuccugacggugugcuauguccuuacaggcaggucagccgaucuggaguuggaacgagcggcugacgugaagugggaggaucaggccgagauuucugggaguucccccauccucagcauuaccaucucugaagacggaagcauguccaucaaaaacgaggaagaggagcagacucugacaauccuaauucgcaccggccugcuuguaaucucagguguguuuccagucaguauucccaucacugcagccgcuugguaccucugggaaguuaagaagcagcgggcaggggugcugugggaugugccuagcccacccccugucgagaaagccgaauuggaggacggagcguauagaauaaagcaaaggggcauuuuaggcuacucucagaucggggcuggaguguauaaagaagguacauuccacaccauguggcauguuacgcguggcgccguacugaugcaccgcgggaagcggaucgagccguccugggcagaugugaaaaaggaccucauuucauacggaggcgguuggaagcuggagggggaauggaaagagggagaagagguccaggugcuugcccuggaaccaggcaagaaucccagagcuguucagacuaaaccuggcaucuuuaagaccaacacagggaccauaggagccgugaguuuggauuucagcccagguacauccggcucucccauugucgacaggaaagggaaggugguaggacuauacggcaauggugucgugacucgaucgggggcauauguuagcgcuaucgcccaaaccgagaagucaauugaggauaacccugaaaucgaggacgauauauuucggaaaaagcgccugacgauuauggaccuccauccgggagcgggcaaaacaaagagauaccugcccgccaucgugagggaagcaaucaaacggggccuucgaacuuuaauucuggcuccaaccagagucguggccgcugagauggaagaggcacuccgcggguugccuaucagguaucagacacccgccauuaagaccgagcacacuggacgugaaauaguugaccugaugugucaugccaccuucacaaugcggcuccuguccccagugagagucccuaacuacaaucuuaucauuauggaugaggcucacuucacggaccccgcgaguaucgcagccagggguuauaucucuacucgcguggaaaugggcgaggcugccgggauuuuuaugaccgcaacaccaccgggaagccgagauccuuucccccaguccaacgccccaauaauggacgaggaaagagagauccccgaacggucauggaacucuggccacgaguggguaaccgauuuuaaggguaaaacugugugguucguuccuagcauuaaggcugggaacgacaucgcggccugccugaggaaaaauggaaagaaagucauucaauugagucgcaagacauuugauuccgaauacgugaagacccgugcaaacgacugggauuucguggucacgacugacaucagcgagaugggcgcuaauuuuaaagccgagagaguaauagauccacggagguguaugaagcccgugauccuaacagacggcgaagaacgcguuauucuggcagggccuaugccggugacccauucuucagccgcucagcgaagaggacggaucgguaggaaccccaaaaaugaaaacgaccaguauauuuacaugggcgagccccucgaaaaugaugaggacugcgcccacuggaaggaggcgaaaauguuacuggauaacaucaauaccccugaagggauaauucccuccauguucgagccagaacgcgagaaggucgacgcaaucgauggagaauacagacuuaggggcgaggcccggaaaacuuuuguggaccugaugcgucgcggugaucucccuguuugguuggcuuauaagguggccgcugaggggauuaacuacgcagaccgaaagugguguuucgauggcaucaaaaauaaccagauacuggaagagaacauggaagucgagaucuggacaaaggagggagaaaggaaaaagcucaaacccagauggcuggacgcccggauuuauagugauccacuugcucuaaaggaguuuaaggaguucgccgcaggccgcaaaagccugaccuugaauuuaaucacagagauggggagacugccuacuuucaugacgcaaaaggcgaggaacgcccucgacaaucuggcugugcuucauaccgccgaagcaggaggucgggcuuacaaccacgcccugucggagcucccggagacauuggaaacucugcuacugcucacccuucuggcaacaguaaccggcgggauauuuuuauucuugaugucuggaaaaggcaucgguaagaugacucuggggaugugcugcauaauuacggccuccauccuccugugguaugcucagauccagccccacuggauugcggccagcaucauacuugaguuuuuccugauugugcucuugaucccagaaccugagaaacagcgaaccccacaagauaaucagcugacauacguugucauugcaaucuuaacugugguggcugccaccauggccaacgaaaugggcuuucuagagaagacaaagaaagaccugggacucggcucaauaaccacucaggagccagaaaguaauauccuugacauugaucugagaccugcaucugcuuggacauuguaugccgucgcgacgaccuucguuacucccaugcugcgccauuccaucgagaacagcucagugaauguaagucucacagcuauugccaaccaggcaaccgugcugauggggcuuggaaaggguuggccgcucagcaaaauggacaucggcgucccacuguuggccauuggguguuacucccaagugaauccuaucacccugacagcugcauuacuacugcucguugcccacuacgcgauaauuggacccggccuucaggcuaaggccacuagggaagcacagaaacgggccgcugccgguaucaugaagaacccaacgguggaugggaucaccgucauugaccuggagcccauaccuuaugauccgaaguuugaaaaacaguugggccaaguaaugcugcucauccugugcgugacacagguucuuaugaugcguacuaccugggcauuaugugaggcucugacacucgccaccggacccauuucuacuuugugggagggcaauccagggagauucuggaacacgacaaucgcggugagcauggccaauauuuuuaggggauccuaccuggcaggcgcuggucuacuguucucaaucaugaagaacaccacuaauacccgccgggggacaggaaacauaggcgaaacucucggugagaaauggaagucucgacuuaacgcccugggcaaaagugaauuucagaucuauaagaaaucggggauucaagaggucgacagaaccuuggcaaaggagggaaucaagaggggcgaaacagaucaucacgcugugagccgcggguccgccaaacugcggugguucgucgagagaaauauggugacgccugaaggaaagguuguggaccucggcugcggucgugggggauggucuuacuauuguggcggucugaaaaacguaagggaggugaagggcuuaaccaaagggggacccggccaugaagaaccuauuccaaugucaacuuacggguggaaucuuguccggcugcagagcggaguugauguguuuuucacacccccugagaagugcgacacccuccuaugugauaucggcgaauccaguccaaaccccacuauagaggccggucgcacacugcgagucuugaaucugguggaaaacuggcucaauaacaauacccaguucugcauuaagguacuuaacccguauaugccuucugugaucgagaaaauggaaacgcugcagagaaaguacgggggagcguugguuaggaauccacugagccggaacucaacccacgagauguacuggguguccaaugcuacaggcaacaucgucaguagcgugaauaugauuucucgcaugcucauaaacagauuuacuaugaaacacaagaaagcaaccuaugagcccgacgucgauuuaggcuccgggacaaggaacaucggaauugaaucagagaucccuaaucuggacauuaucgguaagcgaauagaaaagaucaaacaagagcaugaaacuagcuggcacuacgaccaggaucauccauauaagaccugggccuaccacggcucguaugagacaaaacagaccgggucugcuaguuccauggugaacggaguuguacggcuucugacuaagcccugggacguggucccgauggugacgcagauggccaugacagauaccacuccuuucggccaacagcguguuuuuaaagagaagguggacaccagaacacaggaacccaaggaggguacgaaaaagcuaaugaaaauuaccgcagaauggcucuggaaggagcuggggaaaaagaaaacuccacgcauguguacaagggaggaguucacccggaaggucagaagcaaugccgcuuugggagcgaucuuuacugaugagaacaaguggaaaucagcccgcgaagcaguggaggacggcagguucugggaacugguagaucgagagcggaaucuccaccuugagggcaagugcgaaacauguguguacaacaugauggggaaaagagagaagaaacugggagaauuugguaaggcuaagggcuccagggccauuugguauaugugguuaggggcacgcuuccuggaguuugaagccuugggauuccucaaugaggaccauugguuuucucguggcaacagccugagugguguugagggggaaggacuacaccggcuuggcuacauccugagagaugucggcaaaaaggaagggggagcuauguacgccgacgauaccgcggguugggacacaaggauuacucucgaagaccugaaaaaugaggaaauggugaccaaccauaugaagggcgagcacaaaaaguuggcagaggccauauucaagcugacguaucagaauaaagugguccgcguucaacgaccuaccccacgggggacagugauggauaucauuuccagaagggaccagcgcggaagcggccagguagguacuuacgggcucaacaccuuuacaaauauggaagcucaacuuaucagacagauggagggagaaggcaucuucaagucuauucagcaucugacugccaccgaggagauagcagugcagaacugguuagcucggcugggcagggaacguuugucacgaauggccaucaguggggaugacugcgucgugaaaccaauugaugaccgcuucgcuuccgcccucacggcacugaaugauaugggaaagguuagaaaagacauccaacagugggagcccagccgggguuggaacgauuggacacaggugccuuuuugcucucaccacuuccaugagcuagucaugaaggacggcagggugcuuguaguuccaugucgcaaccaggaugagcugauugggagagcgcggaucucgcaaggagccggcuggucacucaaggaaaccgcuugccuggguaaaagcuaugcccagauguggacuuugauguacuuucacaggcgagacuuacgucuggcagcuaaugccauauguuccgcagugccgagucauuggguccccacaucuagaaccacuuggagcauccacgccaagcacgaguggaugaccacagaggauaugcucgcgguguggaaccgcguguggauucaggaaaauccuuggauggaggacaaaacgccagucgaauccugggaggaaguucccuaucuugggaagcgggaggaccaguggugcggaucacugaucggccuaaccaguagggcuacuugggccaaaaacauucaaacagcaaucaaucaggugagaucucugauaggcaacgaggaauacaccgauuauaugccuagcaugaagcgcuuccggagggaggaagaggaagccgggguacucugguga

SEQ ID NO: 14380 - RNA, 9876 nt, Artificial Sequence
  derived and/or modified CDS sequence (opt3) from DENV-2__FJ024473__SS-prME
accgccggcgugaucgucaugcugauuccaacagcuauggcauuccaccucacuacgagaaauggggagccucauaugauaguuggaaggcaggaaaaggguaaaagccuucuguuuaagaccgaggacggcgugaauaugugcacauugauggccaucgauuuaggggaacugugugaggacacuauuaccuacaaaugcccacuacuccggcaaaacgaaccggaggauaucgacuguuggugcaauuccacaucuaccuggguaacuuauggaacauguaccacgacuggcgagcaccgccgagaaaagcguucaguggcgcuggucccccauguggguauggggcuugagaccagaacagaaacuuggaugaguagcgagggagcuuggaaacacguucagaggauugagaccuggauccugcggcauccuggcuucacaauaauggccgcaaucuuggccuacaccauuggcacgacucacuuucagcgcgcucucaucuucauucugcugacagcaguggccccauccaugaccaugagaugcaucgggacuucuaacagggauuuugucgaaggagugucggguggcucauggguagacauaguucucgagcacgggagcugugugacaaccauggcuaagaauaagcccacguuagauuucgaacugauuaaaaccgaggccaagcagccugcgacacuucggaaauauugcaucgaagcaaaguugacuaacaccacaacugagagucgcuguccaacccaaggagagcccucccugaaugaagaacaggacaaacgauuuauuugcaagcauucuauggucgauagaggcugggguaacggguguggacuauucggcaagggcgggaucgugacaugcgccauguuuaccugcaaaaagaauauggaaggaaaagugguccagccugagaaccucgaauacacuaucguuauuacgccacacagcggugaggagcaugcugugggcgacgauacagggaagcacggaaaagaaauaaagaucaccccgcaguccucaauuacugaggccgaacugaccggcuaugguacaguaaccauggaguguagucccaggacugggcuugacuucaaugaaauggugcuguugcaaauggaggauaaagcauggcucguccaccggcagugguuucuggacuuaccucugccauggcuccccggcgcugacacacagggaagcaacuggauccagaaggagacgcuugugaccuucaagaauccucaugccaaaaagcaagauguugugguccugggcucucaggaaggggcgaugcacacugccuugacaggagcaaccgagauacagauguccucagguaaccuacuguuuacaggccaucucaaaugccgucugcgcauggacaaacuucaacugaaagggaugagcuacaguauguguacuggaaaguucaagauugugaaagaaaucgcugagacccagcacggcacgaucguaauuagaguucaguaugagggugaugggucuccaugcaagauccccuucgaaauuaccgacuuggagaaaaggcaugugcucggccggcugauaacagucaauccgaucgugauugaaaaggauuccccugucaacaucgaggccgaacccccauuuggagacagcuacaucauuauaggcguggagccugggcaguuaaaacugaacugguucaagaagggaucgucuaucggucaaauguuugagacuaccaugcgaggcgcuaaacgcauggccauucuaggggauacagcaugggacuucggaucccucggcgguguuuuuacuucaaucgggaaggcccugcaccagguguucggcgcuauuuacggagcggcauuuaguggcguaagcuggaccaugaaaauccuuauaggggucgugaucacguggauuggaaugaacuccagaucuacgagcuugucaguuagucuggugcucgucggcgugguaacccuguaucuuggugccauggugcaggcugauuccggguguguugucagcuggaagaacaaagaacugaagugcggaucuggcaucuucauuacugacaaugugcacacauggaccgagcaguacaaguuucaacccgaaucaccaaguaaauuggccagcgcaauccagaaggcccaugaggaagguauauguggcauuagguccgugacucggcucgagaaccugauguggaaacagaucacccccgaguuaaaucacauucugucugaaaacgaggucaagcuaacaaucaugacgggggauaccaaaggaauaaugcaggcuggcaagcgcuaucucagaccucaaccaacugaacugaaauacucguggaagacaugggggaaggccaaaaugcuuagcaccgagucccauaaucagacauucuugaucgacggaccggaaacugcagagugccccaacaccaauagggcguggaacucacuggagguugaagacuauggcuuugguguguucacgacaaauauuuggcucaagcugcgugagaaacaggauguguuuugugacaguaaguuaaugucugcugccaucaaagauaaccgggcaguacacgccgacaugggguacuggauugaaagcgcucugaaugauaccuggaagauggagaaggccuccuucaucgaggucaaaucaugccacuggccuaagagccauacucuuuggucuaacggaguguuggaauccgagaugauaauucccaagaauuucgcaggccccguuagucagcacaacuaucgaccugguuaccauacccaaacagcuggcccauggcaccucgggaagcuggaaauggacuuugauuucugugagggaacuaccguggucgugacagaagacugcggcaacagagggcccagccuaaggacgaccacugccucuggaaaacugaucacagaguggugcugucgcuccugcacccucccgccucugcgguacagaggcgaggaugguuguugguaugggauggaaaucaggccacuuaaggagaaggaagagaauuugguuaacucacuggugacugcgggacauggccagauugacaauuuuaguuuagguguacucggcauggcccuguuccuugaagagaugcugcgcacacgagucgggaccaaacacgcuaucuugcucguggcagugagcuuugucacgcugauuacuggaaacaugucguuccgggaucuaggccguguuauggugaugguaggggccaccaugacagacgauauaggaaugggcgugaccuaccuggcucuccuggccgcauuuaaggucagacccacuuucgcggccggucuuuugcugaggaaauuaacauccaaggagcucaugauggcuaccaucgggauuacacugcuuucucagagcacuaucccugaaaccauucuggagcuaacggacgcccucgcacugggaaugaugguguugaaaaucguucgcaauauggaaaaguaucaacuggcugugacaauaauggccaucucaugcguccccaacgcagugauuuuacggaaugccuggaagguuaguuguaccauccucgcugcgguguccgucucuccacugcuucugacuagcucccagcagaaagccgacuggauuccuuuggcacucaccaucaagggccugaaccccacagcuauauuucuaacuacccugucaagaacgagcaaaaagaggaguuggccacuuaaugaggccauuauggccguaggcauggugucuauccucgcuuccagccuguugaaaaacgauaucccgaugacagggccucugguugcaggagguuuacucaccgugugcuacguccugacuggccgaucggccgaccuugaacuggagcgcgcggcugaugugaagugggaggaccaggccgaaauuucagggucuagucccauauuguccaucacaauuagcgaggauggaucuaugagcaucaaaaaugaagaggaggaaaccacucucacaauucugauccggaccggccuacugguaauauccgguguguucccagucucaauccccauuacggcagccgcuugguaucuuugggagguuaagaagcaaagagcaggggugcucugggacgugccuaguccaccccuggucggaaaagccgaauuggaggauggcgcguacaggaucaagcagcguggcauuuuaggguauagccagaucggagcugguguguacaaagaaggcacuuuucacaccauguggcauguuacacgcggggccguacugaugcaccggggaaagagaauagagccuucuugggcagacgugaaaaaggaucucauuuccuacggcgguggguggaagcuggagggagaauggaaagagggcgaagagguccaggugcuugcccuggaaccgggcaagaacccaagggcuguucaaaccaaacccgggaucuucaagacaaauacuggaaccaucggugccgugucauuggacuuuaguccuggcacgagcggguccccaauugucgaucgaaaaggaaaggugguaggccuauaugguaacggggucgugacacggucuggagcauacguuucggcuaucgcccagacugaaaagagcauagaggacaaucccgaaauugaggaugacaucuuccgcaaaaagagacugaccauuauggaccuccauccuggcgcgggcaaaacaaagagguaucugccggccaucgugcgggaagcaauaaaacgagggcuuagaaccuuaauucuggcucccacucgcgucguggccgcugagauggaagaggcacucaggggauugccaauccguuaccagaccccugccaucaaggccgagcacacaggucgggaaauuguugaucugaugugucaugcuacguucacuaugagacuccugucacccgugagggucccaaacuauaaccuuaucauuauggacgaggcgcacuuuaccgauccugcauccauagccgcucgcggcuacaucaguacacgaguggaaaugggggaggccgcaggaauuuucaugaccgccacucccccaggcucuagagacccguuuccucagagcaaugcucccaucauggaugaggaacgggagaucccagaaagguccuggaacucaggucacgaguggguaacagacuucaaggggaaaaccgugugguuuguucccucuauuaaggcgggaaaugauauagccgcaugccugcgcaaaaacggcaagaaagucauccaauugagccguaagacguucgacagugaauaugugaagacuagagcuaaugauugggacuuuguggucacaaccgauauuuccgagaugggcgccaacuucaaagcagagcggguaaucgacccuaggcgcuguaugaagccagugauucuaaccgacggggaagaacgaguuauccuggccggacccaugccugugacucauagcucugcugcccagagacgggguaggauaggccgcaauccgaaaaacgaaaaugaucaguacaucuacaugggggagccacucgaaaacgacgaggauugcgcgcacuggaaggaggcaaaaauguuacuggacaauauuaacacacccgaaggaaucauuccuucaauguuugagcccgaaagagagaaggucgaugccguggacggcgaauauaggcuucggggugaggcucguaaaaccuucguugaucugaugcgccgaggggaccucccagugugguuggccuacaaggucgcugcagagggcaucaauuaugccgauagaaagugguguuuugacggaauuaaaaacaaucaaauacuggaagagaacguggaaguagagaucuggacaaaggagggcgaaaggaaaaagcucaaaccucgguggcuggaugcucgcauuuacuccgacccccuugcccuaaaggaguucaaggaguucgcagcggggagaaaaagucugacuuugaacuuaaucacggagaugggaaggcugccaaccuuuaugacacagaaggcccggaaugcucucgauaaccuggccgugcuucauacugcagaagcugguggccgagccuauaaucacgcacugagcgagcucccugagaccuuggaaacacugcuacugcucacccuucuggccacuguuacaggcgggauauucuuauuuuugaugucggggaaagguaucgggaagaugacccugggcaugugcugcauuaucacagcuucuguccuccugugguacgcgcagauucagccgcacuggaucgccgcauccauaauucuugaguucuuucugaucgugcucuugauccccgaaccagagaaacaaagaacuccucaggacaaccagcugaccuauguggucauugcuaucuuaacaguuguggccgccaccauggcaaaugaaaugggauuccuagagaagacuaagaaagaccugggccucgggagcauaacaacgcaggagucagaaaguaacauucuugauaucgaccugcgccccgcuucugccuggaccuuguacgcgguagcuacuacauuugugaccccaaugcugaggcauuccauugagaauagcucagucaacgugagucucaccgccaucgcaaaucaagccacaguucugaugggacuugguaagggcuggccucucagcaaaauggauauaggggugccccuguuggcuaucggauguuacucccaggucaacccgauuacucugacggcagccuuacuacugcucguagcgcacuaugcuaucauuggcccaggucuucaggccaaggcaacccgggaagcccagaaacgugcugccgcagggaucaugaagaauccuacaguggacggcauuacuguuaucgaucuggagcccauaccauacgaccccaaguucgaaaaacaauugggacaggugaugcugcucauucugugcgucacccaggugcuuaugaugagaacaaccugggcuuuaugugaggcccugacucucgcgacgggcccuaucucuacauugugggaggggaacccgggaagguuuuggaauaccacuaucgccgucagcauggcaaacauuuuccgcggcuccuaucuggcuggugccgggcuacuguuuucaauaaugaagaauaccacaaacacucggcgaggaaccggcaauaucggugaaacacucggcgagaaauggaagucuagacuuaacgcacuggggaaaagugaguuccagauuuacaagaaaucgggaauccaagagguggauaggacguuggcuaaggagggcauuaagcgcggggaaaccgaccaucacgccguuagccggggauccgccaaacugagaugguuuguggagcguaacaugguaacucccgaaggcaagguggucgaucucgguugcgggaggggaggcuggucuuauuacugugguggccugaaaaauguucgggaggugaagggguuaacaaaaggaggcccagggcaugaggaaccuauccccaugucaaccuauggauggaaccuuguccgccugcagagcggcguggacguauucuucacuccuccagagaagugcgauacacuccuaugugacauaggugaauccagucccaauccuaccaucgaggcggggcgaacgcugagaguguugaaccugguugaaaauuggcucaacaauaacacccaguuuugcauuaaggugcuuaauccauacaugcccucugucaucgagaaaauggaaacacugcaaaggaaguacggaggcgcuuuggugcggaacccgcugagccgcaauucaacucacgagauguauugggucuccaacgcaaccggcaauauugugaguagcguuaacaugaucucuagaaugcucauaaauagguucacaaugaaacacaagaaagccacuuacgaggcugauguagacuuaggguccggaacccgaaacauugguaucgaaucagagaucccuaaccuggacauuauaggcaagcggaucgaaaagauuaaacaggagcaugaaacaagcuggcacuaugaucaggaccauccauacaagaccugggccuaucacgggucguacgagacuaaacagacgggaucugcaaguuccauggugaauggcgucgugcgucuucugacaaagcccugggauguugugccuauggucacccaaauggccaugacugacaccacaccauuuggucagcagagaguguucaaagagaagguagauacgcgcacccaggaacccaaggaggggacuaaaaagcuaaugaggaucacagcugaauggcucuggaaagagcugggaaagaaaaagaccccgcggauguguacuagagaggaauuuacacgcaaagugaggagcaacgcggccuugggcgcaauuuucaccgacgagaauaaguggaagucagcucgagaagccguugaggauggccgguuuugggaacuggucgacagagagaggaaccuccaccuugaggggaaaugcgaaacauguguguauaauaugaugggaaagcgcgagaaaaagcugggugaguucggcaaagcaaaggggucccgugccaucugguacaugugguuaggagcucgguuucuggaguucgaagccuugggcuuucucaacgaggaucauugguucucuagagguaauagccugagugggguggagggagaaggccuacacaggcuuggcuacauacugcgcgacgucgggaagaaagagggaggugcgauguaugcagaugacacugccggcugggacacccgaaucacgcucgaagaucugaagaacgaggaaaugguuaccaaucauaugaaaggggagcacaagaaauuggcugaggccauuuuuaagcugacauaccaaaacaaggugguacgggugcagagaccuacucccaggggaaccgucauggacaucauuucccgcagagaucagcggggcagcggucagguggggacauauggacucaauacuuucaccaacauggaagcacaacuuaucaggcagauggagggcgaaggcauuuucaaaucuauacagcaucugacggcuacagaggagaucgccgcucaaaauugguuagcccguguugggcgagaacgccugucaagaauggcaauuaguggagacgauugcguggucaagccaaucgacgaucgguuugcguccgccuugaccgcucucaacgacauggguaaagugaggaaggauauccagcagugggagccuagccgcggcuggaaugacuggacucagguacccuucugcucucaccacuuucaugaacugguuaugaaagaugggagagugcuagucgugccaugucggaaccaagacgagcuuauuggaagggcccgaauaucgcagggcgcagguuggucacugaaggaaacagcuugccucggaaagagcuacgcccagauguggacccugauguauuuccaccguagagauuugcgcuuagcagccaacgcgaucuguuccgcugugcccagucauugggucccuacuucucggaccacauggagcauucacgccaaacacgaguggaugacgaccgaggacaugcuggcaguuuggaauaggguguggauccaggaaaacccauggauggaggacaagacuccgguagaauccugggaggaagugcccuaccucggaaaaagagaggaucaauggugcggcucacuuauuggccugacaagucgcgccaccugggcuaagaauauccagacugccauaaaccagguccggucucuaaucgggaaugaggaauauacagacuacaugccuagcaugaaaagguuucgaagagaggaagaggaagcaggagugcugugguga

SEQ ID NO: 14381 - RNA, 9876 nt, Artificial Sequence
  derived and/or modified CDS sequence (opt3) from DENV-2__FJ024474__SS-prME
accgccggcgugaucgucaugcugauucccacagcuauggcauuccaccucacuacgagaaacggggagccucauaugauaguuggaaggcaggaaaaggguaaaagccuucuguuuaagaccgaggacggcgugaauaugugcacauugauggccaucgauuuaggggaacugugugaggacacuauuaccuacaaaugcccacuacucaagcaaaacgaaccggaggauaucgacuguuggugcaauuccacaucuaccuggguaacuuauggaacauguaccacgacuggcgagcaccggcgcgaaaaacgaucaguggcgcuggucccccauguggguauggggcuugagacccguacagaaacuuggaugaguagcgagggagcuuggaagcacguucagagaauugagaccuggauccugaggcauccuggcuucacaauaauggccgcaaucuuggccuacaccauuggcacgacucacuuucagcgggcucucaucuucauucugcugacagcaguggccccauccaugaccaugcgcugcaucgggauaucuaacagagauuuugucgaaggagugucggguggcucauggguagacauuguucucgagcacgggagcugugugacuacaauggcuaagaauaaacccaccuuagauuucgaacugaucaagacggaggccaaacagccugcgacccuuaggaaguauugcauugaagcaaaauugacaaacacuaccacagagagucgguguccaacucaaggagagcccucccugaaugaagagcaggacaagcgcuuuaucugcaagcauucuauggucgaucgaggcugggguaacggguguggacuauucggcaaaggcgggaucgugaccugcgccauguuuacaugcaagaaaaauauggaaggaaaggugguccagccugagaaccucgaauacaccauuguuauaacuccacacagcggugaggagcaugcugugggcaaugacaucgggaaacacggaaaggaaauuaaaaucacgccgcaguccucaauaacagaggccgaacugaccggcuaugguacuguaaccauggaguguagucccagaacagggcuugauuucaacgaaauggugcuguugcaaauggaggacaaggcauggcucguccacaggcagugguuucuggauuuaccucugccauggcuccccggcgcugacacccagggaagcaauuggauucagaaggagacucuugugacauucaaaaacccucaugccaagaaacaagacguugugguccugggcucucaggaaggggcgaugcacacggccuugaccggagcaacugagauccagauguccucagguaaucuacuguuuacaggccaucucaagugccggcugcguauggauaaacuucaacugaaggggaugagcuacaguauguguaccggaaaguucaaaaucgugaaggaaauugcugagacacagcacggcacuaucguaauucgcguucaguaugagggugacgggucuccaugcaaaauacccuucgaaaucaccgauuuggagaagagacaugugcucggcaggcugauuacggucaacccgaucgugaucgaaaaagacuccccugucaacauugaggccgaacccccauuuggagauagcuacauaaucauuggcguggagccugggcaguuaaagcugaauugguucaagaaaggaucgucuaucggucaaauguuugagaccacaaugcggggcgcuaagcgaauggccauucuaggggacacugcaugggauuucggaucccucggcgguguuuuuaccucaaucgggaaagcccugcaccagguguucggcgcuauauacggagcggcauuuaguggcguaagcuggacaaugaagauccuuauuggggucgugaucacuuggauuggaaugaacucccgcucuaccagcuugucaguuagucuggugcucgucggcgugguaacgcuguaucuuggugccauggugcaggcugacuccggguguguugucagcuggaaaaauaaggaacugaagugcggaucuggcaucuucauaacagauaacgugcacaccuggacugagcaguacaaauuucaacccgaaucaccaaguaaguuggccagcgcaauucagaaagcccaugaggaagguaucuguggcauuagauccgugacaaggcucgagaaucugauguggaagcagaucacccccgaguuaaaccacauacugucugaaaaugaggucaaacuaacuaucaugaccggggacacaaagggaauuaugcaggcuggcaaacgguaucuccgcccucaaccaacggaacugaaguacucguggaagaccugggggaaagccaagaugcuuagcacugagucccauaaccagacauucuugaucgauggaccggaaaccgcagagugccccaauacaaacagagcguggaauucacuggagguugaagacuauggcuuugguguguucacuaccaacauuuggcucaaacugagggagaagcaggacguguuuugugauaguaaauuaaugucugcugccaucaaggacaaucgugcaguacacgccgauaugggguacuggauagaaagcgcucugaacgacacguggaagauggagaaagccuccuucauugaggucaagucaugccacuggccuaaaagccauacacuuuggucuaauggaguguuggaauccgagaugaucaucccaaagaacuucgcaggccccguuagucagcacaacuaucggccugguuaccauacccaaacugcuggcccauggcaccucgggaaacuggaaauggauuuugacuucugugagggaaccacaguggucgugacugaagauugcggcaaucgagggcccagccuaagaaccacaacggccucuggaaagcugauuaccgaguggugcuguagguccugcacucucccgccucugcgcuaccggggcgaggacgguuguugguaugggauggaaaucagaccacuuaaggagaaagaagagaacuugguuaauucacuggugacagcgggacauggccagauugauaacuuuaguuuagguguacucggcauggcccuguuccuugaagagaugcugaggacccgcgucgggacuaagcacgcuauauugcucguggcagugagcuuugucacacugaucaccggaaauaugucguuccgagaccuaggccggguuauggugaugguaggggccacgaugacugaugacauuggaaugggcgugaccuaccuggcucuccuggccgcauuuaaaguccgucccacauucgcggccggucuuuugcugagaaaguuaaccuccaaagagcucaugauggcuacuaucgggauuacacugcuuucucagagcaccaucccugaaacaauacuggagcuaacugaugcccucgcacugggaaugaugguguugaagaucguuaggaacauggaaaaguaucaacuggcugugaccauuauggccaucucaugcguccccaaugcagugauuuuacgcaacgccuggaaaguuaguuguacgauccucgcugcggccuccgugucuccacugcuucugacaagcucccagcagaaggcagacuggauaccuuuggcucucaccauuaaaggccugaaucccacugccaucuuucuaaccacacugucacggacuagcaagaaaagaaguuggccacuuaacgaggccaucauggcugucggcaugguaucuauucucgcauccagccuguugaagaaugacauaccgaugaccgggccucugguggccggagguuuacucacgguuugcuacgugcugacaggcaggucggcggaucuugaacuggagcgagcugccgacgucaaaugggaggaucaggcagaaaucucagggucuagucccauuuuguccaucaccauuagcgaggacggaucuaugagcaucaagaacgaagaggaggaacaaauacucacuauccugauucgcacaggccuacuggugaucuccgguguauucccagugucaauucccaucaccgccgcugcaugguaucuuugggaggucaagaaacagcgggccgggguucucugggaugugccuaguccacccccugugggaaaggcggaacuggaggacggcgcuuacagaauaaaacagaggggcauuuugggguauagccagaucggagccggugucuacaaggaaggcacuuuucacacaauguggcaugugacccguggggcaguuuuaaugcaccgcggaaaacggaucgagccgucuugggccgauguaaagaaggaccugauuuccuacggcgguggguggaaacucgagggagaauggaaggagggcgaagaggugcaaguccuggcucuugaaccaggcaaaaaucccagagccgugcagacgaagccugggaucuucaaaacuaacaccggaacaauaggugcaguuucacuggauuuuaguccaggcaccagcgggucccccauuguggacaggaagggaaaggucgugggcuuguaugguaaugggguagucacacgaucuggagcuuacgugucggccaucgcgcagacugagaaaagcauugaggauaacccugaaaucgaggacgauauauuccggaagaaacgccuaaccauuauggaccugcauccgggcgccggcaagacgaaaagauaucuccccgcaaucguuagggaagcuaucaagcgggggcugcgaacacuuauuuuagccccaacuagaguggucgcugcagagauggaagaggcccugcgcggacucccuaucagguaccagacccccgccauuaaggcugagcacacaggucgugaaauaguggacuugaugugucaugcgaccuucacuaugcggcugcucucaccaguuagagugccuaacuauaaucugaucauuauggaugaggcacacuuuaccgaccccgccuccaucgcugccaggggcuacaucaguacacgcgucgaaaugggggaggcagccggaauuuucaugacggcuacuccaccgggcucucgagauccuuuuccccaaagcaacgcgccaauaauggacgaggaaagagagauccccgaacgguccuggaauucaggucacgagugggugaccgauuucaaagggaagacaguaugguuugugccuucuauuaaagccggaaacgacaucgcagcuugccuuaggaagaauggcaaaaagguuauucagcugagccgcaagaccuucgauagugaauaugucaaaacucgugccaacgacugggauuuuguggugacaaccgacaucuccgagaugggcgcaaauuucaaggccgagagagucauagauccacggagguguaugaaacccguaaucuugacgcauggggaagagcgcgugauucuagcuggaccuaugccgguuacucacagcucugccgcgcagcgaagaggucggaucggcaggaacccaaagaaugaaaacgaccaauacauuuacaugggggagccccuggaaaaugacgaggauugcgcacauuggaaagaggccaagaugcucuuagacaacaucaauacaccugaaggaauaauucccucaauguuugagccagaacgcgagaaaguggaugcugucgacggcgaauauagacugaggggugaggcccggaagaccuucguggaucuuaugcgucgcggggaccugccuguuuggcucgcuuacaagguggcagccgagggcaucaacuaugcugaucgaaaaugguguuuugacggaauuaagaauaaccagaucuuggaagagaacgucgaaguggagauauggaccaaagagggcgaaagaaagaaacugaagcccagguggcucgaugcccggaucuacuccgacccacuggcacuuaaggaguucaaagaauucgcggccgggcgcaagagucuaacucugaauuugauuacagagaugggaagauuaccuaccuuuaugacacagaaagcuaggaacgcccuggauaaucucgcaguacugcacacugcugaagccgguggccgggcauauaaccacgcccuuagcgagcugccggagacgcucgaaaccuugcugcuacugacacuccuugcuacugugaccgggggaaucuuccuguuuuuaaugucgggcaaggguauugggaaaaugacauugggcaugugcugcaucauaaccgcgucuguucugcucugguacgcccagauucaaccccauuggaucgcagcuuccaucauucuggaguucuuucuuaucguccugcucauaccagaaccugagaagcagcgaacuccccaggacaaucaguugacguauguggugauugccauccugaccgucguugccgcaacaauggcuaacgaaaugggauucuuagagaagacuaaaaaggaucuaggccuggggagcauuaccacacaagagucagaaaguaauauccucgacauagaccuuagaccagccucugcguggacccuguacgcuguggccacuacauuuguaacgccuauguugcgccacuccaucgagaacagcucagugaaugucagucugaccgcaauugccaaccaggcuacugugcucaugggacuggguaaaggcuggccccuuagcaagauggauaucgggguuccgcuccuggcaauuggauguuacucccaggugaauccaaucacauugaccgccgcgcuguuacuacuggucgcucauuaugccauuaucggcccuggucuccaggcaaaagccaccagggaagcucaaaagcgggccgcagcugggauaaugaagaaccccacaguagacggcauuacugugaucgaucuugagccaauccccuacgacccuaaauucgaaaagcagcugggacagguuauguugcugauucucugcgugacgcagguccugaugaugcguaccacaugggcccuuugugaggcguuaacucuggccaccggcccgauaucuacacucugggaggggaaucccggaagauuuuggaacaccacuaucgcagugagcauggcuaauauuuucaggggcuccuauuuggccggugcagggcugcuauuuucaaucaugaaaaacacgacaaauacccgccggggaacuggcaacauuggugaaacccugggcgagaaguggaaaucucgacucaacgcucuugggaagagugaauuccaaaucuacaaaaagucgggaauacaggaggucgauagaacacuggccaaggagggcaucaaaaggggggaaacugaccaccaugccgugagccgcggauccgcgaaguugcggugguuuguugagagaaauauggugaccccagaaggcaaaguaguggaucuggguugcgggcguggaggcuggucuuauuacugugguggccucaagaacgucagggagguuaaagggcugacaaagggaggcccugggcacgaagagcccauuccuaugucaacguauggauggaauuuagugcggcuucagagcggcgucgacguguucuucaccccacccgagaagugcgauacucugcucugugacaucggugaauccaguccuaacccaacaauugaggcugggcgcacccuacgaguacugaauuugguggaaaacuggcugaauaacaauacucaauuuugcaucaaaguucucaaccccuacaugccgucugugauagagaagauggaaacacuucagagaaaauacggaggcgcacuggucaggaauccuuugagccggaacucaacccacgagauguauuggguguccaaugccacgggcaacauugucaguagcgugaauaugaucucucgcaugcugaucaacagauucaccaugaagcauaaaaaggcuacauacgagccagauguugaccucggguccggaacuaggaacauugguauagaaucagagauccccaauuuagauauuaucggcaagcgaauugaaaaaaucaagcaggagcacgaaaccagcuggcauuaugaccaggaccacccuuacaaaacaugggccuaucacgggucguacgagacuaagcaaaccggaucugcaaguuccaugguaaacggcgugguccggcugcuuacaaaaccaugggaugugguucccauggugacccagauggccaugacugacacgacaccguuuggucagcagcgugucuucaaggagaagguggauaccagaacucaagaaccuaaagaggggaccaagaaacugaugcgcauaacagcugaauggcuauggaaggagcucggaaaaaagaaaacgcccaggauguguacccgggaggaauuuacuagaaagguacgcagcaaugcggcccugggcgcaaucuucacagacgagaacaaguggaaaucagcuagggaagccguggaggauggccgauuuugggaauugguugaccgggagagaaaucugcaucucgaggggaagugcgaaaccugugucuauaacaugaugggaaaaagggagaagaaacuuggugaauucggcaaggcaaaggggucccgcgccauuugguacauguggcugggagcucguuuuuuagaguucgaagcccugggcuuuuugaaugaggaucacugguucucucgggguaacagccucagugggguggagggagaaggccugcauagacuaggcuacauccuuagggacguggggaaaaaggagggaggugcgauguaugcagaugacacugccggcugggauacacgcauuacccuggaagaccucaaaaaugaggaaauggucacaaaccacaugaagggggagcauaaaaagcuggcugaggccaucuuuaaguugacuuaccagaauaaaguugugcgaguacagcggccaaccccuagaggaacggugauggacauuauauccaggcgcgaucagagaggcagcggucaagucgggaccuauggacugaacacauucacuaauauggaagcacagcucauccggcagauggagggcgaaggcauuuucaagucuauccaacaccuuaccgcuacagaggagaucgccgcucagaacuggcuggccaggguggggcgugaacgauuaucacgcauggcaauuaguggagacgauugcguugugaaacccauagacgauagauuugcguccgcccugacugcuuugaaugacauggguaagguccggaaagauauccagcagugggagccaagcaggggcuggaacgacuggacccaagugcccuucugcucucaccauuuucacgaacucguaaugaaggaugggcgcguucugguggucccuuguagaaaccaggacgagcuaauuggacgggccaggaucucgcagggcgcagguuggucacuuaaggaaacggcuugccuggggaaaagcuacgcccagauguggacacucauguauuuccaucgacgugaucugagauuggcagccaaugcgauuuguuccgcugugccaagucacugggugccgaccucucgcacuacauggagcauccacgccaagcaugaguggaugaccacugaggacauguuagcagucuggaaccggguuuggauacaagaaaaucccuggauggaggauaaaaccccuguggaauccugggaggaaguaccauaccugggaaagagggaggaccaguggugcggcucacucaucggccuuacaaguagagccacgugggcuaaaaacauucagaccgccaucaaucaggugcgcucucugauugggaacgaggaauauacugacuacaugcccagcaugaagcgguuuaggcgagaggaagaggaagcaggaguccuaugguga

SEQ ID NO: 14382 - RNA, 9876 nt, Artificial Sequence
  derived and/or modified CDS sequence (opt3) from DENV-2__FJ024475__SS-prME
accgccggcgugaucgucaugcugauuccaacugcuauggcauuccaccucacuacgagaaacggggagccucauaugauaguugggaggcaggaaaaggguaaaagccuucuguuuaagaccgaggacggcgugaauaugugcacauugauggccaucgauuuaggggaacugugugaggacacuauuaccuacaaaugcccacuacuccggcaaaacgaaccggaggauaucgacuguuggugcaauuccacaucuaccuggguaacuuauggaacauguaccacgacuggcgagcaccgccgagaaaagcguucaguggcgcuggucccccauguggguauggggcuugagaccagaacagaaacuuggaugaguagcgagggagcuuggaaacacguucagaggauugagaccuggauccugcggcauccuggcuucacaauaauggccgcaaucuuggccuacaccauuggcacgacucacuuucagcgcgcucucaucuucauucugcugacagcaguggccccauccaugaccaugagaugcaucgggauaucuaacagggauuuugucgaaggagugucggguggcucauggguagacauuguucucgagcacgggagcugugugacuacaauggcuaagaauaagcccaccuuagauuucgaacugaucaaaacggaggccaagcagccugcgacccuucggaaauauugcauugaagcaaaguugacaaacacuaccacagagagucgcuguccaacucaaggagagcccucccugaaugaagaacaggacaaacgauuuaucugcaagcauucuauggucgauagaggcugggguaacggguguggacuauucggcaagggcgggaucgugaccugcgccauguuuacaugcaaaaagaauauggaaggaaaagugguccagccugagaaccucgaauacaccauuguuauaacuccacacagcggugaggagcaugcugugggcgacgauacggggaagcacggaaaagaaaucaagauuacaccgcaguccucaaucaccgaggccgaacugacuggcuaugguaccguaacaauggaguguagucccaggaccgggcuugacuucaaugaaauggugcuguugcaaauggaggauaaagcauggcucguccaccggcagugguuucuggacuuaccucugccauggcuccccggcgcugacacucagggaagcaacuggauacagaaggagacacuugugacguucaagaauccucaugccaaaaagcaagauguugugguccugggcucucaggaaggggcgaugcacaccgccuugacuggagcaacagagauucagauguccucagguaaccuacuguuuaccggccaucucaaaugccgucugcgcauggacaaacuucaacugaaagggaugagcuacaguauguguacaggaaaguucaagaucgugaaagaaaucgcugagacucagcacggcaccauuguaaucagaguucaguaugagggugaugggucuccaugcaagauucccuucgaaauaacggacuuggagaaaaggcaugugcucggccggcugaucaccgucaauccgauugugaucgaaaaggauuccccugucaacaucgaggccgaacccccauuuggagacagcuacauuauaaucggcguggagccugggcaguuaaaacugaacugguucaagaagggaucgucuauuggucaaauguuugagacaacuaugcgaggcgcuaaacgcauggccauccuaggggauaccgcaugggacuucggaucccucggcgguguuuuuacaucaauugggaaggcccugcaccagguguucggcgcuaucuacggagcggcauuuaguggcguaagcuggacuaugaaaauacuuaucggggucgugauuaccuggaucggaaugaacuccagaucuacgagcuugucaguuagucuggugcucgucggcgugguaacacuguaucuuggugccauggugcaggcugauuccggguguguugucagcuggaagaacaaagaacugaagugcggaucuggcauuuucaucaccgacaaugugcacacuuggacagagcaguacaaguuucaacccgaaucaccaaguaaauuggccagcgcaauacagaaggcccaugaggaagguauuuguggcaucagguccgugacccggcucgagaaccugauguggaaacagauuacucccgaguuaaaucacauccugucugaaaacgaggucaagcuaaccauaaugacaggggauacgaaaggaaucaugcaggcuggcaagcgcuaucucagaccucaaccaaccgaacugaaauacucguggaagacuugggggaaggccaaaaugcuuagcacagagucccauaaucagaccuucuugauugacggaccggaaacagcagagugccccaacacuaauagggcguggaacucacuggagguugaagacuauggcuuugguguguucaccacgaauaucuggcucaagcugcgugagaaacaggauguguuuugugacaguaaguuaaugucugcugccauuaaagauaaccgggcaguacacgccgacaugggguacuggaucgaaagcgcucugaaugauacauggaagauggagaaggccuccuucauagaggucaaaucaugccacuggccuaagagccauacccuuuggucuaacggaguguuggaauccgagaugauuauccccaagaauuucgcaggccccguuagucagcacaacuaucgaccugguuaccauacucaaaccgcuggcccauggcaccucgggaagcuggaaauggacuuugauuucugugagggaacaacuguggucgugaccgaagacugcggcaacagagggcccagccuaaggacaacgaccgccucuggaaaacugaucacugaguggugcugucgcuccugcacacucccgccucugcgguacagaggcgaggaugguuguugguaugggauggaaauuaggccacuuaaggagaaggaagagaauuugguuaacucacuggugaccgcgggacauggccagaucgacaauuuuaguuuagguguacucggcauggcccuguuccuugaagagaugcugcgcacucgagucgggacaaaacacgcuauuuugcucguggcagugagcuuugucacccugauaacgggaaacaugucguuccgggaucuaggccguguuauggugaugguaggggccacuaugaccgacgauaucggaaugggcgugacauaccuggcucuccuggccgcauuuaaggucagacccaccuucgcggccggucuuuugcugaggaaauuaacuuccaaggagcucaugauggcuacaauugggaucacccugcuuucucagagcacaauuccugaaacuauccuggagcuaaccgacgcccucgcacugggaaugaugguguugaaaauaguucgcaauauggaaaaguaucaacuggcugugacgaucauggccauuucaugcguccccaacgcagugaucuuacggaaugccuggaagguuaguuguacaauucucgcugcgguguccgucucuccacugcuucugaccagcucccagcagaaagccgacuggaucccuuuggcacucacuauaaagggccugaaccccaccgcuauuuuucuaacaacucugucaagaaccagcaaaaagaggaguuggccacuuaaugaggccaucauggccguaggcauggugucuauccucgcuuccagccuguugaaaaacgauauuccgaugacggggccucugguugcaggagguuuacucacagugugcuacguccugaccggccgaucggccgaccuugaacuggagcgcgcggcugaugugaagugggaggaccaggccgaaauaucagggucuagucccaucuuguccauuacuaucagcgaggauggaucuaugagcauuaaaaaugaagaggaggaaacaacccucacuauccugauacggacaggccuacugguaaucuccgguguguucccagucucaauucccaucaccgcagccgcuugguaucuuugggagguuaagaagcaaagagcaggggugcucugggacgugccuaguccacccccugucggaaaagccgaacuggaggauggcgcguacaggauuaagcagcguggcaucuugggguauagccagauaggagcugguguguacaaagaaggcacguuucacacuauguggcauguuacccgcggggccguauuaaugcaccggggaaagagaauugagccgucuugggcagacgugaaaaaggaucugaucuccuacggcgguggguggaagcucgagggagaauggaaagagggcgaagagguccaggugcuggcccuugaaccaggcaagaaccccagggcuguucaaacaaaaccugggaucuucaagaccaauacaggaacuauuggugccgugucacuggacuuuaguccaggcaccagcgggucccccaucgucgaucgaaaaggaaaggugguaggcuuguaugguaacggggucgugacgcggucuggagcauacguuucggcuauagcccagacagaaaagagcauugaggacaauccugaaaucgaggaugacauuuuccgcaaaaagagacuaacuaucauggaccugcauccgggcgcgggcaaaaccaagagguaucuccccgccauagugcgggaagcaauuaaacgagggcugagaacacuuaucuuagcuccaacccgcgucguggccgcugagauggaagaggcacugaggggacucccuauccguuaccagacucccgccauuaaggccgagcacaccggucgggaaaucguugauuugaugugucaugcuacauucacgaugagacugcucucaccagugagggucccuaacuauaaccugauuauaauggacgaggcgcacuuuacugaucccgcauccaucgccgcucgcggcuacauuaguacccgaguggaaaugggggaggccgcaggaaucuucaugacagccaccccaccgggcucuagagacccuuuuccccagagcaaugcuccaaucauggaugaggaacgggagauucccgaaagguccuggaacucaggucacgaguggguaacugacuucaaggggaaaacagugugguuuguuccuucuauaaaggcgggaaaugauaucgccgcaugccuucgcaaaaacggcaagaaagucauucaacugagccguaagaccuucgacagugaauaugugaagacgagagcuaaugauugggacuuuguggucacuacagauaucuccgagaugggcgccaacuucaaagcagagcggguaauugacccaaggcgcuguaugaagcccgugaucuugaccgacggggaagaacgaguuauacuagccggaccuaugccggugacccauagcucugcugcccagagacgggguaggaucggccgcaaucccaagaaugaaaaugaucaguacauuuacaugggggagccccuggaaaacgacgaggauugcgcgcacuggaaggaggcaaaaaugcucuuagacaauaucaacacuccugaaggaauuauccccucaauguuugagccagaaagagagaaggucgaugccguggacggcgaauauaggcugcggggugaggcucguaaaacauucguugaucuuaugcgccgaggggaccugccuguguggcucgccuacaaggucgcugcagagggcauaaauuaugccgauagaaagugguguuuugacggaauuaaaaacaaucaaaucuuggaagagaacguggaaguagagauuuggaccaaggagggcgaaaggaaaaagcugaaaccccgguggcucgaugcucgcaucuacuccgacccacuggcccuuaaggaguucaaggaguucgcagcggggagaaaaagucuaacacugaacuugauaacugagaugggaagguuaccuacguuuaugacccagaaggcccggaaugcucuggauaaccucgccgugcugcauacagcagaagcugguggccgagccuauaaucacgcacuuagcgagcugccggagacucucgaaaccuugcugcuacugacacuccuugccaccguuacugggggaaucuuccuguuuuuaaugucgggcaaagguauugggaagaugacguugggcaugugcugcaucauuaccgcuucuguccugcucugguacgcgcagauccagccccacuggauagccgcauccauuauccuggaguucuuucuuaucgugcugcucauuccagaaccugagaaacaaagaacaccccaggacaaccaguugacuuauguggucaucgcuauacugaccguuguggccgccacaauggcaaaugaaaugggauucuuagagaagaccaagaaagaccuaggccuggggagcauuacuacacaggagucagaaaguaacauccucgauauugaccuucgcccagcuucugccuggacgcuguacgcgguagcuaccacuuuugugacaccuauguugaggcauuccaucgagaauagcucagucaacgugagucugaccgccauagcaaaucaagccaccguucucaugggacuggguaagggcuggccccuuagcaaaauggauaucggggugccgcuccuggcuauuggauguuacucccaggucaacccaaugacauugacugcagcccuguuacuacugguagcgcacuaugcuaucauuggcccuggucuccaggccaaggcaacgcgggaagcccagaaacgugcugccgcagggaucaugaagaaucccaccguggacggcauuacaguuaucgaucuugagccaauacccuacgacccuaaguucgaaaaacaacugggacaggugauguugcugauucucugcgucacucaggugcugaugaugagaaccacaugggcucuuugugaggccuuaacccuggcgacuggcccgaucucuacgcucugggaggggaaccccggaagguuuuggaauacaaccaucgccgucagcauggcaaacauuuuccgcggcuccuauuuggcuggugccgggcugcuauuuucaauaaugaagaauacuaccaacacacggcgaggaacuggcaauaucggugaaacccugggcgagaaauggaagucuagacucaacgcacuugggaaaagugaguuccagauuuacaagaaaucgggaauccaagagguggauaggacacuggcuaaggagggcauuaagcgcggggaaacggaccaucacgccguuagccggggauccgccaaauugagaugguuuguggagcguaacaugguaaccccagaaggcaagguggucgaucuggguugcgggaggggaggcuggucuuauuacugugguggccucaaaaauguucgggaggugaaggggcugacuaaaggaggcccugggcaugaggaaccaaucccuaugucaacauauggauggaacuuaguccgccuucagagcggcguggacguauucuucaccccacccgagaagugcgauacucugcucugugacauaggugaauccaguccuaauccaacaaucgaggcggggcgaacccuaagagugcugaacuugguugaaaauuggcugaacaauaacacgcaguuuugcauuaaggugcucaaucccuacaugccgucugucaucgagaaaauggaaacccuucaaaggaaguacggaggcgcucuggugcggaacccuuugagccgcaauucaacacacgagauguauugggucuccaacgcaacuggcaauauugugaguagcguuaacaugaucucuagaaugcugauaaauagguucaccaugaaacacaagaaagccacauacgagccagauguagaccucggguccggaacucgaaacauugguaucgaaucagagauccccaacuuagacauuauaggcaagcggaucgaaaagauuaaacaggagcaugaaaccagcuggcacuaugaucaggaccauccuuacaagacaugggcuuaucacgggucguacgagaccaaacagacuggaucugccaguuccauggugaauggcgucgugcgucugcuuacgaagccaugggauguugugcccauggucacacaaauggcaaugaccgacacuaccccguuuggucagcagagaguguucaaagagaagguagauacacgcacgcaggaaccuaaggaggggaccaaaaagcugaugaggaucacugccgaauggcuauggaaagagcucggaaagaaaaagacaccccggauguguaccagagaggaauuuacucgcaaagugaggagcaacgcugcgcugggcgccauuuucacagacgagaauaaguggaagucagcacgagaagcuguugaggauggccgguuuugggaauuggucgacagagagaggaaccugcaccucgaggggaaaugcgaaaccuguguguauaauaugaugggaaagcgcgagaagaaacuuggugaguucggcaaagccaaagggucccgugcaaucugguacauguggcugggagcccgguuuuuagaguucgaagcucugggcuuuuugaacgaggaucauugguucucuagagguaauagccucagugggguggagggagaaggccugcacaggcuaggcuacauacuucgcgacgucgggaagaaagagggaggugccauguaugcggaugacacagcaggcugggacacucgaaucacccuggaagaucucaagaacgaggaaaugguuacgaaucauaugaaaggggagcacaagaaacuggccgaggcuauuuuuaaguugaccuaccaaaacaaggugguacgggugcagagaccaacaccuaggggaacugucauggacaucauuucccgcagagaucagcggggcagcggucagguggggaccuauggacugaauacauucacuaacauggaagcccaacucaucaggcagauggagggcgaaggcauuuucaaaucuauacagcaucuuaccgcaacggaggagaucgcugcccaaaauuggcuggcucguguugggcgagaacgcuuaucaagaauggccauuaguggagacgauugcguggucaagcccaucgacgaucgguuugcauccgcgcugacagccuugaacgacauggguaaagugaggaaggauauccagcagugggagccaagccgcggcuggaaugacuggacccagguacccuucugcucucaccacuuucaugaacucguuaugaaagaugggagagugcuggucgugccuugucggaaccaagacgagcuaauuggaagggcucgaauaucgcagggcgccgguuggucacuuaaggaaacugcaugccugggaaagagcuacgcucagauguggacacucauguauuuccaccguagagaucugcgcuuggccgcaaacgccaucuguuccgcggugccaagucauugggucccgaccucucggacuaccuggagcauucacgcuaaacacgaguggaugacaacggaggacauguuagccguuuggaauaggguguggauccaggaaaaccccuggauggaggacaagaccccuguagaauccugggaggaagugccauaccugggaaaaagagaggaucaauggugcggcucacucauuggccuuacaagucgcgcaacaugggccaagaauauccagaccgcuauaaaccagguccggucucugaucgggaaugaggaauauacugacuacaugcccagcaugaaaagguuucgaagagaggaagaggaagccggagugcuaugguga

SEQ ID NO: 14383 - RNA, 9867 nt, Artificial Sequence
  derived and/or modified CDS sequence (opt3) from DENV-2__FJ182012__SS-prME
accgccggcgugaucgucaugcugauucccacagcuauggcauuccaccucacuacgagaaacggggagccucauaugauaguuggaaggcaggaaaaggguaaaagccuucuguuuaagaccgaggacggcgugaauaugugcacauugauggccaucgauuuaggggaacugugugaggacacuauuaccuacaaaugcccacuacuccggcaaaacgaaccggaggauaucgacuguuggugcaauuccacaucuaccuggguaacuuauggaacauguaccacgacuggcgagcaccgccgagaaaagcguucaguggcgcuggucccccauguggguauggggcuugagaccagaacagaaacuuggaugaguagcgagggagcuuggaaacacguucagaggauugagaccuggauccugcggcauccuggcuucacaauaauggccgcaaucuuggccuacaccauuggcacgacucacuuucagcgcgcucucaucuucauucugcugacagcaguggccccauccaugaccaugagaugcaucgggauaucuaacagggauuuugucgaaggagugucggguggcucauggguagacauuguucucgagcacgggagcugugugacuacaauggcuaagaauaagcccaccuuagauuucgaacugaucaaaacggaggccaagcagccugcgacccuucggaaauauugcauugaagcaaaguugacaaacacuaccacagagagucgcuguccaacucaaggagagcccucccugaaugaagagcaggacaaacgauuuaucugcaagcauucuauggucgauagaggcugggguaacggguguggacuauucggcaagggcgggaucgugaccugcgccauguuuacaugcaaaaagaauauggaaggaaaagugguccagccugagaaccucgaauacaccauuguuauaacuccacacagcggugaggagcaugcugugggcaaugacaacgggaaggaaaucaaaauuacgccgcaguccucaaucacagaggccgaacugaccggauauggcacuguaaccauggaguguagucccaggacaggucuugauuucaaugaaauggugcuguugcaaauggaggacaaggcauggcucguccaccggcagugguuucuggauuuaccucugccauggcuccccggggcugacacccagggcagcaacuggauacagaaagagacucuugugacauucaagaauccucacgccaagaaacaagacguugugguccugggaucucaggaaggcgcgaugcauacggccuugaccggggcaacugagauucagauguccucaggaaaccuacuguuuacaggucaccucaagugccgucugcgcauggauaaacuucaacugaagggcaugagcuacaguauguguaccgggaaauucaagaucgugaaggaaaucgcugagacacagcauggaacuauuguaaucagaguucaguaugagggcgacgguucuccaugcaaaauucccuucgaaauaaccgauuuggagaagaggcacgugcucgggcggcugaucacggucaacccgauugugaucgaaaaagacuccccugucaauaucgaggccgaacccccauuuggcgauagcuacauuauaaucggaguggagccuggccaguuaaagcugaacugguucaaaaaggggucgucuauuggacaaauguuugagaccacaaugcgaggugcuaagcgcauggccauccuaggcgacacugcaugggauuucgggucccucggaggcguuuuuaccucaauugguaaagcccugcaucagguguucggggcuaucuacggcgcggcauuuaguggaguaagcuggacaaugaagauacuuaucggcgucgugauuacuuggaucgggaugaauuccagaucuaccagcuugucaguuagucuggugcucgucggagugguaacgcuguaucuuggcgccauggugcaggcugacuccgguuguguugucagcuggaaaaacaaggaacugaaaugcgggucuggaauuuucaucacagauaaugugcacaccuggacugagcaguacaaguuucaacccgaaucaccaaguaaguuggccagcgcaauacagaaagcccacgaggaaggcauuugugguaucagguccgugacacggcucgagaaccugauguggaagcagauuacccccgaguuaaaucauauccugucugaaaacgaggucaaacuaacuauaaugaccggcgacacaaaggggaucaugcaggcuggaaaacgcuaucucagaccucaaccaacggaacugaaguacucguggaaaaccuggggcaaggccaagaugcuuagcacugagucccacaaucagacauucuugauugaugggccggaaaccgcagagugccccaacacaaauagggcguggaacucacuggagguugaagacuauggauuuggcguguucacuaccaauaucuggcucaaacugcgugagaagcaggacguguuuugugauaguaaauuaaugucugcugccauuaaggacaaccgggcaguacaugccgauauggguuacuggaucgaaagcgcucugaaugacacguggaaaauggagaaggccuccuucauagaggucaagucaugccacuggccuaaaagccacacacuuuggucuaacgggguguuggaauccgagaugauuaucccaaagaacuucgcaggacccguuagucagcauaauuaucgaccuggcuaccacacccaaacugcugguccauggcaucucggcaaacuggaaauggauuuugacuucugugaggggaccacaguggucgugacugaagauugcggaaacagaggccccagccuaaggaccacaacggccucugggaagcugaucaccgaguggugcugucgcuccugcacucucccgccucugcgguacagaggagaggacggcuguugguaugguauggaaauuaggccacuuaaagagaaggaagagaauuugguuaacucacuggugacagcggggcacggacagaucgauaauuuuaguuuaggcguacucgguauggcccuguuccuugaagagaugcugcgcacccgagucggcacuaagcaugcuauuuugcucguggcagugagcuuugucacacugauaaccgggaacaugucguuccgggaccuaggacguguuauggugaugguaggcgccacgaugacugaugacaucgggaugggagugaccuaccuggcucuccuggccgcauuuaaagucagacccacauucgcggccggccuuuugcugaggaaguuaaccuccaaagagcucaugauggcuacuauugguaucacacugcuuucucagagcaccauuccugaaacaauccuggagcuaacugaugcccucgcacuggggaugaugguguugaagauaguucgcaauauggaaaaauaucaacuggcugugaccaucauggccauuucaugcguccccaacgcagugaucuuacggaaugccuggaagguuaguuguacgauucucgcugcgguguccgucucuccacugcuucugacaagcucccagcagaaggccgacuggaucccuuuggcacucaccauaaaaggacugaaccccacugcuauuuuucuaaccacacugucaagaacuagcaagaaaaggaguuggccacuuaaugaggccaucauggccguaggcauggugucuauccucgcuuccagccuguugaagaacgacauuccgaugaccggcccucugguugcagggggauuacucacggugugcuacguccugacaggucgaucggccgaucuugaacuggagcgcgcggcugacgugaaaugggaggaucaggccgaaauaucaggcucuagucccaucuuguccauuaccaucagcgaggacgggucuaugagcauuaagaaugaagaggaggaacaaauccucacuauacugauccggacaggacuacugguaauuuccggcguguucccagucucaauccccauuaccgcagccgcuugguaucuuugggagguuaaaaagcagagagcaggugugcucugggaugugccuaguccacccccugucgggaaggccgaacuggaggacggagcguacaggaucaaacagcguggcauauugggcuauagccagauuggggcuggaguguacaaggaagguacuuuucacacaauguggcacguuacccgcggcgccguauuaaugcaucgggggaaaagaaucgagccgucuugggcagaugugaagaaagaccugaucuccuacggaggcgguuggaagcucgagggggaauggaaggagggagaagagguccaagugcuggcccuugaaccaggcaaaaaccccagggcuguucagacgaagccuggcauuuucaaaacuaauaccgggacaaucggagccgugucacuggauuuuaguccagguaccagcggcucccccauagucgaccgaaaggggaaagugguaggauuguauggcaacggugucgugacacggucuggggcauacguuucggcuauugcccagacugagaagagcaucgaggauaacccugaaauugaggacgauaucuuccgcaagaaaagacuaaccauaauggaccugcacccgggagcgggcaagacgaaaagguaucuccccgccauugugcgggaagcaaucaagcgaggccugagaacacuuaucuuagcuccaacucgcgucguggccgcugagauggaagaggcacugagggggcucccuauucguuaccagacccccgccaucaaagccgagcauacaggacgggaaauuguugacuugaugugucacgcuaccuucacuaugagacugcucucaccagugagggucccuaauuauaaccugauaaucauggaugaggcgcauuuuaccgaccccgcauccauugccgcucgcgguuacaucaguacacgaguggaaaugggcgaggccgcagggaucuucaugacggccacuccaccgggaucuagagauccuuuuccccaaagcaaugcuccaauuauggacgaggaacgggagauacccgaaagguccuggaacucaggccacgaguggguaaccgauuucaaggguaagacagugugguuuguuccuucuaucaaagcggggaaugacauugccgcaugccuucgcaagaacggaaaaaaggucauccagcugagccguaaaaccuucgauagugaauaugugaagacuagagcuaaugacugggauuuuguggucacaaccgacauuuccgagaugggcgccaacuucaaggcagagcggguaaucgauccaaggcgcuguaugaaacccgugauauugacgcacggcgaagagcgaguuauccuagccgggccuaugccggugacucauagcucugcugcccagagacggggaaggauuggucgcaauccaaagaacgaaaaugaccaauacaucuacaugggcgagccccuggaaaacgacgaggauugcgcgcacuggaaagaggcaaagaugcucuuagacaauauuaacacaccugaagggaucauacccucaauguuugagccagaaagagagaaagucgaugccguggacggagaauauaggcugcggggcgaggcucguaagaccuucguugaucuuaugcgccgaggugaccugccuguguggcucgccuacaaagucgcugcagaggggauuaauuaugccgauagaaagugguguuuugacggcaucaagaacaaccagauuuuggaagagaauguggaaguagagaucuggaccaaagagggagaaaggaagaaacugaagccccgguggcucgaugcucgcauauacuccgacccacuggcccuuaaagaguucaaggaauucgcagcgggcagaaagagucuaacucugaacuugaucacagagauggggagguuaccuaccuuuaugacacagaaagcccggaaugcucuggauaaccucgccgugcugcauacugcagaagcuggaggucgagccuauaaucacgcacuuagcgagcugccggagacgcucgaaaccuugcugcuacugacacuccuugccacuguuaccggcgggauuuuccuguuuuuaaugucgggaaagggcaucgguaaaaugacauuggggaugugcugcauuaucaccgcuucuguccugcucugguacgcgcagauacaaccccacuggauugccgcauccaucauccuggaguucuuucuuauugugcugcucaucccagaaccugagaagcagagaacuccccaggacaaccaguugacguauguggucauagcuauucugaccguuguggccgccacaauggcaaaugaaaugggcuucuuagagaaaacuaagaaggaucuaggacugggcagcaucaccacacaagagucagaaaguaacauucucgacaucgaccuucgcccagcuucugccuggacccuguacgcgguagcuacuacauuugugacgccuauguugaggcauuccauagagaauagcucagucaacgugagucugaccgccaucgcaaaucaggccacuguucucauggggcugggaaaagguuggccccuuagcaagauggauauuggcgugccgcuccuggcuaucggguguuacucccaggucaacccaauuacauugaccgcagcccuguuaucucuaguagcgcacuaugcuaucauuggaccuggccugcaggccaaagcaacccgggaagcccaaaagcgugcugccgcagguaucaugaaaaaucccacaguggacgggauaacuguuauugaucucgagccaauccccuacgacccuaaguucgaaaagcagcuuggccaggugaugcuguugauccugugcgucacgcaggugcucaugaugagaaccacaugggcucugugugaggcccuuacuuuagcgaccggaccgauuagcacacugugggagggcaaccccgggagguuuuggaauaccacuauagccgucuccauggcaaacaucuuccgcggaucauaucucgcuggcgccgguuugcuguuuucuauuaugaaaaauacgacaaacacccggcgagggacuggaaacaucggcgaaacccuaggugagaaguggaaaaguagacugaaugcacucggcaagucggaauuccaaauuuacaaaaagagcgggauccaggagguggauaggacacuugcuaaagagggaauaaagcgcggcgaaacugaccaucacgccguuucccgggggucugccaagcugagaugguuuguggagcguaacaugguaaccccagaaggaaaaguggucgauuugggcugcgguagggggggauggucauauuacuguggcggucugaagaauguucgggaggugaaaggccucacaaaggggggaccuggccaugaagagcccaucccuaugagcacguauggguggaaccugguccgcuuacaguccggaguggacguauucuucaccccacccgagaaaugcgauacucuucugugugacauuggcgaaaguucuccuaauccaacaaucgaggcgggucgaacccucagagugcuaaaccugguugaaaauugguugaacaauaacacucaauuuugcauuaaggugcugaaucccuacaugccgagcgucaucgagaagauggaaacacuccagaggaaauacgggggagcucuugugcggaacccucugucacgcaauuccacccacgagauguauugggucaguaacgcaacgggcaauauagugagcucuguuaacaugauuuccagaauguugaucaacagguucaccaugaagcacaaaaaggccacauacgagccagauguagaccugggcucagggacucgaaauaucggaauugaaagcgagauacccaaccucgauaucauugguaaacggaucgaaaagauuaagcaggagcaugaaaccucguggcacuaugaccaggaccauccuuacaaaacaugggcuuaucacggcucuuacgagacuaagcaaaccgggagugccuccagcauggugaauggagucgugcguuuacugacaaaaccaugggauguugugcccauggucacccagauggcaaugacugacacgacaccguuuggccagcagagaguguucaaggagaaaguagauacccgcacucaagaaccuaaggaggguaccaagaaacuuaugaggaucacagccgaauggcuguggaaggagcuagggaaaaagaaaacgccccggauguguaccagagaggaauuuacucgcaaggugaggucaaacgcugcgcucggagccauauucacagacgagaauaaauggaaguccgcacgagaagcuguugaggauggccgguuuugggaacuggucgacagagagaggaacuugcaccuggagggcaagugcgaaaccuguguguauaauaugauggggaaacgcgagaagaaacucggagaauucgguaaggccaaaggcucucgugcaaucugguacauguggcuuggggcccgguuucuggaguucgaagcuuuaggauuucugaacgaggaucauugguucagcagaggcaauaguuuguccgguguggagggggaaggacuccacaggcugggcuacauucuacgcgacgucggcaagaaggaggggggagccauguaugcggaugacacugcagguugggauacacgaaucacccuugaagaccugaaaaacgaggaaaugguuacaaaucauaugaagggcgagcacaaaaagcucgccgaggcuauuuuuaaacugacuuaccagaacaaggugguacgggugcagagaccaaccccuagggggacggucauggacaucauuagccgcagagaucagcggggaucuggccaaguggguaccuauggguugaauacauucacuaacauggaagcccagcugauaaggcagauggagggagaaggcaucuucaagucaauucaacaucucaccgcaacagaggagaucgcugcccagaauuggcuugcucguguuggccgagaacgccugaguagaauggccaucuccggggacgauugcguggucaaacccauugacgaucgguuugcaagcgcguuaacugcccugaacgacaugggaaaggugaggaaagauauacagcagugggagccaucucgcgguuggaacgacuggacccaaguacccuucugcucgcaccacuuucaugaauugguuaugaaggauggcagagugcucgucgugccuugucggaaucaggacgagcugaucgggagggcucgaauuucacagggagccggcuggagccuaaaagaaacggcaugccuugguaaguccuacgcucagauguggacacugauguauuuccaccguagagaucuccgccuggccgcaaacgccaucuguagugcggugccaucucauugggucccgaccagccggacuacaugguccauucacgcuaagcacgaguggaugaccacugaggacauguuggccguuuggaauaggguguggauccaagaaaaccccuggauggaggauaaaaccccuguagaaucaugggaggaagugccauacuuagggaagagagaggaccaguggugcggaagucugauaggccucacaucucgcgcaacgugggccaaaaauauccagaccgcuauuaaccagguccggagccuuaucggcaaugaggaauauacugacuacaugcccuccaugaagagguuucgaagagaggaagaggaagccggggugcugugguga

SEQ ID NO: 14384 - RNA, 9876 nt, Artificial Sequence
  derived and/or modified CDS sequence (opt3) from DENV-2__EU854293__SS-prME
accgccggcaugaucauuaugcugauacccacagugauggcuuuccaccucacuacgagaaacggggagccucauaugaucgucagcaggcaggaaaagggaaaaucccuucuguuuaagaccggugacggcguuaauaugugcacauugauggcaauggauuuaggggagcugugugaagacacuauuaccuacaaaugcccacuacuccggcaaaacgagccggaagauaucgacuguuggugcaauucuacaucaaccugggugacuuauggaacauguaccacgacuggcgagcaccgccgagagaagcguaguguagcccuggugccccaugucgguauggggcuugaaaccagaacagagacuuggaugagcuccgaaggagcguggaaacacgcucagaggauugagaccuggauccugcggcauccuggcuucacaauaauggccgcaaucuuggccuacaccauuggcacgacucacuuucagcgcgcucucaucuucauucugcugacagcaguggccccaucuaugaccaugagaugcaucgggauaucgaacagggauuuuguugagggagugucagguggcagcugggucgacauugugcucgaacacgggaguuguguaacuacaauggcuaagaauaagcccaccuuagauuucgagcugaucaaaacggaagccaagcaguccgcgacccuucggaaauauugcauugaggcaaaguugacaaacacuaccacagaaucucgcuguccuacucaaggagagccaagccugaaugaggaacaggacaaacgauuuguuugcaagcauuccaugguggauagaggcugggguaacggguguggacuauucggcaagggcgggaucgucaccugcgccauguuuacaugcaaaaagaauaugaaaggaaagguggugcagcccgagaaccucgaauacaccaucgucauuacuccucacucaggugaggaacaugcuguuggcaaugacacggggaaacacggaaaggagauaaaaaucacaccacagaguagcauuaccgaggccgaacugacuggcuaugguaccgugacaauggaguguucuccgaggaccgggcuugauuucaacgaaaugguacuguugcaaauggagaauaaggcauggcucgugcaccggcagugguuucuggacuuaccccugccuuggcucccaggcgcugauacucagggauccaacuggauccagaaggaaacacuugucacguucaaaaauccccaugccaagaaacaagacgugguugugcugggcucacaggagggggcgaugcacaccgccuugacuggagcaacagagauacagaugagcagugguaaccuacuguuuaccggccaucucaagugccgucugcgcauggacaaacuucaacugaaggggaugucuuacuccauguguacaggaaaguucaaagucgugaaggaaauugcugagacucagcacggcaccaucguaaucagaguucaguaugaaggugaugggagcccuugcaaaauuccauucgagaucauggacuuggagaagaggcaugugcucggccggcugauuacggucaaccccauagugaccgaaaaagauucgccggucaauaucgaggccgaaccucccuuuggagacucuuacauuaucaucggcguggagccagggcaguuaaagcugaacugguucaagaaaggauccucaauuggucaaauguuugaaacaacuaugcgaggcgcuaagcgcauggccauacuaggggauaccgcaugggacuucggaagucucggcgguguuuuuacaagcaucgggaaagcccugcaccagguguucggcgcuauuuacggagcggcauuuuccggcguaucuuggacuaugaagauccuuauuggggucaucauaaccuggaucggaaugaauagcagaucaacgaguuuguccgugagccugguucucgugggcgucgugacacuguaucuugguguaauggugcaggccgauucuggguguguugucucauggaaaaacaaggagcugaagugcggaaguggcauuuucaucaccgacaaugugcacacuuggacagagcaguacaaauuucaaccugaaagccccuccaaguuggcuucugccauucagaaagcacaugaggaagguaucuguggcauaaggucggugacccggcucgagaaccugauguggaagcagauuacuccagaauuaaaucacauccugagcgagaacgaggucaaacuaaccauuaugacaggggauaucaagggaauaaugcaggccggcaaacgcucccucagaccccaaccuacggaacugaaguauucauggaagaccugggggaaagcuaagaugcuuaguacugagucucauaaucagacauucuugaucgacggaccagaaaccgccgagugcccgaacacaaauagggcauggaacagccuggaaguugaggauuacggcuuugguguguucacuaccaauauuuggcucaaacugcgugagaagcaggacguguuuugugacuccaaauuaaugucagcggcuaucaaggauaaccgggccguacacgcagacaugggguauuggauugaaagcgcccugaaugauacguggaagaucgagaaagcuucuuucauagaagucaaguccugccacuggcccaaaagucauacacuuuggagcaacgagguguuggagucugaaaugauuaucccuaagaacuucgccggaccaguuucccagcacaauuaccgacccggcuaucauacccaaacugcagguccuuggcaccucggcaaacuggagauggacuuugauuucugugaagggaccacaguggucgugacugaggacugcggaaacagaggcccaucacuaaggaccacaacggcuagugggaagcugaucaccgaauggugcugucgcagcugcacucuccccccgcugcgguacagaggagaggauggcuguugguacgguauggagauuaggccucuuaaggaaaaagaggaaaauuugguuaacucgcuggugacagccgggcauggacagaucgacaauuuuuccuuaggcguacucgguauggcgcuguuccuugaggaaaugcugcgcacccgagucggcacuaagcacgccauuuugcucguggcugugucuuuugucacacugauaaccgggaacaugagcuuccgggaucuaggacguguuauggugaugguaggcgcaacgaugacugacgauaucgggaugggagugaccuaucuggcccuccuggcugccuuuaaagucagaccaacauucgcagcgggccuuuugcugaggaaguuaaccucaaaagagcucaugaugacuacaauugguaucgugcugcuuagucaguccaccauucccgagacaauccuggaacuaacugacgcccucgcucuggggaugaugguuuugaagauggugcgcaagauggagaaauaccaacuggccgucaccauaauggcaaucuuaugcgugccuaaugcuguuauucuccagaacgccuggaaggugucuuguacgauccuggcagucguaagcguguccccccuuuuucugacaucaagccagcagaaagccgauuggauuccauuggcucucaccaucaagggacugaauccuacugcgauauuccuaaccacacugagucggacuaacaaaaagagaucuuggccccuuaaugaagccauuauggcaguuggcaugguguccauccucgcuagcucgcuguugaaaaacgacaucccaaugaccggcccgcuggucgccgggggauuacucacggugugcuauguacugacagguaggucagccgaccuugagcuggaacgagcugcagaugugaagugggaggaccaagccgagauuucuggcaguuccccuauauugagcaucaccauuucugaagaugggagcauguccaucaagaaugaggaagaggagcagauucucacuauccugauacgcacaggacuacuggucaucucaggccuuuuucccguuaguaugccaauuaccgcggcugccugguaccucugggaagugaaaaagcagcgggcaggugugcugugggacguccccagcccuccacccguggggaaagccgaguuggaagauggagcuuauagaaucaagcagaaaggcauuuuaggcuacucucaaaucggggcaggaguuuauaaggaggguacuuuccacacaauguggcauguaaccaggggcgccgugcugaugcacaaggggaaacguauagaaccuuccugggcggacgucaagaaagaucucauuucauacggaggcgguuggaagcuggagggggaguggaaagaaggagaggaagugcagguucuugcucuggagccgggcaagaacccacgcgccgugcagacgaagcccggcuuguuuaaaacuaaugcagggaccaucggagccgucagucuagacuucagcccugguacauccggcucuccaaucauugauaagaaagggaaggugguaggacuguacggcaacggugucgugacccggucgggggcuuauguuagcgccaucgcacagacagaaaaaucaauagaggacaaccccgagauugaagaugacaucuucagaaagaggaagcucacuauuauggaucugcauccuggagcuggcaaaaccaagcgauaccuuccggccaucgugcgggaggcgauaaaacgcggcuuaagaacgcugauucucgcccccacaagggucguggcagcugaaauggaggaagccuugcgggggcugccaauccgauaucaaacuccugcuaucagagcagagcacaccggacgcgagauuguugaccucaugugucaugccacauuuaccaugaggcugcuuucccccgugcgugucccaaauuacaaccugaucauuauggacgaagcccacuucacugauccugcuaguauagcggcacgggguuauaucucuaccagaguggagaugggcgaagccgcugggauuuuuaugacagccacgcccccaggaagcagggacccguucccucaguccaaugcacccaucauggaugaggagcgcgaaaucccagagcgaucauggucuagcggccacgaauggguaacugacuuuaaggguaaaaccgugugguucguucccaguauuaaggccgggaacgauauagcugcgugcuugagaaagaauggaaaaaaggucauccagcuaucccggaaaacauuugacagcgaguacgugaagaccaggacuaacgauugggacuucguggucacaaccgauauuucugaaaugggcgccaauuuuaaagcagagcgcguaaucgacccucguagauguaugaagccagugauucugacggauggcgaggaacggguuauccucgcugggcccaugccugugacucauucauccgccgcacaaaggcgcggacgaauagguagaaacccgaaaaaugagaacgaccaguauaucuacaugggcgaaccauuagagaaugacgaagauugcgcccacuggaaggaggcuaagaugcugcuugacaacauuaauacacccgaggggaucauuccuaguauguucgaacccgagcgggaaaaagucgaugccaucgacggagaguacaggcugcgcggcgaagcgagaaagaccuuuguggaucucaugaggcggggugacuugccaguuuggcuggcauaucguguggccgcugaggggauaaacuacgccgaucgccgaugguguuucgacggcauuaaaaauaaccagauccucgaggaaaacgucgagguggaaauuuggaccaaggagggagagagaaaaaagcugaagccuagguggcuugaugcucggaucuauagcgacccccuagcacugaaagaauucaaggaguuugccgcuggccgcaaaucguugacuuuaaaucugauaacagaaauggggagacucccaaccuucaugacacagaaggccagggaugcacuggacaaccuugcgguacugcauacugccgaggcuggaggucgggccuacaaucacgcacucucugaauugccugagacgcuggagacccuacugcuccuuacacuguuagcuacugugaccggcgggaucuuuuuguuccugauguccggacgaggcauugguaaaaugacacucgggaugugcugcaucauuaccgccagcauccugcuuugguaugcacaaauacagccgcacuggauugccgcuucaaucauccuggaauuuuuccucauuguuuugcugauccccgagccagaaaagcagagaacuccucaggauaaccaauuaacguacgucgugauagcgauucuaaccguggucgccgcaacaauggcuaaugagaugggcuuucuggaaaagacuaaaaaggaccucggacuuggcaguaucaccacacagcagcccgagucuaacauucuggacaucgauuugcgcccagccuccgccuggacccuguaugcaguugcuacuacauucgugacgccuaugcucaggcauagcauagagaauucaaguguaaacgugagccugaccgccaucgcgaaucaggcuacuguccuuauggggcucggaaaagguuggccccuguccaagauggacauuggcgugccguugcuggccaucggguguuacucucaaguuaacccaauuacauuaaccgcagcccuauuucugcucguggcucacuacgcaaucauuggaccuggccuucaggccaaagcgacccgggaagcucagaagcgugccgcagccgguaucaugaagaaucccacagucgaugggauaacuguaauugaccuggauccaauccccuaugacccuaaauucgagaagcaguugggccaagugaugcugcucguucugugcgugacgcagguccuuaugaugagaaccacaugggcuuuaugugaagcccugacucucgcaaccggaccgaucagcacauugugggagggcaaccccgggagguuuuggaauaccacuauugcuguguccauggccaacauauuccgcggaucauaccuggcgggcgccggucuacuguuuucuaucaugaaaaauacgacaaacacccggcgagggacuggaaauauuggcgaaacccucggugagaaguggaaaaguagacuuaacgcacugggcaagucggaguuccagaucuauaaaaagagcgggauucaagaagucgauaggacauuggcuaaggagggaaucaaacgcggcgaaacugaccaucacgccgugucccgggggucugcaaagcugagaugguucguugagcguaacauggugaccccagagggaaaaguaguggaucucggcugcgguagggggggauggucauacuauuguggcggucugaagaauguccgggaaguuaaaggcuuaacaaaggggggaccuggccaugaggaacccauaccuaugagcacguacggguggaaccuugugcgccugcaguccggagucgacguguuuuucaccccacccgagaagugcgauacucuccuaugugacaucggcgaaaguucuccuaauccaacaguagaggcuggucgaacccugagaguguugaaccugguugagaauuggcucaacaauaacacucaguuuugcauuaaagugcuuaaucccuauaugccgagcgucaucgaaaagauggaggcccugcagaggaaauacgggggagccuuggugcggaacccucugucacgcaauuccacacacgaaauguacugggucaguaacgcgagcggcaauauugugucuuccguuaacaugaucucaagaaugcucauaaauagguucaccaugcgacacaagaaagcuacguaugagccagauguagacuuaggcagcgggacccggaacauuggaaucgaaucggagauccccaaccuggacauuauagguaagcguaucgagaagauuaaacaagaacaugagacaucuuggcacuacgaucaggaccauccuuauaagacuugggcauaccacggcaguuaugaaaccaaacagacaggguccgccagcucaauggugaauggagucgugagacuucugacuaagccaugggauguugugcccauggucacccagauggcuaugacagacaccacuccguuuggccaacagcgcguguucaaagagaagguagauacgaggacacaggaaccuaaggaggguaccaaaaagcuaaugaaaaucacugccgaguggcucuggaaggaacuggggaaaaagaaaaccccccggauguguacaagagaggaauuuacgcgcaaggugagguccaacgcagccuugggagcuauuuucaccgacgagaauaaguggaaaucugcgcgagaggccguugaagauagccgguuuugggagcuggucgacaaggaaagaaaccuccaccuugagggcaaaugcgaaacuuguguguacaauaugaugggcaagagggagaaaaagcugggggaguucggaaaggcaaaagguagucgcgcuaucugguauaugugguuaggcgcccguuuucuggaauucgaggcauugggguuucucaacgaagaucauugguucucccgggagaauagccugucuggaguggaaggcgagggucuacacaagcuuggguacauacugagagacgucucaaaaaaggagggaggcgccauguacgcugaugacacagccggcugggacaccaggaucacucucgaagaucugaaaaacgaggaaaugguuacaaaucauauggagggggaacacaagaaguuggcggaggcaauuuucaaacugaccuaucagaacaaggugguacgcgugcaacgaccaacaccucggggaacugucauggacaucauuaguagaagggaucagcgcgguuccggccagguggggaccuacggacucaauacguuuaccaacauggaggcccaacuuaucagacagauggaaggcgaggguguuuucaaaagcauucagcaucugacagugacugaagagauagcuguccagaauugguuagcccggguggggagggagcgucugucucgaauggcaaucucgggagacgauugcguaguuaagcccuuggacgaucgcuuugcuucagcccucaccgcucugaacgacaugggcaaagugagaaaggauauucaacagugggaaccaagccggggcuggaaugacuggacacagguccccuucugcucccaccacuuucaugagcuaaucaugaaggaugggagggugcuuguggucccuugucgcaaccaggacgaacugaucggaagagcccggauuagucaaggugcaggcuggucucucagggagacugcgugccuggggaaaagcuaugcccagaugugguccuugauguacuuccaccgacgugauuuaagacuggcugccaacgcaauauguucagcuguuccaagucauugggugccgaccucucgcacgacauggagcauccacgccaagcacgaauggaugaccacugaggacaugcucacaguauggaaucggguguggauucaggagaaccccuggauggaagacaaaaccccugucgaguccugggaagagaucccauaucuuggaaagagggaagaucaguggugcggcucacugauuggucuaacuagcagagcaaccugggccaaaaauauccaaacagcgauaaaccaggugcgcucucugaucgggaaugaggaguacacggacuauaugcccuccaugaagcgguuuaggcgagaagaggaagaggcuggaguucucugguga

SEQ ID NO: 14385 - RNA, 9876 nt, Artificial Sequence
  derived and/or modified CDS sequence (opt3) from DENV-2__EU854294__SS-prME
accgccggagugaucgucaugcugauucccacagcuauggcauuccaccucacuacgagaaauggggagccucauaugauaguugggaggcaggaaaaggguaaaagccuucuguuuaagaccgaggacggcgugaauaugugcacauugauggccaucgauuuaggggaacugugugaggacacuauuaccuacaaaugcccacuacuccggcaaaacgaaccggaggauaucgacuguuggugcaauuccacaucuaccuggguaacuuauggaacauguaccacgacuggcgagcaccgccgagaaaagcguucaguggcgcuggucccccauguggguauggggcuugagaccagaacagaaacuuggaugaguagcgagggagcuuggaaacacguucagaggauugagaccuggauccugcggcauccuggcuucacaauaauggccgcaaucuuggccuacaccauuggcacgacucacuuucagcgcgcucucaucuucauucugcugacagcaguggccccauccaugaccaugagaugcaucgggauaucuaacagggauuuugucgaaggagugucggguggcucauggguagacauuguucucgagcacgggagcugugugacuacaauggcuaagaauaagcccaccuuagauuucgaacugaucaaaacggaggccaagcagccugcgacccuucggaaauauugcauugaagcaaaguugacaaacacuaccacagagagucgcuguccaacucaaggagagcccucccugaaugaagaacaggacaaacgauuuaucugcaagcauucuauggucgauagaggcugggguaacggguguggacuauucggcaagggcgggaucgugaccugcgccauguuuacaugcaaaaagaauauggaaggaaaagugguccagccugagaaccucgaauacaccauuguuauaacuccacacagcggugaggagcaugcugugggcaaugacacggggaagcacggaaaagaaaucaagauuacaccgcaguccucaaucaccgaggccgaacugacuggcuaugguaccguaacaauggaguguagucccaggaccgggcuugauuucaacgaaauggugcuguugcaaauggaggacaaagcauggcucguccaccggcagugguuucuggauuuaccucugccauggcuccccggcgcugacacucagggaagcaauuggauacagaaggagacacuugugacguucaagaacccucaugccaaaaagcaagacguugugguccugggcucucaggaaggggcgaugcacaccgccuugacuggagcaacagagauucagauguccucagguaaucuacuguuuaccggccaucucaaaugccgucugcgcauggauaaacuucaacugaaagggaugagcuacaguauguguacaggaaaguucaagaucgugaaagaaaucgcugagacucagcacggcaccauuguaaucagaguucaguaugagggugacgggucuccaugcaagauucccuucgaaauaacggauuuggagaaaaggcaugugcucggccggcugaucaccgucaacccgauugugaucgaaaaggacuccccugucaacaucgaggccgaacccccauuuggagauagcuacauuauaaucggcguggagccugggcaguuaaaacugaauugguucaagaagggaucgucuauuggucaaauguuugagacaacuaugcgaggcgcuaaacgcauggccauccuaggggacaccgcaugggauuucggaucccucggcgguguuuuuacaucaauugggaaggcccugcaccagguguucggcgcuaucuacggagcggcauuuaguggcguaagcuggacuaugaaaauacuuaucggggucgugauuaccuggaucggaaugaacuccagaucuacgagcuugucaguuagucuggugcucgucggcgugguaacacuguaucuuggugccauggugcaggcugacuccggguguguugucagcuggaagaauaaagaacugaagugcggaucuggcauuuucaucaccgauaacgugcacacuuggacagagcaguacaaguuucaacccgaaucaccaaguaaauuggccagcgcaauacagaaggcccaugaggaagguauuuguggcaucagguccgugacccggcucgagaaucugauguggaaacagauuacucccgaguuaaaccacauccugucugaaaaugaggucaagcuaaccauaaugacaggggacacgaaaggaaucaugcaggcuggcaagcgcuaucucagaccucaaccaaccgaacugaaauacucguggaagacuugggggaaggccaaaaugcuuagcacagagucccauaaccagaccuucuugauugauggaccggaaacagcagagugccccaauacuaacagggcguggaacucacuggagguugaagacuauggcuuugguguguucaccacgaacaucuggcucaagcugcgugagaaacaggacguguuuugugauaguaaguuaaugucugcugccauuaaagacaaucgggcaguacacgccgauaugggguacuggaucgaaagcgcucugaacgacacauggaagauggagaaggccuccuucauagaggucaaaucaugccacuggccuaagagccauacccuuuggucuaauggaguguuggaauccgagaugauuauccccaagaauuucgcaggccccguuagucagcacaacuaucgaccugguuaccauacucaaaccgcuggcccauggcaccucgggaagcuggaaauggauuuugacuucugugagggaacaacuguggucgugaccgaagauugcggcaauagagggcccagccuaaggacaacgaccgccucuggaaaacugaucacugaguggugcugucgcuccugcacacucccgccucugcgguacagaggcgaggacgguuguugguaugggauggaaauuaggccacuuaaggagaaggaagagaacuugguuaauucacuggugaccgcgggacauggccagaucgauaacuuuaguuuagguguacucggcauggcccuguuccuugaagagaugcugcgcacucgagucgggacaaaacacgcuauuuugcucguggcagugagcuuugucacccugauaacgggaaauaugucguuccgggaccuaggccguguuauggugaugguaggggccacuaugaccgaugacaucggaaugggcgugacauaccuggcucuccuggccgcauuuaaggucagacccaccuucgcggccggucuuuugcugaggaaauuaacuuccaaggagcucaugauggcuacaauugggaucacccugcuuucucagagcacaauuccugaaacuauccuggagcuaaccgaugcccucgcacugggaaugaugguguugaaaauaguucgcaacauggaaaaguaucaacuggcugugacgaucauggccauuucaugcguccccaaugcagugaucuuacggaacgccuggaagguuaguuguacaauucucgcugcgguguccgucucuccacugcuucugaccagcucccagcagaaagccgacuggaucccuuuggcacucacuauaaagggccugaaucccaccgcuauuuuucuaacaacucugucaagaaccagcaaaaagaggaguuggccacuuaacgaggccaucauggccguaggcauggugucuauccucgcuuccagccuguugaaaaaugacauuccgaugacggggccucugguugcaggagguuuacucacagugugcuacguccugaccggccgaucggccgaucuugaacuggagcgcgcggcugacgugaagugggaggaucaggccgaaauaucagggucuagucccaucuuguccauuacuaucagcgaggacggaucuaugagcauuaaaaacgaagaggaggaacaaacacucaccauccugauacggacuggccuacugguaaucuccgguguguucccagucucaauucccaucacagcagccgcuugguaucuuugggagguuaagaagcagagagcaggggugcucugggaugugccuaguccacccccugucggaaaagccgaacuggaggacggcgcguacaggauuaagcagcguggcaucuugggguauagccagauaggagcugguguguacaaagaaggcaccuuucacacgauguggcauguuacucgcggggccguauuaaugcaccggggaaagagaauugagccgucuugggcagaugugaaaaaggaccugaucuccuacggcgguggguggaagcucgagggagaauggaaagagggcgaagagguccaagugcuggcccuugaaccaggcaagaaucccagggcuguucagaccaaaccugggaucuucaagacaaacaccggaacaauuggugccgugucacuggauuuuaguccaggcacuagcgggucccccaucgucgaccgaaaaggaaaggugguaggcuuguaugguaauggggucgugacccggucuggagcauacguuucggcuauagcccagacggaaaagagcauugaggauaacccugaaaucgaggacgauauuuuccgcaaaaagagacuaacaaucauggaccugcauccgggcgcgggcaaaacuaagagguaucuccccgccauagugcgggaagcaauuaaacgagggcugagaacccuuaucuuagcuccaacacgcgucguggccgcugagauggaagaggcacugaggggacucccuauccguuaccagacccccgccauuaaggccgagcacacuggucgggaaaucguugacuugaugugucaugcuaccuucacaaugagacugcucucaccagugagggucccuaacuauaaucugauuauaauggaugaggcgcacuuuacggaccccgcauccaucgccgcucgcggcuacauuaguacucgaguggaaaugggggaggccgcaggaaucuucaugaccgccacaccaccgggcucuagagauccuuuuccccaaagcaacgcuccaaucauggacgaggaacgggagauucccgaaagguccuggaacucaggucacgaguggguaaccgauuucaaggggaaaacugugugguuuguuccuucuauaaaggcgggaaacgacaucgccgcaugccuucgcaaaaauggcaagaaagucauucagcugagccguaagacauucgauagugaauaugugaagaccagagcuaacgacugggauuuuguggucacgacugacaucuccgagaugggcgccaauuucaaagcagagcggguaauugauccaaggcgcuguaugaagcccgugaucuugacagacggggaagaacgaguuauacuagccggaccuaugccggugacccauagcucugcugcccagagacgggguaggaucggccgcaaccccaagaaugaaaacgaccaauacauuuacaugggggagccccuggaaaaugaugaggacugcgcgcacuggaaggaggcaaaaaugcucuuagauaacaucaauaccccugaaggaauuauccccucaauguuugagccagaaagagagaaggucgacgccguggauggcgaauauaggcugcggggugaggcucguaaaacuuucguugaccuuaugcgccgaggggaucugccuguguggcucgccuacaaggucgcugcagagggcauaaacuaugccgacagaaagugguguuuugauggaauuaaaaauaaccagaucuuggaagagaacguggaaguagagauuuggacaaaggagggcgaaaggaaaaagcugaaaccccgguggcucgacgcucgcaucuacuccgauccacuggcccuuaaggaguucaaggaguucgcagcggggagaaaaagucuaacccugaauuugauaacagagaugggaagguuaccuacuuuuaugacgcagaaggcccggaacgcucuggacaaucucgccgugcugcauaccgcagaagcugguggccgagccuauaaccacgcacuuagcgagcugccggagacacucgaaacuuugcugcuacugacccuccuugccacaguuaccgggggaaucuuccuguuuuuaaugucgggcaaagguauugggaagaugacuuugggcaugugcugcaucauuacggcuucuguccugcucugguacgcgcagauccaaccccacuggauagccgcauccauuauccuggaguucuuucuuaucgugcugcucauuccagaaccugagaaacagagaaccccacaggauaaucaguugacauauguggucaucgcuauacugacuguuguggccgccaccauggcaaacgaaaugggauucuuagagaagacaaagaaagaccuaggccuggggagcauuaccacucaagagucagaaaguaauauccucgacauugaucuucgcccagcuucugccuggacacuguacgcgguagcuacgaccuuugugacuccuauguugaggcauuccaucgagaacagcucagucaaugugagucugacagccauagcaaaccaggccaccguucucaugggacuggguaagggcuggccccuuagcaaaauggacaucggggugccgcuccuggcuauuggauguuacucccaggucaauccaaucaccuugacagcagcccuguuacuacugguagcgcacuaugcuauuaucggcccuggucuccaggccaaggcaacucgggaagcccaaaaacgugcugccgcagggauuaugaagaaccccacgguggauggcaucaccguuauagaccuugagccaauucccuacgauccuaaguucgaaaaacagcugggacaggugauguugcugauccucugcgucacacaggugcugaugaugagaacuaccugggcucuuugugaggccuuaacacuggcgaccggcccgaucucuacucucugggaggggaaucccggaagguuuuggaacacgacaauugccgucagcauggcaaauauauuccgcggcuccuauuuggcuggugccgggcugcuauuuucaaucaugaagaacaccacuaauacccggcgaggaacaggcaacauuggugaaacucugggcgagaaauggaagucuagacucaacgcacuugggaaaagugaguuccaaaucuacaagaaaucgggcauucaggagguggacaggacccuggcuaaggagggcaucaagcgcggggaaacagaucaucacgccguuagccggggauccgccaaauugagaugguuuguggagcguaauaugguaacgccagaaggcaagguggucgaccuggguugcgggaggggaggcuggucuuauuacugugguggccucaaaaacguucgggaggugaaggggcugaccaaaggaggcccugggcaugaggaaccaauaccuaugucaacuuauggauggaauuuaguccgccuucagagcggcguggauguauucuucacaccacccgagaagugcgacacccugcucugugauaucggugaauccaguccuaacccaacuauugaggcggggcgaacacuaagagugcugaauuugguugaaaacuggcugaauaacaauacccaauuuugcaucaaggugcucaaccccuacaugccgucugucauugagaaaauggaaacgcuucagaggaaguacggaggcgcucuggugcggaauccuuugagccgcaacucaacccacgagauguauugggucuccaaugcaacaggcaacaucgugaguagcguuaauaugauaucuagaaugcugauuaacagguucacuaugaaacacaagaaagccaccuacgagccagacguagaucucggguccggaacacgaaacaucgguaucgaaucagagauucccaauuuagacauaaucggcaagcggauugaaaagaucaaacaggagcaugaaacuagcuggcacuaugaccaggaucauccuuacaagaccugggcuuaucacgggucguacgagacaaaacaaaccggaucugccaguuccauggugaacggcgucgugcgucugcuuacuaagccaugggacguugugcccauggucacgcagauggcaaugacagauaccacuccguuuggucagcagagaguguucaaagagaagguagacacccgcacacaagaaccuaaggaggggacgaaaaagcugaugaggauuaccgccgaauggcuauggaaagagcucggaaagaaaaagacuccccggauguguacaagagaggaauuuacccgcaaagugaggagcaaugcugcgcugggcgccaucuucacugaugagaacaaguggaagucagcacgagaagcuguugaggacggccgguuuugggaauuggucgauagagagaggaaucugcaccucgaggggaaaugcgaaacauguguguauaacaugaugggaaagcgcgagaagaaacuuggugaguucggcaaagccaaagggucccgugcaauaugguacauguggcugggagcccgguuuuuagaguucgaagcucugggcuuuuugaaugaggaccauugguucucuagagguaacagccucagugggguggagggagaaggccugcacaggcuaggcuacauccuucgcgaugucgggaagaaagagggaggugccauguaugcggacgauaccgcaggcugggacacacgaauuacucuggaagaccucaagaaugaggaaaugguuaccaaccauaugaaaggggagcacaagaaacuggccgaggcuaucuuuaaguugacguaccagaauaaggugguacgggugcagagaccaaccccuaggggaacagucauggauauuaucucccgcagagaccagcggggcagcggucaaguggggacuuauggacugaacaccuucacaaauauggaagcccagcucauuaggcagauggagggcgaaggcauauucaaaucuauccaacaucuuacugcaaccgaggagauugcugcccagaacuggcuggcucguguugggcgagaacgcuuaucaagaauggccaucaguggagaugacugcguggucaagcccaucgaugaccgguuugcauccgcgcugacggccuugaaugauauggguaaagugaggaaggacauucagcagugggagccaagccgcggcuggaacgauuggacacaaguacccuucugcucucaccacuuucaugaacucguuaugaaagacgggagagugcuggucgugccuugucggaaccaggaugagcuaauaggaagggcucgaaucucgcagggcgccgguuggucacuuaaggaaaccgcaugccugggaaagagcuacgcucagauguggacucucauguauuuccaccguagagaccugcgcuuggccgcaaaugccauuuguuccgcggugccaagucauugggucccgacaucucggaccacuuggagcauccacgcuaaacacgaguggaugaccacagaggauauguuagccguuuggaacaggguguggauucaagaaaaucccuggauggaggacaagacgccuguagaauccugggaggaagugccauaccugggaaaaagagaggaccaguggugcggcucacucaucggccuuaccagucgcgcaacuugggccaagaacauacagacagcuaucaaucagguccggucucugauugggaacgaggaauauaccgauuacaugcccagcaugaaaagguuucgaagagaggaagaggaagccggagugcuaugguga

SEQ ID NO: 14386 - RNA, 9876 nt, Artificial Sequence
  derived and/or modified CDS sequence (opt3) from DENV-2__FJ024477__SS-prME
accgcaggcgugaucgucaugcugauucccacagcuauggcauuccaccucacuacgaggaacggggagccucauaugauaguuggaaggcaggaaaaggguaaaagccuucuguuuaagaccgaggacggcgugaauaugugcacauugauggccaucgauuuaggggaacugugugaggacacuauuaccuacaaaugcccacuacuccggcaaaacgaaccggaggauaucgacuguuggugcaauuccacaucuaccuggguuacuuauggaacauguaccacgacuggcgagcaccgccgagaaaagcguucaguggcgcuggucccccauguggguauggggcuugagaccagaacagaaacuuggaugaguagcgagggagcuuggaaacacguucagaggauugagaccuggauccugcggcauccuggcuucacaauaauggccgcaaucuuggccuacaccauuggcacgacucacuuucagcgcgcucucaucuucauucugcugacagcaguggccccauccaugaccaugagaugcaucgggauaucuaacagggauuuugucgaaggagugucggguggcucauggguagacauuguucucgagcacgggagcugugugacuacaauggcuaagaauaagcccaccuuagauuucgaacugaucaaaacggaggccaagcagccugcgacccuucggaaauauugcauugaagcaaaguugacaaacacuaccacagagagucgcuguccaacucaaggagagcccucccugaaugaggaacaggacaaacgauuuaucugcaagcauucuauggucgauagaggcugggguaacggguguggacuauucggcaagggcgggaucgugaccugcgccauguuuacaugcaaaaagaauauggaaggaaaagugguccagccugagaaccucgaauacaccauuguuauaacuccacacagcggugaggagcaugcugugggcaaugacacggggaagcacggaaaagaaaucaagauuacaccgcaguccucaaucaccgaggccgaacugacuggcuaugguaccguaacaauggaguguagucccaggaccgggcuugauuucaacgaaauggugcuguugcaaauggaggacaaagcauggcucguccaccggcagugguuucuggauuuaccucugccauggcuccccggcgcugacacucagggaagcaauuggauacagaaggagacacuugugacguucaagaacccucaugccaaaaagcaagacguugugguccugggcucucaggaaggggcgaugcacaccgccuugacuggagcaacagagauucagauguccucagguaaucuacuguuuaccggccaucucaaaugccgucugcgcauggauaaacuucaacugaaagggaugagcuacaguauguguacaggaaaguucaagaucgugaaagaaaucgcugagacucagcacggcaccauuguaaucagaguucaguaugagggugacgggucuccaugcaagauucccuucgaaauaacggauuuggagaaaaggcaugugcucggccggcugaucaccgucaacccgauugugacagaaaaggacuccccugucaacaucgaggccgaacccccauuuggagauagcuacaucauuauaggcguggagccugggcaguuaaaacugaauugguucaagaagggaucgucuaucggucaaauguuugagacuaccaugcgaggcgcuaaacgcauggccauucuaggggacacagcaugggauuucggaucccucggcgguguuuuuacuucaaucgggaaggcccugcaccagguguucggcgcuauuuacggagcggcauuuaguggcguaagcuggaccaugaaaauccuuauaggggucaucauuacguggaucggaaugaacuccagaucuacuagcuugucagugagucugguucucgugggcgucgugacccuguaucuuggugccaugguacaggcugacuccgggugugugguuagcuggaagaauaaagaacugaagugcggaucuggcauuuucaucacugauaacguccacacauggaccgagcaguacaaguuucaacccgaaucaccaaguaaauuggccagcgcaauacagaaggcccaugaggaagguauuuguggcaucagguccgcuacucggcucgagaaucugauguggaaacagauuacccccgaguuaaaccacauccugucugaaaaugaggugaagcuaacaauaaugacgggggacaucaaaggaauuaugcaggccggcaagcgcucgcucagaccucaaccaaccgaacugaaauauagcuggaagacuugggggaaggcaaaaaugcuuuccacagagucacauaaccagaccuucuugaucgauggaccggaaacagcggagugccccaauacuaacagggcuuggaauagucuggagguggaagacuacggcuuuggugucuucaccacgaacauuuggcucaagcugcgugagaaacaggacguauuuugugauucuaaguuaaugagcgccgcaaucaaagacaaucgggccgugcacgcugauaugggguauuggauagaauccgcccugaacgacacauggaagauggagaaggcaucauucauugaggugaaaagcugccacuggccuaagucucauacccuuugguccaauggaguauuggaaagugagaugaucauccccaagaauuucgcuggccccgucagccagcacaacuaccgaccugguuaucauacucaaaccgccggcccauggcaccucgggaagcuggaaauggauuuugacuucugugagggaacaacugugguugugaccgaagauugcggcaauagagggcccucucuaaggacaacgaccgcguccggaaaacugauuacugaguggugcugucgcucaugcacacucccgccucugcgguacagaggcgaggacgguuguugguacgggauggaaaucaggccacuuaaggagaaggaagagaacuuggucaauagucuggugaccgccggacauggccagauugauaacuuuagcuuagguguucucggcauggcucuguuccuugaagagaugcugcgcacucgaguggggacaaaacacgcaauauugcucgccgcuguaucguuugucacccugaucacgggaaauauguccuuccgggaccuaggccgugugauggugauggucggggccacuaugaccgaugacauuggaaugggcguuacauaucuggcacuccuggcggccuuuaaggugagacccaccuucgcugccggucuuuugcugaggaaauuaacuucuaaggagcucaugauggcaacaaucgggauugcucugcuuagccagucaaccaucccugaaacaauacuggagcuaacugaugcccucgcacugggaaugaugguauugaaaaucgugcgcaacauggaaaaguaccaacuggccgucaccauuauggcuaucaguugcgugcccaaugcgguuauuuuacagaacgccuggaagguguccuguacgauccucgcagucgugucuguuagcccacugcuucugacauccucacagcagaaagcugacuggauaccuuuggcccucaccauuaagggccugaaucccacugccaucuuucuaaccacacugagccggacaaguaaaaagagaucuuggccacuuaacgaggcuaucauggcagugggcauggucuccauucucgccagcucgcuguugaaaaaugacauaccgaugaccgggccucugguagcgggagguuuacucacggugugcuauguucugacaggcaggucagcugaucuugaacuggagcgagccgcagacgugaagugggaggaucaagccgaaaucucugggaguucccccauuuugagcaucaccauuucugaggacggaagcauguccaucaaaaacgaagaggaggaacagacucucacaauacugauccgcaccggccuacuggucauuucagguguguucccaguaaguauccccauuacugcugcagccugguaccuuugggaggugaagaagcagcgggcggggguccucugggauguuccuagcccacccccugugggaaaagcugaacuggaggacggcgccuauagaaucaagcagaggggcauauugggguacucucaaauuggagccgguguguauaaagaaggcacauuucacaccauguggcaugucacgcguggggcaguguuaaugcaccgcggaaagcggaucgagccguccugggcugauguuaaaaaggaccugaucucauacggcgguggguggaagcucgagggagaauggaaagagggcgaagagguacaggugcuggcccuugaaccaggcaagaaucccagagcaguccagacuaaaccugggauuuucaagaccaacacaggaaccaucggugcugugagucuggauuuuagcccaggcacauccgggucucccauaguugacaggaaaggaaagguggucggcuuguacgguaauggggugguaacucgaucgggagccuaugucagcgcgauugcccagaccgagaagucaaucgaggauaacccugaaauugaggacgauaucuuccggaaaaagcgccuaacgauaauggaccugcauccgggcgcaggcaaaacaaagagauaccuccccgcuauugugagggaagccaucaaacgggggcugcgaacucuuaucuuagcuccaaccagaguuguggcagccgagauggaagaggcccugcgcggacucccuauuagguaucaaacacccgcuaucaaggcggagcacaccggucgugaaauugucgacuugaugugucaugcaacuuucaccaugcggcugcucuccccagugagaguuccuaacuacaaucugauaaucauggaugaggcccacuuuacagaccccgcuaguauugccgcaaggggcuauaucucuacgcgcguggaaaugggggaggccgcuggaaucuucaugacugcgaccccaccgggcagccgagauccuuuuccccaguccaacgccccaauuauggacgaggaaagagagauacccgaacggucauggaacucuggucacgagugggucacagauuucaaggggaaaaccgugugguuuguaccuagcaucaaggcaggaaacgacauugcugccugccuuaggaaaaauggcaagaaagugauccagcugagucgcaagacuuucgauuccgaauacguuaagacacgugcaaacgacugggauuuugucgugaccacggacauuagcgagaugggcgccaauuucaaagcugagagagugaucgauccacggagguguaugaagcccgucauauugacugacggggaagaacgcguaauccuagccggaccuaugccggugacacauucuucagcggcacaacgaagaggucggauuggcaggaaccccaaaaaugaaaacgaccaguauaucuacaugggggagccccuggaaaaugaugaggacugcgcccacuggaaggaggcuaaaaugcucuuagauaacauuaauaccccugaaggaaucauacccuccauguuugagccagaacgcgagaagguugacgccauugauggcgaauacagacugaggggugaggcucggaaaaccuucguggaccuuaugcgucgcggggaucugccugucuggcucgcauauaagguggccgcugagggcaucaacuacgccgaccgaaagugguguuuugauggaauuaaaaauaaccagaucuuggaagagaacguugaaguggagauauggacuaaggagggcgaaaggaaaaagcugaaacccagauggcucgacgcacggaucuauagugauccacuggcgcuuaaggaguucaaggaguucgccgcugggcgcaaaagccuaacacugaauuugauuaccgagaugggaagauuaccuacauuuaugacucagaaggccaggaacgcacuggacaaucucgcuguccugcauacggccgaagccgguggacgggcauacaaccacgcucuuucggagcugccggagacccucgaaacauugcugcuacugacucuccuugcgaccgugacagggggaaucuuccuguuuuuaaugucuggcaaagguauugggaagaugaccuugggcaugugcugcaucauaacugccuccguacugcucugguaugcacaaauucagccccacuggaucgcugccagcaucauucuggaguucuuucuuaucgugcugcucauaccagaaccugagaaacagcgaacgccccaggauaaucaauugaccuacguugucauugccauccugacagugguggcagcuacuauggccaacgaaaugggauucuuagagaagaccaagaaagaccuaggccuggggucaauuacaacccaggagagugaaucuaauauccucgacauagaucuuagaccagcguccgcuuggacucuguaugccgucgcaacaacguuuguuaccccuauguugcgccauagcaucgagaacucaagugugaauguaagccugacugccauugcuaaccaggcaacagugcucaugggacuggguaagggcuggccccuuuccaaaauggacaucggggucccgcuccuggccauuggauguuacucucaggugaauccaaucaccuugaccgcggcucuguuacuacugguugcccacuacgcaauuaucggcccuggucuccaagccaaggcuacaagggaagcccagaaacgggcagcugccgggauaaugaagaaccccacuguggauggcauuacggucaucgaccuugagccaauccccuaugauccuaaguucgaaaaacagcugggacagguaauguugcugauucucugcgugacccaaguucugaugaugcguacaacuugggcgcuuugugaggccuuaacccuggcaacaggcccgauaagcacccucugggaggggaaucccggaagauuuuggaacacuacgaucgcuguguccauggccaauauuuucaggggcucauacuuggccggugcugggcugcuauuuucuaucaugaagaacacaaccaauacucgccggggaaccggcaacauuggugaaacacugggcgagaaauggaagagucgacucaacgcccuugggaaaucggaguuccagaucuauaagaaaagcggaauacaggaggucgacagaacucuggccaaggagggcaucaagagaggggaaaccgaucaucacgcggugucccgcggaucugcuaaauugcggugguuugucgagagaaauauggugacaccagaaggcaagguuguggaccuggguugcgggcguggaggcuggucauacuauugugguggccucaaaaacguaagggaggugaaggggcugacgaaaggaggcccugggcaugaagaaccaauuccuaugagcaccuacggauggaauuuaguccggcuucaauccggcguugauguguucuucacuccacccgagaagugcgacacacugcucugugauaucggugaaaguucuccuaacccaaccauugaggcagggcgcacucuacgaguccugaauuugguggaaaacuggcugaauaacaauacacaguuuugcaucaagguacucaaccccuauaugccgagcgugauagagaaaauggaaacccuucagagaaaguacggaggcgcccugguuaggaauccuuugucacggaacuccacgcacgagauguacugggugaguaaugcuaccggcaacauugucagcucugugaauaugaucucccgcaugcugaucaacagauucacaaugaaacacaagaaagccacuuaugagccagacgucgaucucgggucaggaaccaggaacauugguauagaaagcgagauccccaauuuagacauuaucggcaagcgaauugaaaagaucaaacaggagcaugaaacaucguggcacuacgaccaagaucauccuuauaagacuugggcauaccacgggucuuaugagaccaaacagacaggaagugccuccagcauggugaacggcguuguacggcugcuuaccaagccaugggacgugguccccauggugacucagauggcuaugacggauacaaccccguuuggucagcaacguguuuucaaagagaagguggacacuagaacccaggaaccuaaggaggggacgaaaaagcugaugaaaauaacagcggaauggcuauggaaggagcucggcaaaaagaaaaccccacgcauguguacuagggaggaauuuacacggaaggucagaucaaaugccgcacugggcgcuaucuucaccgaugagaacaaguggaaauccgcccgcgaagcaguggaggacggcagguuuugggaauugguagaucgagagcggaaucugcaccucgaggggaagugcgaaacuuguguguacaacaugaugggaaaaagagagaagaaacuuggugaguucggcaaggccaaggggucuagggcuauuugguauauguggcugggagcccgcuuuuuagaguucgaagcgcugggcuuuuugaaugaggaccauugguucagccgugguaacagucucuccgggguugagggagaaggccugcaccggcuaggcuacauccuuagagaugucagcaaaaaggaagggggagcaauguacgccgacgauacagcugguugggacaccaggauuacacuggaagaccucaaaaaugaggaaauggugacuaaccauaugaagggcgagcacaaaaagcuggccgaggcaaucuuuaaguugaccuaucagaauaaagugguccgcguucagcgaccaacgccucgggggaccgugauggauauuauaucuagaagggaccaacgcggaucaggccagguagguacauacgggcugaacacuuucaccaauauggaagcucagcucaucagacaaauggagggagaaggcauuuucaagaguauccagcaucuuacagccacugaggagaucgcugugcagaacuggcuggcccgggucggcagggaacguuuaucccgaauggcaauuagcggggaugacugcgugguuaaacccauagaugaccgcuuugcgucugcccugaccgcuuugaaugauaugggaaaggugagaaaagacauccagcaaugggagccaucgcgggguuggaacgauuggacgcagguccccuucugcucacaccacuuucaugaacucgugaugaaggacggcaggguacugguugugccuugucgcaaccaggaugagcuaauugggagagcccggaucagccagggagcaggcuggucccuuaaggaaacagcuugccuggguaaaaguuaugcccaaauguggacccucauguacuuccacaggcgagaccugcguuuggcagccaaugcgauuuguucugcugucccaagccauugggugccgacuuccagaacaaccuggucaauccacgccaagcacgaguggaugacuaccgaggauauguuagcaguguggaaccgcgucuggauacaggaaaaucccuggauggaggacaaaacaccuguugaaaguugggaggaagugccauaucuggggaagcgggaggaccaguggugcggaucucucaucggccuuacgagcagggccaccugggcuaaaaacauucagacugccaucaaucaaguaagaucccugauuggcaacgaggaauacacagauuauaugcccucaaugaagcgcuuucggagggaggaagaggaagcaggggugcuaugguga

SEQ ID NO: 14387 - RNA, 9876 nt, Artificial Sequence
  derived and/or modified CDS sequence (opt3) from DENV-2__GQ868552__SS-prME
accgccggcgugaucauuaugcugauacccacagcuauggcuuuccaccucacuacgagaaacggggaaccucauaugaucgucggaaggcaggaaaaggguaaaagccuucuguuuaagaccgaggacggcguuaauaugugcacauugauggccauugauuuaggggaacugugugaggacacuaucaccuacaaaugcccacuucuccggcaaaacgaaccggaggauauugacuguuggugcaauuccacaucuaccugggugacuuauggaacauguaccacgacuggcgagcaccgccgagaaaagcguucaguugcgcuggugccccaugucgguauggggcuugagaccagaacagaaacuuggaugaguagcgagggagcuuggaaacacgugcagaggaucgagaccuggauacugcggcauccuggcuucgccaucauggcagccauuuuggcuuacacaaucggcaccacgcacuuucagcgcgcacucauuuucauccugcugacugccguugcuccauccaugacaaugagaugcauagggauuucuaacagggauuuuguggaaggagucucggguggcucauggguggacaucguacucgagcacgggagcuguguuaccacuauggccaagaauaagcccacauuagauuucgaacugauuaaaaccgaggcgaagcagccugcaacgcuucggaaauauugcaucgaagccaaguugaccaacacaacuaccgagagucgcuguccaacacaaggagagcccucccugaaugaagaacaggacaaacgauuuaucugcaagcauucuaugguggauagaggcugggguaacggguguggacuauucggcaagggcgggauugucacuugcgcuauguuuaccugcaaaaagaauauggaaggaaaaguggugcucccugagaaccuggaauacacaauagucaucaccccacacagcggugaggagcaugccguuggcaaugacacugggaagcacggaaaagaaauuaagaucacgccgcaguccucaauaacagaggcagaacuuaccggcuaugguacugugaccauggaguguagucccaggacagggcuggauuucaacgaaaugguauugcuccagauggaggagaaggcuuggcuggugcaccggcaaugguuuuuagaccugccucucccauggcuucccggcgccgauacccagggaagcaauuggauucagaaggaaacucuggucacauucaagaacccucaugcgaaaaagcaggacgugguuguguugggcucucaagagggggccaugcacacggcacuaaccggagcuacugaaauccagauguccucagguaaucugcucuuuacaggccaucugaaaugccgucuucgcauggacaagcugcaguugaaagggaugagcuacaguauguguaccggaaaguucaagaucgucaaagagauugccgagacacaacacggcacuaucgugauuagaguacaguaugaaggugaugggucuccaugcaagauacccuucgagaucauggaccucgagaagaggcauguucugggccgguuaauuaccgugaacccgaucgucacggagaaggauuccccugugaacaucgaagcugagcccccauuuggagacagcuacauuauaaucggcgucgagccugggcagcugaaacuaaauugguucaagaagggaucgucuauuggucagauguuugaaaccacaaugcgaggcgccaaacgcauggcaauccucggggauacugccugggacuucggaucccugggcgguguguuuaccucaauugggaaggcacuucaccaaguuuucggcgcgaucuacggagcagccuuuaguggcgugagcuggacaaugaaaauauugaucgggguaauuaucacuuggauuggaaugaacuccagaucuaccagccugucagucagucucgugcugguuggcguggucacgcuuuaucugggugcuauggugcaggccgauuccggguguguagugagcuggaagaauaaagaguugaagugcggaucuggcaucuucauaacagacaacguucacaccuggacugaacaguacaaguuucagcccgagucaccaaguaaacucgcaagcgccauucaaaaggcucaugaagaggguaucuguggcauuagguccgucacacggcuggagaauuuaauguggaaacagaucacccccgaacugaaccacauacuaucugagaaugaagugaagcucacuaucaugaccggggauauuaaaggaaucaugcaggccggcaagcgcucgcugagaccucagccaacagagcuuaaauauagcuggaagacgugggggaaggcaaaaauguuguccaccgaaucacauaaccaaacuuuccugauugacggaccggagacagcggagugccccaauaccaacagggcuuggaauagucucgaaguggaggauuacggcuuuggugucuucacaacuaacaucuggcugaaguuacgugaaaaacaggacguauuuugugacucuaagcugaugagcgccgcaauaaaagauaaucgggccgugcacgcugacaugggguauuggauugaguccgcccuuaacgauaccuggaagauggagaaggcaucauucaucgaagugaaaagcugccacuggccuaagucucauacguugugguccaauggaguacucgagagugaaaugaucauucccaagaacuucgcuggccccgucagccagcacaacuaccgaccugguuaucauacacagaccgccggcccauggcaccuggggaagcuagagauggacuuugauuucugugaaggaacuaccgugguugugacagaggacugcggcaauagagggcccucucugaggacuaccacagcguccggaaaacucaucacggaguggugcugucgcucaugcacccugccgccucuucgguacagaggcgaagaugguuguugguacgggauggagauuaggccauugaaggaaaaggaggaaaaccuggucaauaguuuagugacugccggacauggccaaauagacaacuuuagccucgguguucugggcaucgcucuuuuccuggaggagauguugcgcacacgaguggggaccaaacacgcaauucuccugguagccaucucguuugucacucuaauuacaggaaauauguccuuccgggaucugggccgugugauggugauggucggggcuaccaugacggacgauaucggaaugggcguuacuuaucucgcccugcuugcagcguuuaaggugagacccaccuucgccgcugguuugcuguuaaggcgccucacaucuaaagaacugaugauggccaccauagggaucgcacuucugagccagucaacuauuccugagacaauccuagaacucaccgacgcucuggccuugggaaugaugguacugaagauugugcggaacauggagaaauaccaguuagcagucacaaucauggccauaaguugcgugcccaaugcuguuauucuccugaacgcguggaagguguccuguacuauccuugccgcagucucugugagcccacuguugcucaccuccucacaacagaaggcugauuggaucccucuggcccuaacgauuaaaggccugaaucccacagccauauuucuuaccacucucagcagaaccaguaagaaaaggucuuggccacugaacgaagcuguuauggcagugggcauggucuccaucuuggccagcucgcuguuaaagaaugacauuccgaugacagggccucucguagcgggaggucugcuuacugugugcuauguucugaccggccgaucagcugacuuggagcucgagcgcgccgcagaugugaaaugggaagaccacgccgagaucucugggaguucccccauucugagcaucacgauaucugaagauggaagcauguccaucaagaacgaggaggaagaacagacacuaaccauucugauccggacuggccuucucgucauuucagguguguucccaguaaguauccccauaacagcugcagccugguaccugugggaagugaaaaagcagagagcgggggucuugugggacguuccuagcccacccccuguggagaaggcugaauuagaggauggagccuauaggauuaaacaacguggcauccugggcuacucucagaucggggcaggaguguauaaggaggguaccuuucauacuauguggcacgucacacgcggcgccgugcucaugcaucgggggaaaagaauugaaccguccugggcugacguuaagaaagaucugaucucauacggaggcgguuggaaacuugagggggaauggaaggagggagaagagguacaggugcuggccuuggagccaggcaaaaaucccagggcaguccagaccaagccuggccuauucaaaacgaacacugggaccauaggagcugugagucuggacuuuagcccagguacauccggcucucccauuguugaucgaaaggggaaaguggucggacucuacggcaauggugugguaacccggucgggggccuaugucagcgcgaucgcccaaacagaaaagucaauugagaacaacccugaaaucgaggacgauauauuccgcaagaaaagacugacuauuauggaccuucacccgggagcaggcaagaccaaaagguacuuacccgcuaucgugcgggaagccaucaagcgaggccugagaacgcucauuuuggcuccaacacgcguuguggcagccgagauggaggaagcccugagggggcucccuauccguuaucagacucccgcuauucgggcggagcauaccggaagagaaauagucgaucugaugugucacgcaacauucaccaugaggcuucuguccccagugcgcguuccuaauuacaacuugaucauuauggacgaggcccacuuuacugaccccgcuaguaucgccgcacgagguuauaucucuaccagaguggagaugggcgaagccgcugggauuuucaugacagcgacgccaccgggaagccgggauccuuuuccccaguccaaugccccaauaauggacgaggaaagggagauccccgaacgcucauggaacucuggccaugagugggucacugauuucaaagguaagaccgugugguuuguaccuagcauuaaggcagggaaugacaucgcugccugccuacguaaaaacggaaagaaagugauucagcugaguagaaagacauucgauuccgaguacguuaaaacccgggcaaaugacugggauuuugucgugacuacagacaucagcgaaaugggcgccaacuucagggcugagcgcgugauagauccacgaagauguaugaagcccgucauccucaccgacggcgaagaacggguaauuuuagccgggccuaugccggugacgcacucuucagcggcacaaaggcgcggaagaaucgguaggaauccaaagaacgaaaaugaucaguauauuuacaugggcgagccccuggagaacgacgaagacugcgcccauuggaaagaggcuaagaugcuucuggauaauaucaacacuccugaagggauaauucccuccauguuugagccagaacgggagaaaguugacgccaucgauggagaguaccgucuccgcggcgaagcucgaaagacauucguggacuugaugagaaggggugaucugccugucuggcucgcauaucggguggccgcugaggggauuaauuacgccgaccgcagaugguguuuugauggcaucaaaaacaaccagauacuggaagagaauguugagguggaaaucuggaccaaggagggagaaaggaagaaacuuaaaccccgguggcuagacgcacgaauuuauagugauccacuggcguugaaagaguucaaggaguucgccgcuggcagaaagagcuuaacccugaaccucaucacugagauggggcgccugccuacauuuaugacccaaaaggccagggacgcacuugauaaucugucgguccuccacacagcugaggccggaggucgggcauacaaccacgccuugucugaacugccggagacucuagaaacgcugcuccuucugaccuuauuggcuacagugacuggcgggauuuuccuguuucucauguccggaaaaggcaucgguaagaugacccuggggaugugcugcauaauuacagcgagcauccuucugugguaugcccagauccagccccauuggauugcagcuucaaucauacucgaguucuuuuugauuguacuguuaaucccagaaccugagaagcagcguaccccacaagacaaucagcuaacuuacgugguuauugccauccugacggucguggccgcaaccauggcuaacgagaugggcuuccucgagaaaacaaagaaagaucuuggacugggcaguauaacuacccaggagccagaaucuaauaucuuggacauugaccugagaccugccuccgcguggacacucuaugcuguggccaccacuuuugucacacccaugcugaggcacagcaucgagaacucaaguguuaaugugagccuuacggcaauugccaaccaggcuaccguacucauggggcugggaaaggguuggccguuguccaaaauggauaucggcgugccacuguuagcaauuggguguuacucucaagucaauccuaucacucuaacagccgcgcugcuccuucugguggcucauuacgccauaauuggacccggcuugcaggcaaaggccacccgcgaagcucagaagcgggccgcagcugguaucaugaaaaacccaaccguugacgggaucacagugauugaucuggagcccauaccuuaugacccgaaguucgagaaacagcucggccaagucaugcugcuuaucuuaugcguaacucaggugcugaugaugcgaacgaccugggcccucugugaagcguugacacuggccacuggacccauuagcacccuaugggagggcaauccagggagauuuuggaacacaaccaucgcaguuuccauggcuaauauuuucaggggaucauaccuggccggcgcaggucuccuauuuucuaucaugaagaacacuacgaauacacgccgggggaccggaaacauaggcgaaacucugggugagaaauggaagaguagauugaacgcucugggcaagucggaguuccagaucuauaaaaagagcgggauucaggaaguggaucguacccucgccaaagagggaaucaagaggggcgaaacagaccaccaugccgucucccgggggucugcgaaacugcgcugguuuguggagcgaaauauggucacuccugaaggaaaggugguugauuuaggcugcgguagagggggauggucauacuauuguggcggucuuaaaaacgugagggagguaaagggccugaccaaaggcgggcccgggcacgaggaaccuauuccaaugagcacauacggguggaaucucgugcggcuacaauccggagucgacguuuucuucacgcccccugagaaaugcgauacccuguugugugacaucggcgaaaguucuccaaaccccacuauagaggcuggucgcacacugagagugcucaaucuugucgaaaacuggcugaauaacaauacccaguuuugcauuaagguguugaacccguauaugccuagcguaaucgagaaaauggagacucugcagaggaaguacgggggagcacucgugcgaaauccauuaucacggaacuccacacacgaaauguacuggguuaguaaugccaccggcaacaucgugagcucugucaauaugauuucccguaugcugauaaacagauucacgaugaaacauaagaaggcuaccuaugagcccgauguggaccuuggcucagggacacgcaacaucggaauugaaagcgagaucccuaaucuggauauuaucgguaaaaggauagaaaagaucaaacaagagcacgagacuucguggcauuacgaccaggaccacccauauaagaccugggccuaccacggcucuuaugaaacaaaacagacugggagugcauccagcauggucaacggagugguucggcuacucaccaagcccugggauguagugccgauggucacacagauggccaugaccgacacuacgccuuuuggccaacagagaguguucaaggagaaaguugauacacgcacccaggaacccaaggaggguacuaaaaagcugaugaaaauuaccgcugagugguuguggaaggaacuggggaagaaaaagacaccaaggauguguacgcgagaggaauuuacccggaaagugagaucaaaugcggcccucggagcaaucuucacugacgagaacaaguggaaauccgcuagggaagccgucgaggauucucgcuuuugggagcuuguggaccgugaacggaaucugcauuuagagggcaagugcgaaacauguguauacaacaugaugggcaaaagagagaagaagcugggggaguucggaaaagcaaaggguagcagggccauuugguauaugugguugggcgcucgcuuucucgaguucgaggcccugggguuucuaaaugaagaucacugguucagucgaggaaacucccuuagcggcguggagggugaagggcugcaucggcucggauacauccugagagacguuucuaaaaaggagggcggcgcgauguacgcagaugacaccgccgggugggauacuaggauuacauuggaagaccugaaaaaugaggagauggucaccaaccacaugaagggagaacauaagaaacucgcugaggccauauuuaaacuuacauaucagaauaaaguggugcgcguccaaagaccuacuccccgggguaccguuauggacaucauuucaaggcgugaucagcgaggcaguggacaggugggaacguacggccugaacaccuucacaaauauggaagcacaguuaauccgccaaauggagggugaggggaucuucaaguccauucagcaccugacuguaaccgaagagauagcugugcagaacugguuggccagagucggacgggaaaggcucagccgcauggcuaucucuggcgacgauugcgugguuaaaccacuggacgauagauuugccucggcacuaacagcgcuuaaugacaugggcaaggugcggaaggauauucaacagugggagcccucaaggggguggaacgacuggacucaggucccuuucugcagccaccauuuucacgaacuggugaugaaagauggacgaguacucguugugccaugucguaaccaggacgagcugaucgguagagcccgcauuucccaaggcgcuggguggaguuugaaggagaccgccugcuuaggaaaaucuuaugcacagauguggacgcugauguacuuccaucggagggaucucagacuugcugccaaugcaaucuguagcgccgucccgucccacugggugcccacaucacgcaccacuuggaguauacacgcgaagcaugaauggaugacaaccgaggacaugcuggcuguguggaaccgggucuggauccaggaaaauccuuggauggaggauaaaacuccaguugaaucuugggaggaggugcccuaucuaggcaagagggaagaccaguggugcgguagccugauugggcucaccucccgagccacaugggcaaagaacauccaaacggccauuaaucagguaagaucauugaucggaaacgaggaauacaccgacuauaugccuagcaugaaacgguuuaggcgcgaggaagaggaggcuggcgugcugugguga

SEQ ID NO: 14388 - RNA, 9876 nt, Artificial Sequence
  derived and/or modified CDS sequence (opt3) from DENV-2__GQ868553__SS-prME
accgccggcgugaucgucaugcugauucccacagcuauggcauuccaccucacuacgagaaacggggagccucauaugauaguuggaaggcaggaaaaggguaaaagccuucuguuuaagaccgaggacggcgugaauaugugcacauugauggccaucgauuuaggggaacugugugaggacacuauuaccuacaaaugcccacuacuccggcaaaacgaaccggaggauaucgacuguuggugcaauuccacaucuaccuggguaacuuauggaacauguaccacgacuggcgagcaccgccgagaaaagcguucaguggcgcuggucccccauguggguauggggcuugagaccagaacagaaacuuggaugaguagcgagggagcuuggaaacacguucagaggauugagaccuggauccugcggcauccuggcuucacaauaauggccgcaaucuuggccuacaccauuggcacgacucacuuucagcgcgcucucaucuucauucugcugacagcaguggccccauccaugaccaugagaugcaucgggauaucuaacagggauuuugucgaaggagugucggguggcucauggguagacauuguucucgagcacgggagcugugugacuacaauggcuaagaauaagcccaccuuagauuucgaacugaucaaaacggaggccaagcagccugcgacccuucggaaauauugcauugaagcaaaguugacaaacacuaccacagagagucgcuguccaacucaaggagagcccucccugaaugaagagcaggacaaacgauuuaucugcaagcauucuauggucgauagaggcugggguaacggguguggacuauucggcaagggcgggaucgugaccugcgccauguuuacaugcaaaaagaauauggaaggaaaagugguccagccugagaaccucgaauacaccauuguuauaacuccacacagcggugaggagcaugcugugggcaaugacacggggaagcacggaaaagaaaucaagauuacaccgcaguccucaaucaccgaggccgaacugacuggcuaugguaccguaacaauggaguguagucccaggaccgggcuugauuucaacgaaauggugcuguugcaaauggaggacaaagcauggcucguccaccggcagugguuucuggauuuaccucugccauggcuccccggcgcugacacucagggaagcaauuggauacagaaggagacacuugugacguucaagaacccucaugccaaaaagcaagacguugugguccugggcucucaggaaggggcgaugcacaccgccuugacuggagcaacagagauucagauguccucagguaaucuacuguuuaccggccaucucaaaugccgucugcgcauggauaagcuucaacugaaagggaugagcuacaguauguguacaggaaaguucaagaucgugaaagaaaucgcugagacucagcacggcaccauuguaaucagaguucaguaugagggugacgggucuccaugcaagauucccuucgaaauaacggauuuggagaaaaggcaugugcucggccggcugaucaccgucaacccgauugugacagaaaaggacuccccugucaacaucgaggccgaacccccauuuggagauagcuacaucauuauaggcguggagccugggcaguuaaaacugaauugguucaagaagggaucgucuaucggucaaauguuugagacuaccaugcgaggcgcuaaacgcauggccauucuaggggacacagcaugggauuucggaucccucggcgguguuuuuacuucaaucgggaaggcccugcaccagguguucggcgcuauuuacggagcggcauuuaguggcguaagcuggaccaugaaaauccuuauaggggucaucauuacguggaucggaaugaacuccagaucuacaagcuugucagugagucugguucucgugggcgucgugacccuguaucuuggugccaugguacaggcugacuccgggugugugguuagcuggaagaauaaagaacugaagugcggaucuggcauuuucaucacugauaacguccacacauggaccgagcaguacaaguuucaacccgaaucaccaaguaaauuggccagcgcaauacagaaggcccaugaggaagguauuuguggcaucagguccgugacucggcucgagaaucugauguggaaacaggugacccccgaguuaaaccacauucugucugaaaaugaggucaagcuaacaaucaugacgggggacauaaaaggaaucaugcaggcuggcaagcgcucgcucagaccucaaccaaccgaacugaaauauagcuggaagacuugggggaaggccaaaaugcuuuccacagagucacauaaccagaccuucuugauugauggaccggaaacagcagagugccccaauacuaacagggcguggaauagucuggagguugaagacuacggcuuugguguguucaccacgaacaucuggcucaagcugcgugagaaacaggacguguuuugugauucuaaguuaaugagcgcugccauuaaagacaaucgggcaguacacgccgauaugggguauuggaucgaauccgcucugaacgacacauggaagauggagaaggccucauucauagaggucaaaagcugccacuggccuaagucucauacccuuugguccaauggaguguuggaaagugagaugauuaucccaaaaaacuucgcaggccccguuagccagcacaacuaccgaccugguuaucauacucaaaccgugggcccauggcaccucgggaagcuggaaauggauuuugacuucugugagggaacaacugucgugguuaccgaagauugcggcaauagagggcccucucuaaggacaacgaccgcuuccggaaaacugaucacugaguggugcugucgcucaugcacacucccgccucugcgguacagaggcgaggacgguuguugguacgggauggaaauuaggccacuuaaggagaaggaagagaacuuggugaauagucugguaaccgccggacauggccagaucgauaacuuuagcuuagguguccucggcauggcgcuguuccuugaagagaugcugcgcacucgaguggggacaaaacacgccauuuugcucguggcugucucguuuguuacccugauaacgggaaauauguccuuccgggaccuaggccgugugaugguaauggugggggcaacuaugaccgaugacaucggaaugggcgucacauaucuggcccuccuggcugccuuuaaggugagacccaccuucgcagcgggucuuuugcugaggaaauuaacuucuaaggagcucaugauggccacaauugggaucgcucugcuuagccagucaaccauuccugaaacaaucuuugagcugacugaugcccuagcacucggaaugaugguucugaaaauagugcgcaacauggaaaaguaccaauuggcugucaccaucauggccauuaguugcgugcccaaugcaguuauccugcagaacgccuggaagguguccuguacgauuuuagcugcggucucuguaagcccacuccugcuuacauccucacagcagaaagccgacuggaucccucuggcauugaccauaaagggccucaaucccacugcuauuuuccugaccacacuaagccggacuaguaaaaagagaucuuggccacugaacgaggccaucauggccgugggcaugguuuccauccuugcuagcucgcuccugaaaaaugacauuccgaugaccgggccuuugguggcaggaggucuguuaacggucugcuaugugcucacaggcaggucagccgaucuggaacuugagcgagcggcugacguaaagugggaggaucaagccgaaauaucugggaguucccccauccugagcauuaccaucucugaggacggaagcauguccauuaaaaacgaagaggaggaacagaucuugacuauacucauccgcacaggccugcuagugauuucaggugucuuuccaguuaguauccccauuaccgcagccgcuugguaccugugggaggugaagaagcagcgggcaggggugcuuugggaugucccuagcccacccccuguggaaaaagccgagcucgaagacggagcguauagaaucaagcagaggggcauacugggcuacucucaaauuggggcuggaguuuauaaagaggguacuuuccacacaauguggcauguaacccguggcgccguguugaugcaccgcgggaagcggaucgagccguccugggcagaugucaaaaaggacuuaaucucauacggaggcgguuggaagcuggaaggggaguggaaagaaggagaggaagugcagguucucgcccuggagccaggcaagaaucccagagcugugcagacgaaaccuggcauuuuuaggacuaacaccgggacaaucggagccgucagucuugauuucagcccagguaccuccggcucucccauaguggaccgaaaggggaaaguagucggacuguacggcaauggugugguuacacggucgggggcauaugugagcgcuauugcccagacugagaagucaaucgaagauaacccugagauugaagacgauaucuuccgcaagaaaagauugaccauaauggaccuacauccgggagcgggcaagacgaaaagguaccugcccgccauuguccgggaggcaaucaagcgaggccucagaacacugauccuugcuccaacucgcgugguugccgcugaaauggaggaggcauuaagggggcugccuauucguuaucaaacccccgccaucaaagccgaacacacaggacgggagauuguggaccucaugugucaugcuaccuuuacuaugagauugcuguccccagucagggugccuaacuacaaucucauaaucauggaugaagcgcacuucaccgaccccgcaaguauugccgcucgcgguuauaucucuacacgaguagagaugggcgaggccgcagggaucuuuaugacggccacuccaccgggaagcagagauccuuucccccaguccaacgcuccaauuauggacgaagagcgggaaauacccgagaggucauggaauucuggccacgaaugggugaccgauuuuaaggguaagacaguuugguucgucccuagcaucaaagcggggaacgacauugccgcaugccugcgcaagaauggaaaaaaggugauccagcuuagucguaaaaccuuugauuccgaguacgugaagacuagagcuaacgacugggauuucgucguaacaaccgacauuagcgagaugggcgccaauuuuaaggcagaacgggugaucgauccaaggcgcuguaugaaacccguuauacugacggacggcgaggaacgagugaucuuggccgggccuaugccggucacucauucuucagcugcccaaagacggggaaggauuggucgcaacccaaagaaugagaacgaccaguauaucuacaugggcgaaccccuagagaaugaugaggacugcgcgcacuggaaagaagcaaagaugcugcucgauaacauuaauacaccugaggggaucauacccuccauguucgaaccagagagagaaaaaguggacgccauugauggagaguacagguuacggggcgaggcucguaagaccuuuguugaccugaugcgccgaggugaucuuccuguguggcuggccuauaaagucgcugcagaagggaucaacuacgccgacagaaagugguguuucgauggcauuaagaauaaccagauccucgaggaaaacguggagguagagauauggaccaaagaaggagagaggaagaaauugaagccccgguggcuggacgcucgcaucuauagugauccacucgcccugaaagaauucaaggaguuugcagcgggcagaaagagccuuacucuaaaucugauuacagaaauggggagguugccuaccuucaugacacagaaagcccggaacgcuuuagacaaucuggccgugcuccauacugcagaggcuggaggucgagccuacaaccacgcacugucggagcuuccggaaacgcuggagacccucuugcugcuaacacugcucgccacuguuaccggcgggaucuuucuuuuccugaugucuggaaagggcauugguaaaaugacauuagggaugugcugcaucauaaccgcuuccauuuugcugugguaugcgcaaauccagccccacuggaucgccgcaagcauuauccucgaauuuuuccugauaguccuucugauuccagagccugaaaagcagagaacuccccaggauaaucaacucacguacguggugaucgcuauuuugaccgucguugccgccacaauggcaaacgagaugggcuuucuggagaaaacuaagaaggacuuaggacuaggcucaaucaccacacaggaaagugagucuaauauacuggacaucgaucuccgcccagcuuccgccuggacccuuuaugcgguggcuacuacauucguaacgccuaugcugaggcauagcauugaaaacucaagugugaaugucagcuugaccgccaucgcaaaccaggccacugugcugauggggcucggaaaagguuggccccuguccaagauggacauuggcguuccgcuucucgcuaucggguguuacucucaggugaauccaauuacacugaccgcagccuugcuguuacuagucgcgcacuacgcuaucauaggaccuggccugcaagccaaagcaacccgggaggcccagaagcgugcugccgcagguauuaugaaaaaccccacaguagaugggaucacugugaucgaccucgaaccaauucccuaugauccuaaguuugagaagcagcuuggccagguuaugcuguugauacugugcgugacgcaaguccucaugaugagaaccacaugggcucugugugaggcccuuacuuuagcgaccggaccgaucagcacacugugggaaggcaaucccgggagguucuggaacaccacuauugccguguccauggcaaauaucuuucgcggaucauaccucgcuggcgccgguuugcuguucucuauuaugaaaaacacgacaaauacccggcgagggacuggaaacaucggcgagacccuaggugaaaaguggaaaaguagacugaacgcacucggcaagucggaguuucagauauauaaaaagagcgggauccaggaggucgacaggacacuugcuaaagaaggaauuaagcgcggcgagacugaucaucacgccgugucccgggggucugccaagcugagaugguucguugaacguaauauggugaccccagagggaaaaguaguggacuugggcugcgguagggggggauggucauacuauuguggcggucugaagaacguccgggaaguuaaaggccucacaaaggggggaccuggccaugaggagcccaucccuaugagcacguacggguggaaucuggugcgcuuacaauccggagucgauguguucuuuaccccacccgaaaaaugcgacacucuucugugugauauuggcgagaguucuccuaacccaacaaucgaagcgggucgaacccucagaguacuaaaucugguggagaacugguugaauaacaauacucaguucugcauaaagguucugaaccccuauaugccgagcgugauugaaaagauggagacacuccagaggaaauacgggggagcucuuguccggaauccucugucacgcaacuccacccacgagauguacugggugaguaaugcaacgggcaacaucgucagcucugugaauaugaucuccagaauguugauuaacagguuuaccaugaagcacaaaaaggccacauaugaaccagacguugaucugggcucagggacucgaaacauaggaaucgagagcgaaauucccaaucucgacaucauugguaaacggaucgagaagauaaagcaggaacaugagaccucguggcacuacgaccaagaucauccuuauaaaacaugggcuuaccacggcucuuaugagacuaagcagaccgggagugccuccagcaugguaaacggagugguccguuuacugacaaaaccaugggacgugguucccauggugacccagauggcaaugacugauacgacaccguucggccagcaaagagucuuuaaggaaaaaguggacacccgcacucaggagccuaaggaagguaccaagaaacuuaugaagaucacagccgaguggcuguggaaagagcuagggaagaaaaagacgcccaggauguguacccgggaagaguucacuagaaaaguacgcucaaaugcugcgcucggagccauuuuuacagaugaaaacaaguggaaguccgcaagggaggcuguggaagacggccgauucugggagcugguugaucgggagagaaauuugcaccuggaaggcaaaugcgagaccugugucuacaacaugauggggaagagggaaaaaaagcucggagaguuugguaaagccaagggcucucgcgcaaucugguauauguggcuuggggcccguuuccuggaauuugaggcuuuaggauuccugaaugaggaccauugguuuagccggggcaacaguuuguccgguguggaaggggagggacuccacagacugggcuacauucuaagggaugugggcaagaaagaagggggagccauguacgcggacgauacugcagguugggacacacgcaucacccuugaggaccugaagaaugaagagauggucacaaaccauaugaaaggcgagcacaagaaacucgccgaagcuauuuucaagcugacuuaucagaauaagguugugcgaguacagcggccaaccccuagagggacggugauggauauaaucagcaggcgcgaccaaagaggaucuggccaggucgguaccuacggguugaacacauucacuaauauggaggcccagcugauucggcaaauggaaggagagggcaucuuuaaaucaauccagcaucucaccgcaacagaggaaauugcugcccagaacuggcuugcuagggugggccgugagcgacugagucgcauggccauauccggggaugacugcguugugaagcccaucgaugacagauucgcaagcgcguuaacugcccugaaugauaugggaaaaguccggaaggacauucagcaaugggaaccaucuagggguuggaacgauuggacccaggugcccuuuugcucgcaccacuuccaugaguugguaaugaaagacggccgcguucucguggucccuuguagaaaccaggaugaacugaucgggcgggcuaggauuucacagggagccggcuggagccuaaaggagacggcaugccuugguaaguccuaugcucaaauguggacacugauguacuuucaccgacgugaccucagacuggccgcaaaugccaucuguagugcggugccaucucauugggugccgaccagccgcacuacaugguccauacacgcuaaacacgaguggaugaccacugaagauauguuggccgucuggaaccggguuuggauccaggagaaucccuggauggaagacaagaccccuguggagucaugggaagagguaccauauuuagggaaaagggaggaccaguggugcggaagucugauuggccucacaucuagagcaacgugggccaagaacauccagaccgcuauuaaucaagugcgcagccuuaucggcaacgaagaguacacugauuauaugcccuccaugaaacgguucaggcgagaagaggaagaggccgggguccugugguga

SEQ ID NO: 14389 - RNA, 9876 nt, Artificial Sequence
  derived and/or modified CDS sequence (opt3) from DENV-2__GQ868554__SS-prME
accgcaggcgugaucgucaugcugauucccacagcuauggcauuccaccucacuacgagaaacggggagccucauaugauaguuggaaggcaggaaaaggguaaaagccuucuguuuaagaccgaggacggcgugaauaugugcacauugauggcaaucgauuuaggggaacugugugaggacacuauuaccuacaaaugcccacuacuccggcaaaacgaaccggaggauaucgacuguuggugcaauuccacaucuaccuggguaacuuauggaacauguaccacgacuggcgagcaccgccgagaaaagcguucaguggcgcuggucccccauguggguauggggcuugagaccagaacagaaacuuggaugaguagcgagggagcuuggaaacacguucagaggauugagaccuggauccugcggcauccuggcuucacaauaauggccgcaaucuuggccuacaccauuggcacgacucacuuucagcgcgcucucaucuucauucugcugacagcaguggccccauccaugaccaugagaugcaucgggauaucuaacagggauuuugucgaaggagugucggguggcucauggguagacauuguucucgagcacgggagcugugugacuacaauggcuaagaauaagcccaccuuagauuucgaacugaucaaaacggaggccaagcagccugcgacccuucggaaauauugcauugaagcaaaguugacaaacacuaccacagagagucgcuguccaacucaaggagagcccucccugaaugaagaacaggacaaacgauuuaucugcaagcauucuauggucgauagaggcugggguaacggguguggacuauucggcaagggcgggaucgugaccugcgccauguuuacaugcaaaaagaauauggaaggaaaagugguccagccugagaaccucgaauacaccauuguuauaacuccacacagcggugaggagcaugcugugggcaaugacacggggaagcacggaaaagaaaucaagauuacaccgcaguccucaaucaccgaggccgaacugacuggcuaugguaccguaacaauggaguguagucccaggaccgggcuugauuucaacgaaauggugcuguugcaaauggaggacaaagcauggcucguccaccggcagugguuucuggauuuaccucugccauggcuccccggcgcugacacucagggaagcaauuggauacagaaggagacacuugugacguucaagaacccucaugccaaaaagcaagacguugugguccugggcucucaggaaggggcgaugcacaccgccuugacuggagcaacagagauucagauguccucagguaaucuacuguuuaccggccaucucaaaugccgucugcgcauggauaaacuucaacugaaagggaugagcuacaguauguguacaggaaaguucaagaucgugaaagaaaucgcugagacucagcacggcaccauuguaaucagaguucaguaugagggugacgggucuccaugcaagauucccuucgaaauaacggauuuggagaaaaggcaugugcucggccggcugaucaccgucaacccgauugugaucgaaaaggacuccccugucaacaucgaggccgaacccccauuuggagauagcuacauuauaaucggcguggagccugggcaguuaaaacugaauugguucaagaagggaucgucuauuggucaaauguuugagacaacuaugcgaggcgcuaaacgcauggccauccuaggggacaccgcaugggauuucggaucccucggcgguguuuuuacaucaauugggaaggcccugcaccagguguucggcgcuaucuacggagcggcauuuaguggcguaagcuggacuaugaaaauacuuaucggggucgugauuaccuggaucggaaugaacuccagaucuacgagcuugucaguuagucuggugcucgucggcgugguaacacuguaucuuggugccauggugcaggcugacuccggguguguugucagcuggaagaauaaagaacugaagugcggaucuggcauuuucaucaccgauaacgugcacacuuggacagagcaguacaaguuucaacccgaaucaccaaguaaauuggccagcgcaauacagaaggcccaugaggaagguauuuguggcaucagguccgugacccggcucgagaaucugauguggaaacagauuacucccgaguuaaaccacauccugucugaaaaugaggucaagcuaaccauaaugacaggggacacgaaaggaaucaugcaggcuggcaagcgcucgcucagaccucaaccaaccgaacugaaauauagcuggaagacuugggggaaggccaaaaugcuuuccacagagucacauaaccagaccuucuugauugauggaccggaaacaguugagugccccaauacuaacagggcauggaauagucuggagguggaagacuacggcuuugguguguucaccacgaacaucuggcucaagcugcgugagaaacaggacguauuuugugauucuaaguuaaugagcgcggcuauuaaagacaaucgggccguccacgcagauaugggguauuggaucgaauccgcccugaacgacacauggaagauggagaaggcuucauucauagaggugaaaagcugccacuggccuaagucucauacccuuugguccaauggaguuuuggaaagugagaugauuauccccaagaauuucgccggccccgugagccagcacaacuaccgaccugguuaucauacucaaaccgcaggcccauggcaccucgggaagcuggaaauggauuuugacuucugugagggaacaacugucgugguuaccgaagauugcggcaauagagggcccucucuaaggacaacgaccgcuuccggaaaacugaucacugaguggugcugucgcucaugcacacucccgccucugcgguacagaggcgaggacgguuguugguacgggauggaaauuaggccacuuaaggagaaggaagagaacuuggugaauagucugguaaccgccggacauggccagaucgauaacuuuagcuuagguguccucggcauggcgcuguuccuugaagagaugcugcgcacucgaguggggacaaaacacgccauuuugcucguggcugucucguuuguuacccugauaacgggaaauauguccuuccgggaccuaggccgugugaugguaauggugggggcaacuaugaccgaugacaucggaaugggcgucacauaucuggcccuccuggcugccuuuaaggugagacccaccuucgcagcgggucuuuugcugaggaaauuaacuucuaaggagcucaugauggccacaauugggaucacccugcuuagccagucaacaauuccugaaacuauccuggagcuaaccgaugcucucgcccugggaaugaugguuuugaaaauagugcgcaacauggaaaaguaccaacuggcagucacgaucauggcuauuaguugcgugcccaaugccguuaucuuacggaacgcauggaagguguccuguacaauucucgccgcugucucuguaagcccacugcuucugaccuccucacagcagaaagcggacuggaucccuuuggcccucacuauaaagggccugaaucccaccgcaauuuuucuaacaacucugagcagaaccaguaaaaagaggucuuggccacuuaacgaggcuaucauggccgugggcaugguuuccauccucgccagcucgcuguugaaaaaugacauuccgaugacggggccucugguggcuggagguuuacucacagucugcuaugugcugaccggccgaucagcagaucuugaacuggagcgcgccgcggacguaaagugggaggaucaggcugaaauaucugggaguucccccaucuugagcauuacuaucucugaggacggaagcauguccauuaaaaacgaagaggaggaacaaacacucaccauccugauacggacuggccuacuggugaucucaggugucuucccaguuaguauucccaucacagccgcagccugguaccuuugggaggugaagaagcagagagcuggggugcucugggaugucccuagcccacccccugugggaaaagcagaacuggaggacggcgccuauaggauuaagcagcguggcaucuugggguacucucagauaggagcggguguuuauaaagaaggcaccuuucacacgauguggcauguaacucgcggggcuguguuaaugcaccggggaaagagaauugagccguccugggccgaugucaaaaaggaccugaucucauacggcgguggguggaagcucgagggagaauggaaagagggcgaagaggugcaaguucuggcacuugaaccaggcaagaaucccagggccgugcagaccaaaccugggaucuucaagacaaacaccggaacaauuggugcugucagucuggauuuuagcccaggcacuuccgggucucccaucguggaccgaaaaggaaagguagucggcuuguacgguaauggggugguuacccggucgggagccuaugugagcgcaauagcucagacggagaagucaauugaggauaacccugaaaucgaggacgauauuuuccgcaaaaagagacuaacaaucauggaccugcauccgggcgccggcaaaacuaagagguaccuccccgcgauaguccgggaagccauuaaacgagggcugagaacccuuaucuuagcaccaacacgcgugguugcugccgagauggaagaggcucugaggggacucccuauccguuaucagacccccgcaauuaaggccgagcacacuggucgggaaaucguggacuugaugugucaugccaccuucacaaugagacugcucuccccagucagggugccuaacuacaaucugauuauaauggaugaggcucacuuuacggaccccgcgaguaucgcagcccgcggcuauauuucuacucgaguagaaaugggggaggcugccggaaucuucaugaccgcaacaccaccgggcagcagagauccuuuuccccaauccaacgccccaaucauggacgaggaacgggagauucccgaaaggucauggaacucuggucacgagugggugaccgauuucaaggggaaaacuguuugguuugucccuagcauaaaggcuggaaacgacaucgcggccugccuucgcaaaaauggcaagaaagugauucagcugagucguaagacauucgauuccgaauacgugaagaccagagcaaacgacugggauuuugucguaacgacugacaucagcgagaugggcgcuaauuucaaagccgagcgggugauugauccaaggcgcuguaugaagcccguuaucuugacagacggggaagaacgagugauacuagcaggaccuaugccggucacccauucuucagccgcucagagacgggguaggaucggccgcaaccccaagaaugaaaacgaccaauauauuuacaugggggagccccuggaaaaugaugaggacugcgcccacuggaaggaggcgaaaaugcucuuagauaacaucaauaccccugaaggaauuauccccuccauguuugagccagaaagagagaagguggacgcaauagauggcgaauacaggcugcggggugaggcccguaaaacuuucguugaccuuaugcgccgaggggaucugccuguguggcucgcuuauaaggucgccgcugagggcauuaacuacgcagacagaaagugguguuuugauggaaucaaaaauaaccagauuuuggaagagaacguggaaguagagaucuggacaaaggagggcgaaaggaaaaagcugaaaccccgguggcucgacgcccgcauauauagugauccacuggcucuuaaggaguucaaggaguucgccgcagggagaaaaagccuaacccugaauuugaucacagagaugggaagguuaccuacuuuuaugacgcagaaggcgcggaacgcccuggacaaucucgcugugcugcauaccgccgaagccgguggccgagcuuacaaccacgcccuuucggagcugccggagacacucgaaacuuugcugcuacugacccuccuugcaacaguuaccgggggaauuuuccuguuuuuaaugucuggcaaagguaucgggaagaugacuuugggcaugugcugcauuaucacggccuccguccugcucugguaugcucagauacaaccccacuggauugcggccagcaucauccuggaguucuuucuuauugugcugcucaucccagaaccugagaaacagagaaccccacaggauaaucaguugacauacguggucauagcaauucugacuguuguggcugccaccauggccaacgaaaugggauucuuagagaagacaaagaaagaccuaggccuggggucaaucaccacucaagagagugaaucuaauauucucgacaucgaucuucgcccagcauccgcuuggacacuguaugccguagcgacgaccuuugugacuccuauguugaggcauagcauagagaacucaagugucaaugugagccugacagcuaucgccaaccaggcaaccguucucaugggacuggguaagggcuggccccuuuccaaaauggacauuggggugccgcuccuggccaucggauguuacucucaggucaauccaauuaccuugacagcugcacuguuacuacugguagcccacuacgcgaucauuggcccuggucuccaggcuaaggccacucgggaagcacaaaaacgugccgcugccgggaucaugaagaaccccacgguggauggcauaaccguuauugaccuugagccaauccccuaugauccuaaguucgaaaaacagcugggacaggugauguugcugauccucugcgucacacaggugcugaugaugagaacuaccugggcacuuugugaggcuuuaacacuggccaccggcccgauuagcacucucugggaggggaaucccggaagguuuuggaacacgacaauagcggucuccauggccaauaucuuccgcggcucauacuuggccggugcugggcugcuauuuucuauuaugaagaacaccacuaauacccggcgaggaacaggcaacaucggugaaacucugggcgagaaauggaagaguagacucaacgcccuugggaaaucggaguuccaaauuuauaagaaaagcggaauccaggagguggacaggacccuggcaaaggagggcauaaagcgcggggaaacagaucaucacgcuguuucccggggaucugccaaauugagaugguuuguggagcguaauaugguaacgccagaaggcaagguggucgaccuggguugcgggaggggaggcuggucauacuauugugguggccucaaaaacguucgggaggugaaggggcugaccaaaggaggcccugggcaugaagaaccaaucccuaugagcacuuacggauggaauuuaguccgccuucaguccggcguggauguauucuucacaccacccgagaagugcgacacccugcucugugauauuggugaaaguucuccuaacccaacuaucgaggccgggcgaacacuaagagugcugaauuugguugaaaacuggcugaauaacaauacccaauuuugcauuaaggugcucaaccccuauaugccgagcgucaucgagaaaauggaaacgcuucagaggaaguacggaggcgcgcuggugcggaauccuuugucacgcaacuccacccacgagauguacugggucaguaaugcuacaggcaacauagugagcucuguuaauaugauuuccagaaugcugaucaacagguucacuaugaaacacaagaaagcaaccuaugagccagacguagaucucgggucaggaacacgaaacaucgguauugaaagcgagauacccaauuuagacaucauuggcaagcggaucgaaaagauuaaacaggagcaugaaacuucguggcacuacgaccaggaucauccuuauaagaccugggccuaccacgggucuuaugagacaaaacaaaccggaagugcuuccagcauggugaacggcgucgugcgucugcuuacuaagccaugggacguugugcccauggucacgcagauggccaugacagauaccacuccguuuggucagcagagaguguucaaagagaagguagacacccgcacacaagaaccuaaggaggggacgaaaaagcugaugaggaucaccgcagaauggcuauggaaagagcucggaaagaaaaagacuccccggauguguacaagagaggaauuuacccgcaaagugaggucaaaugccgcucugggcgcgauauucacugaugagaacaaguggaaguccgcccgagaagcaguugaggacggccgguuuugggaauuggucgauagagagaggaaucugcaccucgaggggaaaugcgaaacauguguguacaacaugaugggaaagcgcgagaagaaacuuggugaguucggcaaagcuaaagggucucgugccaucugguauauguggcugggagcacgguuuuuagaguucgaagcccugggcuuuuugaaugaggaccauugguucagcagagguaacagucucuccgggguggagggagaaggccugcacaggcuaggcuacauucuucgcgaugucgggaagaaagagggaggugcuauguacgccgacgauaccgcgggcugggacacacgaaucacucuggaagaccucaagaaugaggaaaugguuaccaaccauaugaaaggggagcacaagaaacuggcagaggccauuuuuaaguugacguaucagaauaaggugguacgggugcagagaccaaccccuaggggaacagucauggauaucauuagccgcagagaccagcggggcucuggucaaguggggacuuacggacugaacaccuucacaaauauggaagcucagcucauaaggcagauggagggcgaaggcaucuucaaaucaauucaacaucuuacugccaccgaggagaucgcaguucagaacuggcuggcucguguggggcgagaacgcuuaaguagaauggccaucuccggagaugacugcgucgugaagcccauugaugaccgguuugcuagcgcccugacggcauugaaugauauggguaaaguaaggaaggacauacagcagugggagccaucucgcggcuggaacgauuggacacaaguucccuucugcucgcaccacuuucaugaacucgugaugaaagacgggagaguccugguggugccuugucggaaccaggaugagcuaaucggaagggcgcgaauuucacagggcgccgguuggagccuuaaggaaaccgcuugccuggggaaguccuaugcccagauguggacucucauguacuuccaccguagagaccugcgcuuggcagcuaaugccaucuguagugcagucccaucucauuggguuccgacaagccggaccacuugguccauucacgccaaacacgaguggaugaccacagaggauauguuagcgguguggaacaggguauggauccaagaaaaucccuggauggaggacaagacgccuguggaaucaugggaggaagucccauaucugggaaaaagagaggaccaguggugcggcagucucauaggccuuaccucucgcgcuacuugggccaagaacauccagacagcaauuaaucaggugcggagccugaucgggaacgaggaauacaccgauuauaugcccuccaugaaaagguuucgaagagaggaagaggaagccggaguucuaugguga

SEQ ID NO: 14390 - RNA, 9876 nt, Artificial Sequence
  derived and/or modified CDS sequence (opt3) from DENV-2__GQ868555__SS-prME
accgccggcgugaucgucaugcugauucccacagcuauagcauuccaccucacuacgagaaacggggagccucauaugaucguuggaaggcaggaaaaggguaaaagccuucuguuuaagaccgaggacggcgugaauaugugcacauugauggccauugauuuaggggaacugugugaggacacuaucaccuacaaaugcccacuacuccggcaaaacgaaccggaggauauugacuguuggugcaauuccacaucuaccuggguaacuuauggaacauguaccacgacuggcgagcaccgccgagaaaagcguucaguggcgcuggucccccauguggguauggggcuugagaccagaacagaaacuuggaugaguagcgagggagcuuggaaacacguucagaggaucgagaccuggauacugcggcauccuggcuucacaaucauggccgcaauuuuggccuacaccaucggcacgacucacuuucagcgcgcucucauuuucauccugcugacagcaguggccccauccaugaccaugagaugcauagggauuucuaacagggauuuugucgaaggagugucggguggcucauggguagacaucguucucgagcacgggagcugugugacuacaauggcuaagaauaagcccaccuuagauuucgaacugauuaaaacggaggccaagcagccugcgacccuucggaaauauugcaucgaagcaaaguugacaaacacuaccacagagagucgcuguccaacucaaggagagcccucccugaaugaagagcaggacaaacgauuuaucugcaagcauucuauggucgauagaggcugggguaacggguguggacuauucggcaagggcgggauugugaccugcgccauguuuacaugcaaaaagaauauggaaggaaaagugguccagccugagaaccucgaauacaccauaguuaucacuccacacagcggugaggagcaugcugugggcaaugacacggggaagcacggaaaagaaauuaagaucacaccgcaguccucaauaaccgaggccgaacugacuggcuaugguaccguaacaauggaguguagucccaggaccgggcuugauuucaacgaaauggugcuguugcaaauggaggacaaagcauggcucguccaccggcagugguuucuggauuuaccucugccauggcuccccggcgcugacacucagggaagcaauuggauucagaaggagacacuugugacguucaagaacccucaugccaaaaagcaagacguugugguccugggcucucaggaaggggcgaugcacaccgccuugacuggagcaacagagauccagauguccucagguaaucuacuguuuaccggccaucucaaaugccgucugcgcauggauaagcuucaacugaaagggaugagcuacaguauguguacaggaaaguucaagaucgugaaagaaauugcugagacucagcacggcaccaucguaauuagaguucaguaugagggugacgggucuccaugcaagauacccuucgaaaucacggauuuggagaaaaggcaugugcucggccggcugauuaccgucaacccgaucgugacagaaaaggacuccccugucaacaucgaggccgaacccccauuuggagauagcuacauuauaaucggcguggagccugggcaguuaaaacugaauugguucaagaagggaucgucuauuggucaaauguuugagacuaccaugcgaggcgcuaaacgcauggccauccuaggggacacagcaugggauuucggaucccucggcgguguuuuuacuucaauugggaaggcccugcaccagguguucggcgcuaucuacggagcggcauuuaguggcguaagcuggaccaugaaaauacuuaucggggucgugauuacguggaucggaaugaacuccagaucuacaagcuugucaguuagucuggugcucgucggcgugguaacccuguaucuuggugccauggugcaggcugacuccggguguguugucagcuggaagaauaaagaacugaagugcggaucuggcauuuucaucacugauaacgugcacacauggaccgagcaguacaaguuucaacccgaaucaccaaguaaauuggccagcgcaauacagaaggcccaugaggaagguauuuguggcaucagguccgugacucggcucgagaaucugauguggaaacagauuacccccgaguuaaaccacauccugucugaaaaugaggucaagcuaacaauaaugacgggggacaccaaaggaaucaugcaggcuggcaagcgcucgcucagaccucaaccaacugaacugaaauauagcuggaagacaugggggaaggccaaaaugcuuuccaccgagucacauaaccagacauucuugauugauggaccggaaacugcagagugccccaauaccaacagggcguggaauagucuggagguugaagacuacggcuuugguguguucacgacaaacaucuggcucaagcugcgugagaaacaggacguguuuugugauucuaaguuaaugagcgcugccauuaaagacaaucgggcaguacacgccgauaugggguauuggaucgaauccgcucugaacgacaccuggaagauggagaaggccucauucauagaggucaaaagcugccacuggccuaagucucauacucuuugguccaauggaguguuggaaagugagaugauuaucccaaaaaacuucgcaggccccguuagccagcacaacuaccgaccugguuaucauacccaaacagcuggcccauggcaccucgggaagcuggaaauggauuuugaccuaugugagggaacuaccguggucgugacagaagauugcggcaauagagggcccucucugaggacgaccacugccuccggaaaacucaucacagaguggugcugucgcucaugcacccugccgccucuucgguacagaggcgaggacgguuguugguacgggauggaaauuaggccauugaaggagaaggaagagaaccugguuaauaguuuagugacugcgggacauggccagaucgauaacuucagccucgguguacugggcauggcccuuuuucuggaagagauguugcgcacacgagucgggaccaaacacgcuauucuccugguggcagugucguucgucacgcuaauaacuggaaauauguccuuucgggaccugggccguguuauggugaugguaggggccaccaugacagaugacaucggaaugggcgugaccuaucucgcucugcuugccgcauucaaggucagacccacuuuugcggccgguuugcuguuaaggaaacucacaucuaaggagcugaugauggcuaccauugggaucgcccuucugagccagucaacaauuccugaaacuauccuagagcucaccgaugcacuggcuuugggaaugauggugcugaaaauaguucgcaacauggaaaaguaccaauuagccgugacgaucauggcaauuaguugcguccccaaugccgugauccuccggaacgcuuggaagguuuccuguacaauucuggcggccgugucugucagcccacuucuguugaccuccucacagcagaaagcagacuggaucccucucgcucugacuauaaagggccuaaaucccaccgccauuuuccugacaacucuuagcagaaccaguaaaaagaggucuuggccacucaacgaggccaucauggcuguaggcaugguguccauccuggcaagcucguugcugaaaaaugacauuccgaugacggggccuuuaguugccggaggucuccugacagugugcuauguccuuaccggccgaucagcggaucuggaauuggagcgcgcugccgaggugaagugggaagaccaggcagagauaucugggaguucccccauccucagcauuacuaucucugaagauggaagcauguccauuaaaaacgaggaggaagagcaaacacugaccauccuaauacggacuggccugcuuguaaucucagguguguuuccagucaguauucccaucacagccgcugcaugguaccucugggaaguuaagaagcagagagccggggugcugugggacgugccuagcccacccccugucggaaaagcggaguuggaagagggcgcuuauaggauuaagcagcguggcaucuuaggguacucucagauaggagccgguguguauaaagagggcaccuuccacacgauguggcauguuacucgcggggcaguacugaugcaccggggaaagagaauugaaccguccugggccgaugugaaaaaggaccucaucucauacggcgguggguggaagcuggagggagaauggaaagagggcgaagagguccaagugcuugcucuggagccaggcaagaaucccagggccguucagaccaaaccugggaucuuuaagacaaacaccggaacaauuggugcagugaguuuggauuucagcccaggcacuuccgggucucccaucgucgaccgaaaaggaaaggugguaggccuauacgguaauggggucgugacccggucgggagcuuauguuagcgccauagcgcagacggaaaagucaauugaggauaacccugaaaucgaggacgauauuuuucgcaaaaagagacugacaaucauggaccuccauccgggcgccggcaaaacuaagagguaccugcccgcaauagugcgggaagcuauuaaacgagggcuuagaaccuuaauccuggccccaacacgcgucguggcugcagagauggaggaagcccucaggggauugccuauccguuaucagacccccgccauuaaggcugagcacacuggucgggaaaucguugaucugaugugucaugcgaccuucacaaugagacuccuguccccagugagggucccuaacuacaaucuuauuauaauggacgaggcacacuucacggaccccgccaguaucgcugcccgcggcuauauuucuacucgaguggagaugggggaagcagccggaaucuuuaugaccgcuacaccaccgggcagcagagauccuuucccccaauccaacgcgccaaucauggacgaggaacgggagauucccgaaaggucauggaauucuggucacgaguggguaaccgauuuuaaggggaaaacugugugguucguuccuagcauaaaggccggaaacgacaucgcagcuugccugcgcaaaaauggcaagaaagucauucaguugagucguaagacauuugauuccgaguacgugaagaccagagccaacgacugggauuucguggucacgacugacaucagcgaaaugggcgcaaauuuuaaagccgagcggguaauugauccaaggcgcuguaugaagcccgugauccuaacagacggggaagagcgaguuauacuggcuggaccuaugccggugacccauucuucagccgcgcagagacgggguaggaucggccgcaacccaaaaaaugaaaacgaucaauauauuuacaugggggagccccucgagaaugacgaagacugcgcacacuggaaggaggccaaaauguuacuggauaacaucaauaccccugaaggaauuauccccuccauguucgagccagaaagagagaaggucgacgcuauagauggcgaguacaggcuucggggugaagcccguaaaacuuuuguggaccugaugcgccgaggggaucucccuguuugguuggcuuauaagguggcagccgagggcauuaacuacgcugacagaaagugguguuucgauggaaucaaaaauaaccagauucuggaagagaacgucgagguggaaaucuggacaaaggagggcgaaaggaaaaagcucaaaccccgguggcuggacgcccgcauauauagugauccacuugcacuaaaggaguuuaaggaauucgcggccgggagaaaaagccugaccuugaauuuaaucacagagaugggaaggcugccuacuuucaugacgcagaaggcucggaacgcccucgacaaucuggcaguacuucauaccgcugaggccgguggccgagcauacaaccacgcccugucggaacucccggagacauuggaaacucugcuacugcucacccuucuggcuacagugaccgggggaauuuuuuuauucuugaugucuggcaaagguaucgggaagaugacucugggcaugugcugcauuaucacggcguccguucuccugugguaugcccagauacaaccccacuggauugcagcuagcaucauccuugaguuuuuccugauuguccucuugaucccagaaccugagaaacagagaaccccccaggauaaucagcugacauacguggugauagccauuuuaacugucguugccgcaaccauggcuaacgagaugggauuucuagaaaagacaaagaaagaccugggccucgggucaaucaccacucaagagagugaaucuaauauucuugauaucgaccugcgcccagccuccgcguggacauuguaugcuguggccacgaccuucguaacuccuaugcugaggcauagcauagagaacucaagugugaaugucagccucacagcaaucgccaaccaggcuaccgugcugaugggacuugguaagggcuggccccucuccaaaauggacauugggguuccgcuguuggcaaucggauguuacucucaggugaauccaauuacccugacagccgcguuacuacugcucgucgcucacuacgccaucauuggcccuggucuucaggcaaaggccacucgggaagcucaaaaacgugccgcagcugggaucaugaagaaccccacgguagauggcauaaccgugauugaccuggagccaauccccuaugauccuaaguuugagaaacaguugggacagguuaugcugcucauccugugcgugacacagguccuuaugaugagaacuaccugggccuuaugugaagcgcugacacucgccaccggcccgauuagcacuuugugggaggggaaucccggaagguucuggaacacgacaauagcaguguccauggcuaauaucuuucgcggcucauaccuggccggugcagggcuacuguucucuauuaugaagaacaccacuaauacccggcgaggaacaggcaacaucggugaaacucucggcgagaaauggaagaguagacuuaacgcucuggggaaaucggaguuucaaauuuauaagaaaagcggaauccaggaagucgacaggaccuuggccaaggagggcauaaagcgcggggaaacagaucaucacgccgugucccggggaucugcgaaacugagaugguucguugagcguaauauggugacgccagaaggcaagguaguggaccucgguugcgggaggggaggcuggucauacuauugugguggccugaaaaacguccgggagguuaagggguuaaccaaaggaggcccugggcaugaggaacccaucccuaugagcacuuacggauggaaucuugugcgccugcaguccggcgucgauguguuuuucacaccacccgagaagugcgacacccuccuaugugauauuggugaaaguucuccuaacccaacuaucgaggcugggcgaacacugagaguauugaaucugguggaaaacuggcucaauaacaauacccaauucugcauuaagguucuuaaccccuauaugccgagcgugaucgagaaaauggagacgcugcagaggaaguacggaggcgcauugguccggaauccucugucacgcaacuccacccacgaaauguacugggugaguaaugccacaggcaacauagucagcucugugaauaugauuuccagaaugcucaucaacagguuuacuaugaaacacaagaaagcuaccuaugagccagacguugauuuagggucaggaacacgaaacaucgguauugaaagcgagauacccaaucuggacaucauuggcaagcggaucgaaaagauuaaacaggagcaugagacuucguggcacuacgaucaggaccauccuuauaagaccugggccuaccacgggucuuaugaaacaaaacaaaccggaagugcauccagcaugguaaacggcgugguccgucuucugacuaagccaugggacgugguucccauggugacgcagauggccaugacagauaccacuccguucggucagcagagagucuuuaaagagaagguggacacccgcacacaagaaccuaaggaggggacgaaaaagcuaaugaaaaucaccgcugaguggcucuggaaggaacugggaaaaaagaaaacucccaggauguguacacgggaggaauucaccagaaagguacgcucaaaugcggccuugggcgcaauauuuacugaugagaacaaguggaaauccgcuagggaagccguggaggacggccgauucugggagcugguugaucgggaaagaaaucuccaccuugaggggaagugcgaaacaugugucuacaacaugaugggaaaaagggagaagaaacugggugaauuuggcaaggcaaaggggucucgcgccaucugguauaugugguuaggagcucguuuccuggaguuugaggccuugggcuuccucaaugaagaccauugguuuagccgggguaacagucuguccgggguggagggagaaggccuacacagacuuggcuacauucugagggaugugagcaaaaaggaggggggagcgauguacgcagacgauaccgccgguugggacacacgcaucacucucgaagaucugaaaaaugaggagauggucaccaaccauaugaagggcgaacacaaaaaguuggcugaggccauuuucaagcugacguaucagaauaaaguugugcgaguacagcggccaaccccuagagggacagugauggacaucauuucuaggcgcgaccagagaggaucaggccaagucgguacuuacgggcucaacaccuuuacaaauauagaagcacagcuuauccggcagauggagggagagggcauuuucaagaguauccaacaucugacugcuaccgaagagaucgccgugcagaacugguuagcuaggguuggccgugaacgacugucccgcauggccauuagcggggaugacugcguggucaaacccauagaugacagauucgcaucugcguugacggcccucaaugauaugggaaaggugcggaaagacauccagcagugggagccaucgagggguuggaacgauuggacacaaguacccuuuugcucacaccacuuccaugaacugguuaugaaggacggccgcgugcuagucgugccuuguagaaaccaggaugagcuuauugggcgggcuaggaucagccagggagccggcuggucccugaaggagaccgcaugccucgguaaaaguuaugcucagauguggacucugauguacuuucaccgacgugacuugagauuagccgcaaaugccauuuguucugcggugccaagccauugggucccgacaucccgcaccacuuggucaauccacgcuaagcacgaauggaugaccacagaggauaugcuggccguuuggaaccggguguggauacaagaaaaucccuggauggaggacaaaacgccuguagaaaguugggaggaggugccauaucucgggaagagggaagaucaguggugcggaucucuuaucggccugaccagcagagcaacuugggccaaaaacauucagacagcuaucaaucagguccgcucccuaauuggcaacgaggaauacaccgacuauaugcccucaaugaagcgguucaggcgagaggaagaggaggccggggugcugugguga

SEQ ID NO: 14391 - RNA, 9876 nt, Artificial Sequence
  derived and/or modified CDS sequence (opt3) from DENV-2__GQ868556__SS-prME
accgccggcgugaucgucaugcugauucccacagcuauggcauuccaccucacuacgagaaacggggagccucauaugauaguuggaaggcaggaaaaggguaaaagccuucuguuuaagaccgaggacggcgugaauaugugcacauugauggccaucgauuuaggggaacugugugaggacacuauuaccuacaaaugcccacuacuccggcaaaacgaaccggaggauaucgacuguuggugcaauuccacaucuaccuggguaacuuauggaacauguaccacgacuggcgagcaccgccgagaaaagcguucaguggcgcuggucccccauguggguauggggcuugagaccagaacagaaacuuggaugaguagcgagggagcuuggaaacacguucagaggauugagaccuggauccugcggcauccuggcuucacaauaauggccgcaaucuuggccuacaccauuggcacgacucacuuucagcgcgcucucaucuucauucugcugacagcaguggccccauccaugaccaugagaugcaucgggauaucuaacagggauuuugucgaaggagugucggguggcucauggguagacauuguucucgagcacgggagcugugugacuacaauggcuaagaauaagcccaccuuagauuucgaacugaucaaaacggaggccaagcagccugcgacccuucggaaauauugcauugaagcaaaguugacaaacacuaccacagagagucgcuguccaacucaaggagagcccucccugaaugaagaacaggacaaacgauuuaucugcaagcauucuauggucgauagaggcugggguaacggguguggacuauucggcaagggcgggaucgugaccugcgccauguuuacaugcaaaaagaauauggaaggaaaagugguccagccugagaaccucgaauacaccauuguuauaacuccacacagcggugaggagcaugcugugggcaaugacacggggaagcacggaaaagaaaucaagauuacaccgcaguccucaaucaccgaggccgaacugacuggcuaugguaccguaacaauggaguguagucccaggaccgggcuugauuucaacgaaauggugcuguugcaaauggaggacaaagcauggcucguccaccggcagugguuucuggauuuaccucugccauggcuccccggcgcugacacucagggaagcaauuggauacagaaggagacacuugugacguucaagaacccucaugccaaaaagcaagacguugugguccugggcucucaggaaggggcgaugcacaccgccuugacuggagcaacagagauucagauguccucagguaaucuacuguuuaccggccaucucaaaugccgucugcgcauggauaaacuucaacugaaagggaugagcuacaguauguguacaggaaaguucaagaucgugaaagaaaucgcugagacucagcacggcaccauuguaaucagaguucaguaugagggugacgggucuccaugcaagauucccuucgaaauaacggauuuggagaaaaggcaugugcucggccggcugaucaccgucaacccgauugugaucgaaaaggacuccccugucaacaucgaggccgaacccccauuuggagauagcuacauuauaaucggcguggagccugggcaguuaaaacugaauugguucaagaagggaucgucuauuggucaaauguuugagacaacuaugcgaggcgcuaaacgcauggccauccuaggggacaccgcaugggauuucggaucccucggcgguguuuuuacaucaauugggaaggcccugcaccagguguucggcgcuaucuacggagcggcauuuaguggcguaagcuggacuaugaaaauacuuaucggggucgugauuaccuggaucggaaugaacuccagaucuacgagcuugucaguuagucuggugcucgucggcgugguaacacuguaucuuggugccauggugcaggcugacuccggguguguugucagcuggaagaauaaagaacugaagugcggaucuggcauuuucaucaccgauaacgugcacacuuggacagagcaguacaaguuucaacccgaaucaccaaguaaauuggccagcgcaauacagaaggcccaugaggaagguauuuguggcaucagguccgugacccggcucgagaaucugauguggaaacagauuacucccgaguuaaaccacauccugucugaaaaugaggucaagcuaaccauaaugacaggggacacgaaaggaaucaugcaggcuggcaagcgcucgcucagaccucaaccaaccgaacugaaauauagcuggaagacuugggggaaggccaaaaugcuuuccacagagucacauaaccagaccuucuugauugauggaccggaaacagcagagugccccaauacuaacagggcguggaauagucuggagguugaagacuacggcuuugguguguucaccacgaacaucuggcucaagcugcgugagaaacaggacguguuuugugauucuaaguuaaugagcgcugccauuaaagacaaucgggcaguacacgccgauaugggguauuggaucgaauccgcucugaacgacacauggaagauggagaaggccucauucauagaggucaaaagcugccacuggccuaagucucauacccuuugguccaauggaguguuggaaagugagaugauuauccccaagaauuucgcaggccccguuagccagcacaacuaccgaccugguuaucauacucaaaccgcuggcccauggcaccucgggaagcuggaaauggauuuugacuucugugagggaacaacuguggucgugaccgaagauugcggcaauagagggcccucucuaaggacaacgaccgccuccggaaaacugaucacugaguggugcugucgcucaugcacacucccgccucugcgguacagaggcgaggacgguuguugguacgggauggaaauuaggccacuuaaggagaaggaagagaacuugguuaauagucuggugaccgcgggacauggccagaucgauaacuuuagcuuagguguacucggcauggcccuguuccuugaagagaugcugcgcacucgagucgggacaaaacacgcuauuuugcucguggcagugucguuugucacccugauaacgggaaauauguccuuccgggaccuaggccguguuauggugaugguaggggccacuaugaccgaugacaucggaaugggcgugacauaucuggcucuccuggccgcauuuaaggucagacccaccuucgcggccggucuuuugcugaggaaauuaacuucuaaggagcucaugauggcuacaauugggaucacccugcuuagccagucaacaauuccugaaacuauccuggagcuaaccgaugcccucgcacugggaaugaugguguugaaaauaguucgcaacauggaaaaguaccaacuggcugugacgaucauggccauuaguugcguccccaaugcagugaucuuacggaacgccuggaagguuuccuguacaauucucgcugcggugucugucagcccacugcuucugaccuccucacagcagaaagccgacuggaucccuuuggcacucacuauaaagggccugaaucccaccgcuauuuuucuaacaacucugagcagaaccaguaaaaagaggucuuggccacuuaacgaggccaucauggccguaggcaugguguccauccucgcuagcucgcuguugaaaaaugacauuccgaugacggggccucugguugcaggagguuuacucacagugugcuauguccugaccggccgaucagccgaucuugaacuggagcgcgcggcugacgugaagugggaggaucaggccgaaauaucugggaguucccccaucuugagcauuacuaucucugaggacggaagcauguccauuaaaaacgaagaggaggaacaaacacucaccauccugauacggacuggccuacugguaaucucagguguguucccagucaguauucccaucacagcagccgcuugguaccuuugggagguuaagaagcagagagcaggggugcucugggaugugccuagcccacccccugucggaaaagccgaacuggaggacggcgcguauaggauuaagcagcguggcaucuugggguacucucagauaggagcugguguguauaaagaaggcaccuuucacacgauguggcauguuacucgcggggccguauuaaugcaccggggaaagagaauugagccguccugggcagaugugaaaaaggaccugaucucauacggcgguggguggaagcucgagggagaauggaaagagggcgaagagguccaagugcuggcccuugaaccaggcaagaaucccagggcuguucagaccaaaccugggaucuucaagacaaacaccggaacaauuggugccgugagucuggauuuuagcccaggcacuuccgggucucccaucgucgaccgaaaaggaaaggugguaggcuuguacgguaauggggucgugacccggucgggagcauauguuagcgcuauagcccagacggagaagucaauugaggauaacccugaaaucgaggacgauauuuuccgcaaaaagagacuaacaaucauggaccugcauccgggcgcgggcaaaacuaagagguaccuccccgccauagugcgggaagcaauuaaacgagggcugagaacccuuaucuuagcuccaacacgcgucguggccgcugagauggaagaggcacugaggggacucccuauccguuaucagacccccgccauuaaggccgagcacacuggucgggaaaucguugacuugaugugucaugcuaccuucacaaugagacugcucuccccagugagggucccuaacuacaaucugauuauaauggaugaggcgcacuuuacggaccccgcaaguaucgccgcucgcggcuauauuucuacucgaguggaaaugggggaggccgcaggaaucuucaugaccgccacaccaccgggcagcagagauccuuuuccccaauccaacgcuccaaucauggacgaggaacgggagauucccgaaaggucauggaacucuggucacgaguggguaaccgauuucaaggggaaaacugugugguuuguuccuagcauaaaggcgggaaacgacaucgccgcaugccuucgcaaaaauggcaagaaagucauucagcugagucguaagacauucgauuccgaauacgugaagaccagagcuaacgacugggauuuuguggucacgacugacaucagcgagaugggcgccaauuucaaagcagagcggguaauugauccaaggcgcuguaugaagcccgugaucuugacagacggggaagaacgaguuauacuagccggaccuaugccggugacccauucuucagcugcccagagacgggguaggaucggccgcaaccccaagaaugaaaacgaccaauauauuuacaugggggagccccuggaaaaugaugaggacugcgcgcacuggaaggaggcaaaaaugcucuuagauaacaucaauaccccugaaggaauuauccccuccauguuugagccagaaagagagaaggucgacgccauagauggcgaauacaggcugcggggugaggcucguaaaacuuucguggaccuuaugcgccgaggggaucugccuguuuggcucgccuauaagguggcugcagagggcauuaacuacgccgacagaaagugguguuuugauggaaucaaaaauaaccagauuuuggaagagaacgucgaaguggagaucuggacaaaggagggcgaaaggaaaaagcugaaaccccgguggcucgacgcucgcauauauagugauccacuggcccuuaaggaguucaaggaguucgcagcggggagaaaaagccuaacccugaauuugaucacagagaugggaagguuaccuacuuuuaugacgcagaaggcccggaacgcucuggacaaucucgccguacugcauaccgcagaagcugguggccgagccuacaaccacgcacuuucggagcugccggagacacucgaaacuuugcugcuacugacccuccuugccacagugaccgggggaauuuuccuguuuuuaaugucuggcaaagguaucgggaagaugacuuugggcaugugcugcauuaucacggcuuccguucugcucugguaugcgcagauacaaccccacuggauugccgcaagcaucauccuggaguucuuucuuauuguccugcucaucccagaaccugagaaacagagaaccccacaggauaaucaguugacauacguggugauagcuauucugacugucguugccgccaccauggcaaacgaaaugggauucuuagagaagacaaagaaagaccuaggccuggggucaaucaccacucaagagagugaaucuaauauucucgacaucgaucuucgcccagcuuccgccuggacacuguaugcgguggcuacgaccuuuguaacuccuauguugaggcauagcauagagaacucaagugugaaugucagccugacagccaucgcaaaccaggccaccgugcucaugggacuggguaagggcuggccccuuuccaaaauggacauugggguuccgcuccuggcuaucggauguuacucucaggugaauccaauuaccuugacagcagcccuguuacuacuggucgcgcacuacgcuaucauuggcccuggucuccaggccaaggcaacucgggaagcccaaaaacgugcugccgcagggaucaugaagaaccccacgguagauggcauaaccgugauugaccuugagccaauccccuaugauccuaaguucgaaaaacagcugggacagguuauguugcugauccucugcgugacacagguccugaugaugagaacuaccugggcucuuugugaggccuuaacacuggcgaccggcccgauuagcacucucugggaggggaaucccggaagguuuuggaacacgacaauagccguguccauggcaaauaucuuccgcggcucauacuuggcuggugccgggcugcuauuuucuauuaugaagaacaccacuaauacccggcgaggaacaggcaacaucggugaaacucugggcgagaaauggaagaguagacucaacgcacuugggaaaucggaguuccaaauuuauaagaaaagcggaauccaggaggucgacaggacccuggcuaaggagggcauaaagcgcggggaaacagaucaucacgccgugucccggggaucugccaaauugagaugguuuguugagcguaauauggugacgccagaaggcaagguaguggaccuggguugcgggaggggaggcuggucauacuauugugguggccucaaaaacguccgggagguuaaggggcugaccaaaggaggcccugggcaugaagaaccaaucccuaugagcacuuacggauggaauuuagugcgccuucaguccggcgucgauguguucuucacaccacccgagaagugcgacacccugcucugugauauuggugaaaguucuccuaacccaacuaucgaggcggggcgaacacuaagaguacugaauuugguggaaaacuggcugaauaacaauacccaauuuugcauuaagguucucaaccccuauaugccgagcgugaucgagaaaauggaaacgcuucagaggaaguacggaggcgcucugguccggaauccuuugucacgcaacuccacccacgagauguacugggugaguaaugcaacaggcaacauagucagcucugugaauaugauuuccagaaugcugaucaacagguucacuaugaaacacaagaaagccaccuaugagccagacguugaucucgggucaggaacacgaaacaucgguauugaaagcgagauacccaauuuagacaucauuggcaagcggaucgaaaagauuaaacaggagcaugaaacuucguggcacuacgaccaggaucauccuuauaagaccugggcuuaccacgggucuuaugagacaaaacaaaccggaagugccuccagcaugguaaacggcgugguccgucugcuuacuaagccaugggacgugguucccauggugacgcagauggcaaugacagauaccacuccguuuggucagcagagagucuucaaagagaagguggacacccgcacacaagaaccuaaggaggggacgaaaaagcugaugaggaucaccgccgaauggcuauggaaagagcucggaaagaaaaagacuccccggauguguacaagagaggaauuuacccgcaaaguaaggucaaaugcugcgcugggcgccauauucacugaugagaacaaguggaaguccgcacgagaagcuguggaggacggccgguuuugggaauugguugauagagagaggaaucugcaccucgaggggaaaugcgaaacaugugucuacaacaugaugggaaagcgcgagaagaaacuuggugaguucggcaaagccaaagggucucgugcaaucugguauauguggcugggagcccgguuuuuagaguucgaagcucugggcuuuuugaaugaggaccauugguucagcagagguaacagucucuccgggguggagggagaaggccugcacaggcuaggcuacauucuucgcgauguggggaagaaagagggaggugccauguacgcggacgauaccgcaggcugggacacacgaaucacucuggaagaccucaagaaugaggaaauggucaccaaccauaugaaaggggagcacaagaaacuggccgaggcuauuuuuaaguugacguaucagaauaagguugugcggguacagagaccaaccccuaggggaacagugauggauaucauuagccgcagagaccagcggggcucuggucaagucgggacuuacggacugaacaccuucacaaauauggaagcccagcucauaaggcagauggagggcgaaggcaucuucaaaucaauucaacaucuuacugcaaccgaggagaucgcugugcagaacuggcuggcccguguugggcgagaacgcuuaaguagaauggcuaucuccggagaugacugcguggucaagcccauugaugaccgguuugccagcgcacugacggcguugaaugauauggguaaagugaggaaggacauacagcagugggagccaucucgcggcuggaacgauuggacacaaguacccuucugcucgcaccacuuucaugaacucguuaugaaagacgggagagugcuggucgugccuugucggaaccaggaugagcuaaucggaagggcccgaauuucacagggcgcugguuggagccuuaaggaaaccgccugccuggggaaguccuaugcacagauguggacucucauguacuuccaccguagagaccugcgcuuggcugccaaugcaaucuguagugccgugccaucucauugggucccgacaagccggaccacuugguccauucacgcgaaacacgaguggaugaccacagaggauauguuagcuguuuggaacaggguguggauccaagaaaaucccuggauggaggacaagacgccuguagaaucaugggaggaagugccauaucugggaaaaagagaggaccaguggugcggcagucucauaggccuuaccucucgcgccacuugggcaaagaacauccagacagccauuaaucagguccggagccugaucgggaacgaggaauacaccgauuauaugcccuccaugaaaagguuucgaagagaggaagaggaagcuggagugcuaugguga

SEQ ID NO: 14392 - RNA, 9876 nt, Artificial Sequence
  derived and/or modified CDS sequence (opt3) from DENV-2__GQ868557__SS-prME
accgccggcgugaucgucaugcugauucccacagcuauagcauuccaccucacuacgagaaacggggagccucauaugaucguuggaaggcaggaaaaggguaaaagccuucuguuuaagaccgaggacggcgugaauaugugcacauugauggccauugauuuaggggaacugugugaggacacuaucaccuacaaaugcccacuacuccggcaaaacgaaccggaggauauugacuguuggugcaauuccacaucuaccuggguaacuuauggaacauguaccacgacuggcgagcaccgccgagaaaagcguucaguggcgcuggucccccauguggguauggggcuugagaccagaacagaaacuuggaugaguagcgagggagcuuggaaacacguucagaggaucgagaccuggauacugcggcauccuggcuucacaaucauggccgcaauuuuggccuacaccaucggcacgacucacuuucagcgcgcucucauuuucauccugcugacagcaguggccccauccaugaccaugagaugcauagggauuucuaacagggauuuugucgaaggagugucggguggcucauggguagacaucguucucgagcacgggagcugugugacuacaauggcuaagaauaagcccaccuuagauuucgaacugauuaaaacggaggccaagcagccugcgacccuucggaaauauugcaucgaagcaaaguugacaaacacuaccacagagagucgcuguccaacucaaggagagcccucccugaaugaagagcaggacaaacgauuuaucugcaagcauucuauggucgauagaggcugggguaacggguguggacuauucggcaagggcgggauugugaccugcgccauguuuacaugcaaaaagaauauggaaggaaaagugguccagccugagaaccucgaauacaccauaguuaucacuccacacagcggugaggagcaugcugugggcaaugacacggggaagcacggaaaagaaauuaagaucacaccgcaguccucaauaaccgaggccgaacugacuggcuaugguaccguaacaauggaguguagucccaggaccgggcuugauuucaacgaaauggugcuguugcaaauggaggacaaagcauggcucguccaccggcagugguuucuggauuuaccucugccauggcuccccggcgcugacacucagggaagcaauuggauucagaaggagacacuugugacguucaagaacccucaugccaaaaagcaagacguugugguccugggcucucaggaaggggcgaugcacaccgccuugacuggagcaacagagauccagauguccucagguaaucuacuguuuaccggccaucucaaaugccgucugcgcauggauaagcuucaacugaaagggaugagcuacaguauguguacaggaaaguucaagaucgugaaagaaauugcugagacucagcacggcaccaucguaauuagaguucaguaugagggugacgggucuccaugcaagauacccuucgaaaucacggauuuggagaaaaggcaugugcucggccggcugauuaccgucaacccgaucgugacagaaaaggacuccccugucaacaucgaggccgaacccccauuuggagauagcuacauuauaaucggcguggagccugggcaguuaaaacugaauugguucaagaagggaucgucuauuggucaaauguuugagacuaccaugcgaggcgcuaaacgcauggccauccuaggggacacagcaugggauuucggaucccucggcgguguuuuuacuucaauugggaaggcccugcaccagguguucggcgcuaucuacggagcggcauuuaguggcguaagcuggaccaugaaaauacuuaucggggucgugauuacguggaucggaaugaacuccagaucuacaagcuugucaguuagucuggugcucgucggcgugguaacccuguaucuuggugccauggugcaggcugacuccggguguguugucagcuggaagaauaaagaacugaagugcggaucuggcauuuucaucacugauaacgugcacacauggaccgagcaguacaaguuucaacccgaaucaccaaguaaauuggccagcgcaauacagaaggcccaugaggaagguauuuguggcaucagguccgugacucggcucgagaaucugauguggaaacagauuacccccgaguuaaaccacauccugucugaaaaugaggucaagcuaacaauaaugacgggggacaccaaaggaaucaugcaggcuggcaagcgcucgcucagaccucaaccaacugaacugaaauauagcuggaagacaugggggaaggccaaaaugcuuuccaccgagucacauaaccagacauucuugauugauggaccggaaacugcagagugccccaauaccaacagggcguggaauagucuggagguugaagacuacggcuuugguguguucacgacaaacaucuggcucaagcugcgugagaaacaggacguguuuugugauucuaaguuaaugagcgcugccauuaaagacaaucgggcaguacacgccgauaugggguauuggaucgaauccgcucugaacgacaccuggaagauggagaaggccucauucauagaggucaaaagcugccacuggccuaagucucauacucuuugguccaauggaguguuggaaagugagaugauuaucccaaaaaacuucgcaggccccguuagccagcacaacuaccgaccugguuaucauacccaaacagcuggcccauggcaccucgggaagcuggaaauggauuuugaccuaugugagggaacuaccguggucgugacagaagauugcggcaauagagggcccucucugaggacgaccacugccuccggaaaacucaucacagaguggugcugucgcucaugcacccugccgccucuucgguacagaggcgaggacgguuguugguacgggauggaaauuaggccauugaaggagaaggaagagaaccugguuaauaguuuagugacugcgggacauggccagaucgauaacuucagccucgguguacugggcauggcccuuuuucuggaagagauguugcgcacacgagucgggaccaaacacgcuauucuccugguggcagugucguucgucacgcuaauaacuggaaauauguccuuucgggaccugggccguguuauggugaugguaggggccaccaugacagaugacaucggaaugggcgugaccuaucucgcucugcuugccgcauucaaggucagacccacuuuugcggccgguuugcuguuaaggaaacucacaucuaaggagcugaugauggcuaccauugggaucgcccuucugagccagucaacaauuccugaaacuauccuagagcucaccgaugcacuggcuuugggaaugauggugcugaaaauaguucgcaacauggaaaaguaccaauuagccgugacgaucauggcaauuaguugcguccccaaugccgugauccuccggaacgcuuggaagguuuccuguacaauucuggcggccgugucugucagcccacuucuguugaccuccucacagcagaaagcagacuggaucccucucgcucugacuauaaagggccuaaaucccaccgccauuuuccugacaacucuuagcagaaccaguaaaaagaggucuuggccacucaacgaggccaucauggcuguaggcaugguguccauccuggcaagcucguugcugaaaaaugacauuccgaugacggggccuuuaguugccggaggucuccugacagugugcuauguccuuaccggccgaucagcggaucuggaauuggagcgcgcugccgaggugaagugggaagaccaggcagagauaucugggaguucccccauccucagcauuacuaucucugaagauggaagcauguccauuaaaaacgaggaggaagagcaaacacugaccauccuaauacggacuggccugcuuguaaucucagguguguuuccagucaguauucccaucacagccgcugcaugguaccucugggaaguuaagaagcagagagccggggugcugugggacgugccuagcccacccccugucggaaaagcggaguuggaagauggcgcuuauaggauuaagcagcguggcaucuuaggguacucucagauaggagccgguguguauaaagagggcaccuuccacacgauguggcauguuacucgcggggcaguacugaugcaccggggaaagagaauugagccguccugggccgacgugaaaaaggaucucaucucauacggcgguggguggaagcuggaaggagaguggaaagaaggcgaggaaguccaagugcuugcucuggagccaggcaagaaucccagggccguucagaccaaaccugggaucuuuaagacaaacaccggaacaauuggugcagugaguuuggacuucagcccaggcacuuccgggucucccaucgucgaucgaaaaggaaaggugguaggccuauacgguaauggggucgugacccggucgggagcuuauguuagcgccauagcgcagacggagaagucaauugaagacaacccugagaucgaagaugacauuuuucgcaaaaagagacugacaaucauggaucuccauccgggcgccggcaaaacuaagagguaccugcccgcaauagugcgggaggcuauuaaacgagggcuuagaaccuuaauccuggccccaacacgcgucguggcugcagaaauggaggaggcccucaggggauugccuauccguuaucagacccccgccauuaaggcugaacacacuggucgggagaucguugaccugaugugucaugcgaccuucacaaugagacuccuguccccagugagggucccuaacuacaaucuuauuauaauggacgaagcacacuucacggaucccgccaguaucgcugcccgcggcuauauuucuacucgaguggagaugggggaggcagccggaaucuuuaugaccgcuacaccaccgggcagcagagacccuuucccccaauccaacgcgccaaucauggaugaagagcgggaaauucccgagaggucauggaauucuggucacgaauggguaaccgacuuuaaggggaaaacugugugguucguuccuagcauaaaggccggaaacgauaucgcagcuugccugcgcaaaaauggcaagaaagucauucaguugagucguaagacauuugacuccgaguacgugaagaccagagccaacgauugggacuucguggucacgacugauaucagcgagaugggcgcaaauuuuaaagccgaacggguaauugacccaaggcgcuguaugaagcccgugauccuaacagauggggaggaacgaguuauacuggcuggaccuaugccggugacccauucuucagccgcgcagagacgggguaggaucggccgcaacccaaaaaaugagaacgaccaauauauuuacaugggggaaccccucgagaaugacgaggauugcgcacacuggaaggaagccaaaauguuacuggacaacaucaauaccccugagggaauuauccccuccauguucgaaccagagagagaaaaggucgaugcuauagacggcgaguacaggcuucggggugaggcccguaaaacuuuuguggaucugaugcgccgaggggaccucccuguuugguuggcuuauaagguggcagccgaaggcauuaacuacgcugauagaaagugguguuucgacggaaucaaaaauaaccagauucuggaggaaaacgucgagguggagaucuggacaaaggaaggcgagaggaaaaagcucaaaccccgguggcuggaugcccgcauauauagugacccacuugcacuaaaggaauuuaaggaguucgcggccgggagaaaaagccugaccuugaauuuaaucacagaaaugggaaggcugccuacuuucaugacgcagaaggcucggaacgcccucgauaaucuggcaguacuucauaccgcugaggccgguggccgagcauacaaccacgcccugucggagcucccggaaacauuggagacucugcuacugcucacccuucuggcuacagugaccgggggaauuuuuuuauucuugaugucuggcaaagguaucgggaagaugacucugggcaugugcugcauuaucacggcguccguucuccugugguaugcccagauacaaccccacuggauugcagcuagcaucauccuugaauuuuuccugauuguccucuugaucccagagccugaaaaacagagaaccccccaggacaaucagcugacauacguggugauagccauuuuaacugucguugccgcaaccauggcuaacgagaugggauuucuagagaagacaaagaaagaucugggccucgggucaaucaccacucaagaaagugagucuaauauucuugacaucgaccugcgcccagccuccgcguggacauuguaugcuguggccacgaccuucguaacuccuaugcugaggcauagcauagaaaacucaagugugaaugucagccucacagcaaucgccaaccaggcuaccgugcugaugggacuugguaagggcuggccccucuccaaaauggauauugggguuccgcuguuggcaaucggauguuacucucaggugaauccaauuacccugacagccgcguuacuacugcucgucgcucacuacgccaucauuggcccuggucuucaggcaaaggccacucgggaggcucaaaaacgugccgcagcugggaucaugaagaaccccacgguagacggcauaaccgugauugaucuggaaccaauccccuaugacccuaaguuugagaaacaguugggacagguuaugcugcucauccugugcgugacacagguccuuaugaugagaacuaccugggccuuaugugaggcgcugacacucgccaccggcccgauuagcacuuugugggaagggaaucccggaagguucuggaacacgacaauagcaguguccauggcuaauaucuuucgcggcucauaccuggccggugcagggcuacuguucucuauuaugaagaacaccacuaauacccggcgaggaacaggcaacaucggugagacucucggcgaaaaauggaagaguagacuuaacgcucuggggaaaucggaguuucaaauuuauaagaaaagcggaauccaggaggucgauaggaccuuggccaaggaaggcauaaagcgcggggagacagaccaucacgccgugucccggggaucugcgaaacugagaugguucguugaacguaauauggugacgccagagggcaagguaguggaucucgguugcgggaggggaggcuggucauacuauugugguggccugaaaaacguccgggaaguuaagggguuaaccaaaggaggcccugggcaugaggagcccaucccuaugagcacuuacggauggaaucuugugcgccugcaguccggcgucgacguguuuuucacaccacccgaaaagugcgauacccuccuaugugacauuggugagaguucuccuaacccaacuaucgaagcugggcgaacacugagaguauugaaucugguggagaacuggcucaauaacaauacccaauucugcauuaagguucuuaaccccuauaugccgagcgugaucgaaaaaauggagacgcugcagaggaaguacggaggcgcauugguccggaauccucugucacgcaacuccacccacgagauguacugggugaguaaugccacaggcaacauagucagcucugugaauaugauuuccagaaugcucaucaacagguuuacuaugaaacacaagaaagcuaccuaugaaccagauguugacuuagggucaggaacacgaaacaucgguauugagagcgaaauacccaaucuggauaucauuggcaagcggaucgagaagauuaaacaggaacaugagacuucguggcacuacgaccaggaccauccuuauaagaccugggccuaccacgggucuuaugagacaaaacaaaccggaagugcauccagcaugguaaacggcgugguccgucuucugacuaagccaugggaugugguucccauggugacgcagauggccaugacagacaccacuccguucggucagcagagagucuuuaaagaaaagguggauacccgcacacaagagccuaaggaagggacgaaaaagcuaaugaaaaucaccgcugaguggcucuggaaggagcugggaaaaaagaaaacucccaggauguguacacgggaagaguucaccagaaagguacgcucaaaugcggccuugggcgcaauauuuacugacgaaaacaaguggaaauccgcuagggaggccguggaagauggccgauucugggagcugguugaccgggagagaaaucuccaccuugaagggaagugcgagacaugugucuacaacaugaugggaaaaagggaaaagaaacugggugaguuuggcaaggcaaaggggucucgcgccaucugguauaugugguuaggagcucguuuccuggaauuugaggccuugggcuuccucaaugaggaucauugguuuagccgggguaacagucuguccgggguggaaggagagggccuacacagacuuggcuacauucugagggacgugagcaaaaaggaagggggagcgauguacgcagaugacaccgccgguugggauacacgcaucacucucgaggaccugaaaaaugaagagauggucaccaaccauaugaagggcgagcacaaaaaguuggcugaagccauuuucaagcugacguaucagaauaaaguugugcgaguacagcggccaaccccuagagggacagugauggacaucauuucuaggcgcgaucagagaggaucaggccaagucgguacuuacgggcucaacaccuuuacaaauauggaggcacagcuuauacggcagauggaaggagagggcaucuucaagaguauucaacaucugacugcuaccgaggaaaacgccgugcagaauugguuagcuaggguuggccgugagcgacugucccgcauggccaucagcggggacgauugcguggucaaacccaucgacgauagauucgcaucugcguugacggcccucaacgacaugggaaaggugcggaaagauauucagcagugggaaccaucgagggguuggaacgacuggacacaaguacccuuuugcucacaccacuuccaugagcugguuaugaaggauggccgcgugcuagucgugccuuguagaaaucaggacgaacuuauagggcgggcuaggaucagccagggagccggcuggucccugaaggagaccgcaugccucgguaaaaguuaugcucagauguggacucugauguacuuucaccgacgugauuugagauuagccgcaaacgccauuuguucugcggugccaagccauugggucccgacaucccgcaccacuuggucaauccacgcuaagcacgaguggaugaccacagaagacaugcuggccguuuggaaucggguguggauucaagagaaccccuggauggaagauaaaacgccuguagagaguugggaagaggugccauaucucgggaagagggaggaccaguggugcggaucucuuaucggccugaccagcagagcaacuugggccaaaaauauacagacagcuaucaaccagguccgcucccuaauuggcaaugaagaguacaccgacuauaugcccucaaugaagcgguucaggcgagaagaggaagaggccggggugcugugguga

SEQ ID NO: 14393 - RNA, 9876 nt, Artificial Sequence
  derived and/or modified CDS sequence (opt3) from DENV-2__GU131947__SS-prME
accgccggcgugaucgucaugcugauucccacagcuauagcauuccaccucacuacgcggaacggggagccucauaugaucguuggaaggcaggaaaaggguaaaagccuucuguuuaagaccgaggacggcgugaauaugugcacauugauggccauugauuuaggggaacugugugaggacacuaucaccuacaaaugcccacuacuccggcaaaacgaaccggaggauauugacuguuggugcaauuccacaucuaccuggguaacuuauggaacauguaccacgacuggcgagcaccgccgagaaaagcguucaguggcgcuggucccccauguggguauggggcuugagacccggacagaaacuuggaugaguagcgagggagcuuggaaacacguucagaggaucgagaccuggauucugcggcauccuggcuucacaaucauggccgcaauuuuggccuacaccaucggcacgacucacuuucagcgcgcucucauuuucauccugcugacagcaguggccccauccaugaccaugaggugcauagggauuucuaacagggauuuugucgaaggagugucggguggcucauggguagacaucguucucgagcacgggagcugugugacuacaauggcuaagaauaagcccaccuuagauuucgaacugauuaaaacggaggccaagcagccugcgacccuucggaaauauugcaucgaagcaaaguugacaaacacuaccacagagagucgcuguccaacucaaggagagcccucccugaaugaggaacaggacaaacgauuuaucugcaagcauucuauggucgauagaggcugggguaacggguguggacuauucggcaagggcgggauugugaccugcgccauguuuacaugcaaaaagaauauggaaggaaaagugguccagccugagaaccucgaauacaccauaguuaucacuccacacagcggugaggagcaugcugugggcaaugacacggggaagcacggaaaagaaauuaagaucacaccgcaguccucaauaaccgaggccgaacugacuggcuaugguaccguaacaauggaguguagucccaggaccgggcuugauuucaacgaaauggugcuguugcaaauggaggacaaagcauggcucguccaccggcagugguuucuggauuuaccucugccauggcuccccggcgcugacacucagggaagcaauuggauucagaaggagacacuugugacguucaagaacccucaugccaaaaagcaagacguugugguccugggcucucaggaaggggcgaugcacaccgccuugacuggagcaacagagauccagauguccucagguaaucuacuguuuaccggccaucucaaaugccgucugcgcauggauaaacuucaacugaaagggaugagcuacaguauguguacaggaaaguucaagaucgugaaagaaauugcugagacucagcacggcaccaucguaauuagaguucaguaugagggugacgggucuccaugcaagauacccuucgaaaucacggauuuggagaaaaggcaugugcucggccggcugauuaccgucaacccgaucgugacagaaaaggacuccccugucaacaucgaggccgaacccccauuuggagauagcuacauuauaaucggcguggagccugggcaguuaaaacugaauugguucaagaagggaucgucuauuggucaaauguuugagacuaccaugcgaggcgcuaaacgcauggccauccuaggggacacagcaugggauuucggaucccucggcgguguuuuuacuucaauugggaaggcccugcaccagguguucggcgcuaucuacggagcggcauuuaguggcguaagcuggaccaugaaaauacuuaucggggucgugauuacguggaucggaaugaacuccagaucuaccagcuugucaguuagucuggugcucgucggcgugguaacccuguaucuuggugccauggugcaggcugacuccggguguguugucagcuggaagaauaaagaacugaagugcggaucuggcauuuucaucacugauaacgugcacacauggaccgagcaguacaaguuucaacccgaaucaccaaguaaauuggccagcgcaauacagaaggcccaugaggaagguauuuguggcaucagguccgugacucggcucgagaaucugauguggaaacagauuacccccgaguuaaaccacauccugucugaaaaugaggucaagcuaacaauaaugacgggggacaccaaaggaaucaugcaggcuggcaagcgcucgcucagaccucaaccaacugaacugaaauauagcuggaagacaugggggaaggccaaaaugcuuuccaccgagucacauaaccagacauucuugauugauggaccggaaacugcagagugccccaauaccaacagggcguggaauagucuggagguugaagacuacggcuuugguguguucacgacaaacaucuggcucaagcugcgugagaaacaggacguguuuugugauucuaaguuaaugagcgcugccauuaaagacaaucgggcaguacacgccgauaugggguauuggaucgaauccgcucugaacgacaccuggaagauggagaaggccucauucauagaggucaaaagcugccacuggccuaagucucauacucuuugguccaauggaguguuggaaagugagaugauuauccccaagaauuucgcaggccccguuagccagcacaacuaccgaccugguuaucauacccaaacagcuggcccauggcaccucgggaagcuggaaauggauuuugaccuaugugagggaacuaccguggucgugacagaagauugcggcaauagagggcccucucugaggacgaccacugccuccggaaaacucaucacagaguggugcugucgcucaugcacccugccgccucuucgguacagaggcgaggacgguuguugguacgggauggaaauuaggccauugaaggagaaggaagagaaccugguuaauaguuuagugacugcgggacauggccagaucgauaacuucagccucgguguacugggcauggcccuuuuucuggaagagauguugcgcacacgagucgggaccaaacacgcuauucuccugguggcagugucguucgucacgcuaauaacuggaaauauguccuuucgggaccugggccguguuauggugaugguaggggccaccaugacagaugacaucggaaugggcgugaccuaucucgcucugcuugccgcauucaaggucagacccacuuuugcggccgguuugcuguuaaggaaacucacaucuaaggagcugaugauggcuaccauugggaucgcccuucugagccagucaacaauuccugaaacuauccuagagcucaccgaugcacuggcuuugggaaugauggugcugaaaauaguucgcaacauggaaaaguaccaauuagccgugacgaucauggcaauuaguugcguccccaaugccaugauccuccggaacgcuuggaagguguccuguacaauucuggcggccguuucugugagcccacuucuguugaccuccucacagcagaaagcagacuggaucccucucgcucugacuauaaagggccuaaaucccaccgccauuuuccugacaacucuuagcagaaccaguaaaaagaggucuuggccacucaacgaggccaucauggcugucggcaugguauccauccuggcaagcucguugcugaaaaaugacauuccgaugacggggccuuuaguggccggaggucuccugacaguuugcuaugugcuuaccggccgaucagcggaucuggaauuggagcgcgcugccgaggucaagugggaagaccaggcagagauaucugggaguucccccauccucagcauuacuaucucugaagauggaagcauguccauuaaaaacgaggaggaagaacaaacacugaccauccuaauacggacuggccugcuugugaucucagguguauuuccagugaguauucccaucacagccgcugcaugguaccucugggaagucaagaagcagagagccgggguucugugggacgugccuagcccacccccugugggaagggcggaguuggaagauggcgcuuaucguauuaaacagcgcggcaucuuaggguacucucagauaggagccggugucuauaaggagggcaccuuccacacgauguggcaugugacuagaggggcaguucugaugcacagaggaaaaaggauugagccguccugggccgacguaaagaaagaucucaucucauacggcgguggguggaagcuggaaggagaguggaaggaaggcgaggaagugcaaguccuugcucuggagccaggcaaaaauccccgagccgugcagaccaagccugggaucuuuaaaacaaacaccggaacaauuggugcaguuaguuuggacuucagcccaggcacuuccgggucucccaucguggaucggaagggaaaagucgugggccuauacgguaaugggguagucacccgcucgggagcuuaugugagcgccauagcgcagacggagaagucaauugaagacaacccugagaucgaagaugacauuuuuagaaagaaaaggcugacaaucauggaucuccauccgggcgccggcaagacuaaacgguaccugcccgcaauaguucgagaggcuauuaagagagggcuucgcaccuuaauccuggccccaacaaggguggucgcugcagaaauggaggaggcccuccguggauugccuauccgguaucagacccccgccauuaaagcugaacacacugguagagagaucguggaccugaugugucaugcgaccuucacaaugaggcuccuguccccaguucgcgugccuaacuacaaucuuauuauaauggacgaagcacacuucacggaucccgccaguaucgcugcccgaggcuauauuucuacuagagucgagaugggggaggcagccggaaucuuuaugaccgcuacaccaccgggcagccgggacccuuucccccaauccaacgcgccaaucauggaugaagagagggaaauucccgagcgcucauggaacucuggucacgaaugggugaccgacuuuaaggggaagacuguaugguucgugccuagcauaaaagccggaaacgauaucgcagcuugccugcguaagaauggcaaaaagguuauucaguugaguagaaaaacauuugacuccgaguacgucaagacccgggccaacgauugggacuucguggugacgacugauaucagcgagaugggcgcaaauuuuaaggccgaaagggucauugacccacgccgauguaugaaacccguaauccuaacagauggggaggaaagagugauacuggcuggaccuaugccgguuacccauucuucagccgcgcagcggaggggucgcaucggcagaaacccaaagaaugagaacgaccaauauauuuacaugggggaaccccucgagaaugacgaggauugcgcacacuggaaagaagccaagauguuacuggacaacaucaauaccccugagggaauuauccccuccauguucgaaccagagagggaaaaaguggaugcuauagacggcgaguaccggcuucguggugaggcccgcaagacuuuugucgaucugaugcgaagaggggaccucccugugugguuggcuuauaaaguugcagccgaaggcauuaacuacgcugauaggaagugguguuucgacggaaucaagaauaaccagauucuggaggaaaacguggaggucgagaucuggacaaaagaaggcgagcggaagaaacucaagccccgcuggcuggaugccagaauauauagugacccacuugcacuaaaagaauuuaaggaguucgcggccgggagaaagagccugaccuugaauuuaaucacagaaaugggacggcugccuacuuucaugacgcagaaagcucgaaacgcccucgauaaucuggcagugcuucauaccgcugaggccgguggcagagcauacaaccacgcccugucggagcucccggaaacauuggagacucugcuacugcucacccuucuggcuacaguaaccgggggaauauuuuuauucuugaugucuggcaaggguaucgggaaaaugacucugggcaugugcugcauuaucacggcguccgugcuccugugguaugcccagauacaaccccacuggauugcagcuagcaucauccuugaauuuuuccugauuguucucuugaucccagagccugaaaagcagcgcacaccacaggacaaucagcugacauacgucgugauagccauuuuaacuguggucgccgcaaccauggcuaacgagaugggauuucuagagaaaacaaagaaggaucugggccucgggucaaucaccacucaagaaagugagucuaauauucuugacaucgaccugaggccagccuccgcguggacauuguaugcuguugccacgaccuucgugacuccuaugcugcggcauagcauagaaaacucaaguguaaaugugagccucacagcaaucgccaaccaggcuaccguccugaugggacuugguaaaggcuggccccucuccaagauggauauuggggugccgcuguuggcaaucggauguuacucucagguuaauccaauuacccugacagccgcguuacuacugcucguggcucacuacgccaucauuggcccuggucuucaggcaaaagccacucgugaggcucaaaagagagccgcagcugggaucaugaaaaaccccacggucgacggcauaaccguaauugaucuggaaccaauccccuaugacccuaaguuugagaagcaguugggacaggugaugcugcucauccugugcguuacacaggugcuuaugaugaggacuaccugggccuuaugugaggcgcugacacucgccaccggcccgauuagcacuuugugggaagggaaucccggacgcuucuggaacacgacaauagcagucuccauggcuaauaucuuucggggcucauaccuggccggugcagggcuacuguucucuauuaugaaaaacaccacuaauacccgaagaggaacaggcaacaucggugagacucucggcgaaaaguggaaaaguaggcuuaacgcucuggggaagucggaguuucaaauuuauaaaaagagcggaauccaggagguggaucgcaccuuggccaaagaaggcauaaagagaggggagacagaccaucacgccgucuccagaggaucugcgaagcugcguugguucguggaaaggaauaugguuacgccagagggcaaagugguagaucucgguugcgggcggggaggcuggucauacuauugugguggccugaagaacgugcgcgaagucaaaggguuaaccaagggaggcccugggcaugaggagcccaucccuaugagcacuuacggauggaaucuuguucgacugcaguccggcguggacgucuuuuucacaccacccgaaaaaugcgauacccuccuaugugacauuggugagaguucuccuaacccaacuaucgaagcugggagaacacugaggguguugaaucugguagagaacuggcucaauaacaauacccaauucugcauuaaggugcuuaaccccuauaugccgagcguuaucgaaaagauggagacgcugcagcggaaauacggaggcgcauuggugcgcaauccucugucaagaaacuccacccacgagauguacugggucaguaaugccacaggcaacauagugagcucugucaauaugauuuccaggaugcucaucaaccgauuuacuaugaagcacaaaaaggcuaccuaugaaccagauguggacuuagggucaggaacacggaacaucgguauugagagcgaaauacccaaucuggauaucauuggcaaacguaucgagaagauuaagcaggaacaugagacuucguggcacuacgaccaggaccauccuuauaaaaccugggccuaccacgggucuuaugagacaaagcaaaccggaagugcauccagcaugguuaacggcguagugagacuucugacuaaaccaugggaugucgugcccaugguuacgcagauggccaugacagacaccacuccguucggucagcagcgcguguuuaaggaaaaagucgauaccaggacacaagagccuaaggaagggacgaagaaacuaaugaagaucaccgcugaguggcucuggaaagagcugggaaagaaaaagacuccccggauguguacaagagaagaguucacccgcaaagugaggucaaaugcggccuugggcgcaauauuuacugacgaaaacaaguggaaguccgcucgagaggccguagaagauggccgguucugggagcugguggacagagagaggaaucuccaccuugaagggaaaugcgagacauguguuuacaacaugaugggaaagcgcgagaaaaagcugggugaguuuggcaaagcaaaggggucucgugccaucugguauaugugguuaggagcucgguuccuggaauuugaggccuugggcuuccucaaugaggaucauugguuuagcagagguaacagucuguccggggucgaaggagagggccuacacaggcuuggcuacauucugcgcgacgugagcaagaaagaagggggagcgauguacgcagaugacaccgccgguugggauacacgaaucacucucgaggaccugaagaaugaagagauggugaccaaccauaugaaaggcgagcacaagaaauuggcugaagccauuuucaagcugacguaucagaauaaggucguucgggugcagagaccaaccccuagggggacaguaauggacaucauuucucgcagagaucagcggggaucaggccaaguggguacuuacgggcucaacaccuuuacaaauauggaggcacagcuuauaaggcagauggaaggagagggcaucuucaaaaguauucaacaucugacugcuaucgaggaaaucgccguccagaacugguuagcucgugugggccgagagcgccuguccagaauggccauuagcggggacgauugcguugugaagcccauagacgaucgguucgcaucugcguugaccgcccucaaugacaugggaaaagucaggaaggauauccagcagugggaaccaucgcgcgguuggaacgacuggacgcaagugcccuuuugcucacaccacuuccaugagcugguaaugaaagauggcagaguucuaguggucccuugucggaaccaggacgaacuuauugggagggcucgaaucagccagggagccggcuggucccugaaggagacagcaugccucgguaagaguuaugcucagauguggacccugauguacuuucaccguagagauuugcgcuuagccgcaaaugccauuuguucugcggugccaagccauugggugccgacuucccggacaaccuggucaauccacgcuaaacacgaguggaugacuaccgaagacaugcuggccgucuggaacaggguuuggauacaagagaaucccuggauggaagauaagacaccuguggagaguugggaagagguaccauaucucgggaaaagagaggaccaguggugcggaucucuuaucggccugacgagccgcgcaaccugggccaagaacauucagacugcuaucaaucaggugcggucccuaauuggcaacgaagaguacacagacuauaugcccucaaugaaaagguuccgaagagaagaggaagaggccgggguccugugguga

SEQ ID NO: 14394 - RNA, 9876 nt, Artificial Sequence
  derived and/or modified CDS sequence (opt3) from DENV-2__GQ868558__SS-prME
accgccggcgugaucgucaugcugauucccacagcuauagcauuccaccucacuacgaggaauggggagccucauaugaucguuggaaggcaggaaaaggguaaaagccuucuguuuaagaccgaggacggcgugaauaugugcacauugauggccauugauuuaggggaacugugugaggacacuaucaccuacaaaugcccacuacucaagcaaaacgaaccggaggauauugacuguuggugcaauuccacaucuaccuggguaacuuauggaacauguaccacgacuggcgagcaccggcgcgaaaaacgaucaguggcgcuggucccccauguggguauggggcuugagacccguacagaaacuuggaugaguagcgagggagcuuggaagcacguucagagaaucgagaccuggauacugaggcauccuggcuucacaaucauggccgcaauuuuggccuacaccaucggcacgacucacuuucagcgggcucucauuuucauccugcugacagcaguggccccauccaugaccaugcgcugcauagggauuucuaacagagauuuugucgaaggagugucggguggcucauggguagacaucguucucgagcacgggagcugugugacuacaauggcuaagaauaaacccaccuuagauuucgaacugauuaagacggaggccaaacagccugcgacccuuaggaaguauugcaucgaagcaaaauugacaaacacuaccacagagagucgguguccaacucaaggagagcccucccugaaugaggaacaggacaagcgcuuuaucugcaagcauucuauggucgaucgaggcugggguaacggguguggacuauucggcaaaggcgggauugugaccugcgccauguuuacaugcaagaaaaauauggaaggaaaggugguccagccugagaaccucgaauacaccauaguuaucacuccacacagcggugaggagcaugcugugggcaaugacacggggaaacacggaaaggaaauuaaaaucacaccgcaguccucaauaaccgaggccgaacugacuggcuaugguaccguaacaauggaguguagucccagaaccgggcuugauuucaacgaaauggugcuguugcaaauggaggacaaggcauggcucguccacaggcagugguuucuggauuuaccucugccauggcuccccggcgcugacacucagggaagcaauuggauucagaaggagacacuugugacguucaaaaacccucaugccaagaaacaagacguugugguccugggcucucaggaaggggcgaugcacaccgccuugacuggagcaacagagauccagauguccucagguaaucuacuguuuaccggccaucucaagugccggcugcguauggauaaacuucaacugaaggggaugagcuacaguauguguacaggaaaguucaaaaucgugaaggaaauugcugagacucagcacggcaccaucguaauucgcguucaguaugagggugacgggucuccaugcaaaauacccuucgaaaucacggauuuggagaagagacaugugcucggcaggcugauuaccgucaacccgaucgugacagaaaaagacuccccugucaacaucgaggccgaacccccauuuggagauagcuacauuauaaucggcguggagccugggcaguuaaagcugaauugguucaagaaaggaucgucuauuggucaaauguuugagacuaccaugcggggcgcuaagcgaauggccauccuaggggacacagcaugggauuucggaucccucggcgguguuuuuacuucaauugggaaagcccugcaccagguguucggcgcuaucuacggagcggcauuuaguggcguaagcuggaccaugaagauacuuaucggggucgugauuacguggaucggaaugaacucccgcucuaccagcuugucaguuagucuggugcucgucggcgugguaacccuguaucuuggugccauggugcaggcugacuccggguguguugucagcuggaaaaauaaggaacugaagugcggaucuggcauuuucaucacugauaacgugcacacauggaccgagcaguacaaauuucaacccgaaucaccaaguaaguuggccagcgcaauacagaaagcccaugaggaagguauuuguggcaucagauccgugacuaggcucgagaaucugauguggaagcagauuacccccgaguuaaaccacauccugucugaaaaugaggucaaacuaacaauaaugacgggggacaccaagggaaucaugcaggcuggcaaacggucgcuccgcccucaaccaacugaacugaaguauagcuggaagacaugggggaaagccaagaugcauuccaccgagucacacaaccagacauuccuuauugauggaccggaaacugcagagugccccaauaccaacagagcguggaauaguuuggagguugaagacuacggcuuugguguguucacgacaaacaucuggcugaaacucagggagaagcaggacguguuuugugauucuaaacugaugagcgcugccauuaaggacaaucgugcaguacacgccgauaugggguauuggaucgaauccgcuuuaaacgacaccuggaagauggagaaagccucauucauagaggucaagagcugccauuggccuaaaucucacacucugugguccaauggagugcuugaaagugagaugauuaucccaaagaacuucgcaggccccguuagccagcauaacuaccggccugguuaucacacccaaacagcuggcccauggcauuuggggaaacucgaaauggauuuugaccugugugagggaacuaccguggucgugacagaagauugcggcaaucgagggcccucucuaagaacgaccacugccuccggaaagcugaucacagaguggugcuguaggucaugcacccucccgccucugcgcuaccggggcgaggacgguuguugguacgggauggaaauuagaccacuuaaggagaaagaagagaacuugguuaauagucuggugacugcgggacacggccagaucgauaacuucagcuuagguguacucggcauggcccuguuucuugaagagaugcugaggacacgcgucgggaccaagcacgcuauuuugcucguggcagugucguucgucacgcugauaacuggaaauauguccuuucgagaccuaggccggguuauggugaugguaggggccaccaugacagaugacaucggaaugggcgugaccuaucuggcucuccuggccgcauucaaaguccgucccacuuuugcggccggucuuuugcugagaaaguuaacaucuaaagagcucaugauggcuaccauugggaucgcccugcuuagccagucaacaauuccugaaacuauccuggagcuaaccgaugcacucgcucugggaaugaugguguugaagauaguuaggaacauggaaaaguaccaacuggccgugacgaucauggcaauuaguugcguccccaaugccgugaucuuacgcaacgcuuggaaaguuuccuguacaauucucgcggccgugucugucagcccacugcuucugaccuccucacagcagaaggcagacuggaucccuuugguacucacuauaaaaggccugaaucccaccgcuauuuuccuaacaacucugagccggaccaguaagaaaagaucuuggccacuuaacgaggccaucauggccgugggcaugguuuccauccucgcuagcucgcuguugaagaaugacauuccgaugacggggccucugguggcaggagguuuacucacagucugcuaugugcugaccggcaggucagccgaucuugaacuggagcgagcggcugagguaaaaugggaagaccaggccgagauaucugggaguucccccaucuugagcauuacuaucucugaagauggaagcauguccauuaagaacgaggaggaagaacaaacacucaccauccugauacgcacuggccuacuggugaucucaggugucuuuccaguuaguauucccaucacagcagccgcuugguaccuuugggaagugaagaaacagcgggcaggggugcucugggacgucccuagcccacccccugugggaaaggccgagcuggaagauggcgcguauagaauuaaacagaggggcaucuugggguacucucagauaggagcugguguuuauaaggagggcaccuuccauacgauguggcacguaacucguggggccguguuaaugcaucgcggaaaacggauugagccguccugggcagacgucaagaaggaucugaucucauacggcgguggguggaaacucgaaggagaguggaaggaaggcgaggaagugcaaguucuggcccuugagccaggcaaaaaucccagagcugugcagaccaagccugggaucuuuaaaacaaacgccggaaccauuggugcagucagucuggacuucagcccaggcacauccgggucucccaucguggauaggaagggaaagguagucggcuuguacgguaauggggugguuacucgaucgggagcuuaugugagcgccauagcgcagaccgagaaaucaauugaagacaacccugagaucgaagaugacauuuuucggaagaaacgccuaacgaucauggaucugcacccgggcgccggcaagacaaaaagauaccuccccgcaauagucagggaggcuauuaagcgggggcugcgaacucuuaucuuagccccaaccagagugguugcugcagaaauggaggaggcccugcgcggacucccuaucagguaucagacacccgccauuaaggcugaacauaccggucgugagaucguggacuugaugugucacgcgacuuucaccaugcggcugcucuccccagucagagugccuaacuacaaucugauuauaauggacgaagcacacuucacagaucccgccaguaucgcugccaggggcuauauuucuacgcgcguagagaugggggaggcagccggaaucuuuaugacugcuaccccaccgggcagccgagacccuuucccccaauccaacgcgccaaucauggaugaagagagagaaauucccgagcggucauggaacucuggucaugaaugggugacagacuuuaaagggaagaccguuugguucgucccuagcauaaaagccggaaacgauaucgcagcuugccuuaggaagaauggcaaaaaggugauucagcugagucgcaagacuuuugacuccgaguacgugaaaacacgugccaacgauugggacuucgucguaaccacggauaucagcgagaugggcgcaaauuuuaaggccgaaagagugauugacccacggagguguaugaaacccguuaucuugacugauggggaggaacgcgugauacuagcuggaccuaugccggucacacacucuucagccgcgcagcgaagaggucggaucggcaggaacccaaagaaugagaacgaccaauauauuuacaugggggaaccccuggagaaugacgaggauugcgcacauuggaaagaagccaagaugcucuuagacaacaucaauaccccugagggaauuauccccuccauguucgaaccagagcgcgaaaaaguggaugcuauagacggcgaguacagacugaggggugaggcccggaagaccuuuguugaucuuaugcgucgcggggaccugccuguguggcucgcuuauaaggucgcagccgaaggcauuaacuacgcugaucgaaaaugguguuucgacggaaucaagaauaaccagauuuuggaggaaaacguggagguagagaucuggacuaaagaaggcgagagaaagaaacugaagcccagguggcucgaugcccggauauauagugacccacuggcacuuaaggaauuuaaagaguucgcggccgggcgcaagagccuaacacugaauuugaucaccgaaaugggaagauuaccuacauucaugacucagaaagcuaggaacgcccuggauaaucucgcagugcugcacacggcugaggccgguggccgggcauacaaccacgcccuuucggagcugccggaaacccucgagacauugcugcuacugacucuccuugcuaccguuacagggggaauuuuucuguucuuaaugucuggcaaggguaucgggaaaaugaccuugggcaugugcugcauuaucacugcguccguccugcucugguaugcccagauacaaccccauuggauugcagcuagcaucauccuggaauuuuuccuuauugugcugcucaucccagagccugaaaagcagcgaacgccccaggacaaucaguugaccuacguggucauagccauucugacaguuguggccgcaacuauggcuaacgagaugggauuuuuagagaagaccaaaaaggaucuaggccuggggucaaucacaacccaagaaagugagucuaauauucucgacaucgaccuuagaccagccuccgcguggacucuguaugcuguagccacaacguucgugaccccuauguugcgccacagcauagaaaacucaagugucaaugugagccugacugcaaucgccaaccaggcuacaguucucaugggacuggguaaaggcuggccccuuuccaagauggauauuggggugccgcuccuggcaaucggauguuacucucaggucaauccaauuaccuugaccgccgcgcuguuacuacugguagcucauuacgccaucauuggcccuggucuccaggcaaaagccacaagggaggcucaaaagcgggccgcagcugggaucaugaagaaccccacuguggacggcauaacgguuauugaucuugaaccaauccccuaugacccuaaauuugagaagcagcugggacaggugauguugcugauccucugcgucacccaggugcugaugaugcguacaacuugggcccuuugugaggcguuaacccuggccacaggcccgauuagcacccucugggaagggaaucccggaagauucuggaacacuacgauagcagucuccauggcuaauaucuuuaggggcucauacuuggccggugcagggcugcuauucucuauuaugaaaaacacaaccaauacucgccggggaaccggcaacaucggugagacacugggcgaaaaguggaaaagucgacucaacgcucuugggaagucggaguuucaaauuuauaaaaagagcggaauccaggagguggauagaacucuggccaaggaaggcauaaaaagaggggagaccgaccaccaugccguuucccgcggaucugcgaaguugcggugguucguggaaagaaauaugguaacaccagagggcaaaguggucgaucuggguugcgggcguggaggcuggucauacuauugugguggccucaagaacguuagggaagugaaagggcugacgaagggaggcccugggcacgaggagcccaucccuaugagcaccuacggauggaauuuaguccggcuucaguccggcguggacguauuuuucacuccacccgaaaagugcgauacacugcucugugacauuggugagaguucuccuaacccaaccaucgaagcugggcgcacucuacgagugcugaauuugguugagaacuggcugaauaacaauacacaauucugcauuaaagugcucaaccccuauaugccgagcgucaucgaaaagauggagacccuucagagaaaauacggaggcgcacuggugaggaauccuuugucacggaacuccacgcacgagauguacugggucaguaaugccaccggcaacauagugagcucuguuaauaugauuucccgcaugcugaucaacagauuuacaaugaagcauaaaaaggcuacuuaugaaccagauguagaccucgggucaggaaccaggaacaucgguauugagagcgaaauacccaauuuagauaucauuggcaagcgaaucgagaaaauuaagcaggaacacgagacaucguggcauuacgaccaggaccacccuuauaaaacuugggccuaccacgggucuuaugagaccaagcaaacaggaagugcauccagcauggugaacggcgucgugcggcugcuuaccaaaccaugggauguugugcccauggucacucagauggccaugacggacacaaccccguucggucagcagcguguguuuaaggaaaagguagauacuagaacccaagagccuaaagaagggacaaagaaacugaugaagaucacggcugaguggcuauggaaagagcucggaaagaaaaagacaccccgcauguguacuagggaagaguucacacggaaggugagaucaaaugcggcccugggcgcaauauuuaccgacgaaaacaaauggaaguccgcucgcgaggccguugaagauggcagguucugggaguuggucgaccgagagcggaaucugcaucucgaagggaaaugcgagacuuguguguacaacaugaugggaaagagagagaagaaacuuggugaguuuggcaaggcaaaagggucuagggccaucugguauauguggcugggagcucgcuucuuagaauuugaggcccugggcuucuugaaugaggaucacugguuuagccgugguaacagucucuccgggguggaaggagagggccugcaucggcuaggcuacauucuuagagacgucagcaagaaagaagggggagcgauguacgcagaugacacagccgguugggauaccaggaucacacuggaggaccucaagaaugaagagaugguuacuaaccacaugaaaggcgagcauaagaagcuggcugaagccauuuucaaauugaccuaucagaauaaggugguacgcgugcagcgaccaacgccucgggggaccgucauggacaucauuucuagaagggaucagcgcggaucaggccaaguggguacauacgggcugaacacuuuuaccaauauggaggcacagcucauaagacagauggaaggagagggcaucuucaaaaguauucaacaccuuacagcuaucgaggaaaucgccguucagaacuggcuggcuaaggugggccgggagagguuaucccguauggccauuagcggggacgauugcgucgugaaacccauagacgaucgauucgcaucugcgcugacugccuugaaugacaugggaaagguacgcaaggauauccagcagugggaaccaucgagagguuggaacgacuggacccaaguucccuuuugcucacaccauuuccacgagcucgugaugaaagauggccggguccugguggugccuuguaggaaccaggacgaacuaauugggcgcgcuagaaucagccagggagccggcuggucccuuaaggagacggcaugccuggguaaaaguuaugcucagauguggacacucauguacuuucaucggagggaucugcgauuggccgcaaaugccauuuguucugcggucccaagccacuggguuccgaccucccguacuacauggucaauccacgcuaagcaugaguggaugaccacugaagacauguuagccguguggaacagaguauggauacaagagaaucccuggauggaagauaaaaccccuguggagaguugggaagaggucccauaucuggggaagcgcgaggaccaguggugcggaucucucaucggccuuacaagccgggcaacgugggccaagaacauucagaccgcuaucaaucaggugaggucccugauuggcaacgaagaguacacugacuauaugcccucaaugaaaagauuccgccgggaagaggaagaggccgggguucuaugguga

SEQ ID NO: 14395 - RNA, 9876 nt, Artificial Sequence
  derived and/or modified CDS sequence (opt3) from DENV-2__KJ189305__SS-prME
accgccggcgugaucgucaugcugauucccacagcuauggcauuccaccucacuacgcggaauggggagccucauaugauaguuggaaggcaggaaaaggguaaaagccuucuguuuaagaccgaggacggcgugaauaugugcacauugauggccaucgauuuaggggaacugugugaggacacuauuaccuacaaaugcccacuacuccggcaaaacgaaccggaggauaucgacuguuggugcaauuccacaucuaccuggguaacuuauggaacauguaccacgacuggcgagcaccgccgagaaaagcguucaguggcgcuggucccccauguggguauggggcuugagaccagaacagaaacuuggaugaguagcgagggagcuuggaaacacguucagaggauugagaccuggauccugcggcauccuggcuucacaauaauggccgcaaucuuggccuacaccauuggcacgacucacuuucagcgcgcucucaucuucauucugcugacagcaguggccccauccaugaccaugagaugcaucgggauaucuaacagggauuuugucgaaggagugucggguggcucauggguagacauuguucucgagcacgggagcugugugacuacaauggcuaagaauaagcccaccuuagauuucgaacugaucaaaacggaggccaagcagccugcgacccuucggaaauauugcauugaagcaaaguugacaaacacuaccacagagagucgcuguccaacucaaggagagcccucccugaaugaagaacaggacaaacgauuuaucugcaagcauucuauggucgauagaggcugggguaacggguguggacuauucggcaagggcgggaucgugaccugcgccauguuuacaugcaaaaagaauauggaaggaaaagugguccagccugagaaccucgaauacaccauuguuauaacuccacacagcggugaggagcaugcugugggcaaugacacggggaagcacggaaaagaaaucaagauuacaccgcaguccucaaucaccgaggccgaacugacuggcuaugguaccguaacaauggaguguagucccaggaccgggcuugauuucaacgaaauggugcuguugcaaauggaggacaaagcauggcucguccaccggcagugguuucuggauuuaccucugccauggcuccccggcgcugacacucagggaagcaauuggauacagaaggagacacuugugacguucaagaacccucaugccaaaaagcaagacguugugguccugggcucucaggaaggggcgaugcacaccgccuugacuggagcaacagagauucagauguccucagguaaucuacuguuuaccggccaucucaaaugccgucugcgcauggauaaacuucaacugaaagggaugagcuacaguauguguacaggaaaguucaagaucgugaaagaaaucgcugagacucagcacggcaccauuguaaucagaguucaguaugagggugacgggucuccaugcaagauucccuucgaaauaacggauuuggagaaaaggcaugugcucggccggcugaucaccgucaacccgauugugacagaaaaggacuccccugucaacaucgaggccgaacccccauuuggagauagcuacaucauuauaggcguggagccugggcaguuaaaacugaauugguucaagaagggaucgucuaucggucaaauguuugagacuaccaugcgaggcgcuaaacgcauggccauucuaggggacacagcaugggauuucggaucccucggcgguguuuuuacuucaaucgggaaggcccugcaccagguguucggcgcuauuuacggagcggcauuuaguggcguaagcuggaccaugaaaauccuuauaggggucaucauuacguggaucggaaugaacuccagaucuacuagcuugucagugagucugguucucgugggcgucgugacccuguaucuuggugccaugguacaggcugacuccgggugugugguuagcuggaagaauaaagaacugaagugcggaucuggcauuuucaucacugauaacguccacacauggaccgagcaguacaaguuucaacccgaaucaccaaguaaauuggccagcgcaauacagaaggcccaugaggaagguauuuguggcaucagguccgugacucggcucgagaaucugauguggaaacagauuacccccgaguuaaaccacauccugucugaaaaugaggugaagcuaacaauaaugacgggggacaucaaaggaauuaugcaggcuggcaagcgcucgcucagaccucaaccaaccgaacugaaauauagcuggaagacuugggggaaggccaaaaugcuuuccacagagucacauaaccagaccuucuugaucgauggaccggaaacagcagagugccccaauacuaacagggcguggaauagucuggaggucgaagacuacggcuuugguguuuucaccacgaacauuuggcucaagcugaaagagaagcaggacguguuuugugauucuaaauuaaugagcgcugccaucaaggacaaucgugcagugcacgccgauaugggguauuggauagaauccgcucugaacgacacauggaagauggagaaagccucauucauugagguaaagagcugccacuggccuaaaucucauacccuuugguccaauggagucuuggaaagugagaugaucaucccaaagaacuucgcaggccccgcuagccagcacaacuaccggccugguuauuacacucaaaccgccggcccauggcaucucgggaaacuggaaauggauuuugacuucugugagggaacaacugugguugugaccgaagauugcggcaaucgagggcccucucuaagaacaacgaccgcguccggaaagcugauuacugaguggugcuguaggucaugcacacucccgccucugcgcuaccggggcgaggacgguuguugguaugggauggaaaucagaccacuuaaggagaaagaagagaacuuggucaauagucuggugaccgccggacacggccagauugauaacuuuagcuuagguguucucggcauggcucuguuccuugaagagaugcugaggacucgcguggggacaaagcaugcaauauugcucguagccgucucguuugugacccugaucacgggaaauauguccuuccgagaccuaggccgggugauggucaugguuggggcuacuaugaccgaugacauuggaaugggcgugacauaccuggcccuccuggcagcguuuaaaguacgucccaccuucgccgcuggucuuuugcugagaaaguuaacuucuaaagagcucaugauggccacaaucgggauugcacugcuuagccagucaaccaucccugaaacaauacuggagcuaacugaugcucucgcccugggaaugaugguguugaagaucgucaggaacauggaaaaguaucaacuggcagugaccauuauggccaucaguugcguucccaaugcugugauuuuacagaacgcguggaaagucuccuguacgauccucgccgcagugucuguuagcccacugcuucugacauccucacagcagaaggcugacuggauaccuuuggcccucaccauuaaaggccugaaucccacugccaucuuucuaaccacacugagccgcacaaguaagaaacggucuuggccacuuaacgaggcuaucauggcagugggcauggucuccauucucgccagcucgcuguugaagaaugacauaccgaugaccgggccucugguagcgggagguuuacucacggugugcuacguucugacaggcagaucagcugaucuugaacuggagagggccgcagacgugaaaugggaggaucaagccgaaaucucugggaguucccccauuuugagcaucaccauuucugaggacggaagcauguccaucaagaacgaagaggaggaacagacucucacaauacugauccgaaccggccuacuggucauuucagguguguucccaguaaguauccccauuacugcugcagccugguaucuuugggaggugaagaaacagcgcgcggggguccucugggauguuccuagcccacccccugugggaaaggcugaacuggaggacggcgccuaccggaucaaacagagaggcauauugggguauucucaaauuggagcaggaguguacaaggaaggcacauuucacaccauguggcacgucacgagaggggcaguguuaaugcaucguggaaaacgcaucgagccguccugggcugauguuaagaaggaccugaucucauacggcgguggguggaaacucgagggagaauggaaggagggcgaagagguacaggugcuggcccuugaaccaggcaaaaauccccgggcaguccagacuaagccugggauuuucaaaaccaacacaggaaccaucggugcugugagucuggauuuuagcccaggcacauccgggucucccauaguugacaagaagggaaaaguggucggcuuguaugguaauggggugguaacuagaucgggagccuacgucagcgcgauugcccagaccgagaagucaaucgaggauaacccugaaauugaggacgauaucuucaggaaaaagcgacuaacgauaauggaccugcacccgggcgcaggcaaaacaaagcgguaucuccccgcuauugugcgcgaagccaucaagagagggcugaggacucuuaucuuagcuccaacccggguuguggcagccgagauggaagaggcccugcgaggacucccuauuagauaccaaacacccgcuaucaaagcggagcauaccggucgcgaaauugucgacuugaugugucacgcaacuuucaccaugaggcugcucuccccagugcguguuccuaacuauaaucugauaaucauggaugaggcccauuuuacagaccccgcuaguauugccgcacggggcuacaucucuacgagaguggaaaugggggaggccgcuggaaucuucaugacugcgaccccaccgggcagcagggauccuuuuccccaguccaacgccccaauuauggacgaggaacgcgagauacccgaacgaucauggaacucuggucacgagugggucacagauuucaaggggaaaaccgugugguuuguaccuagcaucaaggcaggaaacgacauugcugccugccuuaggaagaauggcaagaaggugauccagcugagucggaaaacuuucgauuccgaauauguuaagacaagggcaaacgacugggauuuugucgugaccacggacauuagcgagaugggcgccaauuucaaagcugagcgcgugaucgauccacguagauguaugaagcccgucauauugacugacggggaagaacggguaauccuagccggaccuaugccggugacacacucuucagcggcacaaaggcgcggucgaauuggcagaaaccccaagaaugaaaacgaccaguacaucuacaugggggagccccuggaaaaugaugaggacugcgcccauuggaaggaggcuaaaaugcucuuagauaacauuaauaccccugaaggaaucauacccuccauguuugagccagaacgggagaagguugacgccauugauggcgaauauaggcugcgcggugaggcuagaaagaccuucguggaccuuaugaggagaggggaucugccugucuggcucgcauacaaaguggccgcugagggcaucaacuaugccgaccguaagugguguuuugauggaauuaaaaauaaccagaucuuggaagagaacguugaaguggagauauggacuaaggagggcgaacgcaaaaagcugaagccccgauggcucgacgcaagaaucuacagugauccacuggcgcuuaaagaguucaaggaguucgccgcugggaggaaaagccuaacacugaauuugauuaccgagaugggacgguuaccuacauuuaugacucagaaggcccgcaacgcacuggacaaucucgcuguccugcacacggccgaagccggugguagagcauauaaccaugcucuuucggagcugccggagacccucgaaacauugcugcuacugacucuccuugcgaccgugacagggggaaucuuccuguuuuuaaugucuggcaaagguauugggaagaugaccuugggcaugugcugcaucauaacugccuccauucugcucugguacgcacaaauccagccccacuggaucgcugccagcauuauccuggaguucuuucuuauaguacugcucauuccagaaccugagaagcagaggacgccccaggauaaucaauugaccuaugugguuaucgccauucugacagucguggcagcuacuauggccaacgaaaugggauucuuagagaaaaccaagaaagaccuaggccuggggucaaucacaacccaggagagugaaucuaauauacucgacaucgaucuucggccagcguccgcuuggacucuguacgccguggcaacaacguuugucaccccuauguugcgacacagcauugagaacucaaguguuaaugugagccugacugccaucgcuaaccaggcaacaguacucaugggacuggguaagggcuggccccuuuccaaaauggacauuggggugccgcuccuggccaucggauguuacucucaggucaauccaauuaccuugaccgcggcucuguuacuacugguggcccauuaugcaaucauaggcccuggucuccaagccaaggcuacaagagaagcccagaagcgcgcagcugccgggauuaugaaaaaccccacuguugauggcaucacggugaucgaccuugagccaauucccuacgauccuaaguucgaaaaacagcugggacaggucauguugcugauacucugcguaacccaagugcugaugaugaggacaacuugggcgcuuugugaggccuuaacccuggcaacaggcccgaucagcacccucugggaggggaaucccggacgguuuuggaacacuacgauugcuguuuccauggccaauaucuuccguggcucauauuuggccggugcugggcugcuauuuucuauuaugaagaacacaaccaauacuagaaggggaaccggcaacaucggugaaacacugggcgagaaauggaagagucgccucaacacucuugggaaaucggaguuccagauauacaaaaagagcggaauccaggagguggaccggacccuggccaaagagggcauuaagcgaggggaaacagaucaccaugccgucuccagaggaucugcgaaauugaggugguuuguggagcgcaauauggucacgccagaaggcaaggugguugaccuggguugcgggcggggaggcuggucauauuacugugguggccucaaaaacgugagagagguaaaggggcugaccaagggaggcccugggcacgaagaaccaaucccuaugagcacuuauggauggaauuuagugcgucuucaauccggcgucgauguuuucuucacaccacccgagaaaugcgacacccugcucugugauauuggugaaaguucuccuaacccaacuaucgaggcugggaggacacuacgggugcugaauuuggucgaaaacuggcugaauaacaauacccaguuuugcauaaaggugcucaaccccuacaugccgagcguaauugagaaaauggaaacgcuucagcgcaaguacggaggcgcacuggugcgaaauccuuugucaagaaacuccacccaugagauguauuggguuaguaaugccacaggcaacaucgugagcucugucaauaugaucuccaggaugcugauuaaccgguucacuaugaaacacaagaaggcuaccuacgagccagacguggaucucgggucaggaacacgcaacauagguaucgaaagcgagauucccaauuuagacaucauuggcaaaagaaucgaaaagauaaaacaggagcacgaaacuucguggcauuaugaccaagaucacccuuacaagaccugggccuaucaugggucuuacgagacaaaacagaccggaagugcauccagcauggucaacggcgugguuaggcugcuuacuaagccaugggacguagugcccauggucacgcagauggccaugacagauaccacuccguuuggucagcaacgaguguucaaggagaaaguugacacccggacacaggaaccuaaggaggggacgaaaaagcugaugaaaaucaccgcugaauggcuauggaaggagcucggcaagaagaagacuccccguauguguacaagagaggaauuuacccgcaaagugaggucaaaugcggcccugggcgcaauuuucacugaugagaacaaguggaaauccgcucgggaagccgucgaggacggcagauuuugggaauugguggaucgcgagaggaaucugcaccucgaggggaagugcgaaacauguguauauaacaugaugggaaaacgagagaagaaacuuggugaguucggcaaagcaaaggggucucgggccaucugguacauguggcugggagcuagauuuuuagaguucgaagcccugggcuuuuugaaugaggaccacugguucagcagggguaacagucucuccgggguggagggagaaggccugcaucgccuaggcuacauucuucgugauguugggaaaaaggagggaggugcgauguaugcagacgauaccgccggcugggacacacggaucacucuggaagaccucaaaaaugaggaaauggucaccaaccacaugaagggggagcauaagaaacuggcugaggccauuuuuaaguugacguaccagaauaaaguggugagaguccagaggccaaccccucgcggaacaguuauggauauaaucagccgacgggaccaaagaggcucuggucagguggggacuuauggacugaacaccuucacaaauauggaagcacagcucauuaggcaaauggagggcgaaggcaucuucaagucaauccagcaccuuacugcuaccgaggagauugccguacagaacuggcuggcucgcguggggagagaacgguuaaguaggauggccauauccggagaugacugcgucgugaaacccaucgaugaccguuuugcaagcgcgcugacggccuugaaugauauggguaagguucgaaaggacauucagcaaugggagccaucucgcggcuggaacgauuggacacaggugcccuucugcucgcaucacuuucacgaacucgucaugaaagacgggagagugcugguaguuccuugucggaaccaggaugagcuaaucggaagggcucgcauuucacagggcgccgguuggagccuuaaggaaaccgcaugccuggggaaauccuacgcucaaauguggacucucauguauuuccauagacgggaccugagguuggccgcaaaugccaucuguagugcggugccaucucacugggucccgacaagccgaaccacuugguccauacaugcuaagcacgaguggaugaccacagaggauauguuagccguguggaaccguguguggauccaggaaaaucccuggauggaggacaaaacgccugucgaaucaugggaggaaguuccauaccugggaaagagagaggaccaguggugcggcagucucauuggccuuaccucucgcgcaacuugggccaagaacauccagacagcuauuaaucaagugcggagccugaucgggaacgaggaauauaccgauuacaugcccuccaugaaaagguuuagacgcgaggaagaggaagccggaguacuaugguga

SEQ ID NO: 14396 - RNA, 9876 nt, Artificial Sequence
  derived and/or modified CDS sequence (opt3) from DENV-2__FJ898451__SS-prME
accgccggcgugaucguaaugcugauucccacagcuauggcauuccaccucacuacgagaaacggggagccucauaugauaguuggaaggcaggaaaaggguaaaagccuucuguuuaagaccgaggacggcgugaauaugugcacauugauggccaucgauuuaggggaacugugugaggacacuauuaccuacaaaugcccauuacuccggcaaaacgaaccggaggauaucgacuguuggugcaauuccacaucuaccuggguaacuuauggaacauguaccacgacuggcgagcaccgccgagaaaagcguucaguggcgcuggucccccauguggguauggggcuugagaccagaacagaaacuuggaugaguagcgagggagcuuggaaacacguucagaggauugagaccuggauccugcggcauccuggcuucacaauaauggccgcaaucuuggccuacaccauuggcacgacucacuuucagcgcgcucucaucuucauucugcugacagcaguggccccauccaugaccaugagaugcaucgggauaucuaacagggauuuugucgaaggagugucggguggcucauggguagacauuguucucgagcacgggagcugugugacuacaauggcuaagaauaagcccaccuuagauuucgaacugaucaaaacggaggccaagcagccugcgacccuucggaaauauugcauugaagcaaaguugacaaacacuaccacagagagucgcuguccaacucaaggagagcccucccugaaugaagaacaggacaaacgauuuaucugcaagcauucuauggucgauagaggcugggguaacggguguggacuauucggcaagggcgggaucgugaccugcgccauguuuacaugcaaaaagaauauggaaggaaaaauugugcagccugagaaccucgaauacaccauagucaucacuccacacagcggugaggagcaugcuguuggcaaugacacggggaagcacggaaaagaaauuaagaucacaccgcaguccucaaccacugaggccgaacugaccggcuaugguacagugaccauggaguguagucccaggacugggcuugauuucaacgaaaugguacuguugcaaauggaggacaaagcauggcucgugcaccggcagugguuucuggauuuaccucugccauggcuccccggcgcugacacacagggaagcaauuggauacagaaggagacgcuugucaccuucaagaacccucaugccaaaaagcaagacgugguugugcugggcucucaggaaggggcgaugcacacugccuugacaggagcaaccgagauucagauguccucagguaaucuacuguuuacaggccaucucaaaugccgucugcgcauggauaaacuucaacugaaagggaugagcuacaguauguguacuggaaaguucaagaucgucaaagaaaucgcugagacccagcacggcacgauugugaucagaguacaguaugagggugacgggucuccaugcaagauucccuucgaaauaaccgauuuggagaaaaggcauguucucggccggcugaucacagugaacccgauugucacugaaaaggacuccccugugaacaucgaggccgaacccccauuuggagauagcuacaucauugucggcguggagccugggcaguuaaaacugaauugguucaagaagggaucgucuauaggucaaauguuugagaccacaaugcgaggcgcuaaacgcauggccauccuaggggacacugcaugggauuucggaucccucggcgguguuuuuaccucaauugggaaggcccugcaccagguguucggcgcuaucuacggagcggcauuuaguggcguaagcuggacgaugaaaauucuuaucggggucauaaucacauggauuggaaugaacuccagaucuaccagcuugucagugagucugguucucgugggcgucgugacucuguaucuugguguaauggugcaggccgacuccggguguaucguuagcuggaagaauaaagaacugaagugcggaucuggcauuuucaucacagauaacguccacaccuggacugagcaguacaaguuucaacccgaaucaccaaguaaauuggcuagcgccauacagaaggcacaugaggaagguauuuguggcaucagguccgugacccggcucgagaaucugauguggaaacagauuacacccgaguuaaaccacauccugucugaaaaugaggugaagcuaacgauaaugaccggggacaucaaaggaauuaugcaggccggcaagcgcucgcucagaccucaaccaacugaacugaaauauagcuggaagacaugggggaaggcuaaaaugcuuuccaccgagucacauaaccagacauucuugaucgauggaccggaaacugccgagugccccaauaccaacagggcauggaauagucuggaggucgaagacuacggcuuugguguuuucucuacgaacauuuggcucaagcugcgugagaaacaggacguguuuugugauagcaaguuaauguccgcggcuaucaaagacaaucgggccgugcacgcagauaugggguauuggauagaaucaguacugaacgacacauggaagauggagaaggccagcuucauugaggucaaaucuugccacuggccuaagucccauacccuuuggaguaauggaguguuggaaagcgagaugaucauccccaagaacuucgcuggccccguuucucagcacaacuaccgaccugguuaucauacucaaaccgccggcccauggcaccucgggaagcuggaaauggauuuugacuucugugagggaacaacuguggucgugaccgaagauugcggcaauagagggcccucccuaaggacaacgaccgcaucaggaaaacugauuacugaguggugcugucgcaguugcacacucccgccucugcgguacagaggcgaggacgguuguugguacgggauggaaaucaggccacuuaaggagaaggaagagaacuugguuaauagccuggugaccgcuggacauggccagauugauaacuuuucguuagguguacucggcauggcccuguuccuugaagagaugcugcgcacucgagucgggacaaaacacgcgauauugcucguggcccuguccuuugugacccuaaucacgggaaauaugucuuuccgggaccugggccgugucaugguuauggugggggcuacuaugaccgaugacauuggaaugggcguaacauaucucgcacugcuugccgcuuuuaaggugagacccaccuucgccgcagguuugcuguuaaggaaacucacuagcaaggagcugaugauggcgacaaucgggauugcccuucugucacagaguacccuaccugaaacaauccucgagcugacugaugcuuuggcccugggaaugauggucuuaaaaauagugcgcaacauggaaaaguaccaacucgcaguuaccaucauggcuauuuccugcgugcccaaugccgucauccugcagaacgcauggaaggugucuuguacgauucuugccgcuguuagcguguccccacuguugcucacaucaagccagcagaaagcggacuggaucccucuggcccuaaccauaaagggccugaaucccacugcaauuuuucuuaccacacucagucggacuucuaaaaagagauccuggccacugaacgaggcuaucauggccgucggcaugguaagcaucuuggccucgucacugcuaaagaaugacauuccgaugaccgggccucucguggcuggaggucugcuuacgguuugcuaugugcugacaggcaggucugcagauuuggaacucgagcgagccgcggacgucaagugggaggaucaagcugaaauaaguggguccagccccauccugucuauuaccaucagcgaggacggauccaugucaauuaaaaacgaagaggaggaacagacucuaacaauccugauacgcaccggccuucucgugaucagugguguauucccagugagcauucccaucacugccgcagccugguaccugugggaggucaagaagcagcgggcugggguuuugugggaugugccuucuccacccccugugggaaaagcagaauuagaggacggcgccuauagaauuaagcagaggggcauccugggguacucccaaauaggagcgggugucuauaaagaaggcacauuucacaccauguggcaugugacgcguggggcuguucucaugcaccgcggaaagcggauugagccgucaugggccgaugucaaaaaggaccugaucaguuacggcgguggguggaaacuugagggagaauggaaagagggcgaagaggugcagguccuggcauuggaaccaggcaagaaucccagagccgugcagacuaaaccugggaucuucaagaccaacacaggaaccauuggugcuguuagccuagauuuuuccccaggcacaucugggucgcccaucguggacaggaaaggaaaggucgugggccuguacgguaaugggguagucacucgaagcggagccuaugugucagcaauagcucagaccgagaaguccauugaggauaacccugaaaucgaggacgauauuuuccggaaaaagcgccucacgaucauggaccugcauccgggcgccggcaaaacaaagagauaccuucccgcgauaguuagggaagccauuaaacggggguuacgaacucugauccucgcaccaaccagaguggucgcugccgagauggaagaggcuuugcgcggacugccuaucagguaucaaacacccgcaauucgugccgagcacaccggucgggaaaucguggaccucaugugucaugccacuuucaccaugagacugcuuaguccaguuagggugccuaacuacaaucugauuauaauggaugaggcucacuuuacagaccccgcgucuaucgcagcccgcggcuauauuagcacgcgagucgaaaugggggaggcugccggaaucuucaugacugcaaccccaccgggcuccagagauccuuuuccccagucaaacgccccaaucauggacgaggaacgggagauucccgaaaggucuuggaauagcggucacgagugggugacagauuucaaggggaagaccguaugguuugugccuaguauaaaagcuggaaacgacaucgcggccugcuugcgcaagaauggcaaaaagguuauucagcuaucccguaaaacuuucgauagcgaauacgucaagacaagagcaaacgacugggauuuuguggugaccacggacaucucugagaugggcgcuaauuucaaggccgagcgggucauugauccaaggcgcuguaugaaacccguaauccugacugacggggaagaacgagugauacucgcaggaccuaugccgguuacacauucauccgccgcucaaagacgggguaggaucggccgcaacccaaagaaugaaaacgaccaguauauuuacaugggggagcccuuagaaaaugaugaggacugcgcccacuggaaagaggcgaagaugcugcuugauaacaucaauaccccugaaggaauuauccccaguauguuugagccagaaagagagaaaguggacgcaauagauggcgaauacaggcugcggggugaggcccguaagaccuucgucgaccucaugcgccgaggggauuugccuguguggcuggcuuauaaaguugccgcugagggcauuaacuacgcagacagaaagugguguuuugauggaaucaagaauaaccagauucucgaagagaacguggaagucgagaucuggacuaaagagggcgaaaggaagaaacugaagccccgguggcuugacgcccgcauauauagcgauccacuagcucugaaagaguucaaggaguucgccgcagggagaaagucguugacauuaaaucugaucaccgagaugggaaggcucccuacauuuaugacucagaaagcgcggaacgcccuggacaaucuugcugugcugcauacggccgaaguagguggccgagcauacaaccacgcucucucugaguugccggagacccuggaaacacuacugcuccuuacucuguuagccaccgugacagggggaauuuucuuguuucugauguccggcaaggguaucgggaaaaugacccucggcaugugcugcauuaucacugcaagcauacugcuuugguaugcccaaauucagccccacuggaucgcugcgucaaucauucuggaguucuuucucaucguuuugcugauaccagaaccugagaagcagagaacgccccaggauaaucaauuaaccuacgucgugauugccauccuaacaguggucgcagcuacuauggccaacgaaaugggauuccuggagaaaaccaagaaggaccucggcuuugggaguauuacaacccaggagucugaauccaauauccuugacauagaucugcgcccagccagcgcauggacuuuguaugcuguugccacaacguucgugaccccuaugcugaggcauucaaucgagaacaguagcguaaaugugucccucacugcgauugcuaaccaggccacaguccugaugggacuugguaaaggcuggccccucucuaagauggacaucggggugccgcuguuggcaauuggauguuacagccagguuaauccaaucacccugaccgccgcuuuacuacugcucguggcacacuacgccauuaucggcccuggucuucaagcgaaagcuacacgggaagcccagaagcgugcagccgcugggauaaugaaaaaccccacugucgauggcauuacgguaaucgaccuggagccaauccccuaugauccuaaguuugaaaagcaguugggacaggugaugcugcucauucugugcguuacccaagugcuuaugaugagaacaacuugggccuuaugugaggcacugacccucgcuacaggcccgauauccaccuugugggaggggaaucccggaagguucuggaacacuacgaucgccgucucaauggcgaauauuuuucgcggcucuuaccuggccggugcagggcuacuguucaguaucaugaaaaacacaaccaauacucggcgaggaaccggcaacgugggugaaacacucggcgagaaguggaaaucgagacuuaacgcucugggaaagagcgaauuucagauuuauaaaaaguccggaauccaggaggucgacaggacuuuggccaaagagggcauaaagcgcggggaaaccgaucaucacgcagugucucggggaucagcuaagcugagaugguucguugagcguaauauggugacaccagaaggcaaaguaguggaccucgguugcgggaggggaggcuggagcuacuauugugguggccugaagaacguccgggagguuaaaggguuaacgaagggaggcccugggcaugaggaaccaaucccuauguccaccuacggauggaaucuugugcgccugcaaaguggcgucgauguguucuuuacuccacccgagaaaugcgacacacuccuaugugauauuggugaaucuagcccuaacccaaccaucgaggccgggcgaacucugagaguauugaaucugguggaaaacuggcucaauaacaauacacaguucugcauuaagguucuuaaccccuauaugccgucagugaucgagaagauggaaacccugcagaggaaauacggaggcgccuugguccggaauccucugucccgcaacaguacgcacgagauguacugggugagcaaugcgaccggcaacauagucucuuccgugaauaugauuucaagaaugcucaucaacagguuuacaaugaagcacaaaaaggcuacuuaugagccagacguugauuuagggagcggaacccgaaacaucgguauugaaucggagauacccaaucuggacaucauuggcaaacggaucgaaaagauuaagcaggagcaugaaacaucuuggcacuacgaccaagaucauccuuauaaaacuugggcauaccacgggaguuaugagaccaagcagacaggauccgccagcucaaugguaaacggcgugguccgucuucugaccaaaccaugggacgugguucccauggugacucagauggcuaugacggauacaaccccguucggucagcaaagagucuuuaaggagaaaguggacacucgcacccaggaaccuaaggaggggacaaagaaacuaaugaagaucacggccgaauggcucuggaaagagcugggaaagaaaaagacccccaggauguguacucgggaggaguucacaagaaaaguacgcuccaaugcagccuugggcgcuauauuuaccgaugagaacaaguggaagucugcgagggaagccguggaggacggccgauucugggaacugguugaucgggagagaaaucuccaccuugaggggaaaugcgaaacuugugucuacaacaugaugggaaagagggagaaaaagcugggugaauuuggcaaagcaaaggggagccgcgcuaucugguauaugugguuaggagcccguuuccuggaguuugaagcauugggcuuccucaaugaggaccauugguuuagucgggguaacucccugagcgggguggagggagaaggccuacacagacuuggcuacauucugagggagguggggaagaaagaaggaggugccauguacgcugaugacacagccggcugggauacccgcaucacacucgaggaccugaagaaugaagagauggucacuaaccauaugaaaggggagcacaagaaauuggcggaagcaauuuucaagcugaccuaucagaauaagguugugcgaguacagcggccaacgccuagaggaaccgugauggacaucauuucuaggaaagaucaacgcggcucaggucaggucgggacauacggacucaacacuuucaccaauauggaggcccagcuuauaagacaaauggaaggcgagggcaucuuuaagaguauucagcaucugacagcuacugaggaaaucgccgugcagaacugguuagcacggguugggagggagcgucugucccgaauggcuaucagcggagacgauugcguggucaaacccauugacgaucgcuucgccucugcuuugaccgcccucaaugacauggguaaggugagaaaagauauacagcaaugggaaccaucgcggggcuggaacgacuggacgcagguacccuuuugcucacaccacuuccaugagcugguuaugaaggaugggagggugcuagucgugccuugucgcaaccaggacgaacuuaucgggagagcacggauuagccagggcgcggguuggucccugaaggagacagccugccucgggaaaaguuaugcucaaauguggacccugauguacuuucacaggcgagauuugcguuuagccgcaaaugcuaucuguucugccgugccaagccauugggucccgacuuccagaacaaccuggucaauucacgcaaagcacgaguggaugacuaccgaagacaugcuggccguuuggaaccgcguguggauccaggagaaucccuggauggaagauaaaacaccuguagagaguugggaagaggugccauaucucggaaagcgggaggaccaguggugcggcucucuuauaggccugacgagcagggcgaccugggcuaaaaacauccagacugccauuaaucaagucagaucccuaaucgggaacgaagaguacacagacuauaugcccucaaugaagcgcuuccggagggaagaggaagaggcaggagugcugugguga

SEQ ID NO: 14397 - RNA, 9876 nt, Artificial Sequence
  derived and/or modified CDS sequence (opt3) from DENV-2__HM488257__SS-prME
accgccggaaucauuauaaugaugauccccacagugauggcuuuccaccugacuacgagaaacggggaaccucauaugauuguaagcaggcaggaaaagggaaaaucccuccuuuuuaagaccgagaaugguguuaacaugugcacacugauggcaauggacuugggcgaauuaugugaggauacuaucaccuacaauugcccacugcuacggcaaaacgaaccggaggacauugauuguuggugcaauucuacaucaaccugggugacuuaugggacauguaccguaacgggagagcaccgccgagaaaaacguaguguggcccucgucccccaugugggcaugggucuggagacucggaccgaaacauggaugagcuccgagggggcguggaagcacgcucagaggaucgagacuuggguucuucggcauccuggauucaccauaauggccgcaauccuggccuacacaauuggcaccacguauuuucagcgcguguugaucuucauucuccugacugcugucgcaccaucuaugacaaugagaugcaucggcauaucgaacagggacuuuguggaagggguaucaggagguagcuggguugauauugugcuggagcacggcaguugugucaccacuauggccaaaaauaagcccacacucgacuucgaauuaaucaagaccgaggcuaaacacccugccacgcugcggaaguacugcauugaagcgaaacuuaccaacacaacuaccgcaucccgcuguccaacacagggggagcccucuuugaaugaggaacaagauaagcgauuugugugcaaacauagcaugguggacagaggauggggcaacgguugugggcuguucggaaagggcggcaucgucacuugcgccauguuuaccugcaagaaaaauauggaggggaagaucguucagccugaaaaccuagaguauacaauugugauaaccccacacuccggagaagagaaugcuguagguaacgauacuggcaaacaugggaaggagaucaaagugacgccgcagucaaguauuacagaagccgagcucaccggauacggcacugucaccauggaauguagccccaggacaggucuggacuucaaugagauggugcuucugcagauggaaaacaaggcaugguugguucaccggcaaugguuucucgaucugccuuuaccauggcugcccggggcugacacccagggcucuaacuggauccagaaagagacucucgugacauucaagaauccucacgccaagaaacaggaugucgugguacuuggaucccaagagggcgcgaugcauacggcccugaccggggcaacugaaauacagaugucaagcggaaacuugcuauuuacaggucaccugaagugccgucuccgcauggacaaacugcagcuuaagggcaugaguuauucuauguguaccgggaaauucaagguugugaaggagauugcugaaacacaacauggaacuaucgucaucagagugcaguacgagggcgacgguuccccaugcaaaauucccuucgagaucauggaucuggaaaagaggcacgucuuggggcggcucauuaccgugaauccgauaguuacggagaaagacagcccugugaacaucgaagccgagcccccauuuggcgauucguacauuaucguaggagucgaaccuggccagcugaaguuaucuugguucaaaaagggguccucaaucggacagauguuugagaccacaaugcgaggugcuaagcgcauggccauucugggcgacacugcaugggauuucgggagucuaggaggcguguuuaccagcauagguaaagcccuccaucaaguuuucggggcuaucuauggcgcggcauuuuccggagugucuuggacaaugaagauucugaucggcgucgugauuacuuggaucgggaugaauagcagaucaaccagucuuuccgucagcuuggugcugguuggagucgugacgcucuaccugggcgugaugguccaggccgacucugguuguguugugucauggaaaaacaaggagcuuaaaugcgggaguggaauauucaucacagauaaugugcacaccuggacugaacaguauaaguuucagcccgagagcccauccaagcuggcuucugccauucaaaaagcacacgaagagggcaucugugguauuaggucgguaacacgguuggaaaaccucauguggaagcagaucacccccgagcugaaucauauauuaagcgagaacgaagucaaacugacuauuaugaccggcgacaucaaggggauuaugcaggccggaaaacgcucccuaagaccucagccaacagagcucaaguacucauggaaggcuuggggcaaggccaagaugcugaguacggaacuucacaaucauaccuucuugaucgaugggccggagacugcagaaugccccaacacaaauagggcguggaacucucuggagguggaggacuauggauuuggcguuuucaccacaaauauauggcucaaacugaaggaacgucaagauguguuuugugacagcaaauuaauguccgcugccaucaaggacaaccgggcaguccacgccgauauggguuacuggauugagucagcucugaacgacacuuggaaaaucgaaaaggccagcuucauugaggugaagucuugccacuggccuaaaucccauacccuuuggaguaaugggguuuuggagagcgaaaugaucauaccaaagaacuucgcaggacccgugucucagcacaauuaucgaccuggcuaccauacgcagacagcugguccauggcaccucggcagacuggagauggauuuugacuucugugaagggaccacuguagucgugaccgaggauugcggaaacaggggccccucccuacgcacaacuaccgccucagggaaacugauuacagaauggugcugucggaguugcacgcucccgccucugagauacaggggagaggacggcuguugguaugguauggagauccgcccacuuaaggaaaaagaggaaaauuuggugaacagccuggucaccgcggggcauggacagaucgauaauuuuucguuaggcguucucgguauggcccuguuccuugaggaaaugcugcgaacucgggugggcacaaagcacgcuauuuugcucguagcaguguccuuugucacccugaucacugggaacaugucuuuccgugaccuaggaagagugaugguuauggugggcgccacaaugaccgaugacauugggaugggagucacguaccuggcucuccuggccgcauuuaaggugaggcccacuuaugcggccggccuuuugcugcgcaaauuaaccagcaaggagcucaugaugacaaccauagguaucguucugcuuucacaaaguacuauuccugagacaauccuggaacuaaccgaugcucucgcccuggggaugaugguguugaaaauuguccggaauauggagaaguaccagcuggcaguaacaaucauggcuauauuaugcgugcccaacgccguuauccuccagaaugcauggaaaguguccuguacuacccuggccauggucucugugagcccacuucuguugacguccucacaacagaaggcugacuggauuccucucgcgcugacaaucaagggacuaaaccccaccgccauuuuccugacuacccuuagcagaacaaguaaaaagaggucuuggccacucaaugaagcaaucauggcuguaggcaugguguccauacuggccagcucguugcugaaaaacgauauuccgaugacuggcccuuuagucgccgggggacuccugaccguuugcuaugugcuuacgggucgaucagcugaccuggaguuggaacgcgcagccgacgugcggugggaggagcaggcggaaaucucuggcaguucccccauccucagcauuacaauaucugaggaugggagcauguccaucaagaaugaagaggaggaacagacccugacuauucuaaucagaacaggacugcuugucauuucaggccucuuuccagugaguauccccauaaccgcugccgcaugguaccugugggagguuaaaaagcaaagggccgguguauugugggacgugccuagcccacccccugucgggaaagcugaauuagaggauggagcauaucguaucaagcagaagggcauucugggcuacucucagaucggggccggaguguacaaagaagguacuuuccacacaauguggcauguuacccgcggcgcggugcucaugcacaaggggaaacggauugagccguccugggcugacgucaagaaagaucugaucucauauggaggcgguuggaaacuugagggggaauggaaggagggagaagaggugcagguacuggccuuggaaccaggcaaaaaccccagagcaguccaaacgaagccuggccuauuuaaaacuaacaccgggacaauaggagccgugagucuggacuucagcccagguaccuccggcucucccauuguugauaagaaagggaagguggucggacucuacggcaauggugugguuacaaggucggggacuuaugugagcgcuaucgcccagaccgagaagucaaucgaggacaacccugaaauugaggaugacaucuuuaggaagaaacggcugacgauaauggaucuucauccgggagcaggcaaaacaaaacgcuacuuacccgcuauugucagagaagccaucaaaaggggccugcggacucucauuuuggcgccaacccgagugguagccgcagagauggaagaggcucugagagggcucccuauccgcuaucagacacccgccauaagggcugagcacaccggacgugaaauuguggaccugaugugucaugcaacuuucaccaugcggcuucuguccccaaucagaguuccuaauuacaacuugaucauuauggaugaggcccacuucacagaccccgccaguaucgcugcgagggguuauauuucuacgcgcgucgaaaugggcgaggcagccgggauauuuaugacugcuaccccaccgggaagccgagacccuuucccccaguccaaugccccaaucauggaugaggaaagagagauucccgaacggucauggaacucuggccacgagugggugacagacuuuaaggguaagaccgugugguucgucccuagcaucaaagcagggaaugauaucgccgcuugccuaaggaagaacggcaaaaagguaauucaacugagucgcaaaacuuuugacuccgaauacauaaagacacguaccaaugauugggacuucgugguuacgacugauaucagcgagaugggcgcgaacuuuaaggccgagagagugauugacccacggagguguaugaaacccgucauccucacagauggcgaagaacgcgugauuuuagcagggccuaugccgguuacccauucuucagcugcccagcgaagaggacggguggguaggaauccaaagaacgaaaaugaccaguacaucuauaugggcgagccccuggaaaacgaugaggacugcgcacacuggaaagaggccaagaugcuucuggacaauauaaacaccccugaagggaucauucccuccauguucgagccagaacgcgagaaagucgaugcuaucgacggagaauacagacucaggggcgaggcccggaagacuuuuguggauuugaugcgucgcggugaccugccuguauggcucgcguaucgaguggcagccgaggggauuaacuacgcugauagaaggugguguuucgacggcguuaaaaauaaccaaauccuggaagagaaugucgaaguggagauauggacaaaggagggagaacggaagaaacuuaagccccgcuggcuagaugccagaauuuauagugacccacuggcuuugaaagaguuuaaggaguucgcagccggcagaaagagcuuaacccugaaccucaucacagagauggggcggcugccuacuuucaugacgcagaaggcucgaaaugcccuugauaaccuggcagugcuccauaccgcggaagccggagguagagcuuacaaucacgccuugucggagcugccggagacacuagaaacucugcuccuucugaccuuauuggcaacagucaccggcgggauuuuucuguuccucaugucuggaaagggcaucgguaaaaugacucuggggaugugcugcauaaucacggcuuccauucuucugugguaugcccagauccagccccacuggauugcagccagcaucauacucgaguuuuucuugauuguucuguuaaucccagaaccugagaagcaacgcacaccccaggacaaccagcuaacauacgugguaaucgcuauucugacuguggucgcggccaccauggcaaaugaaaugggcuuucucgagaaaacaaagaaagauuucggacuuggcucaaucaccacucagcaaccagagaguaacauacuggacauugauuugaggccugcuucugccuggacacuguacgccguggcaacgaccuuuaucacucccaugcuccggcauuccauugaaaauagcucaguuaacgugagucugacagcuaucgccaaucaggcgaccguccuuauggggcucggaaaggguuggccgcugagcaagauggacauaggcguaccauugcuggcuaucggguguuauucccaggugaacccuauuaccuuaacagccgcacuacugcuccuuguugcccacuacgcuaucauuggacccggccugcaggcaaaagccacucgugaggcgcaaaagagagcugccgcagguaucaugaaaaauccaacgguggacgggauuaccgucaucgauuuggaccccauaccuuaugauccgaaguucgaaaaacagcugggccaggugaugcuccugguccuuugcgugacacagguuuuaaugaugaggacuaccugggcccugugugaggcucucacauuggccaccggacccauuucuacucugugggaaggcaacccagggcgcuuuuggaauacgacaaucgcagugagcauggcuaacaucuuccggggauccuaccuagccggcgcgggucugcucuuuucaauuaugaagaacaccgccaauacucgaagagggaccggaaacacaggcgagacucuuggugagaaguggaaacauaggcugaaugcauugggcaagucugaguuccaaauauauaaaaagagugggauccaggagguagaccgcacccuggcuaaagaaggaauuaagcggggcgagacagaucaccaugccgugucgagagggagcgcaaaacuccguugguuugucgagaggaaccugguuacgccugaaggaaagguggucgacuuaggcugcgguagagggggaugguccuacuauuguggcggucuuaagaaugugaaagagguaaagggccugaccaaagggggacccggccacgaagaaccuaucccaaugucuacuuacggguggaaccucgugcgccuacagucaggaguugauguguucuucacacccccugaaaagugcgacacccuguugugugauauuggcgagagcuccccaaaucccacugucgaggcuggucgaacacugagagugcucaaccuugucgaaaauuggcugaacaauaacacccaauuuugcaucaaaguguugaauccguacaugccuaguguuauagagaagauggaagcccugcagaggaaguaugggggagcccucguacggaacccauuaucucgcaauagcacgcacgagauguacugggugucaaacgcguccggcaacaucgucaguagcgugaauaugauuucuagaaugcugaucaacagguucaccaugcgacauaaaaaggcuacauaugaacccgacguugaucuuggcuccgggacucggaauauuggaaucgagucagagaccccuaaccuggacauaauugguaaacguaucgaaaagaucaaacaggagcacgaaacaagcuggcauuacgaucaggaccacccauauaagacuugggcauaccacggcucguaugagaccaagcaaacagggucugccaguuccauggugaauggagucgugagacuacucaccaaacccugggacguaauuccgauggugacucagauggcuaugacggauacaaccccuuuuggccagcagcgcguuuucaaggaaaaagucgacacuaggacccaagagcccaaggaggguaccaaaaagcugaugaagauaacggccgaaugguuguggaaagagcuggggaagaaaaagaccccacggauguguacuagagaagaguuuacacgcaaagugaggagcaacgcagcccucggagcuaucuucaccgaugagaauaaguggaaaucagcgcgagaagccguggaggacuccggcuuuugggaacuugucgauaaggagcggaaccugcauuuagaaggcaagugcgagacuuguguuuacaauaugauggggaaaagagagaagaaacugggagaguucgguaaggcaaaaggcucuagggcuauuugguacaugugguugggggcccgcuuucucgaguucgaagcacugggauuucuaaacgaggaccacugguucagccguaagaauagucuuuccggcguggaaggugaggggcugcauaagcucggauauauccugcgggauguaagcaaaaaggagggcggcgccauguacgcugacgauacagccgggugggacaccagaauuacauuggaagaucugaaaaacgaggaaauggugacuaaucacauggagggagaacauaagaaacucgcggaggcaaucuuuaggcuuaccuaucagaacaaggucgugcgcguucagcgaccuacgccccgggguaccgugauggacauaaucucuagaagggaccagcgcggcucagggcaagucgugacauacggacugaauacuuucaccaacauggaggcccaguuaauuagacagauggaaggcgaggguguauucaagaguauccaacaccugacagcuacugaagagauugccguuaaaaccugguuggugcgggucgggagggagcgucucucccgaauggcaaucagcggagaugacugcguggugaagccacuggaugaccgcuuugcuucugcccuaacggcucuuaacgauaugggcaaagucagaaaggacauucagcagugggaacccucgcggggcuggaaugauuggacacagguuccuuucugcucacaccauuuucacgagcugauaaugaaagacgggagggugcucguagugccaugucgcaaccaagaugaacugaucggacgagcccggauuagccagggugcaggcugguccuugagggagaccgcgugcuuagggaagaguuaugcccagauguggucucugauguacuuccaucgacgugaccucagacuugcugccaaugcaaucuguagcgcugucccgucccacugggugcccacuucacgcacaaccuggaguauccacgccacucaugaauggaugaccacagaggauaugcugacgguuuggaaccggguguggauucaggagaauccuuggauggaagacaagaccccagucgagucuugggaagagauacccuaucuaggaaaaagggaagaucaauggugcggcagccugaucggucucacuuccagagcaacaugggccaagaacauucagaccgcgaucaaucaggugcgcucauugauugggaacgaggaguacacugacuacaugccuagcaugaaacgguuuaggcgagaagaggaagaggcuggaguacugugguga

SEQ ID NO: 14398 - RNA, 9876 nt, Artificial Sequence
  derived and/or modified CDS sequence (opt3) from DENV-2__HQ999999__SS-prME
accgccggcgugaucgucaugcugauucccacagcuauggcauuccaccucacuacgcgaaauggggagccucauaugauaguuggaaggcaggaaaaggguaaaagccuucuguuuaagaccgaggacggcgugaauaugugcacauugauggccaucgauuuaggggaacugugugaggacacuauuaccuacaaaugcccacugcuccggcaaaacgaaccggaggauaucgacuguuggugcaauuccacaucuaccugggugacuuauggaacauguaccacgacuggcgagcaccgccgagaaaagcguucaguggcgcuggucccccauguggguauggggcuugagaccagaacagaaacuuggaugaguagcgagggagcuuggaaacacauucagaggaucgagaccuggauacugcggcauccuggcuucacaaucauggccgcaauuuuggccuacaccaucggcacgacucacuuucagcgcgcucucauuuucauccugcugacagcaguugccccauccaugaccaugagaugcauagggauuucuaacagggauuuuguggaaggagucucggguggcucauggguggacaucguccucgagcacgggagcuguguuacuacaauggcuaagaauaagcccaccuuagauuucgaacugauuaaaacggaggccaagcagccugcgacccuucggaaauauugcaucgaagcaaaguugacaaacacuaccacagagagucgcuguccaacucaaggagagcccucccugaaugaagaacaggacaaacgauuuaucugcaagcauucuaugguggauagaggcugggguaacggguguggacuauucggcaagggcgggauuguaaccugcgccauguuuacaugcaaaaagaauauggaaggaaaaguggugcagccugagaaccucgaauacaccauagucaucacuccacacagcggugaggagcaugcuguuggcaaugacacggggaagcacggaaaagaaauuaagaucacaccgcaguccucaauaaccgaggccgaacugacuggcuaugguaccgugacaauggaguguagucccaggaccgggcuugauuucaacgaaaugguacuguugcaaauggaggacaaagcauggcucgugcaccggcagugguuucuggauuuaccucugccauggcuccccggcgcugacacucagggaagcaauuggauucagaaggagacacuugucacguucaagaacccucaugccaaaaagcaagacgugguugugcugggcucucaggaaggggcgaugcacaccgccuugacuggagcaacagagauccagauguccucagguaaucuacuguuuaccggccaucucaaaugccgucugcgcauggauaaacuucaacugaaagggaugagcuacaguauguguacaggaaaguucaagaucgucaaagaaauugcugagacucagcacggcaccaucgugauuagaguacaguaugagggugacgggucuccaugcaagauacccuucgaaaucacggauuuggagaaaaggcauguucucggccggcugauuaccgugaacccgaucgucacagaaaaggacuccccuaucaacauugaggccgaacccccauuuggagauagcuacauaaucauuggcguggagccugggcaguuaaaacugaauugguucaagaagggaucgucuaucggucaaauguuugagacuaccaugcgaggcgcuaaacgcauggccauucuaggggacacagcaugggauuucggaucccucggcggugucuuuacuucaaucgggaaggcccugcaccagguguucggcgcuauauacggagcggcauuuaguggcguuagcuggaccaugaaaauccuuauuggggugaucauuacguggaucggaaugaacuccagaucuacuagcuugucaguaagucugguccucgugggcguugugacccuguaucuuggugccaugguccaggcugacuccgggugugugguaagcuggaagaauaaagaacugaagugcggaucuggcauauucauuacugauaacgugcacacauggaccgagcaguacaaguuucaacccgaaucaccaaguaaauuggccagcgcaauccagaaggcccaugaggaagguauuuguggcaucagguccguuacucggcucgagaaucugauguggaaacagauaacccccgaguuaaaccacauccugucugaaaaugaggucaagcuaacaauuaugacgggggacaucaaaggaauuaugcaggcuggcaagcgcucgcucagaccucaaccaaccgaacugaaauauagcuggaagacuugggggaaggccaaaaugcuuuccacagagucacauaaccagaccuucuugaucgauggaccggaaacagcagagugccccaauacuaacagggcguggaauagucuggagguggaagacuacggcuuugguguguucaccacgaacauauggcucaagcugaaagagaagcaggacgucuuuugugauucuaaauuaaugagcgcugccauuaaggacaaucgugcaguucacgccgauaugggguauuggaucgaauccgcucugaacgacacauggaagauggagaaagccucauucaucgagguaaagagcugccacuggccuaaaucucauacccuuugguccaauggaguguuggaaagugagaugauuaucccaaagaacuucgcaggccccguaagccagcacaacuaccggccugguuaucauacucaaaccgcuggcccauggcaccucgggaaacuggaaauggauuuugaccuaugugagggaacaacugucgugguuaccgaagauugcggcaaucgagggcccucucugagaacaacgaccgccuccggaaagcucauuacugaguggugcuguaggucaugcacacugccgccucuucgcuaccggggcgaggacgguuguugguacgggauggaaauaagaccauugaaggagaaagaagagaaccuggugaauaguuuagucaccgcgggacauggccagaucgauaacuucagccucggugugcugggcauggcccuuuuucuggaagagauguugaggacucgcauugggacaaagcacgcuauccuccugguugcagugucguucguaacccuaauuacgggaaauauguccuuucgagaccugggccgggucauggugauggugggggccacuaugaccgaugacaucggaaugggcgucacauaucucgcucugcuugccgcauucaaaguucgucccaccuuugcggccgguuugcuguuaagaaagcucacuucuaaagagcugaugauggcuacaauagggaucgcccuucugagccagucaaccauuccugaaacaauccuagagcucacugaugcacuggcuuugggaaugauggugcugaagguagugaggaacauggaaaaguaccaauuagccgucaccauuauggcaaucaguugcgugcccaaugccguuauacuccagaacgcuuggaaaguguccuguacgauucuggcggccgucucugugagcccacuucuguugacauccucacagcagaaggcagacuggaucccucucgcucugaccaucaaaggccuaaaucccacugccauuuuccugaccacacuuagccgcacaaguaccaagcggucuuggccacucaacgaggccauaauggcuguuggcaugguguccauccuggcaagcucguugcugaaaaaugacauuccgaugacggggccuuuagucgccggaggucuccugacaguaugcuaugugcuuaccggcagaucagcggaucuggaauuggagagggcugccgacguuaagugggaggaucaagcagaaaucucugggaguucccccauucucagcaucacuauaucugaggacggaagcauguccaucaaaaacgaagaggaggaacagacacugaccauucuaauccgaacuggccugcuugugauuucaggugucuuuccagugaguauccccauaacagccgcugcaugguaccucugggagguaaagaagcagcgcgccggggugcugugggaugucccuagcccacccccuguugaaaaagcggaguuggaagacggagcuuaucggauuaagcagagaggcaucuuaggcuacucucaaaucggggccggaguguauaaagaggguaccuuccacacgauguggcaugugacuaggggcgcaguccugaugcaccgugggaagcgcauugagccguccugggccgaugugaaaaaggaccucaucucauacggaggcgguuggaagcuggaaggggaguggaaagaaggagaggaaguucagguacuugcucuggagccaggcaagaauccccgggccgugcagaccaaaccuggcauauuuaagacaaacaccgggacaauuggagcagucaguuuggauuucagcccagguacuuccggcucucccaucguggacagaaaagggaagguugugggacuauacggcaauggugucgugaccaggucgggggcuuauguaagcgccauugcgcagacggagaagucaaucgaagauaacccugagauagaagacgauauuuuuagaaagaagcggcugacaaucauggaccuccauccgggagccggcaaaacuaagcgcuaccugcccgcaaucgucagagaggcuauuaaaaggggccuucggaccuuaauccuggccccaacacgagugguugcugcagaaauggaggaggcccucagaggguugccuauucgcuaucaaacccccgccauaaagacugaacacaccggaagggagaucguggaccugaugugucaugcuacauucacgaugcgucuccuguccccaguccgggugccuaacuacaaucuuauuaucauggaugaagcgcacuucacugaccccgcaaguaucgccgcuagagguuauauuucuaccaggguugagaugggcgaggccgcagggauauuuaugacagccaccccaccgggaagccgcgauccuuucccccaguccaacgcuccaaucauggacgaggaacgagaaauucccgagagaucauggaacucuggccacgaaugggugacugauuuuaaggguaaaacagucugguucgugccuagcaucaaggcggggaacgacauugccgcaugccugcggaaaaauggaaagaaaguaauccaguugaguaggaagaccuuugauuccgaguacgugaagacgcgcgcuaacgacugggauuucguugucacuacagacauaagcgagaugggcgccaauuuuaaagcagaacgugugaucgauccaagacgguguaugaagcccgugauucuaaccgacggcgaggaaagggucauccuggccgggccuaugccgguaacccauucuucagcugcccaacgccgaggaagaauuggucggaaccccaagaaugagaacgaccaguauaucuacaugggcgaaccccucgagaaugaugaggacugcgcgcacuggaaggaagcaaaaauguuacuggauaacauaaauacuccugaggggauuauccccuccauguucgaaccagagagggaaaagguggacgccauugauggagaguaccgccuuagaggcgaggcuaggaaaacauuuguugaccugaugcggcguggugaucucccugugugguuggccuauaaggucgcugcagaagggaucaacuacgccgaccgccgaugguguuucgauggcauaaagaauaaccagauccuggaggaaaacauggagguggagauuuggaccaaagaaggagagagaaagaaacucaagcccagguggcuggacgcucggaucuauagugauccacuugcccuaaaagaauuuaaggaguucgcagcgggccgcaagagccugacauugaauuuaauuacugaaauggggagacugccuacguucaugacccagaaagccaggaacgcucucgacaaucuggccguucuucauacagcagaggcuggaggucgggccuacaaccacgcacugucggagcucccggaaacuuuggagacccugcuacugcucacacuucuggccaccgugacuggcgggaucuuuuuauucuugaugucuggaaagggcauagguaaaaugacgcuggggaugugcugcauuaucaccgcuuccauccuccugugguaugcgcaaauucagccccacuggaucgccgcaagcauaauucuugaauuuuuccugaucguccucuugauuccagagccugaaaagcagcgaacaccccaggauaaucaacugacuuacgugguaaucgcuauauuaaccgugguugccgccacaauggcaaacgagaugggcuuucuagagaaaaccaagaaggaccugggacucggcucaaucacuacacaggaaagugagucuaauauucuugacaucgaucugagaccagcuuccgccuggacguuguaugcggucgcuaccacuuuccugacaccuaugcuccgccauagcauugaaaacucaagugugaaugugagccugaccgccaucgcaaaccaggccaccguccuuauggggcucggaaaagguuggccccuguccaagauggacauuggcgcuccguugcuggcaaucggguguuacucucagguuaauccaauaacauuaacugccgcgcuacugcuccuuguggcucacuacgccauuaucggaccuggccugcaagcaaaagccacgagggaggcucagaagcgggccgcagcugguaucaugaaaaaccccaccguagaugggauuacagugauagacuuggauccaauccccuaugacccuaaguuugaaaagcagcugggccaggucaugcuccugauucuuugcgugacucaaguuuuaaugaugcguaccacaugggcccugugugaggcgcucaccuuggccacuggaccgaucagcacgcugugggagggcaaucccgggagauucuggaacacaaccauugcaguguccauggcuaauaucuuuaggggaucauaccuagccggcgcaggucuacucuucucuauaaugaaaaacacuaccaguacacgccgggggacuggaaauaucggcgaaacccuuggugagaaguggaaaucgcgacugaacgcuuugggcaagagcgaauuucagauuuauaaaaaguccgggauccaggaggucgauagaacacuggccaaagagggaauuaagaggggcgaaacggaccaucacgccguaucucgcgggucagcgaagcuccggugguucguggagagaaacaugguuaccccagaaggaaaaguggucgaucugggcugcggucgugggggauggagcuacuauuguggcgguuuaaagaaugugagggaggucaaaggccuuacuaaagggggaccuggccaugaggaaccaaucccuauguccacauacggguggaaccuggugcggcuccaaaguggaguugacguguuuuucaccccacccgagaaaugcgauacucuacugugugacauaggcgaaucuagcccuaauccaacaauugaggcuggucgcaccuugcgaguacugaaccucguggaaaauuggcuuaacaauaacacgcaguucugcaucaagguccugaaucccuauaugccgucaguuaucgagaagauggaagcauugcagagaaaauacgggggagcccuggugaggaacccucucucccggaauaguacccacgagauguacugggucagcaacgcuacaggcaauauugugucuuccguaaacaugauaucacgcauguuaaucaauagauuuacuaugaagcacaaaaaggccaccuaugagccagauguggaccugggcagcgggacaaggaacauuggaaucgaaucggagguucccaaccuugacauuaucgguaaacgaauagaaaagaucaagcaggagcaugaaacuucuuggcacuacgaucaagaccauccuuauaaaaccugggcauaccacggcaguuaugagacaaagcagaccggguccgccagcucaauggugaauggagucgugcggcugcuaacuaaaccaugggaugucgugcccaugguuacgcagauggcuaugacagacaccacuccguucggccagcaacguguauuuaaggagaaaguggauaccagaacacaggaaccuaaggaggguacgaagaaacucaugaagauuaccgcggaauggcuguggaaagaguuggggaagaaaaagacuccccgcauguguacaagggaggaguucacccggaaagucagauccaacgccgcacugggagcuaucuuuacugacgagaauaaguggaagucugcccgcgaagcaguggaggauggcagguucugggaacucguugaccgagagcggaaccuucaccuggagggcaaaugcgaaacauguguguacaauaugauggggaagagagagaaaaaguuaggagaauuugguaaagccaagggcagcagggcuauuugguauauguggcugggggcccgcuucuuggaguuugaagcgcucggauuccugaacgaggaucauugguuuagucguggcaauucccuaagcggugucgagggggaaggacuucaccggcugggcuacauccucagagaggugucuaagaaagaaggcggggcaauguacgccgacgauaccgcuggaugggacacaaggauuacucuggaggacuugaagaacgaagagaugguaaccaaucauaugaaaggugagcacaagaaacuggccgaagcaauauucaagcucacguaucagaacaaggugguucgcguccagcgaccaaccccucggggcacagugauggauaucauuucaagaagggaccaacgcgggaguggacaggugggcacuuacggucuuaauaccuuuacaaacauggaggcucagcugaucagacaaauggaaggggagggaaucuucaaauccauucagcauuuaacugccaccgaggaaauagcuguccagaauuggcuggcccggguuggcagggagcguuugagccgaauggcaaucucuggcgaugacugcgugguaaagcccauugaugaccgcuucgcgucggcccucacggcucugaacgauauggggaaagugagaaaggacauccagcaaugggaaccaucacggggauggaaugauuggacacagguccccuuuugcagccaccacuuccaugagcuagugaugaaagacgguaggguucuuguggucccuugucgcaaccaggaugaacugauuggcagagcccggaucucccagggggcaggauggagucucaaggagaccgcuugccugggcaagucuuaugcccaaauguggacuuugauguacuuucacaggcgagacuuacgucuggcagccaacgcgauauguagcgcugugccaucccauuggguaccgacaucaagaaccacuuggaguauccacgccaaacacgaguggaugaccacagaagauaugcucgcaguuuggaaucgcguguggauucaggagaaccccuggauggaagacaagacgccugucgagucuugggaagaggugccauaucuugguaaacgggaggaccaguggugcgggagccugaucggacuaaccuccagggccacuugggcuaagaauauucagacagccaucaaccaagugagaucacugauaggcaaugaagaguacaccgauuauaugcccagcaugaaacgcuuccggagggaagaggaagaggcaggcguccucugguga

SEQ ID NO: 14399 - RNA, 9876 nt, Artificial Sequence
  derived and/or modified CDS sequence (opt3) from DENV-2__FJ898449__SS-prME
accgcaggaaugaucauuaugcugauacccacugugauggcuuuccaccucacuacgagaaauggggagccucauaugaucgucagcaggcaggaaaagggaaagucccuucuguuuaagaccaaggacgguacaaauaugugcacuuugauggcaauggauuuaggcgagcugugugaagacaccauuaccuacaagugcccauuccucaagcaaaacgagccggaagauaucgacuguuggugcaauucuaccucaacuuggguuacauaugggaccuguacgacuaccggagagcaccggcgcgagaagcgaaguguggcccucguaccccaugugggcaugggucuggaaacacguacugagaccuggaugagcuccgaaggggcguggaagcacgcucagagaauugagacauggauccuuaggcauccuggauuuaccauaauggccgcaauccuggccuacacgauuggcacuacacacuuccagcgggucuugaucuuuauucuccugaccgcuaucgcaccaucuaugacuaugcgcugcauaggcauuucgaacagagauuucguggaggggguuucaggagguagcuggguggacaucguccuggaacacggcaguugugugacaaccauggccaaaaauaagcccacgcucgauuuugaguuaauuaaaaccgaagcuaagcagccugccacacugaggaaauauugcaucgaggcgaaacuuacuaacaccacaacugacucccgguguccaacccaaggggaacccacauugaaugaggagcaggauaagcgcuucguaugcaaacauucuaugguugaccgaggauggggcaacgguugugggcuguuuggaaagggcggcaucgugaccugcgcaauguucacuugcaaaaagaauauggaagggaaaauuguccagccugagaaccuagaauacacgguggugauaacaccacacagcggagaggaacaugccgucgguaaugauaccggcaagcacgggaaagagguuaagaucacuccgcaguccucaauuaccgaggcugaacucacaggauauggcaccgugacuauggaguguagucccagaacaggucuggacuuuaacgaaaugguacuucugcaaauggaggauaaggccugguuggugcacaggcagugguuccucgaccugccuuuaccauggcugcccggggcagacacgcagggcagcaauuggauccagaaagaaacccucgucacuuuuaagaacccucaugcuaaaaagcaagaugugguugugcuuggaucucaggagggcgccaugcacacagcgcugaccggggccacagagauacagauguccucaggaaauuugcuauucacuggucaucugaaaugccggcuccguauggacaagcugcaacuuaagggcaugagcuacaguauguguaccgggaaauucaagauugucaaagaaaucgcagagacgcagcacggaaccaucgugauucgcguacaguaugaaggcgaugguucuccaugcaagauccccuuugagauuauggaccuggagaaaagacauguuuuggggaggcucauaacagugaacccgaucgucacugaaaaggauuccccugugaacauugaggcugaacccccauucggcgacagcuacaucaucauuggagucgagccuggccagcugaaguuagauugguuuaaaaaggggucgucuauaggacaaauguucgaaaccacaaugcggggugccaaacgaauggcuauccugggcgacacugccugggauuuugggucccuaggaggcguguucaccucaauugguaaggcacuccaccagguuuuuggggccaucuacggcgcugcguucaguggagugagcuggacgaugaaaauucugaucggcguaauaaucacauggauugggaugaacucccgcucuaccagccuuucagucaguuuggugcugguuggaaucgugacucucuaucugggcgucauggugcaggcagacuccgguuguguagugagcuggaagaacaaggagcuuaaaugcgggucuggaauuuuuguuacagauaauguccacaccuggacugagcaguacaaguuccaacccgaaucaccaaguaaacuggccagcgcuauccagaaggcccaugaggaaggcauaugugguauuagauccgugaccagguuggagaaccucauguggaaacagaucacaucugaacugaaucacauuuuaucggagaacgaggugaagcugacgaucaugaccggcgacauaaaagggaucaugcaggucggaaagcggagccuacgcccccaaccuacugaacucagauauuccuggaagacauggggcaaagcaaagaugcugucaaccgagcuucauaaucagacauuuuugauugacgggccagaaacugccgagugcccgaacaccaauagggcuuggaacagucuggaaguugaggauuacggauucggcguguuuacgacaaauaucuggcuccgucugcgggagaaacaggacguguucugugauucuaaguuaaugagcgccgcaauuaaagacaaccgagcgguacacgcugauauggguuauuggaucgaauccgcccugaaugacaccuggaagauagagaaggcaucauucauugaagucaaaagcugccacuggcccaagucucauacucuuugguccaacgggguguuggagagugagaugaucaucccuaaaaauuuugccggaccaguuagccagcacaacaacagacccggcuaccauacccaaacagcugguccuuggcaccucggcaagcuggaaauggauuucgacuuuugugaggggacuaccguggucgugacagaagagugcggaaauaggggcccaucucuacgcacgaccacugccuccgggaaacugauuacagaauggugcugucggucaugcacccuacccccgcugagauauaggggagaggauggcuguugguacgguauggagauccgcccucuuaaggaaaaggaggaaaacuugguuaguagccuggugacugcagggcauggacagauugacaauuucucguuaggcauacucgguauggcucuguuucuugaggaaaugcugcgaacacggguaggcaccaaacacgccaucuugcucgucgcgguguccuucgugacgcugauuacugggaacaugucuuuucgugaucuaggaagagucaugguuauggugggcgccaccaugacagacgauaucgggaugggaguaaccuaccuggcucuccuggcagccuucaaggugaggccaacuuuugcugccggccuuuugcugcgcaaauuaacaagcaaggagcucaugaugaccacaauugguaucguccugcuuucacagaguuccauacccgagacuauccuggaacuaaccgacgcacucgcgcuggggaugaugguguugaaaaugguucggaauauggagaaguaucaacuggccgugacgauuauggcuaucuuaugcgucccuaacgccgugauucuccagaaugcauggaagguuucuuguacaauccuggcuguggucagcguaagcccccuucuguugaccucaagccagcagaaagccgacuggauaccacucgcacugacuauuaagggacuaaacccuaccgccaucuuccugacaacucuuaguagaaccucuaaaaagagguccuggccccucaaugaagcuaucauggcggugggcaugguuagcauucuggccucgucauugcugaaaaacgauauaccaaugacgggcccguuaguggcagggggacuccugacagucugcuacgugcuuaccggucgaucugcugaccuggaguuggaacgcgccacugauguaaagugggacgaucaagccgagaucaguggcuccagcccuauucucucuaucacaauuagcgaggacggguccaugucaaucaaaaaugaagaggaagaacagacccugacuauacuaauccggacaggacugcuugugauuaguggccucuuucccgucagcaucccaauuaccgcugcagccugguaucugugggagguuaagaagcagagagcggguguguugugggaugugcccucuccuccacccgucgggaaagcugaauuagaggacggagccuacaggaucaagcagaaaggcauacugggcuauucccaaauuggggcaggaguguacaaggaagguacguuccacacuauguggcauguuacccguggcgccguacucaugcacaaagggaagcgcaucgagccuucaugggcugaugugaagaaagaccugaucaguuauggaggcgguuggaaacuugaaggggaguggaaagagggagaagagguccaggugcuggcauuggaaccgggcaagaacccacgggccguucagacaaaacccggccuauuuagaaccaauacagggacuauuggagcggugagccuggauuucuccccugguaccucuggcucgccaaucgucgacaagaaggggaaagugguaggacucuacggcaacggugucgugacgaggagcggggcuuacguuucagccauagcacagacagagaaguccauugaagauaaucccgagaucgaggacgacauuuuccgaaaacggcgccugacuaucauggaucuucauccuggagccggcaagaccaaaaaguauuuaccggcuauagugagagaagccauuaagaggggccugcggacacucaucuuggcacccacccgagucguggcugccgagauggaagaggcgcugagagggcucccaauccgcuaccaaacuccugccauuagggcagaacacaccggacgugagaucguugaccugaugugucaugcuacauuuacgaugcggcuucugagucccauuagagugccaaacuauaacuugauaaucauggaugaggcccacuucacugacccugcuucuauugcagccagggguuacaucagcacccgcgucgaaaugggcgaggccgcugggaucuuuaugacagcgacacccccaggaucccgagauccguucccucagucaaaugcacccauuauggacgaagagagagagauaccagaacggucuuggaacagcggccacgagugggugacugauuuuaaagguaagacaguaugguucgugcccaguaucaaaaccgggaaugacauugccgcuugccuaaggaagaacggaaaacgcguuauccagcugucccguaagacguuugauagcgaauaugucaagacuagaacaaaugacugggauuucguggugaccaccgacauuucugagaugggcgccaacuuuaaagcagaacgggucaucgacccuaggcgcuguaugaagccaguaauacucacugauggcgaggagcgagugaucuuagccgggcccaugccuguuacacauucauccgcugcgcaaagacggggaaggauuggucgcaauccgagaaacgaaaaugaccaguacaucuauaugggcgagccacuggaaaacgaugaggacugcgcccacuggaaagaagcaaagaugcuucuggauaauauuaacacccccgaggggaucauaccuaguauguucgagcccgaaagggagaaaguggacgcuauugauggagaauaccggcuccguggcgaggcccgcaagacauuugucgacuugaugcgaagaggugaucugccaguguggcucgcauacaaaguugccagcgaagggaucaauuaugcugacaggcggugguguuucgauggcacucgcaacaaucagauucuggaggagaacguggaagucgagaucuggacgaaggaaggagagagaaagaaacuuaagccuagguggcuagacgcccggauauacucggauccccuggcguugaaagaguucaaggaauuugcagccggccgaaaaucuuuaacccugaaccucaucacagagauggggagacugccaacuuucaugacccagaaggcucgcgacgcccuugacaaucuggcugugcuccauacagcagaagccggagguaaggcuuauaaccacgccuuguccgagcugccugaaacccuagagacucugcuccuucugacguuauuggcaaccguaacaggcgggauuuuucuguuccucaugagcggaaggggcaucgguaaaaugacucuggggaugugcugcauuaucaccgcgucaauacuucugugguacgcccaaauucagccgcacuggaucgcugccaguaucauucucgaguuuuucuugaucgugcuguuaauacccgaaccagagaagcagcggacaccucaggauaaucaacuaaccuauguuauuaucgcaauucugacugucguggcugccacaauggcaaacgaaaugggcuuucucgagaaaacgaagaaagaccuuggacugggccauaucgccacccagcagcccgaaucuaauauauuggauaucgaccugcguccagcuuccgcguggacucucuacgccguggcaacaaccuucauuaccccuaugcugagacacagcaucgagaacucaagugucaauguuagccuuacagcuauugccaaccaggccacugugcucauggggcugggaaaggguuggcccuuguccaagauggauaucggcguaccgcuguuagcaauuggguguuauucucaagugaauccaaucacgcuaaccgcugcccugcuccuucuggucgcgcauuacgcuauaauuggaccuggcuugcaggccaaagcaacaagggaggcccagaagcgcgcugcagccgguaucaugaaaaaccccacuguggacgggaucaccguuauugaucuggacccaauacccuacgauccuaaguuugaaaaacagcucggccaagugaugcugcuugucuuaugcguaacacaggugcugaugaugcggaccacuugggcgcucugugaggcuuugacgcuggccacaggaccgguuagcacccuaugggaaggcaaucccgggcgauucuggaacacuaccaucgcaguguccauggccaauauuuuuagaggaucauaucuggcuggcgccggucuccuuuucucuaucaugaagaacacaacaaguaccaggcgcgggacaggaaauauuggcgagacgcugggugaaaaguggaaaucgcgguugaacgcacugggcaagagcgaguuucagaucuacaaaaaguccgggauacaagaggucgacagaacccucgcuaaagaaggaaucaagcguggcgagacugaucaccaugccgugucuagggggucagcgaaacugcggugguucgucgaacgcaauuuagugacaccagagggaaagguuguggaccuuggcugcggucgagggggauggagcuauuacuguggcggucugaagaacguaagagaggugaaaggccucaccaaaggcgggccugggcacgaggaacccauuccuauguccacuuauggguggaaccuagucaggcugcagaguggaguugauguguucuuugucccacccgaacggugcgacacauugcugugugacaucggcgagucuagcccuaauccaaccguggaagccggucgcacgcucagaguacuuaaccugguggagaauugguugaacaauaacacccaguucugcguuaaagugcugaaucccuacaugccgucagucauugagaggauggaaacacuccagcgaaaguaugggggagcauuagugcggaacccucugucccguaauaguacucacgagauguacugggucagcaacgcuucuggcaauaucguguccucaguuaacaugauaagcagaaugcuuauuaaucgcuuuaccaugaggcauaaaaaggccacauacgaaccagauguagaccugggcucggggacucggaacaucggaaucgagucugaaacccccaaucuagauauuauagguaagagaaucgagaaaauuaagcaagagcacgaagcaaguuggcauuaugaccaggaucacccuuacaaaacaugggcuuaucacggcuccuacgagaccaagcagacugggagcgccucauccauggugaacggagucgugcgccuccugacgaaaccaugggacguugugcccauggucacacagauggccaugaccgauacuaccccguucggccaacagaggguguuuaaggaaaagguagacacacgaacgcaggagccuaaagaagguaccaagaaauugaugaagaucacugcggaguggcuguggaaagagcucgggaaggaaaagacaccccggauguguaccagagaggaguucacuaaaaaggugaggucuaacgcugcacuuggagccauuuuuacagaugagaauaaauggaaguccgcucgcgaggccguugaagacaaccguuucugggagcuggucgauaaagaacggaauuuacaucuggagggcaagugcgaaaccuguguguauaacaugaugggcaaaagagagaagaaguugggggaguuuggaaaagcaaaggguaguagggccaucugguacauguggcucggcgcucgcuuccuggaauuugaggcgcuaggguuccuuaaugaagaccacugguuuucccgagagaacagccugucuggaguggaaggcgagggucuccauaaacugggguauauauugcgggaggucucaaagaaagaaggaggcgccauguacgcagacgauacagcuggcugggacacuagaaucaccauugaggaucugaagaaugaagagaugaucacgaaccacauggccggggaacauaagaaacucgcagaggccauuuucaaacuuaccuaccagaauaaaguugugaggguacaacgcccaacaccuagaggaacugugauggacaucauuagucggagggaucagcgugguuccggccaggucgggaccuauggacugaacacauucacuaauauggaggcucaauuaauacgacagauggaaggcgaggguaucuuuaagagcauucagcaccugaccgccucugaagagaucgcggugcaggacugguugguucgcguggggagagagcggcucucgaggauggcaaucucaggagaugacugcgucgugaaaccccuggaugaccgcuucgccagagcucuaacggcccuuaacgauaugggcaagguacggaaggacauucaacagugggaaccaagcaggggcuggaaugauuggacacagguucccuuuugcucccaccauuuccacgagcugauaaugaaagacgggcgaacccucguggucccuugucguaaccaggacgaacugaucggcagagcacgcauuagucaaggugcuggcuggucuuugcgggagacugccugcuuaggaaagagcuacgcucagauguggucccugauguauuuucauaggagagaucuccgccuugccgcaaaugcgaucuguucagccgugccaagucacugggugccgacaucucggaccacuuggagcauucacgcuucccaugaauggaugaccacagaggacaugcugacggucuggaacaggguuuggauccuagagaaccccuggauggaagauaaaaccccuguggagucaugggaagagauaccauaccugggaaagcgagaagaccaguggugcggcagccucaucgguuugacuucuagagccacaugggccaagaauauucagaccgcuaucaaccaaguacggucccugauugggaaugaggaguauacugauuacaugcccaguaugaagagguuccgccgugaagaggaagaggccggagugcuuugguga

SEQ ID NO: 14400 - RNA, 9876 nt, Artificial Sequence
  derived and/or modified CDS sequence (opt3) from DENV-2__FJ906966__SS-prME
accgccggcaugaucauuaugcugauacccacagugauggcuuuccaccucacuacgagaaacggggagccucauaugaucgucagcaggcaggaaaagggaaaaucccuucuguuuaagaccgaggacgguguuaauaugugcacauugauggcaauggauuuaggcgaacugugugaggacacuauuaccuacaaaugcccauuccuaaagcaaaacgaaccggaggauaucgacuguuggugcaauucuacaucaaccugggugacuuaugggacauguaccacgacuggagagcaccggcgcgaaaaacgaaguguagcccucgugccccaugucggcaugggucuggagacccguacagaaacuuggaugagcuccgagggggcguggaagcacgcucagagaauugagaccuggauccuuaggcauccuggauuuacaauaauggccgcaauccuggccuacaccauuggcacgacucacuuccagcgggcuuugaucuuuauucuccugacagcaguggccccaucuaugaccaugcgcugcaucggcauaucgaacagagauuucguugaaggggugucaggagguagcugggucgacauugugcuggagcacggcaguuguguaacuacaauggcuaagaauaaacccacccucgauuuugaauuaaucaagacggaggccaaacagccugcgacccugaggaaguauugcauugaagcaaaacuuacaaacacuaccacagacucccgguguccaacucaaggggagcccucuuugaaugaggaacaggauaagcgcuucguuugcaagcauagcaugguggaccgaggauggggcaacgguugugggcuguuuggaaaaggcggcaucgucaccugcgccauguucacaugcaagaaaaauauggaggggaagguggugcagccugaaaaccuagaguacaccaucgucauuacuccacacuccggagaagagcaugcuguugguaaugauacgggcaaacacgggaaggagauaaaaaucacaccgcagucaaguauuaccgaagccgagcucacuggauauggcaccgugacaauggaauguagccccagaaccggucuggacuuuaacgagaugguacuucugcaaauggaaaauaaggcaugguuggugcacaggcagugguuccucgaucugccuuuaccauggcugcccggggcugacacucagggccucaacuggauccagaaggagacacuugucacguuuaaaaauccucaugccaagaaacaagacgugguugugcugggaucucaggagggcgcgaugcacaccgccuugacuggggcaacagaaauacagauguccucaggaaaccuacuguucaccggucaucucaagugccggcugcguauggauaaacuucaacugaagggcaugagcuacaguauguguacagggaaguucaaagucgugaaggagauugcugaaacucagcacggaaccaucguaauccgcguucaguaugagggcgacgguucuccaugcaaaauucccuuugagaucauggauuuggaaaagagacaugugcucgggaggcugauuacggucaacccgauagugaccgagaaagacuccccugucaauaucgaagccgagcccccauucggcgauagcuacauuaucaucggaguggaaccuggccaguuaaagcugaacugguuuaagaaagggucgucuauuggacaaaugauagagacaacuaugcggggugcuaagcgaauggccauccuaggcgacaccgcaugggauuucgggucccucggaggcguuuuuacaucaauugguaaagcccugcaccagguguucggggcuaucuacggcgcggcauuuaguggaguaagcuggauuaugaagauccuuauaggcgucaucauuacuuggaucgggaugaauucccgcucuaccagcuugucagugagucugguucucgugggagucgugacgcuguaucuuggcguaauggugcaggccgacuccgguuguguugucagcuggaaaaacaaggagcugaagugcgggucuggaauuuucaucacagauaaugugcacaccuggacugaacaguacaaauuucaacccgagucaccaaguaaguuggcuagcgccauacagaaagcacaugaagagggcauuugugguaucagauccgugacaaggcucgaaaaccugauguggaagcagauuacccccgaguuaaaucacauccugucugagaacgaagucaaacuaacuauaaugaccggcgacaucaaggggauuaugcaggccggaaaacggucgcuccaaccucagccaacagagcugaaguauagcuggaagacguggggcaaagcuaagaugcuuuccaccgaaucacauaaucagacuuucuugaucgaugggccggagacagccgaaugccccaacaccaaucgcgcauggaacagucuggagguugaggacuacggauuuggcguguucacaacuaauauuuggcucaaacugagagaaaagcaggacguguuuugugauucuaaauuaaugagcgcggcuaucaaggacaacagggccguacacgcagauauggguuauuggauagaguccgcccugaaugacaccuggaagauugaaaaagcuucauucaucgaggucaagagcugccacuggccuaaaucucauacgcuuugguccaacgggguguuggagagugaaaugaucauuccaaagaacuucgccggacccguuagccaacacaauuaccguccuggcuaucauacacagaccgcagguccauggcaccucggcaaacuggagauggauuuugacuucugugaagggacuaccguggucgugacagaggauugcggaaaccggggccccucucuacgaacuaccacagcuuccgggaagcugaucacggaauggugcuguagaucaugcacccucccgccucugagguaccgcggagaggacggcuguugguacgguauggagauucggccacuuaaggaaaaagaggaaaauuugguuaacagucuggugacugccgggcauggacagauagauaauuuuagcuuaggcguacucgguauggcgcuguuccuugaggaaaugcugagaacaagggucggcaccaagcacgccaucuugcucguggcugugucguuugucacucugauuacagggaacauguccuuccgcgaccuaggacgaguuauggugaugguaggcgcaaccaugacggaugacaucgggaugggagugacuuaucuggcccuccuggcugccuuuaaaguccggcccaccuucgcagcgggccuuuugcugcguaaguuaacaucuaaagagcucaugaugaccacuauugguaucgugcugcuuagccaaucaacaauaccugagaccauccuggaacuaacagaugcccucgcucuggggaugaugguuuugaagauggugagaaagauggagaaauaccagcuggccgucacuauuauggcaaucuuaugcgugcccaaugcuguuauucuccagaacgccuggaaggugaguuguaccauccuggcagucguauccgugucuccacuuuuucugacgagcucccagcaaaaagccgacuggauaccuuuggcucucacaauuaagggacugaaucccaccgcgaucuuccuaacuacccugucaaggacaaacaaaaagcgcagcuggccacuuaaugaagccaucauggcaguuggcauggugaguauucucgcuucuucccuguugaaaaacgacauaccgaugacuggcccucuggucgccgggggauuacucaccgugugcuauguacugacgggucggagcgccgaucuugagcuggaaagagcugcagacgugaagugggaggaucaggccgagaucucgggcucaucucccauuuugaguaucacaauuuccgaagacgggagcaugucuaucaagaaugaggaagaggagcagacccucacuauacugaucaggacaggacuacuggucauuagcggccuuuuuccaguuuccauccccauuaccgcggcugccugguaccucugggaagugaaaaagcagcgagcaggugugcugugggaugucccuucaccacccccuguggggaaagccgaguuggaagacggagcuuaucgcaucaagcaaaaaggcauauuaggcuacagucagauuggggcaggaguuuauaaggaggguacuuuccacacaauguggcauguaacccggggcgccgugcugaugcacaaggggaaaagaaucgaaccgagcugggcggaugucaagaaagaccucaucucuuacggaggcgguuggaagcuggagggggaguggaaagaaggagaggaagugcagguucuugcucuggagccaggcaagaaccccagggccgugcagacgaagccuggcuuguuuaaaacuaaugcagggaccauuggagccgucucccuagauuucucaccagguacaaguggcagccccaucauagacaagaaagggaaggugguaggacuguacggcaacggugucgugacccguuccggggcuuauguuucugccauugcacaaacagaaaaaucgaucgaggauaacccugagauugaagacgauaucuuccgcaagcggaagcucacuauaauggaccugcauccgggagcuggcaaaaccaagagauaccuucccgccauugugagggaggcgaucaaacgaggcuuacggacgcugauccucgccccaacacgcgucguggcagcugaaauggaggaagccuugagagggcugccuauuagguaucagacucccgcuauccgggcagagcacaccggacgagagauuguugaccucaugugucaugccacauuuaccaugagacugcuuagcccagugcgcgucccuaauuacaaccugauaaucauggaugaagcccacuucacugaccccgcuucaauugcggcaagggguuauaucuccacccguguggagaugggcgaagccgcugggaucuuuaugacagccacgccaccgggaagucgggauccuuucccccagucuaaugcaccaauuauggacgaggagagagaaauacccgagaggagcugguccucaggccacgaauggguaacugauuuuaaggguaaaaccgugugguucguuccuucuaucaaggccgggaacgacauugcugcgugcuugcgcaagaauggaaaaaaggucauccaacuaagccgaaaaacauuugauagugaguacgugaagaccagaacuaacgacugggauuucguggucacaaccgacauuuccgaaaugggcgccaauuuuaaagcagagcggguaaucgauccaaggcgcuguaugaagcccgugauacugacggacggcgaggaacguguuauccucgcugggccuaugccggugacucauagcucugccgcacagagacggggaaggauuggucgcaacccaaaaaaugagaacgaccaguauaucuacaugggcgaacccuuagagaaugaugaagacugcgcccacuggaaggaggcuaagaugcugcuugauaacauuaauacaccugaggggaucauacccucaauguucgaaccagagcgagaaaaagucgacgccauugauggagaguacagacugcggggcgaagcgaggaagaccuuuguggaccucaugcgcagaggugauuugccuguuuggcuggcauauaggguggccgcugaggggaucaacuacgccgaccggcguugguguuucgauggcauuaaaaauaaccagauccucgaggaaaacgucgagguggaaauauggaccaaggagggagagcgcaaaaagcugaagccccgauggcuugacgcuagaaucuauuccgauccacuagcacugaaagaauucaaggaguuugccgcuggcaggaaaaguuugacuuuaaaucugauuacagaaauggggcggcucccuaccuucaugacacaaaaggcccgcgacgcacuggauaaccuugcgguacugcauacugccgaggcuggagguagagccuacaaucacgcacucagcgaauugccggagacgcuggagacccuacugcuccuuacacuguuagcuacugugaccggcgggaucuuuuuguuccugaugucgggaaggggcauugguaaaaugacacucgggaugugcugcaucauaaccgccucuauucugcuuugguaugcacagauccagccccacuggaucgccgcuuccauuauccuggaauuuuuccucauaguuuugcugauuccagagccugaaaagcagcggacuccccaagacaaccaguuaacguacgucgugaucgcgauucuaaccguggucgccgcaacaauggcuaaugagaugggcuuucuggaaaagacuaaaaaggaccucggacuuggcagcaucaccacacagcagccagagucaaacauacuggauaucgacuugcgaccugccagugccuggacccuguaugcaguugcuacuacauucgugacgcccaugcucagacauucuauugagaauuccagcguaaacgugucacugaccgccaucgcgaaucaagcuacuguccuuauggggcucggaaaagguuggccgcugaguaagauggauauuggcgugccauugcuggccaucggguguuacagccagguuaacccuauuacauuaaccgcagcccuauuucugcucguggcucacuacgcaaucauaggacccggccuucaggccaaagcgacccgcgaagcucagaagagggccgcagccgguauuaugaagaauccaacagucgacgggaucacuguaaucgaucuggaccccauuccuuaugauccgaaauucgagaagcaauugggccaggugaugcugcucguucugugcgugacgcagguccuuaugaugcggaccacaugggcuuuaugugaagcccugacucucgcaaccggacccauauccacauugugggagggcaacccagggcguuuuuggaauaccacuaucgcugugucuauggccaacauuuucagaggaagcuaccuggcgggcgccggucuacuguuuuccaucaugaaaaauacgacaaacaccaggcgcgggacuggaaauauuggcgaaacccucggugagaaguggaaaucacggcuuaacgcacugggcaagucugaguuccaaaucuauaaaaagagugggauacaggaagucgaccgaacauuggcuaaggagggaaucaaaagaggcgaaacugaucaucacgccgugucgagggggagcgcaaagcugcgcugguucguugagcggaacauggugaccccugagggaaaaguaguggaccucggcugcgguagagggggaugguccuacuauuguggcggucugaagaauguccgugaaguuaaaggcuuaacaaaggggggacccggccaugaggaaccuauuccaaugucuacguacggguggaaccuugugaggcugcagucaggagucgauguguuuuucacccccccugagaagugcgacacucuccuaugugauaucggcgaaagcuccccaaaucccacaguagaggcuggucggacccugcgcguguugaaccugguugagaauuggcucaacaauaacacucaguuuugcauuaaagugcuuaauccguauaugccuagugucaucgaaaagauggaggcccugcaacgaaaauacgggggagccuuggugagaaacccacugucuaggaauagcacacacgaaauguacugggucucaaacgcguccggcaauauagugaguagcguuaacaugauuucucggaugcucaucaaucgcuucaccaugagacacaagaaagcuacguaugagcccgacguagacuuaggcuccgggaccaggaacaucggaauugaaucagagauaccuaaccuggauaucauugguaagcgaaucgagaagauuaaacaggaacaugagacaagcuggcacuacgaccaggaucauccauauaagacuugggcauaccacggcucguaugaaaccaaacagacagggucugccaguuccauggugaauggagucgugcggcuucugacuaagcccugggacguugugccgauggucacccaaauggcuaugacagauaccacuccuuuuggccagcagcguguguucaaagagaagguagacacgagaacacaggaacccaaggaggguaccaaaaagcuaaugaaaaucacugccgaguggcucuggaaggaacuggggaaaaagaaaaccccacgcauguguacaaggcaagaguuuacgcggaaggugagaagcaacgcagccuugggagcuauauucaccgaugaaaauaaguggaaaucagcgcgcgaggccguugaggacuccagguuuugggaacuggucgauaaggagcgaaaccuccaccuugaaggcaaaugcgagacuuguguguacaauaugaugggcaagcgggaaaaaaagcugggggaguucggaaaggcaaaagguucuagagcuaucugguauaugugguuaggcgccagguuucuggaguucgaagcauugggguuucucaacgaggaccauugguucagccgcgaaaauagucuguccggaguggagggcgaaggucuacacaagcuuggguacauucugcgugaugucagcaaaaaggagggaggcgccauguacgcugacgacacagccggcugggauacccggaucacucucgaggaccugaaaaacgaagagaugguuacaaaucauauggaaggggagcacaagaaguuggcggaagcaauuuucaaacugaccuaucagaacaaggugguaagagugcagaggccuacaccccgcggaacugucauggauaucauuucucgacgggaccaaagagguucaggccagguggggaccuacggacucaauacguuuaccaacauggaggcccagcuuauaaggcagauggagggcgaagguguuuucaaaaguauccaacaucugacagugacugaggaaauugcuguccagaauugguuagcccgcguggggagagagcggcuguccaggauggcaaucagcggagaugacugcguaguuaagccauuggaugaccguuuugcuucugcccucaccgcucugaacgauaugggcaaagugcgaaaggacauccagcagugggagcccucgcgcggcuggaaugauuggacacaagucccuuucugcucacaccacuuucaugaacuaauuaugaaggacgggagagugcuuguggucccaugucggaaccaggaugagcugauaggaagggcccgcaucagccagggugcaggcuggucccucagagaaacugcgugccuggggaaaaguuaugcccagauguggucuuugauguacuuccaccggagggacuuacgacuggcugccaacgcaauuuguagcgcuguuccgucccauugggugcccaccucacguacgacauggaguauccacgccaagcacgaguggaugaccacugaagacaugcucacaguauggaauagaguguggauucaagagaacccuuggauggaggauaaaaccccagucgaaucuugggaggaaauccccuaucuuggaaagcgcgaggaccaguggugcggcagccugauaggucuaacuucccgggcaaccugggccaaaaauauccagacagcgauuaaccaggugaggucacugaucgggaaugaagaguacacggauuauaugccuagcaugaagagauuucgccgggaggaagaggaagcuggaguucucugguga

SEQ ID NO: 14401 - RNA, 9876 nt, Artificial Sequence
  derived and/or modified CDS sequence (opt3) from DENV-2__FJ906968__SS-prME
accgccggcaugaucauuaugcugauacccaccgugauggcuuuccaccucacuacgaggaacggggaaccucauaugaucgucagcaggcaggaaaagggaaaaucccuucuguuuaagaccgaggacgguguuaauaugugcacauugauggcgauggauuuaggcgaacugugugaggacacuauuaccuacaaaugcccauuccuaaagcaaaacgaaccggaggauaucgacuguuggugcaauucuacaucaaccugggugacuuaugggacauguaccacgacuggagagcaccggcgcgaaaaacgaagugucgcccucgugccccaugucggcaugggucuggagacccguacagaaacuuggaugagcuccgagggggcguggaagcacgcucagagaauugagaccuggauccuuaggcauccuggauuuacaauuauggccgcaauccuggccuacaccauuggcacgacucacuuccagcgggcuuugaucuuuauucuccugacagcaguggccccaucuaugaccaugcgcugcaucggcauaucgaacagagauuucguugaaggggugucaggagguagcugggucgacauugugcuggagcacggcaguuguguaacuacaauggcuaagaauaaacccacccucgauuuugaauuaaucaagacggaggccaaacagccugcgacccugaggaaguauugcauugaagcaaaacuuacaaacacuaccacagacucccgguguccaacucaaggggagcccucuuugaaugaggaacaggauaagcgcuucguuugcaagcauagcaugguggaccgaggauggggcaacgguugugggcuguuuggaaaaggcggcaucguaaccugcgccauguucacaugcaagaaaaauaugaaggggaaaguggugcagccugagaaccuagaauacaccaucgucauuacuccacacuccggagaggaacaugcuguugguaaugauacgggcaagcacgggaaagagauaaagaucacaccgcagucaaguauuaccgaggccgaacucacuggauauggcaccgugacaauggaguguagccccagaaccggucuggacuuuaacgaaaugguacuucugcaaauggagaauaaggcaugguuggugcacaggcagugguuccucgaucugccuuuaccauggcugcccggggcugacacucagggcucuaacuggauccagaaagaaacacucgucacguuuaagaauccucaugccaaaaagcaagacgugguugugcuuggaucccaggagggcgcgaugcacaccgcccugacuggggcaacagagauacagaugucaagcggaaacuugcuauucaccggucaucugaaaugccggcuccguauggauaagcugcaacuuaagggcaugaguuacucuauguguacagggaaauucaaggucgugaaagaaauugcugagacucagcacggaaccaucguaauccgcguucaguaugaaggcgacgguuccccaugcaagauucccuuugagaucauggaucuggagaaaagacauguguuggggaggcucauuacggucaacccgauagugaccgaaaaggacagcccugucaauaucgaggccgaacccccauucggcgauucguacauuaucaucggaguggagccuggccagcugaaguuaaacugguuuaaaaaggggucuuccauuggacaaaugauagaaacaacuaugcggggugcuaaacgaauggccauccugggcgacaccgcaugggauuucgggucacuaggaggcguuuuuacaaguauugguaaggcccuccaccagguguucggggcuaucuacggcgcggcauuuagcggaguauccuggauuaugaaaauccugauaggcgucaucauuacuuggaucgggaugaacucucgcagcaccucacuuaguguguccuugguucuggugggagucgugacgcucuaucugggcguaauggugcaggccgacagcgguuguguugucucuuggaagaacaaggagcuuaaaugcgggucaggaauuuucaucacagauaaugugcacaccuggacugagcaguacaaguuucaacccgaaaguccaagcaaacuggcuuccgccauacagaaggcacaugaggaaggcauuugugguaucagaucugugacaagguuggagaaccucauguggaaacagauuacccccgaacugaaucacaucuuaucggagaacgaggucaagcugacuauaaugaccggcgacaucaaagggauuaugcaggccggaaagcggagccuacaaccucagccaacagaacucaaguauuccuggaaaacguggggcaaggcuaaaaugcugucaaccgagagucauaaucagacuuuccuuaucgaugggccggaaacagccgagugccccaacaccaaucgcgcauggaacucuuuggaaguugaggacuacggauuuggcguguucacaacuaauauuuggcugaagcucagagagaaacaggacguguuuugugauagcaagcugauguccgcggcuaucaaggacaacagggccguacacgcagauauggguuauuggauagaaucagccuuaaaugacaccuggaaaauugagaaggcuagcuucaucgaagucaaaucuugccacuggccuaagucccauacgcuguggaguaacgaggugcuugagagcgaaaugaucauucccaagaauuucgccgggcccguuucucaacacaauuaccguccuggauaucauacacagaccgcaggcccauggcacuuggguaagcucgagauggauuuugacuucugugaaggcacuaccguggucgugacagaggauugcgggaaccggggacccucccugcgaacuaccacagcuucaggcaagcuaaucacggaauggugcuguagaaguugcacccugccgccucucagguaccgcggggaggacggauguugguacggcauggagauucggccacugaaagaaaaggaggaaaaucuuguuaacagcuuggugacugccggucaugggcagauagauaauuuuucgcugggaguauuaggcauggcacucuuccuggaggaaaugcuuagaacaagggucgguaccaaacacgccauccuguugguggcuguguccuuugucacucucauuacaggcaacaugucuuuccgcgaccuggggcgaguuauggugaugguaggagcaaccaugacggaugacaucggcaugggggugacuuaucuagcccugcucgcugccuuuaagguccggcccaccuucgcagcgggacugcuuuugcguaaacugacaagcaaggaguuaaugaugaccacuauuggcaucgugcuccugucacaaaguacaauaccugagaccauccuugaacugacagaugcccuagcucucgguaugaugguucugaagauggugagaaaaauggagaaguaccaguuggccgucacuauuauggcaauccugugcgugcccaaugcuguuauuuuacagaacgccuggaaaguguccuguaccauccucgcagucguaucugugagcccacuguuucuuacguccucacagcaaaaggccgacuggauaccucuggcuuugacaauuaaagggcucaaucccaccgcgaucuuccugacuacccuaagcaggacaaacaagaaacgcaguuggccacugaaugaagccaucauggcaguuggaauggugucuauucuugcuuccagccuccugaagaacgacauaccgaugacuggcccuuuggucgccggcgggcuguuaaccgugugcuauguacucacgggacggucggccgaucuggagcuugaaagagcugcagacgugaagugggaggaucaggccgagaucucagguucuagucccauucuguccaucacaauuagcgaagacggcucuaugagcaucaaaaaugaggaagaggagcagauauugaccauccucauuaggacugggcugcuagucaucuccggacuguuuccaguuucaauucccaucacagcggcugccuggugucuuugggaagugaagaaacagcgagcaggcgugcucugggaugucccuaguccacccccuguggguaaggccgagcuggaagacggggcuuaccgcauaaaacaaaagggaauuuugggcuauagccagaucggcgcagggguuuacaaggagggaaccuuccacacuauguggcauguaacacggggugccguguuaaugcacaaaggcaagagaaucgaaccgucuugggcggaugucaaaaaggaccugauuuccuaugggggaggcuggaaacucgagggugaguggaaggaaggggaggaagugcagguucuggcucuugagccaggaaagaaccccagggccgugcagaccaaaccuggccuguuuaagacgaaugcaggcacuaucggggccgucucauuggauuucaguccaggaaccagcgguucccccauaauugacaaaaagggcaaagugguagggcuauacggaaacggcgucgugacacguucuggugcuuacguuucggccaucgcacaaaccgaaaagagcauugaggauaacccugagaucgaagacgauauauuccgcaagcggaaacugacaauuauggaccuccauccgggggcuggaaagacuaaaagauaucugcccgccaucgugagggaggcgaucaagcgaggccuucggaccuuaauucuggccccaacgcgcgucguggcagcugaaauggaggaagcccucagaggcuugccuaucagguaccagacacccgcuauucgggcagagcacacugggcgagagauaguugaccugaugugccaugccaccuuuacaaugagacuccugucaccagugcgcgucccuaauuauaaccuuaucauuauggaugaagcccacuucaccgaccccgcuuccaucgcggcaaggggauacaucaguacucguguggagaugggugaagccgcuggcauuuuuaugaccgccacaccaccggggucucgggauccuuucccccagagcaaugcaccaauaauggacgaggagagagaaauccccgagagguccuggucaucuggacacgaauggguaacggauuuuaaaggcaagacugugugguucguuccuagcauuaaggccgguaacgacaucgcugcgugucugcgcaaaaaugggaagaaagucauucaauugagucgaaagaccuuugauuccgaguaugugaaaacaagaaccaacgacugggauuucguggucacuacagacaucagcgaaaugggagccaauuuuaaggcagagcggguaauagauccaaggcgcugcaugaaacccgugauccuaaccgacggcgaggaacguguuauucuggcuggcccuaugccggugacgcauucuucagccgcacagagacgggggaggaucggacgcaacccaaagaaugagaacgaccaguacauuuauaugggugaaccccucgagaaugaugaagacugugcccacuggaaggaggcuaaaauguuacuggauaacaucaauacuccugagggcauaauucccuccauguucgaaccagagcgagaaaaggucgacgccaucgauggggaguacagacuucggggagaagcgaggaaaacauuuguggaccugaugcgcagaggcgaucucccuguuugguuggcauacaggguggccgcugaggguauuaacuaugccgaccggcguuggugcuucgaugggaucaagaauaaccagauacuggaggaaaacgucgagguggaaaucuggaccaaagagggcgagcgcaagaagcucaaaccccgauggcuggacgcuagaauuuacagugauccacuugcacuaaaggaguucaaagaguuugccgcuggaagaaagagccugaccuugaauuuaaucacugaaaugggccggcugccuacauucaugacccaaaaagcccgcgacgcacucgauaaccuggcgguacuucauacagccgaggcuggugggagggccuauaaucacgcacugucggaacucccggagacuuuggagacgcugcuacugcucacccuucuggcuacagugacugggggcauauuuuuauucuugaugucugggaggggaaucggcaagaugacccuggguaugugcuguauaauuacagccuccauccuccugugguacgcacagauccagccccacuggauugccgcuagcaucauacuugaauuuuuccugauuguucucuugaucccagagccugaaaagcagcggaccccacaagacaaccagcugacuuaugucgugauugcgaucuuaacgguggucgccgcaaccauggcuaaugagaugggguuucuagagaaaacuaagaaagaccugggccucggaucaauaacuacccagcagccagaaaguaacauccuugauauugaccugcgaccugccucugccuggacauuguacgcaguugcuaccacuuucgugacacccaugcugagacauuccaucgagaauagcucaguaaacgugagucucacggccauugcgaaucaagcuaccguccugaugggccuugggaagggauggccgcucagcaaaauggauaucggugugccacuguuggccauuggcugcuauucccagguuaacccuaucacucugacagcagccuuauuucuacugguggcucacuacgcaauaauugggcccggacuccaggccaaggcgacccgcgaagcucagaagagggccgcagccggcaucaugaaaaauccaaccgucgacgguaucacaguaauugaucuugaccccauaccuuacgauccgaaguucgagaaacaacugggacaggugauguugcugguucucugugugacucagguccugaugaugcggacgaccugggcucuuugcgaagccuuaacacuggcaacuggccccaucucuacccucugggagggaaacccaggccguuuuuggaauacaaccauugcugugagcauggccaacaucuucagaggguccuauuuggcgggagccggccugcuauuuucaauuaugaagaauacuacgaacacaaggcgcgguaccgggaauaucggagaaacucugggcgagaaauggaagucucggcucaacgcacuugguaaaagugaguuccaaauauacaagaagucgggcauccaggaagucgaccgaacccuggcuaaagaggggauuaagagaggagaaacagaucaucacgccgugagcaggggcuccgcaaaauugcgcugguucguugagcggaacauggugacuccugaggggaagguaguggaccugggauguggcagagguggguggucuuauuacugcggaggccucaaaaauguccgugaaguuaagggucugaccaagggcgggcccggacaugaggaaccuaucccaaugucaacauauggcuggaacuuagugaggcuucagagcggggucgauguguuuuucacgcccccugagaaaugugacacccugcucugcgauauuggagaauccaguccaaaucccacuguagaggcuggccggacacuacgcgugcugaacuugguugagaauuggcugaacaauaacacccaguuuuguaucaaggugcucaauccguacaugccuucugucauagagaaaauggaggcccuucaacgaaaguaugguggggcccuggugagaaacccauugagcagaaauucaacucacgaaauguacugggucuccaacgcgaguggaaauauugugagcucuguuaacaugaucucccggaugcugaucaaucgcuucacaaugagacacaaaaaggcuaccuacgagcccgacguagaccucggcucaggcacgaggaacauugggauagaaagcgagaucccuaacuuagauauuaucggaaagcgaauugagaaaaucaagcaggaacaugagaccucguggcacuaugaccaggaucauccauacaaaacaugggcauaucacgguucuuacgaaacuaagcagaccggcagugccuccagcauggugaauggggucgugcggcugcuuacaaaacccugggacguugugccgauggucacucaaauggcuaugaccgauacaaccccuuuuggacagcagcguguguucaaggagaagguagacacuagaacgcaggaacccaaagagggcacaaagaaacugaugaagauaaccgccgaguggcuauggaaagaacucgguaagaaaaagacuccacgcaugugcaccagggaggaauuuacacggaaggugagaucaaacgcagcccugggggcuaucuucacggaugagaauaaauggaaguccgcgcgcgaggccguugaagacucuagguuuugggaguuggucgauaaagaacgaaaccugcaccucgagggaaagugugaaaccugcguguauaauaugaugggcaaacgggagaagaaacuuggcgaguucgggaaagcaaagggaagcagagcuauuugguacauguggcugggugccagguuuuuagaguucgaggcacugggcuuuuugaacgaagaccauugguucagucgcgaaaauucccucagcgggguggaaggagagggccugcacaaacuagguuauauccuucgugaugucucuaagaaagaagggggagccauguacgcugacgacacugccggcugggauacacggauuacccuggaagaccucaagaacgaggaaaugguuacuaaucauauggagggcgaacacaagaaacuggcggaggcaaucuucaaguugacauaccaaaacaaagugguaagagugcagaggccuacaccccgcgggacagucauggauauuauaucacgacgggaccagagaggaaguggucaagugggcacuuaugggcugaauaccuuuacgaacauggaggcccagcucaucaggcagauggaaggagagggcguuuucaaguccauucagcaucuuaccgugacagaagagaucgcuguccaaaauuggcuggcccgcguggguagagagcgguuaagcaggauggcaaucucuggggaugacugcguaguuaaaccacuggaugaccguuuugcuucggccuugacugcucucaacgauaugggaaaggugcgaaaggacauucagcagugggaacccucacgcggcuggaaugauuggacccaggucccuuucuguagccaccacuuucaugagcugauaaugaaagacggcagagugcuaguggucccaugccggaaccaagaugaacuuaucgggagggcccgcauuucccagggagcagguuggagucugagagagacagcgugucucggcaagucuuacgcccagauguggagccugauguauuuccaccggagggacuugcgauuagcugccaacgcaaucugcuccgcuguuccgucacauugggugcccacaagucguaccacguggucuauucacgccaaacacgaauggaugacaaccgaggacaugcugacuguauggaauagaguguggauccaggagaacccuuggauggaagauaagacaccagucgagagcugggaagagauacccuaccucgggaaacgcgaagaccaaugguguggaucccuuaucggccugaccucacgggcaacuugggccaagaauauucagaccgcgaucaaccaggugaggagccuaauugguaaugaggaguauacagauuacaugccuucuaugaagagauuucgccgggaagaggaagaggcugggguucugugguga

SEQ ID NO: 14402 - RNA, 9876 nt, Artificial Sequence
  derived and/or modified CDS sequence (opt3) from DENV-2__FJ906969__SS-prME
accgccggcaugaucauuaugcugauacccacagugauggcuuuccaccucacuacgagaaacggggagccucauaugaucgucagcaggcaggaaaagggaaaaucccuucuguuuaagaccgaggacgguguuaauaugugcacauugauggcaauggauuuaggcgaacugugugaggacacuauuaccuacaaaugcccauuccuaaagcaaaacgaaccggaggauaucgacuguuggugcaauucuacaucaaccugggugacuuaugggacauguaccacgacuggagagcaccggcgcgaaaaacgaaguguagcccucgugccccaugucggcaugggucuggagacccguacagaaacuuggaugagcuccgagggggcguggaagcacgcucagagaauugagaccuggauccuuaggcauccuggauuuacaauaauggccgcaauccuggccuacaccauuggcacgacucacuuccagcgggcuuugaucuuuauucuccugacagcaguggccccaucuaugaccaugcgcugcaucggcauaucgaacagagauuucguugaaggggugucaggagguagcugggucgacauugugcuggagcacggcaguuguguaacuacaauggcuaagaauaaacccacccucgauuuugaauuaaucaagacggaggccaaacagccugcgacccugaggaaguauugcauugaagcaaaacuuacaaacacuaccacagacucccgguguccaacucaaggggagcccucuuugaaugaggaacaggauaagcgcuucguuugcaagcauagcaugguggaccgaggauggggcaacgguugugggcuguuuggaaaaggcggcaucgucaccugcgccauguucacaugcaagaaaaauaugaaggggaaaguggugcagccugagaaccuagaauacaccaucgucauuacuccacacuccggagaggaacaugcuguugguaaugauacgggcaagcacgggaaagagauaaagaucacaccgcagucaaguauuaccgaggccgaacucacuggauauggcaccgugacaauggaguguagccccagaaccggucuggacuuuaacgaaaugguacuucugcaaauggagaauaaggcaugguuggugcacaggcagugguuccucgaucugccuuuaccauggcugcccggggcugacacucagggcucuaacuggauccagaaagaaacacucgucacguuuaagaauccucaugccaaaaagcaagacgugguugugcuuggaucccaggagggcgcgaugcacaccgcccugacuggggcaacagagauacagaugucaagcggaaacuugcuauucaccggucaucugaaaugccggcuccguauggauaagcugcaacuuaagggcaugaguuacucuauguguacagggaaauucaaggucgugaaagaaauugcugagacucagcacggaaccaucguaauccgcguucaguaugaaggcgacgguuccccaugcaagauucccuuugagaucauggaucuggagaaaagacauguguuggggaggcucauuacggucaacccgauagugaccgaaaaggacagcccugucaauaucgaggccgaacccccauucggcgauucguacauuaucaucggaguggagccuggccagcugaaguuaaacugguuuaaaaaggggucuuccauuggacaaauguucgaaacaacuaugcggggugcuaaacgaauggccauacugggcgacaccgcaugggauuuugggucacuaggaggcguuuucacaaguaucgguaaggcccuccaccagguguuuggggcuauuuacggcgcggcauucagcggaguauccuggaucaugaaaauucugaucggcgucauaaucacuuggauugggaugaauucucgcagcaccucacuuaguguguccuugguucuggugggagucgugacgcucuaucugggcguaauggugcaggccgacagcgguuguguugucucuuggaagaacaaggagcuuaaaugcgggucaggaaucuuuauuacagauaaugugcacaccuggacugagcaguacaaguuccaacccgaaaguccaagcaaacuggcuuccgccauccagaaggcacaugaggaaggcauaugugguauuagaucugugacaagguuggagaaccucauguggaaacagaucacccccgaacugaaucacauuuuaucggagaacgaggucaagcugacuaucaugaccggcgacauaaaagggaucaugcaggccggaaagcggagccuacaaccucagccaacagaacucaaguauuccuggaaaacguggggcaaggcuaaaaugcugucaaccgagagucauaaucagacuuuucuuauugaugggccggaaacagccgagugccccaacaccaaucgcgcauggaacucuuuggaaguugaggacuacggauucggcguguuuacaacuaauaucuggcugaagcucagagagaaacaggacguguucugugauagcaagcugauguccgcggcuauuaaggacaacagggccguacacgcagauauggguuauuggaucgaaucagccuuaaaugacaccuggaaaauagagaaggcuagcuucauugaagucaaaucuugccacuggccuaagucccauacgcuguggaguaacggggugcuugagagcgagaugaucaucccaaaaaacuuugccggacccguuucucaacacaauuaccguccuggcuaucauacacagaccgcagguccauggcacuugggcaagcucgaaauggauuucgacuuuugugaggggacuaccguggucgugacagaagauugcggaaaccggggccccucccugcgaacuaccacagcuucagggaagcuaauuacggaguggugcuguagaaguugcacccugccgccucucagguaccgcggagaagacggcuguugguacgguauggagauccggccacugaaagagaaggaagagaaucuuguuaacagcuuggugacugccgggcauggacagauugauaauuucucgcugggcguauuagguauggcgcucuuucuggaagagaugcuuagaacaagggucggcaccaaacacgccauacuguugguggcuguguccuucgucacucucaucacagggaacaugucuuuucgcgaccugggacgaguuauggugaugguaggcgcaaccaugacggaugacauugggaugggagugacuuaucuagcccugcucgcugccuucaagguccggcccaccuuugcagcgggccugcuuuugcguaaacugacaagcaaggaauuaaugaugaccacuaucgguauugugcuccugucacaaaguacaaucccugagaccauacuugagcugacagaugcccuagcucucgggaugaugguucugaagauggugagaaaaauggaaaaguaccaguuggccgucacuaucauggcaauucugugcgugcccaaugcuguuaucuuacagaacgccuggaaaguguccuguaccauucucgcagucguaucugugagcccacuguuccuuacguccucacagcaaaaggccgacuggaucccucuggcuuugacaauaaaaggacucaaucccaccgcgauuuuucugacuacccuaagcaggacaaacaagaaacgcaguuggccacugaaugaggccaucauggcaguuggcauggugucuauccuugcuuccagccuccugaagaacgacauuccgaugacuggcccuuuggucgccgggggacuguuaaccgugugcuauguacucacgggucggucggccgaucuggaacuugagagagcugcagacgugaagugggaagaucaggccgagauaucaggcucuagucccauccuguccauuacaaucagcgaggacgggucuaugagcauuaaaaaugaagaggaagagcagaucuugaccauacucaucaggacuggacugcuagucauuuccggccuguucccaguuucaauccccauuacagcggcugccuggugucuuugggaggugaagaaacagcgagcaggugugcucugggaugucccuaguccacccccuguggggaaggccgaacuggaggacggagcuuaccgcaucaaacaaaagggcauauugggcuauagccagauuggggcaggaguuuacaaggaagguaccuuucacacuauguggcauguaacacggggcgccguguuaaugcacaaagggaagagaaucgagccgucuugggcggaugucaaaaaggaccugaucuccuauggaggcgguuggaaacucgaaggggaguggaaggagggagaagaggugcagguucuggcucuugaaccaggcaagaaccccagggccgugcagaccaaaccuggccuguucaagacgaaugcagggacuauuggagccgucucauuggauuucaguccagguaccagcggcucccccaucauagacaaaaaggggaaagugguaggacuauacggcaacggugucgugacacguucuggggcuuacguuucggccauugcacaaaccgagaagagcaucgaagauaacccugagauugaggacgauaucuuucgcaagcggaaacugacaauaauggaccuccauccgggagcuggcaagacuaaaagauaucugcccgccauugugagggaagcgaucaagcgaggccuucggaccuuaauccuggccccaacgcgcgucguggcagcugagauggaagaggcccucagaggguugccuauuagguaccagacacccgcuauccgggcagaacacacuggacgagagauuguugaccugaugugccaugccaccuucacaaugagacuccugucaccagugcgcgucccuaauuauaaccuuauaaucauggaugaggcccacuuuaccgaccccgcuuccauugcggcaagggguuacaucaguacucguguggaaaugggcgaggccgcugggaucuucaugaccgccacaccaccgggaucucgggauccuuuuccccagagcaaugcaccaauuauggacgaagagagagagauacccgaaagguccuggucaucuggccacgaguggguaacggauuucaaagguaagacugugugguuuguuccuagcaucaaggccgggaacgacauugcugcgugucugcgcaaaaauggaaagaaagucauccaauugagucgaaagaccuucgauuccgaauaugugaaaacaagaaccaacgacugggauuuuguggucacuacagacauuagcgagaugggcgccaauuucaaggcagaacggguaaucgauccaaggcgcugcaugaaacccgugauacuaaccgacggcgaggagcguguuauccuggcugggccuaugccggugacgcauucuucagccgcacagagacggggaaggauuggucgcaacccaaagaaugaaaacgaccaguacaucuauaugggcgagccccucgaaaaugaugaggacugugcccacuggaaggaagcuaaaauguuacuggauaacauuaauacuccugaggggaucauacccuccauguuugagccagaacgagagaaggucgacgccauugauggagaauacagacuucggggcgaggcgaggaaaacauucguggaccugaugcgcagaggugaucucccuguuugguuggcauacaggguggccgcugaagggaucaacuaugccgaccggcguuggugcuucgauggcauuaagaauaaccagauccuggaggagaacgucgaaguggagauauggaccaaagaaggagagcgcaagaagcucaaaccccgauggcuggacgcuagaaucuacagugauccacuugcacuaaaggaguuuaaagaauucgccgcuggcaggaagagccugaccuugaauuuaauuacugagauggggcggcugccuacauuuaugacccaaaaagcccgcgacgcacucgauaaccuggcgguacuucauacagccgaagcuggagguagagccuauaaucacgcacugucggagcucccggaaacuuuggagacgcugcuacugcucacccuucuggcuacagugacuggcgggaucuucuuauuuuugaugucuggaaggggcauugguaagaugacccuggggaugugcuguaucauaacagccuccauucuccugugguacgcacagauccagccccacuggaucgccgcuagcauuauccuugaguucuuucugauaguucucuugauuccagaaccugagaagcagcggaccccccaagacaaccagcugacuuaugucgugaucgcgauuuuaacgguggucgccgcaaccauggcuaaugaaaugggcuuccuagagaaaacaaagaaagaccugggacucggcucaaucacuacccagcagccagaaaguaacauacuugauaucgaccugcgaccugccucugccuggacauuguacgcaguugcuaccacuuuugugacacccaugcugagacauuccauugagaauagcucaguaaacgugagucucacggccaucgcgaaucaagcuaccguccugauggggcuuggaaaggguuggccgcucagcaaaauggauauuggcgugccacuguuggccaucgggugcuauucccagguuaacccuauuacucugacagcagccuuauuccuacugguggcucacuacgcaaucauaggacccggccuccaggccaaggcgacccgcgaggcucagaagagggccgcagccgguauuaugaaaaauccaaccgucgacgggaucacaguaaucgaucuugaccccauuccuuacgauccgaaguuugaaaaacaacugggccaggugauguugcugguucucugugugacucagguccugaugaugcggacgaccugggcucuuugcgaggccuuaacacuggcaacuggacccauaucuacccucugggaaggcaacccagggcguuucuggaauacaaccaucgcugugagcauggccaacauuuuuagaggauccuauuuggcgggcgccggucugcuauucucaaucaugaagaauacuacgaacacaaggcgcgggaccggaaauauuggcgagacucugggugaaaaauggaagucucggcucaacgcacuuggcaaaagugaguuccaaaucuacaagaagucggggauacaggaggucgaccgaacccuggcuaaagaaggaaucaagagaggcgagacagaucaucacgccgugagcaggggguccgcaaaauugcgcugguuuguugaacggaacauggugacuccugagggaaagguaguggaccugggcugugguagagggggauggucuuauuacugcggcggucucaaaaauguccgugagguuaagggccugaccaaggggggacccggccaugaagagccuauuccaaugucaacauauggguggaacuuagugaggcuucagagcggagucgauguguucuuuacgcccccugaaaaaugugacacccugcucugcgauaucggcgaguccaguccaaaucccacuguagaagcuggucggacacuacgcgugcugaacuugguugagaauuggcugaacaauaacacccaguucuguauuaaggugcucaauccguacaugccuucugucaucgagaaaauggaagcccuucaacgaaaguaugggggagcccuggugagaaacccauugagcaggaauucaacucacgagauguacugggucuccaacgcgaguggcaauauagugagcucuguuaacaugauuucccggaugcugaucaaucgcuuuacaaugagacacaaaaaggcuaccuacgaacccgacguagaccucggcucagggacgaggaacaucggaauugagagcgaaauaccuaacuuagauaucauugguaagcgaaucgagaaaauuaagcaggagcaugaaaccucguggcacuaugaccaggaucauccauacaaaacaugggcauaucacggcucuuacgagacuaagcagaccgggagugccuccagcauggugaauggagucgugcggcugcuuacaaaacccugggacguugugccgauggucacucaaauggcuaugaccgauacaaccccuuucggccagcagcguguguuuaaggaaaagguagacacuagaacgcaggagcccaaagaagguacaaagaaacugaugaagaucaccgccgaguggcuauggaaagagcucgggaagaaaaagacuccacgcaugugcaccagggaagaguucacacggaaggugagaucaaacgcagcccugggagcuauauuuacggaugaaaauaaauggaaguccgcgcgcgaggccguugaggacucuagguucugggaauuggucgauaaagagcgaaaccugcaccucgaaggcaagugugagaccugcguguauaauaugaugggcaaacgggaaaagaagcuuggggaguuuggaaaagcaaaggguagcagagcuaucugguacauguggcugggcgccagguucuuagaguuugaagcacugggguucuugaacgaggaccauugguucagucgcgaaaauucccucagcggaguggagggcgaaggucugcacaaacuaggguauauucuucgugaugucucuaagaaagagggaggcgccauguacgcugacgacacugccggcugggauacacggaucacccuggaggaccucaagaacgaagagaugguuacuaaucauauggaaggggagcacaagaaacuggcggaagcaauuuuuaaguugacauaccaaaacaaagugguaagagugcagaggccuaccccccgcggaacagucauggauaucauuucacgacgggaccagagagguaguggccaaguggggacuuauggacugaauaccuucacgaacauggaggcccagcucauaaggcagauggagggcgaagguguuuuuaaguccauccagcaucuuaccgugacagaggaaauugcuguccaaaauuggcuggcccgcguggggagagagcgguuaagcaggauggcaaucucuggagaugacugcguaguuaaaccacuggaugaccguuucgcuucggccuugacugcucucaacgauaugggcaaggugcgaaaggacauccagcagugggagcccucacgcggcuggaaugauuggacccaggucccuuuuuguagccaccacuuccaugaacugauuaugaaagacgggagagugcuaguggucccaugccggaaccaagaugagcuuauaggaagggcccgcaucucccagggugcaggcuggagucugagagaaacagcgugucucgggaagucuuacgcccagauguggagccugauguauuuucaccggagggacuugcgauuagcugccaacgcaauuugcuccgcuguuccgucacauugggugcccacuagucguaccacguggucuauccacgccaaacacgaguggaugacaaccgaagacaugcugacuguauggaauagaguguggauucaggagaacccuuggauggaggauaagacaccagucgaaagcugggaggaaauccccuaccucggaaaacgcgaggaccaaugguguggcucccuuauaggucugaccucacgggcaacuugggccaagaauauccagaccgcgauuaaccaggugaggagccuaaucgggaaugaagaguauacagauuacaugccuucuaugaagagauuccgccgggaggaagaggaagcuggaguucugugguga

SEQ ID NO: 14403 - RNA, 9876 nt, Artificial Sequence
  derived and/or modified CDS sequence (opt3) from DENV-2__FJ898454__SS-prME
accgccggcgugaucauuaugcugauacccacagcuauggcauuccaccucacuacgagaaacggggagccucauaugaucgucagcaggcaggaaaagggaaaaucccuucuguuuaagaccgaggacgguguuaauaugugcacauugauggccauggauuuaggcgaacugugugaggacacuauuaccuacaacugcccacuacuccggcaaaaugaaccggaggauaucgacuguuggugcaacucuacaucaaccugggugacuuaugggacauguaccgcgacgggagagcaccgccgagaaaaacguaguguagcucuggugccccaugucggcaugggucuugagacuagaaccgaaacauggaugagcuccgagggggccuggaagcacgcacagaggauugagacuuggauccugcggcauccuggauucaccauaauggccgcuaucuuggcauacacaauuggcaccacguauuuucagcgcgugcucaucuucauucugcugacugccguugcuccaucuaugacaaugagaugcaucggcauaucgaauagggauuuuguggaaggggucucaggagguagcuggguggacauuguacucgagcacggcaguuguguuaccacuauggccaaaaacaagcccacauuagauuucgaacugaucaagaccgaggcgaaacagccugcaacgcuucggaaguacugcauugaagccaaauugaccaauacaacuaccgcuucccgcuguccaacacaaggggagcccucucugaacgaggaacaggacaagcgauuugugugcaaacacagcauggucgauagaggauggggcaaugguugugggcuauucggaaagggcggcaucgugacuugcgccauguuuaccugcaagaaaaacauggaggggaagaucgugcagccugaaaaucucgaguauacaauugucguuaccccacauuccggagaagagaacgcaguggguaaugacacuggcaaacacgggaaggagauaaaaguaacgccgcagucaaguaucacagaagcugagcugaccggauacggcacugugaccauggaauguagccccaggacaggucuugauuucaacgagaugguccuguugcaaauggaaaauaaggccuggcucgugcaucggcagugguuucuggacuuaccucugccauggcuccccggggcggauacccagggcucuaacuggauucagaaagagacucuuguuacauucaagaacccucacgccaagaaacaagacguggucgugcugggaucccaggagggcgcaaugcacacggcuuugaccggggccacugaaauccagaugucaagcggaaaucuacuguuuacaggucaucucaagugccgucugcgcauggacaaacuucaacugaagggcaugaguuauucuauguguaccgggaaauucaagguaguuaaggagauagcugaaacacagcacggaacuauuguggucagagugcaguacgagggcgaugguuccccaugcaaaauccccuucgagaucauggacuuggaaaagaggcauguccucgggcggcugauuaccgugaacccgaucguuacggagaaagauagcccugugaauauugaagccgagcccccauuuggcgacucguacauaaucauuggaguagaaccuggccaguuaaagcugucuugguucaaaaagggguccucaaucggacaaauguuugagaccacaaugcgaggugcaaagcgcauggccauccuaggcgauacugcuugggacuucgggagucucggaggcgucuuuaccagcauugguaaagcgcugcaccagguguucggggcaauauauggcgccgcuuuuuccggaguuucuuggacaaugaagauccuuauuggcguggucaucacuuggauugggaugaacagcagaucaaccaguuuguccgugagccugguacucgugggaguugucacgcuguaccuuggcgugauggugcaggccgauucugguugugucguuucauggaaaaauaaggagcugaaaugcgggaguggaaucuucauaacagacaacgugcauaccuggacugaacaguauaaguuucaacccgagagcccauccaaguuggcaucugccauccagaaagcuuacgaagagggcauuugugguaucaggucggugacacggcucgaaaaucugauguggaagcagauuacccccgaguuaaaccacauccugagcgagaaugaagccaaacuaacuauaaugaccggcgauauuaaggggaucaugcaggcaggaaaacgcucccucagaccucaaccaacagagcugaaguauucauggaaaacguggggcaaggcgaagaugcuuaguaccgaaccgcacaaccagacuuucuugauugacgggcccgagacagcugaaugcccuaauaccaacagggccuggaauucucuggagguagaggauuacggauuuggcgucuucacaacuaacaucuggcucaaacugaaggaacgucaggacguguuuugugacagcaaauuaauguccgcagccauaaagaauaaccgggcuguucaugccgauauggguuauuggaucgagucagcacugaacgacaccuggaaaauugaaaaggcuagcuucaucgaggugaagucuugccacuggccaaaaucccauacgcuuuggaguaauggggucuuggagagcgaaaugauuauccccaagaacuucgccggaccugugucucagcacaauuaccgaccaggcuaccacacacaaaccgcgggucccuggcaucucggcaaacuggagauggauuuugacuucugugaagggacuaccguugugguaacagaggauugcggaaacagaggcccgucccuaaggacuaccacagccucagggaagcugauaacggaauggugcugucgcaguugcacccucccuccacugcgguauagaggagaggacggcuguugguacgguauggagauuaggccccuuaaagaaaaggaggaaaauuuggucaacagccuggugacugcugggcacggacagaucgauaauuuuucguuaggcgugcucgguauggcacuguuccuugaggaaaugcugcgcacacgagucggcaccaagcaugccguuuugcucguggcuguauccuuuaugacucugaucacagggaacaugucuuuccgggaccuaggacgugugauggucauggugggcgccgcaauuaccgaugacaucgggaugggaguuacguaucuggcgcuccuggccgcuuuuaaagugagaccuacuuucgccgcaggccuuuugcugaggaaguuaaccagcaaagagcucaugaugacaaccauugguauaguccugcuuucacagaguacuauccccgagacaauucuggaacuaaccgaugcucucgcccuggggaugaugaucuugaagauugugcgcaauauggagaaauaccaacuggcaguuacaaucauggccacuuuaugcgugccaaacgcugucauacuccagaaugcguggaagguauccuguaccauccuggccgugguuucugugagcccucuucuguugacguccucacagcagaaggcagacuggauuccccucgcucugacaaucaaaggacuaaacccaaccgccauuuuucugacuacccuuagccggacaaauaagaaaagaaguuggccgcucaacgaagccaucauggcugucggcauggugucuauacuggcauccagcuugcugaagaaugauauuccuaugacuggccccuuaguagccgggggacuccugaccgugugcuauguccuuacggguaggucggcggaccuggaguuggaacgagcugccgacguucgcugggaggaucaagcagagaucucaggcucuaguccaauccucuccauuacaauaagcgaagacgggucuaugagcaucaaaaacgaggaagaggagcagacccugacuauucuaauccggacaggacugcuugugauuuccggccucuuccccgugucaaucccuauaaccgccgcugcaugguaccugugggaagucaagaaacagagagccgguguguugugggauguuccaagucccccuccgguagggaaggcggaguuagaagacggagcuuauaggaucaagcagaaaggcauucugggcuacagccaaaucggggccggaguguacaaggaggguacuuuucacacaauguggcaugucacccguggcgcagugcucaugcacaaagggaagcgcauugaaccaucuugggccgauguucggaaagaccugaucuccuauggaggcgguuggaagcuugagggggaguggaaggaaggagaggaagugcagguccuggcuuuggagcccggcaaaaacccuagagccgugcagacgaagccaggccuauucaaaacuaauaccgggacaauaggagcaguaucacuggauuuuagucccgguaccagcggcuccccuauugucgacaagaaagggaaggugguuggacucuacggcaacgguguggucacaaggucugggacuuaugugucggcuaucgcccagaccgaaaagagcaucgaggauaauccggagauugaagacgauaucuuccgaaaaaagcggcugacgauaauggaccuucaccccggagcgggcaaaacaaagcgcuacuuaccagccauuguuagagaggcaaucaaaaggggccugcggacucucauuuuggcuccuacccgaguggucgccgcugaaauggaggaagcacugagagggcuccccauccgcuaucaaacaccagccauaagggccgagcauaccggacgugagauuguggaucugaugugucacgcuacuuucaccaugcggcuucugucaccuguaagagugcccaacuacaauuugaucaucauggacgaagcgcauuuuacagacccagcauccauugccgcuagggguuauaucaguacgcgcguugagaugggcgaagccgcagggauuuucaugacugccaccccgccuggaucucgagaucccuuuccacagagcaacgcucccauaauggacgaggagagagaaaucccugagcgguccuggaauucaggccacgaaugggucacagauuucaaggguaagaccgugugguuugugccaucuauuaaagcggggaacgacaucgccgcaugccuaaggaagaauggaaaaaaggucauccagcugagccgcaaaacuuucgauagugaguacauuaagacacguaccaacgacugggauuuuguagugacgacugacauauccgaaaugggcgcuaauuucaaggccgagagaguuaucgauccccggagguguaugaaaccugugauucucacagacggcgaggaacgcgucaucuuagcagggccgaugccagugacccauagcucugccgcucaacgaagaggacggauugguaggaaccccaagaaugagaacgaucaguacaucuauaugggcgaaccucuggagaaugacgaagacugcgcccacuggaaagaggcgaagaugcuucuggauaacauaaacacccccgaggggaucauuccaucaauguuugaaccugagcgcgaaaaaguugacgcaaucgauggagaguacagacucaggggcgaagcccggaagacuuucguggacuugaugcgucgcggugaucugcccgucuggcucgcuuaucgaguggccgcugaggggauuaauuacgcagacagaaggugguguuuugauggcaucaaaaacaaucagauacuggaggaaaacguagagguggaaauuuggacaaaggagggagagcggaagaaacuuaagccacgcuggcuagacgccagaaucuauuccgauccucuggcuuugaaagaauucaaggaguucgccgcaggcaggaaaaguuuaacccugaaucucauuacagaaauggggcggcugccgacuuuuaugacgcagaaggcgcgaaacgcccuugacaaucuggcuguucuccacaccgccgaggcaggagguagagcuuacaaccaugccuugagcgaacugcccgagacacuagagacucugcuccuucugaccuuauuggcaacagucaccggcgggaucuuccuguuucucaugucgggaaagggcauagguaaaaugacucuggggaugugcugcaucauuacggccucuauccuucugugguaugcucaaauucagccacacuggaucgcggccuccauaauucucgaauucuuuuugaucgugcuguuaaucccugagcccgaaaagcagcgcaccccacaggauaaucaacuaacauacguggucauugcaauccugacuguuguggcugccaccauggccaacgagaugggcuuccucgaaaaaacaaagagggacuuuggacuuggcagcauagcaacccagcagccugagucaaauauucuggauaucgacuugcggcccgcuagugccuggacucuguacgcgguagcuacaacguucauuaccccgaugcuccgucauucuaucgagaacuccagcgugaaugucucacugacugccauagcaaaccaggccacagugcuuauggggcucggaaaagguuggccacugaguaagauggacaucggcguuccuuugcuggcuauuggguguuauagccaagugaaucccaucaccuuaaccgcagcccuacugcuccuugucgcgcacuacgcuauuaucggaccaggccugcaggccaaggcaacaagagaagcccagaaaagggcugccgcagguauuaugaagaaccccacuguagaugggaucacggugauagacuuggauccuauuccguaugaccccaaauuugagaagcagcugggccaaguuaugcuccuggugcuuugcgucacccagguguuaaugaugcgcacaacuugggcucugugugaagcccucaccuuggcgacaggaccaaucuccacccugugggagggcaauccugggcgguucuggaacacuacgaucgccgucucuauggcaaacauuuuucgaggaagcuaccuagcuggcgccggucugcucuucuccauaaugaaaaauacaaccaacacuagaagggggaccggaaauacaggcgaaacucuuggugagaaguggaagaaccgccugaauucauugggcaaaucugaguuucagaucuauaagcggagugggauucaagaaguggauagaacccuggcaaaagagggaaucaagcguggcgaaacagaccaccaugcuguuucgagggggagcgccaaacuccggugguucguggagcgcaaccugguaacgcccgagggaaagguggucgauuuaggcugcggucgagggggaugguccuacuauuguggcggucuuaaaaauguuagagaagugaagggccugaccaaggggggaccuggccacgaggaaccaauucccaugucuacuuacggguggaaccucgucaggcuacagucaggaguggacguauucuuuacaccuccagagaaaugcgauacccuguugugugacaucggcgaaagcucccccaauccgacuguggaggccggucggacacugcgcguucucaaccuuguggagaauuggcugaacaauaacacccaguucugcauaaaggucuugaauccuuacaugccaagugugaucgaaaaaauggagacgcugcagagaaaguaugggggagcgcucgucaggaaccccuuaucucgaaacagcacccaugaaauguacugggugucaaaugcuuccggcaacauuguuaguagcguaaauaugaucucucggaugcugauuaaccguuuuacaaugagacacaaaaaggcaacuuaugagccugauguggaccuuggcuccgggacccgcaauaucggaauagaaucagagacaccaaaccuggauauuaucgguaagaggaucgagaaaauuaagcaagaacaugagacuagcuggcacuacgaccaggaccaccccuauaaaaccugggccuaccauggcucguaugaaacaaagcagaccgggucugcuaguuccauggucaauggagugguucggcuacucacuaaaccgugggaugugauaccuauggucacgcagauggccaugacagacaccacucccuucggccaacagagaguguuuaaggagaagguagauacccgcacacaggaaccaaaagaggguacgaagaaacugaugaagaucaccgcagagugguuguggaaagaacuggggaagaagaaaacuccuaggauguguacacgagaggaauucacccggaaggugagaagcaacgccgcucucggagcgauuuuuacugacgagaauaaauggaagucagccagggaggcaguugaagauucccgcuucugggagcuugucgacaaagaacguaaccugcacuuagagggcaagugcgaaacauguguguacaauaugaugggcaaacgggagaagaagaucggggaguuuggaaaagcuaaggguucuagagccauuugguacauguggcugggcgcaagguucuuggaauuugaggcccucggguuccugaacgaagaucauugguuuagccgcgagaauagucuauccggaguggaaggcgagggucuucacaaacugggguauauccuccgagaggucagcaagaaagaaggaggcgcuauguacgccgacgauaccgcgggcugggacacacggauaacucuggaggauuugaagaacgaagagaugguuaccaaucacauggaaggggagcauaagaaacuggcagaggccaucuucaagcucacguaucagaacaaagugguaagagugcaaaggcccaccccacgcggaacagucauggacauuaucucuagacgggaccagagggguucaggccagguggggacuuacggacuuaacaccuucacaaauaugggcgcucaacugauucgucagauggaaggugaggggguuuuuaagggaauccagcacuuaacugccaccgaagagguggcaguccaggauuggcuggcucgagugggccgcgagagauugagucggauggccauuuccggcgacgauugcguaguuaaaccccucgacgauagguucgcuagcgcccugacggcacuaaacgacauggggaagauacgcaaggauauccaacagugggaaccuucuagaggauggaaugacuggacacaggugccauuuugcucgcaucacuuccaugagcuuauuaugaaagauggucggguccugguggugccguguaggaaccaggacgaacucaucggccgagcgcguaucucacaaggggccggauggagccugagagagaccgcuugcuugggcaaguccuaugcccagauguggaguuuaauguacuuucaccgccgggaucugaggcucgcagcuaaugccauuuguucugcaguccccagccacuggguuccuacuuccagaacaaccuggucaauacaugcccgccacgaauggaugacuaccgaggacaugcuuacaguguggaaccggguauggauccaggagaauccauggauggaagauaaaacgcccguggagaguugggaagagauuccuuaucuggguaagagggaagaccaguggugcgggucucuaaucggacugaccagccgagcgacuugggcuaaaaacauucaaacagccaucaaucaggucagaucccucauaggcucagaggaguacaccgacuacaugccaagcaugaagcgguucaggcgcgaagaggaagaggcaggcguguugugguga

SEQ ID NO: 14404 - RNA, 9876 nt, Artificial Sequence
  derived and/or modified CDS sequence (opt3) from DENV-2__JQ922551__SS-prME
accgugggcaugaucauuaugcugauacccacggcaauggcuuuccaccucacuacgcgaaacggggagccucauaugaucgucagcaggcaggaaaagggaaaaucccuucuguuuaagaccgaggacgguguuaauaugugcacauugauggcaauggauuuaggcgaacugugugaggacacuauuaccuacaacugcccacuacucaaacaaaaugaaccggaggauaucgacuguuggugcaacucuacaucaaccugggugacuuaugggacauguaccgcaacgggagagcaccggcgcgaaaagcgaaguguagcgcuggugccccaugucggcaugggucuugagacucguaccgaaacauggaugagcuccgagggggcuugcaaacacgcccagaggauugagacuuggauccugaggcauccuucuuucaccauaauggcagccaucuuggcuuacacaauuggaaccacguauuuucagcgggugguuuuccucauggugcugacugcagucgcccugucgaugacaaugcgcuguaucggcauuucaaauagagauuuuguggaaggcguaagcgggggaaguuggguugacaucgugcucgagcacgguuccugcgucaccacuauggcuaagaacaagccaacauuagauuucgaacugauaaaaaccgaggccaagcagcccgcgacgcuuaggaaauacuguauugaagcaaaguugaccaauacaacuaccgccucucggugcccuacacaaggcgagccaagccugaacgaggaacaggacaaacgcuuugugcgaaagcacuccaugguggauagaggguggggaaauggcuguggucuauucgggaagggaggcaucgucacuugcgcuauguuuaccugcaaaaagaacauggagggcaaaauuguucagcccgaaaaucucgaguauacacuggugaucaccccucauucaggggaagagaacgccguaggaaaugacacugguaaccacggcaaggagaucaaagugacgccacagaguagcauuacagaagcagcucuuaccggguacggaacugucaccauggaguguucuccgaggacaggccugaauuuccaugaaaugguguccuugcccauggagaacaaggccuggaugguucaccggcaaugguuucucgaucugccuuuaccauggcugcccggugcggacacccaggggucaaacuggauacagaaagaaacucucgugacauucaagaauccucacgccaagaaacaggaugucgugguacuuggcagccaagagggagcaaugcauacggcucugaccggcgccacugagauccagaugaguucugggaacuugcuauuuacaggacaccugaagugccgucuccgcauggacaaacugcagcuuaaggguauguccuauagcauguguaccggcaaauucaagguugugugggggauugcuagaacacaacauggaacuaucguccacagggugcaguacgaaggcgacgguucgccaugcaagauaccccugaauauuaugggguuggagaaacggcauguccucggccgaccgaucaccgugaacccuaucguuacgggaaaggauucucccgugaauauugaagccgagccaccucugggcgacuccuacaucauuauagggguagagcccggacaggucaaauuaaccuguucacagaaggguaguagcaucggccaaauguucgaaacaacuaugcgcggggcaaaaagaauggccauucugggagauaccgcuugggacuuuggcucccuaggugggguguucacaucuaucggcaaggcgcuccaccagguuuuuggagcaaucuauggcgccgcuuucagcggggugucauggacuaugaagauucugauaggagucgugaucaccuggauuggcaugaacaguagguccacgagccuuucuguaucauuggugcugguuggugucgugacacucuaccugggggugaugguccaggccgauaguggaugcguugugagcuggaaaaauaaggagcuuaaauguggcuccgguaucuuugugaccgacaacguacacacuuggacagaacaguauaaguuccaaccagagucucccucgaaacuggcaagcgccauucagaaggcucaugaagagggcaucugcgggauacgguccgucacccgcuuggagaaucucauguggaagcagaucacuccugaacugaaccacauuuuaucagagaaugaagugaaacugaccaucaugacaggagauauuaagggcaucaugcaggccgggaaaagaagucuaaggccacaaccgacggagcucaaguacucuuggaaaaccuggggaaaggcaaaaaugcugagcacugaaccccauaaccagacauuucuuauagacggcccugagaccgcggaguguccauccacaaaucgugcuuggaacucauugaaggguggggauuauggauucggcguuuuuacuaccaauauuuggcugaagcucaaagaacggcaggacgugagcugcgauucuaagcugauguccgccgcaaucaaagacaaccgagccguccacgcugacauggguuacuggauugagagugccuuaaacgauacguggaagaucgaaaaagccagcuucauagaggugaagucuugucacuggcccaagucccauacacuguggucaaauggcguucuugaaagugagaugaucauuccuaaaaacuuggcugggccagugagccagcacaauuauagacccggauaccauacccaaacugccggcccguggcaccucgggaagcuggagauggacuuugaucuaugcgaaggaaccacaguagucgugacugaggacugcggcaacagggguccuucgcugcgcaccacaacggcguccgggaaacucaucaccgaaugguguugccggucuuguacucugccaccccuuagauacaggggagaggauggcugcugguaugguauggagauucgcccuuugaaggaaaaagaggaaaaucuggugaacagcuuagucacagccgagcaugaacagaucgacaauuucucacucggcguucuggggauggcucuuuuucuggaggagauguugcgaacccgggugggaacuaagcacgcaguacuccugguggccgucaguuucaugacacuaauaaccggcaacauguccuuccgugaucuggggagagugaugguuauggugggagcugccaugacggacgauauuggcaugggugucacuuaccucgcacugcuugcggccuuuaaggugaggcccaccuucgcugccggguugcuguuacgcaaacucacaucuaaggaacugaugaugaccacuaucggaaucguucuucugagccaguccacaauuccagagaccauccuagaacucacagacgcacuggcuuugggcaugaugauucugaaaauagugcggaauauggagaaguaucaauuagccgucacuaucauggcaauucucuguguaccuaacgccaugauccugcagaaugcuuggaaagugucaugcaccauucuugcgguugugagcgucaguccccuguugcucacgucuucccagcagaaggccgauuggaucccacuggcacuaacaauaaagggccugaacccgaccgcuaucuuucuuacuacccucagcagaacaaauaaaaagaggucguggccucugaacgaagccauuauggccguggggaugguaucaaucuuggcuucuagucugcuaaagaaugacauucccaugacuggaccacucguggccgguggccugcuuaccgucuguuaccuguugcccgggcgauccgccgaucucgagcuggagcgcgcggcugaccuacggugggaagaccaagccgagaucagcggaucuagcccuauacuguccauuacgaucucagaagauggcaguaugagcaucaagaaccaggaggaaaaacagacacuuaccauucucauaaagacuggucuguugguuaucucugaguuauucccagugcagauucccaucacagcagccgcuugguaucugugggaggugaaaaagcaaagagcagggguccucugggacgugccuuccccgccacccguuggaaaggccgaacuggaggauggcgcguacggcauuaaacagaaggggauccuuggauauucacagauaggugcuggcguauacaaagaagggaccuuucacacuauguggcaugugacaaggggagccguccugaugcacaagggcaaacguaucgagccuaguugggcagacgugcgcaaggauuugauuagcuacggugggggauggaagcuagagggcgaauggaaagagggcgaagagguucaggugcuggcccucgaaccagggaagaacccccgggcuguccaaaccagaccuggacuguucaaaacgaauacugguaccaucggcgccgugucccuugacuuuucuccggggacaucgggaagccccauuguagauaagaaaggcaaggucguggguuuauaugggaacggaguugugaccaggucaggcacauacgucuccgcaaucgcucagacugagaagaguauagaggacaauccagaaauugaggaugacaucuuccggaaaaagagacugaccaucauggaucuccauccuggcgccgggaaaacgaagcgcuauuugcccgcgauugugagagaagccaucaaaaggggacugcggacacucauacuggcaccaacucgaguuguggcugccgagauggaagaggcucuuagaggucugccuauucgcuaccagacccccgcaaucagggccgagcacacaggccgugaaauugucgacuugaugugccaugccaccuuuacuaugcggcuacugucuccagugagaguaccgaacuauaaucucaucauaauggaugaggcucacuucaccgacccugcgagcauugcagccaggggguacaucuccacacgcguggaaaugggagaggcugccggcaucuuuaugacggcaacucccccagguucacgagaccccuucccucaaucuaacgccccaauuauggaugaagagagagagauccccgaacggagcuggaauagugggcacgaguggguuaccgacuuuaagggaaagacagucugguucgugccuuccauuaaagcuggcaacgauauagcggccuguuuaaggaagaauggcaaaaaggugauccagcugagccgcaaaaccuucgacucugaauauauuaagacucguacaaacgauugggacuuugucguaaccacggauaucucagagaugggggcaaauuucaaggcugagagagugaucgacccgcggaggugcaugaaaccaguuauucuuacugauggagaggaacgcgugauacuggccggucccaugccugucacacauuccagugcagcccagcgaagaggccggaucgggaggaaccccaagaaugaaaacgaccaguacauuuacaugggagagccacucgaaaaugaugaggacugugcucacuggaaagaggccaagauguugcuggacaacaucaacaccccugaaggcauuauccccagcauguuugagccagaacgcgagaaaguggaugcgauagacggugaauauagacucagaggggaagcacggaagaccuucguugaucugaugcgucgcggcgaccuuccuguguggcuagccuaccgagucgcugccgagggaaucaauuaugcugauagaagguggugcuuugacggcauuaaaaacaaucaaauccuggaagagaacguggaaguagagauuuggacuaaggaaggggagaagaaaaaguugaaaccgcggugguuagaugcacgcaucuacucggacccccuggcccucaaggaguucaaagaauuugcugccggaagaaagucucugacacuuaaucugauaaccgagauggguaggcucccaacauucaugacucagaaggcacggaacgcguuggauaaucuggccgugcuacauacggcugaagccggcgggcgagcauauaaccacgcucuguccgagcucccugagacccuugaaacacuguuauugcugacucuccuggccaccguuacaggaggcauuuuucuuuuccugaugagcgguaaagggaucggcaagaugacccucggaaugugcuguauuaucacugcaucaauauugcugugguacgcccagauccagccccacuggauugcugcgaguaucauuuuagaguuuuuccuaaucguccugcucauaccagaaccugagaaacaaagaacgccccaggacaaucagcuuaccuauguggugauugccauccugacagcagucgcugccacuauggccaacgaaaugggcuucuuggagaagaccaaaaaggauuuugggcugggaucuaucgcaacacagccgccagaguccaauauucucgacaucgaucugcgcccugcuagcgccuggacccuuuacgcgguugcuacuacauucauaacgucaaugcucaggcauaguauugaaaacagcuccgugaauguaucucugaccgccaucgcaaaccaagccacuguguugaugggucugggcaagggguggcccuuaagcaaaauggacauuggagucccacuacuggcuaucggcugcuacucccaggugaaucccauaacacucaccgcagcccuucuguugcugguugcgcacuaugcuaucauugguccugggcuccaggccaaggcaacccgggaggcccagaaacgugcugccgcaggcaucaugaagaacccgacaguggacggaauuacugucaucgaucuggaccccauuccauacgauccuaaauuugaaaagcaacuuggccagguaauguuacuggugcucuguguuacacagguguugaugaugagaaccacaugggcucugugcgaggcccuaacucuggcgaccgggcccaucucaacacucugggaaggaaauccuggcagguucuggaacaccacuauagccgucucuauggcaaacauuuuucgcgguaguuaucuugcuggggccggacuguuguucucgaucaugaagaauacgacaaacacccggcgaggcacugguaauaccggcgagacacugggggagaaauggaagaacagacucaaugcacugggaaaaagcgaauuucaaaucuacaagaaauccggcauucaggagguggacaggacuuuagcuaaggaagggauaaaacgcggagagaccgaucaucacgccgucucucggggcucagccaaacuuagaugguucguggaacguaaccugguuacaccagaggguaaggugguagaccucggguguggaaggggcgguuggagcuauuacugcggcgggcugaaaaaugugcgggaggucaagggauuaacgaaaggcgggcccggacaugaggagccuaucccaauguccaccuauggcuggaacuugguucgccugcagagugguguggaugucuuuuucacucccccggaaaagugugacacacuccuuugcgauauuggggagucuagcccuaauccaaccguggaggcgggacgaacucugagaguauugaaccugguggaaaauuggcucaacaauaacacacaguuuuguguuaaaguguuaaaucccuacaugccuucagucaucgagaagauggaaacccugcaaaggaaguacggcggcgcucuugugcggaacccacugucccgcaacaguacgcacgagauguauugggucagcaaugcaucugggaacauuguguccucaguuaauaugaucagcagaaugcuaauaaacagguucaccaugcgacacaaaaaggccacauacgaacccgacguagaucucggaucggguacucggaauaucggcauugagucugagaccccgaaccuggacaucauugggaaacguaucgaaaagauaaaacaggagcaugaaacaaguuggcacuaugaucaggaccauccuuacaagacuugggcuuaucacggauccuacgagaccaagcagacaggcagcgccucauccauggugaauggugucgugagauugcugaccaaacccugggacguuauuccaauggugacucaaauggcaaugacggauacaaccccuuuugggcagcagcgcgucuucaaggaaaaaucugacacuaggacccaggagcccaaggagggaaccaaaaagcucaugaagaucacgccaaaauggcuuuggaaggaacugggcaaaaagaaaacaccccggaugugcacuagagaggaguucacacgcaaggugaggagcaacgccgcuuuaggcgcgaucuuuaccgaugagaauaaauggaagagugcccgagaagcaguagaggacucccgguucugggagcugguggauaaggaaagaaacuugcaccucgaggggaaaugugaaacuugcguuuauaauaugaugggaaagagggagaaaaagcugggugaguuuggcaaagcuaaggggagccgcgccauuugguacauguggcuaggagcacguuuccuugaauuugaggcccugggcuuccucaacgaagaccauugguuuucucgggaaaauucacugaguggugucgaaggggagggauugcacaagcugggcuacauacucagagauguguccaaaaaggagggcggggcuauguaugccgacgauacagcgggaugggacaccaggaucacacuugaagaucugaaaaacgaggaaaugggugcaaaucauuuagagggcgaaccuaagaaacuguacgaggccauuuucaaguugacuuaucaaaacaagggggugcgcguccagcgaccaaccccgcggggaccccucauggacaucauucugagaagggaccagggcgguagcgggcaaguuggaacguacggccuaaacaccuuuacaaauaugggcgcucagcuuauccgccagauggagggggaaggaguguucaaagguauacagcaccugaucgccacugaggaaauugcaguacaagauuggcucgcuagagugggccgggagagguuuucucguauggccaucucgggggacgauugcgucgugaagccucuggacgaucgauucgcuucagccuugaccgcauuaaacgacaugggaaaagaacgcaagguucugcagcagugggagccaagcagagaguggaaugauuggacacaggugcccuuuuguucccaucacuuccacgaacucauuaugaaagacggccggguccuugugguaccuugcaggaaccaagaugagcugaucggucgcgcgagaauuagucagggggccggauggucucuacgggaaacugcuugucugggcaagagcuaugcccagauguggucccagauguacuuccauaggcgagaccuccguuuggcagcuaaugccauaugcucagcaguuccaagucacugggugcccaccucuagaacgacauggagcauccaugcccgccacgaguggaugaccacugaggauaugcugacagucuggaaccggguguggauucaagaaaauccuuggauggaggacaagaccccgguggaauccugggaggaaaucccauaucuuggcaaaagggaggaucaguggugugggucacugaucggacucacuagcagagcgaccugggcuaagaacauucagacagccauaaaucagguccgcucuuuaaucgguaacgaggaauacacggacuacaugcccuccaugaaacgguuuaggcgagaggaagaggaagcaggcguucugugguga

SEQ ID NO: 14405 - RNA, 9876 nt, Artificial Sequence
  derived and/or modified CDS sequence (opt3) from DENV-2__JQ922550__SS-prME
accgugggaaugaucauuaugcugauacccacagucauggccagccaccucacuacgagaaacggugggccucauaugaucguuauugggcagcaaaagaggaaaaccuccuucuuuaagaccaagaagggccacgacaugugcacucuuauggcuauggcauucggggaguuuugugaaaauaccaucacauacaaaugcccauuccugaagcagaacgagccggaagauauugacuguuggugcaauucuaccucaacuugggugacauauggaaccuguacgacuaccggcgagcaucggcgcgaaaagcgaaguguagccuuggugccccacgucgguaugggguuagagacacguacugagaccuggaugagcuccgaaggagcguggaaacaugcucagagaaucgagacauggauacugaggcacccuggcuuuaccaucauggccgcaauucuagccuacacgaucggcacuacacacuuccagcgggugcucauuuuuauccugcuuaccgcuauagcaccaucuaugacuaugcgcugcauugggaucucgaacagagauuucguugaaggagugucagguggcagcugggucgacauugugcuggagcaugggaguuguguaacaaccauggccaagaauaaacccacguuggauuuugagcucaucaagaccgaagcuaaacaaccugccacacugaggaaguauugcaucgaggcgaagcugacuaacaccacaacugacucccgguguccaacccagggagaacccacacucaaugaggaacaggauaaacgcuucguuugcaagcacucuaugguggaccgaggcugggguaacggguguggauuauuuggcaaaggcgggauugucacaugcgcaauguucacuugcaagaaaaauaugaagggaaaaauagugcagccugagaaccuggaguacacgguggucaucacaccacauagcggugaagaacacgccguuggcaaugauaccgggaagcacggaaaggaagugaaaauuacuccgcaauccucaaucaccgaggcugaacuuacaggcuaugguaccguaacuauggaguguagucccagaacaggguuggacuuuaacgagauggugcugcuacagauggaagauaaggccuggcucguccauaggcagugguuccuggaccuuccucugccaugguugcccggcgcagauacgcagggaagcaauuggauacaaaaagagacccucgugacuuucaagaacccucacgcuaaaaagcaggacguugugguccugggcucucaggaaggggccaugcauacagcguuaaccggagccacagagauucaaauguccucagguaaucugcucuuuacuggccaccuuaagugccggcugcguauggacaaauugcagcuaaaggggaugagcuacaguauguguaccggaaaauucaaggugguaaaagaaaucgcagagacgcagcauggcaccaucguuauucgcgugcaguaugagggugaugggucuccaugcaagauccccuuugaaauuaaggaccuggagaaaagacacguccucggcaggcugauaacagugaacccgaucgucacugaaaaggauuccccugugaacauugaggcugagcccccacuuggagacagcuacaucaucauuggcguugaaccugggcaacugaaauuggauugguucaagaaaggaucgucuauaggucagauguuugagaauaccaugcggggcgccaagcgaauggcuauccucggggacacagccugggauuucggaucccugggcgguguguuuacuucaauugggaaggcauuacaccagguauucggcgccaucuacggagcugcguuuaguggcgucagcuggaccaugaaaauucugaucggggugauaaucacguggauuggaaugaacucccgcucuacaagccuaucaguuagucucgugcuggucggcaucgugacccuuuauuuggguguaauggugcaggcagacuccggguguggaggcugcgaaagaaagacuaaaacaaagugugguagcggcauuuucguuaccgauaauguccauacuuggaccgagcaauacaaauuucagcccgaaucuccaucaaagcuggccagugcuauccagaaagcccacgaggaggggauaugcggaauuaggagcgugacacggcucgaaaaccugauguggaagcagaucacgcccgagcuuaaucauauucuguccgaaaacgaggugaaguugaccaucaugacuggcgacauaaaagggaucaugcaagcaggaaagcgcucucucagaccucagccaacagaacugagguauucguggaaaaccuggggcaaggccaaaauguuaagcacagagcugcacaaucagacuuuccuaauugaugguccggagaccgcugaaugucccaacacgaaucgugccuggaacucccucgaggucgaagacuacggguuuggaguuuucacaaccaauaucuggcugcggcuucgagagaagcaggacguguucugcgauucaaaguugaugagugcagcgauuaaagacaacagagcugugcacgccgauaugggcuauuggaucgaaucugcacugaaugacacuuggaagauagagaaagccagcuuuauugagguaaaguccugucauuggccuaaaucacacacccucugggguaacggcguccuggaaagcgagauggugaucccaaagaauuucgcugggcccguuucucaacauaacaacaggccuggauacuauacacagacugccggcccauggcacuuagggaagcuggaaauggauuuugacuucugcgagggaaccacaguggucgugacggaggauugcggcaaucgcggucccucccuucggaccacuacagcaagugggaaauugaucaccgaaugguguugcagaagcuguacucucccgccuccaaaguacaggggagaggacggcugcugguacgguauggaaauucgcccccugaaagagaaggaagagaaccuaguuucuucccuggugacagcuggccaugggcagaucgauaauuuuucacucggcauucugggcauggcccuuuucuuggaggaaaugcugcgaacccggguagggacgaaacacgcgauauuacucgucgccgugaguuuugugacucugaucaccggaaacaugagcuuccgugaccuuggcagagucaugguuauggugggugcuacaaugaccgaugacauugggaugggaguaacuuaucuggcauugcucgccgcuuuuaaggugaggccuacauucgccgcaggccugcuacugcgcaagcucaccucgaaagagcugaugaugacaacuaucggcauuguccuuuccucucaaagcucaauccccgaaaccauauuggagcugacggaugcguuagcccucgggaugauggugcugaagaugguucggaauauggaaaaauaccagcuugcugugacaaucauggccauucugugugucccaaacgcagugauccuacagaaugcuuggaagguuaguugcaccauucucgccguggucuccguaucuccucuguugcugacuagcucccagcaaaaagcagacuggauccccuuagcccucaccauaaagggacugaacccaacagcuauuuuucuuacuacccugucagguacgagcaaaagaaggaguuggccguugaaugaggcgaucauggccgugggcaugguuucuauccucgcauccagccugcuaaagaacgacauuccuaugacagggccccugguggcuggaggccuucucaccgucuguuaugugcugacuggucgaucggccgauuuggagcuggaacgcgccacagacguaaagugggaugaccaggcugagauaucagggucuaguccaaucuuauccauuaccaucagcgaagauggaucuaugagcauuaaaaaugaggaagaggagcagacucucacaauccugauacggaccggccuucuggugaucuccggcuuguuccccgucucaauuccuaucacggcagccgcgugguaccucugggaaguuaagaaacagagagcuggggugcugugggacgugccaagucccccucuagucggaaaggccgagcuggaagauggugcauauaggauuaaacaaaagggcauccuuggguacagccagauaggagccggcguguauaaggaggguacuuuucacaccauguggcauguuacacguggggcuguacucaugcacaaaggaaagcgcauugagccgucuugggcagacgugaaaaaggaucugaucuccuacggcggcggguggaaauuggaaggagaguggaaggaaggugaggaaguccagguguuagcccuggagccaggcaagaacccccgggcgguucagaccaaaccuggacucuucagaacaaauacuggaaccaucggcgcugugucacuggacuucaguccagguacgagcgggucccccauugucgauaagaaaggaaaggugguaggccuuuacggcaacggggucgugacaaggucuggagccuauguuucggcaaucgcccaaacugagaaaagcauagaagacaauccugagauugaagaugacaucuuucgaaagcggcgccugaccauuauggacuugcauccgggugcuggcaagacaaaaagauaccuacccgccaucgugagggaggcaauaaagcgggggcugcgaacccucauucuggcuccaacuagagucguggccgcggaaauggaggaggcccuucgcggauuaccuaucagguaucagacccccgcaauccgugcugaacacacaggccgggagauuguugaucugaugugccaugccacguucacuaugagacucuugucaccaaucagggugccuaacuacaaccugauuauaauggacgaagcucacuuuaccgaucccgcauccaucgccgcccgcgguuauauuaguacacgagucgagaugggggaagcugcgggaaucuucaugaccgcaacuccaccgggcucuagagacccuuuuccccagagcaaugccccaaucauggaugaggagcgggaaauucccgagagguccuggaacucaggccacgaaugggugacagacuucaaagggaagaccguaugguuugugccuucuauaaaaacgggaaaugauaucgcugccugucuccgcaagaacgguaagcguguuauucaacugagcagaaaaacuuucgacagugaguacgucaagacacggaccaaugauugggacuuuguggugaccacugauaucuccgagaugggcgcaaacuucaaagccgaaagggucauugacccacgccgaugcaugaagcccguaauccuuacagacggggaggaaagagugauacuggcuggaccuaugccgguuacccauagcucugcggcccagcggaggggccgcaucgguagaaaucccaaaaacgagaaugaucaguauauuuacaugggggaacccuuggagaacgacgaggauugugcacacuggaaggaagcuaaaaugcuacuggacaauaucaacacaccugagggcauuauccccucaauguuugaaccagagagggaaaagguggaugccauagacggagaguaccggcuccguggcgaggcacgcaagacuuuacuggaacuuauucgagggggaccuauccccgucuaucuggguuacaaauggccaggcgaggggauuaauuaugccgauuccagacucugcgugggaaggacgcagaacaaucaaaucuuggaagagaacguugaaguggagauauggaccaaggagggcaaagguaagaaacugaagccucgguggcucgacgcucgcaucuacagugauccgcuggcccuuaaggaguucaaagaguucgcggcagggagaaagagccuaacacugaacuugauuacugaaaugggcagguuacccaccuuuaugacacagaaagcccgggacgcucuggauaaucucgccguccugcauaccgcugaggcaggaggcaaggccuauaaccacgcucuuucggagcugccagaaacucucgagacguugcugcuacugacccuccuugccacagugacugggggaaucuuccuguuuuuaaugucuggucgaggcauugggaaaaugaccuugggaaugugcuguaucauaacagcauccauucugcucugguacgcgcagauccagccucacuggaucgccgcuagcauuauccuggaguucuuucuuauaguacugcucauucccgagccagaaaagcaaagaaccccucaggacaaucaguugacuuaugugaucauugccauccugacaguugucgcagcuacgauggccaacgagaugggcuucuuagagaagaccaaaaaggaucuaggucuggggaauauagcaacucagcaacccgaaucaaacauccucgacauugaccuucgcccggccagugcuuggacacuguacgcgguggccaccaccuuuaucacaccaauguugaggcauucuauugaaaauuccagcgugaacgucucacugacugcaaucgcuaaucaggccacgguucucaugggccugggaaaaggcuggccucuuaguaagauggauauuggggugccccuccuggccaucggaugcuacagccagguaaacccaauaaccuugacagcagcucuguuacuacugguggcccacuaugcgauuaucggccccggucuccaggcuaaagccacucgggaagcacaaaagcgugccgcugcagggaucaugaagaauccuaccgucgacggaauuacagugauagaucuugacccgauccccuacgauccaaaauucgagaagcagcugggccagguuauguugcuggugcucugugucacccaaguacugaugaugagaacuacgugggcccuuugcgaagcguuaacacuggcuaccgguccuguguccacucucugggagggcaaccccgggagguuuuggaauaccacaauuuugauccagauggccaacauucugcgcggaucuuaucuagcaggcgccgggccucuguucagcaucauggagaauacuaccggaccacggcgaagaacaggccagcucgguagggaacuucugcgccgguggaaauccagauugaacgcucuggggaagucagaguuucagauauacaaaaagucuggaauccaagaaguugaccguacgcucgccaaagagggcauuaagaggggugaaaccgaucaucacgcagugagucggggcucggcuaagcugcgcugguucgucgagcgaaauuuagugacucccgaggggaaagucguggaccuuggauguggcagagggggauggagcuauuacugcggcggucugaagaacguuagggaagugaaagggcucacaaagggaggcccuggccaugaggaaccaauccccauguccaccuauggguggaaccuaguacggcugcagucuggaguggaugucuuuuucauuccgccugagcgcugugacacuuugcugugcgauaucggugagucaagcccaaaucccacaguugaagccggcagaacccucagggugcuuaaccuggucgagaauugguugaacaauaacacgcaguucuguauaaaagugcugaauccuuacaugccauccguaauugaaaagauggagacccuccagcgaaaguacgggggagcguuagugcggaacccccugagucguaauucuacacacgaaauguauuggguuagcaacgccucaggcaauaucguguccagugucaacaugaucagcagaaugcuuauuaaucgcuuuacuaugaggcacaaaaaggcaaccuacgagccggacguggaucuggguucugggacacggaacauaggaaucgaguccgaaauuccuaaucuagacaucauuggcaaaagaaucgagaagauaaaacaagaacaugagacuucauggcacuaugaccaggaucaucccuacaagaccugggcuuaucacggcagcuacgaaacaaagcagaccgggucggccucuaguauggucaacggagugguucgccuccugacuaaaccaugggacguagugccuauggucacgcagauggcaaugacagauaccacucccuucggucaacagaggguguuuaaggagaaaguugacacccgaauccaggagccaaaggaaggcaccaaaaaguugaugaagauuauggcugaguggcuguggaaagaacucgggaagaaaaagacgccccggaugugcaccagagaggaguucacuaaaaaggugagguccaacgccgcccuuggagcgaucuuuacagaugagaauaaauggaaaagcgcucgcgaggcagucgaagacggccguuucugggagcugguggaucgggaaagaaacuuacaccuggaggguaagugugagaccugcguauauaauaugauggggaaaagggaaaagaaauugggagaguuuggcaaggccaaaggcucacgcgcuauuugguacauguggcucggggcccgauuccuggaauuugaggcacuaggauuccuuaacgaagaccauugguuuucccgggaaaauucucugagcgguguggagggcgaagggcuccacaagcugggauacaucuugagagagguuaguaagaaagaaggcggugccauguaugcugaugacacugcggggugggauacaaggauuacccugggagcccucaagaacgagcgcaaaugcacagaacauauggagggcgagccuagaaagccaggccgggggcacuucaaauggaggaaucaaaaccgugucgugggagugcaggguccgacucccggcgggaccgucauggacauaaucucccgaaagaaucagcgcggaagcggccagguugguacguacgggcuuaacaccuuuacaaauauggaagcacaacugauuagacagauggagggagaaggcuucuucaucgagcaucagcacuuaacugcuucugaagagaacgccgugcaggacuggcuggcacggguaggcagggagaaggugucacgcaugccuaucaguggggaugacugugucgugaaaccauuggaugacagauuugcccgggcucucaccgcccugaaugauaugggaaagguuaggaaagacauucaacagugggaacccucccgagguuggaacgauuggacacaggugccuuucugcagccaccauuuucacgagcuaauaaugaaggacggccguacucuugucgugccauguagaaaucaggaugaacugaucgggcgcgcgcggauuucucaaggagcaggcuggucguucggugagaccgccugccucgggaaaucauaugcucagauguggagccugaucaacuuuaggauucccgacuugagauuagccgcaaacguaaucuguuccguugugccuagucauugggucccgacgucucgcacaaccuggagcauacacgcuaaucacgaguggaugacuacagaagauaugcugaccguguggaaccggguguggauccucgagaauccauggauggaagacaagacucccgucgaguccugggaagagauuccuuaccuugagaagagggaagaucaguggugcggaucacugaucggccuaacaccacagccaccuugggccaaaaacauugagacagcuaucaaucaaguucgaagucugauaggcaacgaagaguauauugacuaccuccccucuaugaagagauuccggaucgaagaggaggaaagcggguuuuugugguga

SEQ ID NO: 14406 - RNA, 9876 nt, Artificial Sequence
  derived and/or modified CDS sequence (opt3) from DENV-2__JQ922553__SS-prME
accgccggcaugaucauuaugcugauacccacagugauggcuuuccaccucacuacgagaaacgucgagccuccaaugaucuuuagcagacaggaaaaggggaaauccuuccuuuuuaagaccaaagacggacaugauaugugcacauucauggcaauggaccugggugaguugugugaagauacuauuaccuacaagugcccguuuuuaaaacaaaaugagcccgaagacaucgauuguuggugcaacucuacaucaaccuggguuacuuauggcacauguaccacgacuggggagcaccggcgcgagaagcgaaguguggcccugguaccucaugugggaaugggcuuagaaacccguacagagacuuggaugagcuccgaaggugcguggaagcacguccagagaauugagaccuggauccucaggcauccaggguucacaauaauggcugccauccuggcauacaccauuggaacgacucacuuucagcgggugcuuaucuucauucuguugacaggcguugcccccucuaugcgcaugagaugcaucggcauaucgaauagggacuuuguggagggggucucaggagguagcuggguggauauuguacucgaacacggcaguuguguuaccacuauggcuaaaaacaagccuacacuggaccuggagcucaucaaaaccgaagcaaagcagccagccacguuacggaaauauugcauugaggcuaagcugaccaauacaacuaccgauucccgcugucccacacaaggggaaccuacucuuaacgaggagcaggacaagcgauucgugugcaaacauucuauggucgauagaggauggggcaaugguuguggguuguuuggaaagggcgccaucgugaccugcgcgauguucacaugcaaaaagagcaugaaaggcaagaucgugcagccagaaaaccuggaguacaccgucguuauuacuccgcacuccggggaagaguaugcagugggaaaugacacggguaaacauggcaaggaaguaaagauaacaccccagucaaguaucaccgaggccgagcuaacuggguacggaaccgugacaauggaauguagcccuaggaccggccucgauuuuaacgagaugguccugcuucaaauggaagacaaggcuuggcuggugcaccggcagugguucuuggaccucccacugcccugguuaccuggugccgauacucaggggucuaauuggauucagaaggagacacugguuacguucaaaaacccacacgcaaagaaacaagacguggucgugcucggcucccaggaaggagcuaugcauaccgcccuuacuggcgcgacagagauccagaugucaagcgggaaucuguuguuuaccggacaccuaaagugccgucugcgcauggauaagcuccaacugaaagguaugaguuauucuauguguacaggcaaguucaaaguaguuaaggagauagccgaaacucagcaugggaccauugugaucagaguccaguacgagggagacggcucccccugcaaaaucccguuugaaauuauggaucuugagaagaggcacgugcugggucgguugaucacggucaacccuauugugaccgagaaggacagccccguuaauauagaagcagagccaccuuucggggauucguacaucauuaucggcguggaacccggacagcucaaacuggacugguuuaagaaaggaucuuccaucgggcaaauguuagagacaacuaugcgaggagcuaagcgcauggccauucugggugauaccgcuugggacuucggcucacuagggggaguauuuacaaguauaggcaaagcccuccaucaggucuucggugcaaucuauggggccgcuuuuagcggcguguccuggacuaugaagauucugaucggaguuauuaucaccuggauaggcaugaacucuagaagcacgucacuuaguguguccuugguccugguggggaucguaacacucuaccugggagugaugguucaggcggauagcggcugugucgugucuuggaagaacaaagaacuuaagugcgguucagggauuuucgugaccgacaauguccacacuuggacagagcaguauaaauuucaaccagagagucccagcaagcuggcauccgccauccagaaagcucacgaagagggaauuuguggcaucaggucuguuacccgguuggaaaaccucauguggaagcagauaacucuggaguuaaaucauauucugucggaaaacgaggugaaacuaaccaucaugacaggugacauuaagggcaucaugcaaguggggaagcgcagccucagaccucaaccaacggagcugagguacuccuggaaaaccuggggaaaggccaaaaugcuuucaacugaauugcacaaucagacauuccugauagauggcccggagaccgcagaaugccccaacgccaaucgugcuuggaacagucucgagguagaagacuauggguuucggaaguacaaaacaaagaucuggccuacucugaaggaguggcgaaaagucuucugugauucuaaguuaaugagcgccgcaauuaaagacaauagagcggugcaugcugauaugggauauuggaucgaguccgcccugaacgacaccuggaagauugaaaaagcaucauucaucgagguuaagagcugccacuggccaaagucucacacgcuuuggggcaauggugugcaggaauccgagauggucauacccaaaaacuuugccgggccugugagucagcauaauaacaggccaggauacuacacacaaaccgcuggccccuggcacuuggguaagcucgagauggauuucgacuuuugugaaggcacuaccguugugguaacagaggauugcgggaaucgcggaccgagccugcggacuaccacagccucuggcaaacuaauuacggaauggugcuguagauccugcacccugccuccacucagguaucgcggggaggcaggauguugguacuggauggacauccgaccccugaaggaaaaagagaagaaccuugucucaaguuuggugacugcuggccauggucagaucgauaacuucagccugcggauuuuagggauggcccucuuucuggagaagaugcuuaugacacgucugggaaccaaacacgcgaucuugcucguggccgucucguucguuacucugauuacaagaaauauguccuuuaaggaccuaggcagggugaugguaauggugggugcuaccaugacggaugacaugcgcaugggcgucacuuaucuggcacuccugccugccuucaaagugcggcccaccuuugcuacagggcuuuugcugagaaaguuaaccucuaaagaacucaugaugacuacaauaggaaucguucuguucagccagucaaguauuccagagaccauccuugaacugacagacgcccuagcacucggcaugauggugcugaagauggucaggaacauggagaaauaccaauuggcggugacuauuauggccauccugugcguuccuaaugcugugauauuacagaacgccuggcgagucuccuguaccauccucgcaguagugucuguuagcccccuguuucuuacguccucacgccagaaggcugauuggauuccacuggccuugacaaucaaggggcucaauccgaccgcaauuuuccugacuacccuaagccggacaaguaaaaagagaucuuggccucugaacgaagccaucauggcugugggaauggucuccauacuugcgagcucgcuccugaaaaaugacauucccaugacuggcccauugguggccggugggcuguuaaccguaugcuaugugcucacgggaaggucagcagaucuggagcuugagcgugcugccgacgucaagugggaugaccaggccgaaaucucuggcaguucccccauccugagcauuacaauaucugaggauggcagcauguccaucaaaaacgaagaggaagaacagaccuugacuauucucauccgcacagggcugcuaguuauuucaggacuguuuccugugaguaucccaauaaccgcugcagccugguaccuuugggaggugaagaagcagcgggcggguguccucugggacgugcccagcccuccgccaguuggcaaagcugaacuggaggauggggccuauagaauccagcagaagggaauuuucggcuacucucaaaucggugcagggguauacaaagaaggaacuuuccccacaauguggcaugugaccaggggcgccgucuugaugcacaagggcaaacgaauugagccuuccugggcugacgugaagaaggauuuaaucucauaugggggagguuggaaacuggagggcgaauggaaggagggggaagagguucaggugcucgcacuggaaccaggcaaaaauccccgggccguccagacgaagccuggccuuuuuaaaacuaacaccgguacaauaggggcggugagucuggacuucagcccgggaaccuccggcucucccauuguagauaagaagggcaaagucgugggguuguacggaaaugguguugugacacgcucgggcgcuuaugucagcgccaucgcacagacugagaagucaaucgaggacuacccagaaguggagauggacauuuuuaggaagaaaaggcuaaccaucauggauuuccacccuggggccggacggcaaaaacgauauuuucccgcuauaguuagagaagccauuaaacgcggccugaggacgcucauccuggcaccaacacguguggucgcugccgagauggaagaggcgcuucgggguuuaccuauuagauaccagacucccgccaucagggcagagcauaccgggcgcgaaauaguggaccugaugugucacgcuacauucaccaugcgacucuuguccccaauuagaguaccgaacuauaaucugaucaucauggaugaggcccauuuuacugacccugcuaguauugcagcccggggauacaucucuaccaggguggaaaugggcgaggccgcuggcauuuucaugacagcgacgcccccagggagccgcgaucccuuuccucaguccaacgcaccaauaauggacgaagaacgugagauccccgaaagaucauggaacucuggacacgaguggguuacugauuucaaggguaaaauugucugguuugugccuagccucaagaccggcaaauacaucgccgcuugccugcggaagaaugggaaaagggugauccaacuuagucgcaagacauucgacuccgaauaugucaaaacccgaacuaacgauugggacuucguagugacaaccgauauuagcgagaugggagccaauuuuaaggcagagagaguuauagacccgcggagguguaugaagccagugauccugacggacggcgaagaacgcgucauuuuggccggucccaugccugugacucauucuucagcugcgcagagaagggggcggaucggacguaaccccaaaaaugaaaacgaucaguacauuuauaugggcgagccacuagaaaaugacgaggauugcgcccacuggaaggaggcaaaaaugcugcucgacaacaucaauacaccugaaggcauaauccccuccauguucgagccagaacgcgagaagguugaugcuauugacggggaauaccgauuaagaggagaggccaggaaaacccugcuugagcugauccgggguggcccuauuccgguguaucucggguacaaguggcccggagaaggcaucaacuaugcagauagucgcuuguguuuugacgguauaaagaauaaccagauucuggaggaaaaugucgagguggaaaucuggaccaaagagggggagagaaaggaacucaaaccaagguggcuggaugcccggauuuacagcgacccucuugcucuaaaggaguucaaagaauuugccgcgggccgaaagucgcugacuuugaacuuaaucacagagaugggaagacugcccaccuucaugacacaaaaggcacgcggcgcccucgcuucucugaugguacuucacacugccgaggcugggggaagggcauacaaucaugcccuguccgaacucccagagacguuggaaacccugcuacugcucacacuucuggcuacugugaccgguggcauauuuuuauucuugaugagcgggcggggaaucggcaaaaugacacuggguaugugcugcauuaucaccgccucaauucuccugugguaugcacagauccagccucacuggauagcggccaguauuauccuugaguuuuuccugacuguucucuugauccccgaaccggagaagcagcguacgccacaagauaaccagcugaccuacgucauuaucgcuauauuaacagugguggccgcaacuauggcuaaugagaugggguuucuagagaaaaccaagaaagaccugggccucggaaacauugccacacagcagucuuguaagaagauccuugauauuuaucugggcccugcauugcccuggaaacuguacgccgggggaaccacuuucaucacaccaaugcucagacauuccauagagaacagcucagucaauguuagucugacggcuaucgcgaaccaagccaccgugcuuaugggucucggcaagggguggccccugagcaaaauggacauuggaguaccuuugcuggcaaucggcugcuauucccaggugaauccgauuacuuuaacagcugcccuauuucugcucgucgcccacuacgcaaucauuggucccgggcuucaggcuaagccaaccagggaagcccagaaacgcgcggcugccggcaucaugaagaacccuaccguggacggaauaacaguuauugaucuggaccccaucccuuaugauccaaaauucgagaagcaauugggccaggugaugcugcucguccuguguguaacucaggugcuuaugaugcggacgaccugggcauuaugcgaagcccugacacucgcuacugggcccguuucuaccuugugggagggaaauccuggccgauucuggaacacaaccaucgcagugagcauggccaauauuuuuagagguuccuaccuggcgggggcuggacuacuguucucaauaaugaagaacacuacgucuacaaggcgcggcaccgguaauaucggcgagacucucggggaaaaauggaagagucggcuuaacgcccugggaaaaucggaguuucaaauuuacaagaaaagcggcauccaggaagucgacagaaccuuggcaaaggaggggauuaagcguggagaaacagaucaccaugccguguccaggggcucugcuaaacugcggugguucgacgagcgcaaucucgucacuccagaggguaaggugguugaucugggguguggacgaggcgguuggucauuuuucugcggcgggcuuaaaaacgugagagaaguaaaggcccuaaccaucggaggccccgggcacgaggaaccgauacugaugagcacauauggaaggaaucucgugcggucccagaguggcgucguuguguuucauacgccuccagagaaaugugacaccucucuacgcgauaucggugagagcucacccaacccuacugucgaagcagggagaacacugaggguguugaaucugguagagaacuggcucaauaacaacacccaguucugcauuaaggugcuuaauccauacaugcccuccguuaucgaaaagauggaggcucugcaacgaaaauauggaggcgccuuggugcggaacccgcugagucguaauagcacucacgaaauguacugggucucuaacgcguccggcaauauugugucaagcgucaacaugaucucgagaaugcucauaaaucgcuuuacaaugaggcauaagaaagccaccuaugagccugacguggauuuagggucuggaacgcggaacauugguaucgagagugaaacccccaaucuggacaucauuggcaagagaauagagaaaaucaagcaggaacacgagacauccuggcacuacgaucaggaccauccauauaagacuugggggagccacggaucauacgaaaccaaacagacaggcuccgcaucuagcaugguuaacgguguagugcgccuucugacuaagccuugggacgucgugcccaugguuacccaaauggcuaugacagauaccacuccauucgggcagcagaggguguuuaaagagaaggucgacacgcgaacacaggagcccaaagaaggaaccaagaaacuaaugaagauuacugccgaguggcucuggaaggaacugggcaaaaagaaaaccccucggauguguacaagagaggaguucaucaagaaagugaggaguaaugcagcuuugggcgccauuuuuacggaugagaacaaguggaaguccgcccgcgaggcgguagaagacgggcguuucugggagcugguggauaaagaacggaaucuccaucuugagggaaagugcgagaccuguguuuacaacaugauggguaaaagagaaaagaaacugggcgaguucgggaaggcuaagggaagcagggcaaucugguauaugugguuaggcgcccgcuuucuggaguucgaggcuuuggguuuucucaaugaagaccacugguucucucgagagaacucacugaguggggucgagggagaaggccuacacaaacuuggcuacauacugcgggagguguccaagaaagaagggggagccauguaugcagaugacacugccgguugggauacaagaaucacccucgaggaccugaagaacgaagagaggaaaacuaaucauaugggcggggagcaccgcaaguuggcuagaggaauuuuuaagaugaaccugacaaauaaagugguccggguucaaaggccaaccccgggcgguacacucauggauaucauuagccguaagacucagcgagggucugaacaggugggaaccuacggccuuacgacccugacaaacuuagaggcgcccccuauccgccaaauggaaggcaaagggguauucaagggacaucagcacagaacugccucggaggaaaaugcagugcaggacuggcuggcucgggucgguggcgagagguugucacgccucgccauuagcggggacgauugcgugguuaaaccacuggacgauagauuugcacgggcccuaaccgcucuuaacgacaugggaaaggugaggaaggauauacagcaaugggagcccucccgaggcuggaaugacuggacacaggucccuuucugcagucaucacuuucacgaacugaucaugaaagauggucguacucucgugguaccauguagaaaccaggacgagcugauugggcgcgcccggaucucucagggagcgggcuggagcuugagggaaaccgcaugcuuaggcaaguucuaugcccaaagauggucccugauguacuuucaucgccgggaucucaggcuugcucccaaugccaucuguucagcaguucgaacgcacugggugccuacaaguagaaaaaccuggccgauucaugcuucucacgacuggaugacuacagaggucaugcugaccguguggaacaagcuaugguuccaggagaauccauggauggaagauaaaacucccgugggguuuugggaggaaauaccuuuccuggagaagggaaaagaccagugggguggcagccucaucggguugaccucccggcccccaugggccaagaacuuccagccugcuauuaaucaagucaggucacugcuuugcaacgaagagagcgccgauuuuaugcccucuaugaagcgcuuccguagagaggaagaggaagcaggaguucugugguga

SEQ ID NO: 14407 - RNA, 9876 nt, Artificial Sequence
  derived and/or modified CDS sequence (opt3) from DENV-2__JQ922549__SS-prME
accgcaggagugauaauuaugcugauacccacagcuauggcauuccaccucacuacgcggaauggggaaccucauaugaucgucagcaggcaggaaaaggggaaaucccuucuguucaagaccgaagacgguguuaauaugugcacauugauggccauggauuuaggcgaacugugugaagacacuauuaccuacaauugcccacugcuccggcaaaaugaaccggaggauaucgacuguuggugcaacucuacaucaaccugggugacuuaugggacauguaccgcgcccggagaucaccgccgagagaaacguaguguagcucuggugccucaugucggcaugggucuugaaacgagaacugagaccuggaugagcuccgaaggggccuggaagcacgcacagaggauugagacauggauccugcggcauccaggauucacuauaauggccgcuaucuuggcauacaccauuggcacaaccuauuuucagcgcgugcucauccugauucugcucacggccguugcucccucuaugacuaugagaugcaucggcauaucgaauagggacuucguggagggggucucaggagguagcuggguggauauuguauuagaacacggcaguuguguuacaaccauggccaaaaacaagccuacucuggacuuugagcuuaucaagacagaagcgaaacagccagcaaccuugacgaaguacugcauugaggccaaacugaccaauacaacuaccgcuucccggugucccacacaaggggaaccuucucuaaacgaggagcagcacaagcgcuucgugugcaaacauagcauggucgaucgaggauggggcaaugguugugggcucuuuggaaagggcggcaucgugacuugcgccauguuuaccugcaagaaaaacaugaaggggaaaaucgugcagccagaaaaucuggaguauacaauugucguuaccccgcacuccggagaagagaacgcaguggguaaugacacuggcaagcaugggaaagaaauaaagguaagaccccagucaaguaucacggaggcugagcuuacaggauacggcaccgugacuauggaauguagcccuaggaccgguuuugccuucaacgagaugguccuguugcaaauggaaaauaaagcguggcucgugcaccggcagugguuucuggauuuaccacugcccuggcucccuggggccgacacacagggcucuaacuggauucagaaggagacccuuguuacuuucaagaacccacacgccaagaaacaagauguggucgugcugggaucccaggaaggcgcuaugcauacagccuugacgggggcuaccgagauccagaugucaagcggaaaucuacuguuuacuggucaccucaaaugccgucugcgcauggacaaacuucaacugaaaggcaugaguuauucuauguguacagggaaguucaagguaguuaaagagauagccgaaacccagcauggaacaauugugaucagaguccaguacgagggcgacgguucccccugcaagaucccguucgaaauuauggauuuggagaaaaggcucgugcuggggcgguuaaucacugucaacccuauugugaccgagaaggacagccccguuaauauagaagcagagccaccuuuuggcgauucguacaucauuaucggaguggaacccggccagcugaaaccaucuugguucaagaagggguccucaauccgacaaauguuugagacgaccaugcgcggagccaaaagaauggcuauucuaggugacacagcgugggauuucggcagucucgggggaguauuuacuagcauaggcaaggcacugcaccaggucuucggugccaucuauggggcugccuuuuccggcgugucuuggaccaugaaaauucuuaucggaguugugauuacauggaucggcacuaacagcaggucaaccaguuuguccgucagccuggugcucguaggggugguuacgcuguaccuuggagucauggugcaggcagacucuggcuguguggucucauggaagaauaaagaacugaagugcgguagugggauauucaucacagauaacguucauaccuggacugagcaguauaaguuucaacccgagagcccuuccaaauuggccucugcuauucagaaggcccacgaagagggaaucuguggcauucggucggugacacgccucgaaaaucugauguggaaacagaucaccccagaguuaaaccacauacugagcgaaaaugaggugaagcuaacuauuaugaccggugacaucaaaggcauuaugcaggcagggaagagaucccucaggccgcaacccacagagcugaaauacucauggaagacguggggaaaggcgaaaaugcuuaguaccgaaccucauaaccagacuuucuugaucggcgggccagagacagcugaaugccccaauaccaaccgugccuggaacucucuggagguagaagauuauggauuuggcgucuucacaacuaacauauggcucaagcugaaagagcggcaggacguguuuugugauagcaaguuaauguccgcagccaucaaagacaaucgagcuguucacgccgacauggguuacuggauugagucagcacugaacgauaccuggaagaucgaaaaggcuagcuucauugaggugaaaucuugccauuggccuaagucccacacgcuuuggaguaacggggucuuggaaagcgagaugaucauacccaagaauuucgccggacccgugucucagcacaacuauagaccgggcuaccauacacaaaccgcggguccuuggcaccucggcaagcuggagauggacuuucauuucugugaagggacuaccguugugguaacagaggauugcggaaauaggggcccaucccuacgcacuaccacagccucagggaaacugauuacggaauggugcugucggaguugcacccucccaccucugagauacaggggagaggacggcuguugguaugguauggaaauccgcccccuugagggggaggaaggagauuugguccacagccuggugacugcuggccauggucagaucgacaacuuuucguuaggcgugcucgggauggcacuguuccuugaggaaaugcugcgaacacgggucggaaccaagcacgccguuuugcucguggcuguauccuuuaugacucugauuacaggcaauaugucuuuccgugaucuagggagagugauggucauggugggagccgcaaugaccgacgauaucggcauggguguuacguaccuggcgcuccuggccgcuuuuaaggugaggccaacuuucgccgcagggcuuuugcugcgcaaauuaaccagcaaggagcucaugaugacaaccauuggaauaguccugcuuucacagaguacuaucccugaaacaauucuggagcuaaccgacgcucucgcccugggccggaugaucuugaaaauugugagaaacauggagaaguaucaacuggcaguuacaaucauggccauauuaugcgugcccaaugcugucauccuccagaacgcguggaaaguauccuguacuauucuggccgugguuucugugagcccacuucuguugaccuccucacagcagaaggcagauuggaucccgcucgcucugacgauuaagggccuaaauccuacagccaucuuucugaccacucuuagcaggaccaacaaaaagcgaaguuggccccucaaugaagccauaauggcugucgggauggugucuauucuggcauccagcuugcuggagaacgacaucccaaugacaggacccuuaguagccgguggccuccugacugugugcuacguccuuaccgggcgcucggcggaucuggaauuggagcgggcugccgacguuagaugggaagaccaagcagagaucucaggaucuaguccuauucucuccauaacgaucagcgaggauggcucuaugagcauuaaauaugaagaggaagaaccaacacugaccauccuaauuaggacuggucugcuugugaucuccggacucuuccccgugucaauaccuaucacagccgcugcaugguaccugugggaggucaagaaacagcgugccggaguguugugggacguuccgaguccacccccuguaggcaaggcggaauuagaggauggcgcuuaucgcauuaaacagaaggggauccugggaagcucucagauuggugcccggguguacaaggaaggcaccuuucacacuauguggcaugucacaagaggggcagugcucaugcacaaaggaaagaggaucgagccauccugggccgacguucgaaaagaucugauaucauacggcgguggguggaaacuugaaggagaguggaaagagggcgaagaggugcaaguccuggcuuuggaacccggcaagaauccucgggccgugcagaccaagccggggcuauucaaaacgaacacuggaaccauugguacaguaagucuggacuuuagccccggcaccuccgagucuccaaucgucgauaagaaagggaaggugguuggacucuauggcaaugguguggucacacgcucggggacuuacgugagcgcaaucgcucagaccgaaaaaucaauugaggacaacccugagaucgaagaugacauauucagaaagaagaggcugacgauuauggaucuucaucccggagccggcaaaacaaagcgguauuuaccagcgaucguucgagaggccauuaaaagaggccugcgcacucucaucuuggcaccuaccaggguggucgcugccgaaauggaggaagcucugcgugggcuccccauacgguaccagacaccagcaauuagagccgagcacaccggaagggagaucguggaccugaugugucaugccacuuucaccaugcgccuucuguccccgguacgagugccuaacuauaauuugaucauuauggaugaagcucacuuuacagaccccgcgaguaucgcagccagagguuacauuucuacgcggguugagaugggcgaagcugccgggauauucaugacugcaaccccacccggaagcagggacccuuuuccacaauccaacgcccccaucauggaugaggagcgcgaaauuccugagcguucauggaacucuggccacgaaugggucacagacuucaaggguaaaaccgugugguuugugccgagcaucaaggcugggaacgauaucgcggccugccuaagaaagaauggcaagaaggucauucagcugagucggaaaacuuucgacuccgaguauauaaagacaaggaccaacgauugggacuuuguagugacgacugauaucagcgaaaugggcgcaaauuucaaagcugagcgcguuauugacccacgaagauguaugaagcccgugauccucacagauggcgaggaacgggucauuuuagccgggccuaugcccgugacccauucuucagcagcccagaggcgcggaagaaucgguaggaacccaaagaaugagaacgaccaauacauauacaugggcgaaccucuggagaaugaugaagacugcgcucacuggaaagaggccaagaugcuucuggacaacaucaauacccccgaggggauuaucccauccauguuugaaccugagcgggaaaaaguugaugcgauugacggagaguaucgucuccgcggcgaagcacgaaagacuuucguggauuugaugagaaggggugaccugccggucuggcucgccuaccggguggcugccgaggggaucaacuaugcugaucgcagaugguguuuugacggcaucaaaaauaaccagauucuggaggaaaacguagagguggaaaucuggacaaaggagggagagaggaagaaacuuaaaccccgguggcuagaugcacgaauuuacagugacccacuggccuugaaagaguucaaggaguucgcugccggcagaaagagcuuaacccugaaucucaucacagaaauggggcgccugccuacuuuuaugacgcagaaggcaaggaacgcgcuugauaaucuggccguucuccauaccgcugaggccggaggucgggcauauaaccacgcuuugucggaacugcccgagacacuagagacucugcuccuucugaccuuauuggccacagucaccggcgggauauuccuguuucucaugucuggaaaaggcaucgguaagaugacucuggggaugugcugcauuaucacggcauccauucuucugugguacgcccagauccaaccacacuggauagcugcgagcauuauccucgaguucuuuuugaucgugcuguuaauuccugagcccgaaaagcagcguaccccgcaggacaaucagcuaacauauguggucaucgccauacugacuguuguggcagcuaccauggccaacgagaugggcuuccucgagaaaacaaagaaagauuuuggacuuggcucaauugccacccaacagccagagaguaauauccuggacauugauuugagaccugcaucugcuuggacucuguacgccguagcgacaacguucaucacccccaugcucaggcauuccauagagaacagcccagugaaugucucacugacugcuaucgccaaccaggcaacagugcuuauggggcucggaaaggguuggccccugaguaaaauggacauuggcguuccuccguuggccaucggguguuacagccaggugaaucccauuacccugaccgcugcauuacuacugcucgucgcccacuaugcgaucauuggaccaggccuucaaguaaaggcuacacgcgaagcccagaagcgggcagccgcugguaucaugaaaaacccuacuguggacgggauaacgguuauugaucuggaccccaucccuuacgauccaaaguuugagaaacaguugggccagaucaugcugcgagugcucugcgucacccaagugcugaugaugagaacaacuugggcccuuugugaagcauuaacccuggcuacaggacccauuuccacccucugggagggcaauccugggagguugggaaacacuacgauagccgucucuauggcgaauaucuuccgcggcagcuaucuggccggugcagggcuacuguuuuccauuaugaagaacacaaccaauacucggagaggaaccucaaaccucggcgaaacacuuggugagaaauggaagaaccgucuaaauucuuugggcaagagugaguuccagaucuacaaaaagucggggauucaggaaguggacaggacucuggcuaaagagggaaucaagaaaggcgaaaccgaucaucacgccguuagccggggguccgcaaagcuccgcugguuuguggagcgaaaccugguaacaccagagggaaaaguggucgacuuaggcugcgguagagggggauggucuuauuacuguggcggucuuaagaauguuagggaagugaagggccugacgaaagggggacccggccaugaggaaccgauaccuaugucaaccuauggguggaaccucguccggcuacaaagcggagaggauguguucuucacuccacccgaaaagugcgacacacuguugugugauaucggcgaguccaguccuaauccaaccguagaggcuggucgcacucugagagugcucaacaugguugaaaauuggcuuaacaauaacacacaguuuugcauuaaagugcugaaucccuacaugccgucugucaucgagaagauggaagccuugcagaggaaauacgggggagcccuggugcgaaacccucucagcagaaauucaacccacgagauguauugggucuccaacgcgaguggcaauauugugagcucuguuaacaugaucucccguauguuaauaaacagauucacgaugcgccacaagaaggcuaccuacgaacccgacguagaucugggcucagggacaaggaauauuggaaucgagagcgagacuccaaaccuugacaucauugguaaacggauagaaaagaucaaacaggagcaugaaaccucguggcacuaugaucaagaccauccuuacaagacaugggcauaucacggcucuuacgagacuaaacagaccgggagugccuccagccuggugaauggagucgugagacuacucacaaagcccugggacguuauuccaauggugacccagauggcuaugacugauacgacacccuuuggccagcaacgcgucuucaaggaaaaaguggacaccaggacucaggagccuaaggaggguaccaaaaagcugaugaaaaucacagccgaaugguuguggaaggagcuggggaagaaaaagacgccacgaauguguacccgggaagaguuuucaagaaaaguaagguccaacgcagcccucggagcuauuuucacugaugagaauaaguggaaaucugcgcgcgaagccguggaggacggccguuuuugggaacuuguugauaaggagcggauccugcacuuagaaggcaaaugcgagacaugugucuauaacaugauggggaagagagagaagaaaauaggagaguucgguaaggcaaaaggcagcagggcuaucugguacauguggcugggggcccgcuuuuuggaguucgaagcacucggauuucugaaugaggaccauugguucagucgagaaaacucccuaagcggcguggagggugaggggcuucacaagcugggauacauucuccgggaagugucuaaaaaggagggcggcgccauguaugcugaugacaccgccgggugggauacuagaaucacacuggaagacuugaagaaugaggaaauggucaccaaccauauggagggagagcacaaaaagcuggcggaagcaauuuuuaaacucacauaccagaauaagguugugaggguacagcgcccgacucccagagguaccgugauggauaucauuucacggagggaccaacguggcagugggcaggucggaacguauggccuuaacaccuucacaaauaugggugcccagcugauacgacaaauggagggggaaggaguguucaaaggcauccagcauuuaacugcuaccgaggagauugccguucaggacuggcuggcacgcgugggcagagaacgguuguccaggauggcuaucagcggggaugacugcgucgugaagccucucgaugaccgcuuugccucugcucugacagcccuaaacgauaugggaaagguaagaaaagacauccagcaaugggagccaucgcgggguuggaaugauuggacucagguucccuucugcucacaccacuuucaugaacuuauuaugaaggacggcagggugcuggucgugccuugucgaaaccaggaugagcucauagggcgugcaagaaucagccagggagcgggcuggucccugcgcgaaaccgccugcuuggguaaaaguuacgcucaaauguggucuuuaauguauuuccaccggagggaccugagacucgccgcaaacgcuauuuguagcgccgugccaucccauuggguccccacgucacgcacaacccggaguauccacgcaaggcaggaguggaugacuacagagguuaugcuuaccguguggaaucgaguauggauucaggaaaacccuuggauggaggauaagacuccgguggaaucuugggaggaaaucccauaccuggggaaaagagaggaccaguggugcggaagccuaauaggccugaccucccgggccacaugggcgaagaauauccaaacggcuauuaaccaggucaggucacucaucggcagcgaggaauauaccgauuacaugcccucuaugaagcgcuuucguagagaggaagaggaagccgggguguugugguga

SEQ ID NO: 14408 - RNA, 9876 nt, Artificial Sequence
  derived and/or modified CDS sequence (opt3) from DENV-2__JQ922552__SS-prME
accgccggcaugaucauuaugcugauacccaccgugauggcuuuccaccucacuacgaggaauggggaaccuccaaugaucgucagcaggcaggaaaagggaaaaucccuucuguuuaagaccgaagacgguguuaauaugugcgcauugauggccauggauuuaggcgaacggugugaggacacaauuacuuacaacugcccgcugcuaaaucagaacgaacccgaggauaucgacuguuggugcaauucuaccucaacaugggugaccuaugggacuuguacaaccacgggagagcuccgccgagagaagauuaguguagcgcuggugccucaugucggcaugggucuugagacucguaccgaaacauggaugagcuccgagggggcuuggaagcacgcccagagaaucgagauauggauccugaggcauccaggauucacuauuauggcagccaucuuggcuuacaccauuggcacaucucacuuucagcgggugcucaucuucauacugcugaccgcaauugcccccucgaugacgaugcgcugcaucggcauuucaaacagagauuuuguugaaggggugagcggagguaguugggucgacaucgugcucgagcauggcuccuguguaacuacaauggcuaaaaauaagccuaccuuagauuucgaacugaucaagacugaggccaaacagccagcgacacuuaggaaguauugcauugaagcaaaauugaccaacacgaccacagacucucggugucccacucaaggggagccuacccugaaugaggaacaggauaagcgcuuuguuugcaaacacagcaugguggaccgaggauggggcaacgguugugggcuauucggaaagggcggcauagucacaugcgccauguuuacuugcaagaaaaucaugaaggggaaaauugugcagccagagaaucucgaauacaccguggucaucacaccgcacuccggagaggaacaugcuguugguaacgauaccggcaagcacgggaaagaggugaagauaacuccccagucaaguauuacggaggccgaacugacaggauauggcaccguaacuauggaguguagcccuagaaccggucuugacuucaaugaaauggugcuguugcaaauggaggauaaagcauggcucguccauaggcagugguuucuggacuuaccacugcccuggcucccuggggcugacacacagggcucuaacuggauccagaaggaaacccuugugacuuucaagaauccacacgccaaaaagcaagauguugugguccugggaucccaggagggcgcgaugcacacagccuugacgggggcaaccgagauccagaugucaagcggaaaccuacuguuuacuggucaucucaaaugccggcugcguauggacaaacuucaacugaaaggcaugaguuacucuauguguacagggaaguucaaggugguaaaagaaauugcugagacccagcacggaacaaucguuauucgcgugcaguaugaaggcgaugguucccccugcaagauaccguucgagaucauggacuuggagaaaagacauguccucgggaggcugauuacugugaacccuaucgucaccgaaaaggauagccccgugaauaucgaggccgaaccaccuuuuggcgacucguacauuauaaucggaguugagcccggccaguuaaaacugaacugguucaagaaggggucuuccauuggacaaaugcuagaaacgaccaugcggggugcuaaacgaauggccauccucggcgauacagcaugggacuuugggucacugggaggcguguucacaaguauugguaaggcccuucaccagguauuuggggcuaucuacggcgcggcauucagcggagucuccuggaccaugaaaauauugacaggcgugaucauuacuuggaucgggaugaacucucgcagcaccucacugaguguuucccucgugcuggucggaauugugacgcuuuaucugggcguaauggugcaggccgauagcgguuguguugucucuuggaagaacaaagaguugaagugcgggucaggaaucuuugugacagacaaugugcauaccuggacugagcaguacauguuccaaccagaaagucccagcaagcucgcuuccgccauacagaaagcacacgaggaaggcauuugugguaucagaucugucacaaggcuggagaacuuaauguggaagcagauuaccccugaacugaaucacauccuaucggagaacgagguuaaacucacuauaaugaccggcgauaucaaggggauuaugcaagugggaaaacggagccugcgcccacaaccgacagaacuuagauauuccuggaagacguggggccagcccaaaauguugucaccugagcugcaucaccagaccuuucucaucgacgggccagaaacugccgagugccccaauacaaacaggaccugggacagucuggaaguggaggauuacggauucggcguauuuacaacuaagauuugguuacgucugcgggagaagcaggacgucuucugugauucuaaacuuaugagcgcugccaucaaggacaaucgagcagugcaugcggauauggguuauuggauagaauccgcuuugaacgacaccuggaaaauugagaaggccucauuuaucgaaguuaaaagcugccacuggccuaagucucacacgcucugguccaugggggugcuggagagugagauggucaucccaaagaauuucgcaggacccgugagccaacauaaccacagaccgggcauuccuacacagaccgccgguccauggcaucuaggcaaacuggaaauggauuucgacuuuugugaggggacuaccguugugguaacagaagauugcggaaauaggggccccucucuccgcacuuccaccgcuucagggaagcugaucacagaguggugcugucggaguugcacgcuuccucccuugagauacaggggagaagacggcuguugguaugguauggagauucgcccacugaaagagaaggaagagaacuuagucagcucgcucgugaccgccgggcacggacagauagauaacuucucccugggcauccuugguauggcacuguuuuuggaagagaugcuccgaacucgggugggcacaaaacaugcuauucugcuagucgccguuucuuucgugacccugaucacugggaauaugagcggacgugaccucggcagaguaauggugauggucggggcgacaaugaccgaugacauuggaaugggcgugacguaccuggcccuuuuggcugcauuuaagguuaggccuacuuucgccgcuggucuguuacuccgcaagcugaccucaaaagaacuuaugaugacaaccaucgggauagugcugcuaagucaauccucuauccccgagacuauucucgagcugacagacgccuuggcacugggaaugauggucuuaaagauggugcggaacauggaaaaauaccagcucgcgguuaccaucauggccauucugugcgugccaaaugcugucauccuucagaacgccuggaagguaagcuguacaauacuggcauugguguccguuucaccgcucuuucugacuagcagucagcaaaaagcugauuggauuccucuagcccugaccaucaagggccuuaaucccacggcaaucuuccucacaacccugucuagaacuuccaagaaaaggagcuggccauugaacgaggccauuauggcugugggcauggucucgauacuggcgucaucuuuacucaagaaugacauccccaugaccgggccucugguggccggaggucuucugacaguaugcuauguguugacuggccgaagugcagaucucgaacuggagcgcgcugccgacgucaaaugggaugaccaggccgaaauuuccgggagcucuccaauccuaagcauuaccaucuccgaggauggaucaaugaguauaaagaacgaggaagaggaacagacgcugacaauccuuauucggaccgagcuccugguuaucagcggcuuguuucccauuucuaucccuauaacugcugcagccugguacuuaugggaggugaaaaagcagagagcgggugugcugugggacgucccguccccacccccuguggggaaagcugaacucgaggauggagccuauaggauuaagcaaaagggcauccugggcuacucacagaucggggcaggaguuuauaaagaagguacauuccacaccauguggcacguaacucguggcgccgugcuuaugcauaaggggaaacgcauugagccaaguugggcugacgucaagaaagaucugaucagcuacggaggcgguuggaaguuggaaggggaguggaaggagggagaagaggugcagguucuagcacuggaacccggcaaaaauccucgggccgugcagacaaagccgggccucuuuaaaaccaacacggggacuauaggagcggucucccuggacuucucucccgguaccucgggcagcccaauuguggauaagaaagggaagguagucggacuuuauggcaauggugugguuacaagaucaggggcuuacguguccgccaucgcacaaaccgagaagaguauugaagacaacccugagaucgaggacgauauauuuaggcggaaaaaguuaacaauuauggaccugcaccccggagccggcaaaacuaagcgguaccucccagcuaucguccgcgaagccaucaaaagaggcuugaggacccugauucucgcaccuacgcgggugguugcugccgagauggaagaggcgcugcgagggcuucccaucagauaucagacaccagccauucgcgcagaacauacuggaagggagauaguggaucugaugugucacgcuaccuucacaaugcguuugcuaucuccgauccgggucccuaauuacaaccugauuaucauggacgaggcccauuucaccgaucccgcuagcaucgcagccagagguuauauuuccacuaggguggaaaugggcgaggccgcugggauauuuaugaccgcgacaccacccggaucacgcgacccuuucccacagucuaaugcacccaucauggaugaagaacgagagauuccugaaagaagcuggaacaguggccacgaguggguaacggacuuuaaggguaagacugugugguucguuccguccaucaaaaccgggaacgauauugccgcuugccuccggaagaauggaaaaagggucauccaauuaagccgcaagacauuugacucugaauacgugaaaacccguacuaacgauugggacuucguggucacaaccgacauaucagagaugggcgccaauuuuaaggcagaaagaguaaucgauccacggagguguaugaagcccgugauucugacggacggcgaggagcgcguuauccuugccgggccuaugcccgugacucacuccagugcugcgcagcgaagaggacggauugguaggaaccccaaaaaugaaaacgaucaguauaucuacaugggcgagccucuggaaaaugacgaggauugcgcccauuggaaggaagcaaaaaugcucuuggacaacauaaauacacccgaggggauuaucccaagcauguucgagccugaacgcgagaaggucgaugcuauugacggagaauauagacugaggggcgaggcccggaaaaccuuuguggaucucaugcgucgcggugaccugccgguuuggcuugcauaccgagggcccgccgaaggcaucaacuacgcugauagaaggugguguuucgacggaauaaagaacucgcaguuucuagaggagaauguggaagucgagaucuggccaucuggcggggaacggaaagagcugaagccucgcugguuggaugccagaauuuauuccgaccccuuagcgcugaaggaguucaaagaguucgcagccggaagaaagagccucacccugaaucuuaucacugagaugggucggcugccaacauuuaugacccaaaaagcucgaaacgcccucgacaauuuggcugugcugcacacagcagaagccggcgggagagcuuacaaccaugcccuaucagagcugccugaaacucucgagacgcuucuguuauugacccugcucgcaacaguaacuggaggcauuuuccuguuucuuaugaguggucgcgggaucggcaagaugacccugggaaugugcugcauaauuacagcgucuauccucuugugguaugcccagauccagccccacuggauugcugccuccaucauacuggaguucuuuuuaauugugcuacugaucccggaaccagagaaacagaggaccccucaagauaaccagcucacuuacguuauuaucgcaauacuuacggucguggcugccaccauggcaaaugaaaugggcuuccuggagaagacaaagaaagacuuggggcugggaaacaucgugacucagcagcccgaaagcaauauucucgauaucgaccugcggccagccucagcuuggacccuuuaugcggccgcaacaaccuuuauuacucccaugcuccgucacaguaucgagaacagcuccgucaauaugucucugacagcuauugccaaccaagccacgguuuugaugggucugggcaagggguggccuuuaagcaaaauggauaucggagugccgcuacuggcaauaggcuguuacucccagguaaaucccauuacccucacugcugcccuuuuccuguugguggcgcauuaugcuaucaaggguccagggcugcaggccaaagcaacaagagaggcccagaagagggcugcagccggcaucaugaagaacccuaccgucgacggaauuaccgugauagaucucgaccccaucccuuacgauccaaaauuugaaaagcaacugggccagguuaugcuuuuagugcugugcgucacacagguacucaugaugcgcacuacgugggcguugugugaggcucugacccuagccacagggcccgugucaacucugugggaaggaaauccuggccgguucuggaacaccacaauugcaguuucuauggccaauaucuuucgagguaguuaccucgcugggucgagccaaguguggccauccauuaacaaucuuaaaggaggcagaagggguaccggcgcccagggggagacucugggagaaaaguggaaacgccaguugaaccagcugucuaagucagaguucaauacguauaagcggagcggcaucauggaggucgacagauccgaagcaaaagaggggcucaagcguggagaaacaaccaaacacgcugugaguaggggcacugccaagcugcggugguuugucgagcgcaacuuagugaaacccgaggguaagguuauagaucuugggugcggacgaggcgguuggucuuacuauugugcgggccugaaaaaggugaccgaaguaaagggguacacaaaaggaggcccggggcaugaggaaccuaucccaauggccacuuauggauggaaucucgugaagcuacacagcggcaaagacgucuucuucacaccaccugagaagugcgauacacuguugugugacauuggugaaucauccccaaaccccacgguugaggcagggagaacccugagggugcucaaccuugucgagaauuggcugaacaauaacacucaauuuugcaucaaaguguugaauccguacaugccuaguguaauugaaaagauggagacacugcagcggaaguauggaggcgcucucgugcgcaaccccuuaagcagaaauucuacccaugaaauguacuggguuuccaacgccucaggcaauaucgugagcucggucaacaugauaucuaggaugcugauuaaucgauucacuaugcggcacaaaaaggcaacauacgagccagacguggaucuugggaguggaacccguaacaucgguaucgaauccgagacgccuaaucuggacauuauaggcaaaagaaucgagaagauuaaacaggaacacgagaccagcuggcauuaugaucaggaccaccccuacaagacaugggcuuaucaugggucauacgaaacuaagcaaaccggauccgccucuagcauggucaacggcgugguucgccuacucacaaaaccaugggauguagugcccauggucacucagauggccaugaccgacacaaccccuuuuggucagcagaggguguucaaggagaaaguugauacucggacgcaagaaccaaaggaggggacuaaaaagcugaugaagaucaccgcggagugguuguggaaagaacugggaaagaaaaagacuccgagaauguguccccgcgaggaauuuaccaaaaaggugaggaguaaugcugcacucggcgccauuuucacagacgcuacgaaauggaaguccgcccgagaggcagucgaggauggccgguuuugggaacuuguggacaaggagagaaaccugcacuuagaagggaaaugcgagaccuguguauauaacaugaugggaaagagggagaaaaagcugggugaguucggcaaagccaaggggagccgcgcuaucugguacaugugguugggagcgcguuuucucgaguucgaagcccugggcuuucuaaaugaggaucacugguucucucgggaaaacucacuuagugguguggagggggaaggacugcauaagcucggcuauauacugagagagguuaggaaaaaggagggcggggcaauguacgcugacgacuccgccggaugggauacucgcaucacauuggaagaccugaaaaaugaggaacgaauuaccaaccacauggaggucgaacauaagaaacucgcagugggucacuuuauccuuacuuacccuaauaaggugguccggguucagagaccaacacccgugggcaccguaauggauauuaucagcaggaagucucagcgcgggucgggacaagugggcacauauggucugaacacuuucaccaauuuagaggggccucgaauuagacagauggagggagaagagucauucaaaagccaucagcugcagacggccaccgaaaggaacgcuguccaagacugguuggcccgugugggccgagagcgccucuccagaauggcgauaaguggcgaugacugcguugugaagccacuggaugaccgguuugcaagggcccuaacagcucuuaaugauauggggaaaguccgcaaggacauccagcagugggagcccucuagaggauggaacgauuggacucaggugccuuucugcagccaccacuuucaugaacugauuaugaaagacggucggacccucguaguuccguguaggaaucaagaugagcugaucggccgagcccguaucucccagggggcaggauggucauugagagaaacagcuugcuuaggcaagaguuacgcccagauguggucucugauguauuuccaccgccgggaccucaggcuugcugccaacgcaauuuguagcgcggugccaucccauuggguccccacuucaagaaccacguggagcauacacgccucucacgaguggguggcuacagaagacaugcugaccguguggaaucgcgucuggauccaggagaacccuuggauggaggauaagacucccguugaauccugggaggaaauuccauaccuagguaaacgggaggaccaauggugcgggagucugaucggacucacaagcagggccaccugggcaaagaauauucagacugcuaucaaccaggugcgaucguugauaggcaacgaagaguauaccgauuacaugccuuccaugaaaagauuucggagggaggaagaggaagccggcguacugugguga

SEQ ID NO: 14409 - RNA, 9876 nt, Artificial Sequence
  derived and/or modified CDS sequence (opt3) from DENV-2__GU131896__SS-prME
agcgccggaaugaucauuaugcugauacccaccgugauggcuuuccaccucacaacuagaaacggggagccucauaugaucgucgguauucaagaaaaggguaaaucccuucuguuuaagacggaggacggcguuaauaugugcaccuugauggcaauggauuuaggggaacugugugaggacacaaucacuuacaaaugcccacuacucaggcaaaacgaaccggaggauauugacuguuggugcaauucuaccucaacaugggugaccuauggaacuuguacaaccacgggcgagcaccggcgcgaaaagcgaaguguagcccuggugccccaugucgguauggggcuugagacucguaccgaaacauggaugagcuccgagggagcguggaaacacgcucagagaaucgagacuuggauacugaggcauccuggcuucaccaucauggccgcaauuuuggccuacacaaucggcaccacgcacuuucagcgggcucucauuuucauccugcugacugcaguggccccaucuaugacaaugcgcugcauagggauuucgaacagagauuuuguugaaggagugucagguggcagcugggucgacaucgugcucgagcacgggaguuguguuaccacuauggcuaagaauaagcccacauuagauuucgaacugauuaaaaccgaggccaagcagccugcgacgcuuaggaaauauugcaucgaagcaaaguugaccaacacaacuaccgagucccgguguccaacacaaggagagcccucucugaaagaagaacaggacaagcgcuuuguuugcaagcauagcaugguggaucgaggcugggguaauggguguggacuauucggcaaaggcgggaucgucacuugcgccauguuuaccugcaagaaaaacauggaaggaaagauugugcagccugagaaucucgaauacacaauaguggucaccccacacuccggugaggagcaugcuguuggcaacgacacugggaaacacggaaaggaaaucaaagugacgccgcagucaaguauuacagaggccgaacugaccggcuaugguacuguaaccauggaguguagccccagaacagggcuugauuucaaugaaauggugcuguugcaaauggagaacaaggcauggcucguccacaggcagugguuucuggacuuaccucugccauggcuccccggcgcugauaagcagggaucuaauuggauccagaaagagacccuugugacuuucaagaacccucaugccaaaaagcaagacguugugguccugggcucccaggaaggggcgaugcacacagccuugacgggagcaaccgagauacagaugucaagcgguaaucuacuguuuacuggccaucucaaaugccggcugcguauggacaaacuucaacugaaggggaugaguuacucuauguguacaggaaaauucaaggugguaaaagaaauugcugagacccagcacggcacaaucguuauccgcuugcaguaugagggugauggguccccaugcaagauucccuucgaaaucauggaccucgagaaaagauacgugcugggcagguuaauuacugucaacccgauagugaccgaaaaggauagcccugucaacaucgaggccgaacccccauuuggagacucguacauuaucaucggcguggagccugggcagcugaagcuaaauugguucaaaaagggaucuuccauuggucaaauguuugagacgaccaugcggggcgcuaaacgaauggccauacucggggauacagcaugggacuucggaucacugggcgguguuuuuacaaguguggggaaggcccuucaucagaucuucggcgcuauuuauggagcggcauuuagcggcguauccuggaccaugaaaaucuugauuggggucaucauaacauggaucggaaugaacucucgcagcacuucacugagugugucccucguucuggugggcauugucacccuuuaccugggugugaugguacaggccgauagcgggugugugguuucuuggaagaauaaggaauugaaaugcggaucaggcaucuucauuacggacaacguccacacauggaccgagcaguauaaguuucaacccgaaaguccaagcaaacucgcuuccgccauccagaaggcacaggaggaagguauauguggcauuagaucugugacuaggcuggagaauuuaauguggaaacagaucacacccgagcugaaccacauucuagccgaaaaugaggugaagcucaccaucaugacuggggauauaaaaggaaucaugcaagcuggcaagcggucgcugcgcccucagccaaccgaacuuaaguacagcuggaaaacaugggggaaggccaaaauguuguccacggagucacauaaccagaccuuccugauugacggaccggaaacugcagagugccccaauacaaacagagcguggaauagucucgaggucgaagauuauggcuuugguguuuucaccacaaacaucuggcugaaguuaaaagagaagcaggacgcuuuuugugacucuaagcugaugagcgccgcaauuaaagauaauagggccgugcacgcugacaugggguacuggaucgaauccgcccuuaacgauacuuggaagauagagaaagcaucauucauugaggugaagaauugccauuggccuaaaagccacaccuuguggucuaacggaguacucgaauccgagaugaucaucccaaagaaccuggcuggccccgucagucaacacaauuaucguccugguuaccauacgcagacagccggcccauggcaccuagggaagcuggaaauggacuucgauuuuugugacggaaccacugugauuguuaccgaggauugcggcaaccgggggcccagccuccgaacaacuaccgcgucuggaaaacugaucacagaauggugcuguagauccugcacgcuuccgccuuugagguaccgcggcgaggacgguuguugguaugggauggagauucggccacugaaggaaaaagaggaaaauuuagugaacucacucgucaccgccggacauggccagguggauaauuucagucuggguguucuuggcauggcucuguuuuuggaggaaaugcucagaacuaggguggggacaaagcacgcaauacugcuaguagccgucagcuucgugacccugaucacuggaaacaugucguuuaaagaccucggccgcguggucguuauggugggggcuacaaugaccgaugacauuggaaugggcguaacguaccuggcccuuuuggcagcguucaaggugcgacccacuuuugccgcuggucuguuacuccggaagcugaccuccaaagagcuuaugaugacaaccaucgggauuguccugcuaucucaaagcacuaucccugagacaauacucgaacugaccgaugccuuggcacugggaaugaugguguuaaagaucguucgugacauggagaaauaucagcucgcugugacaauuauggccauccugugcguccccaaugcagugauucuucagaacgccuggaagguuucauguacuauccuggcuguggucaguguauccccauugcuccugaccucuagccagcagaagacggacuggauaccucuagcgcugacaauuaagggccuuaaucccaccgccaucuuccucacuacccuguccagaacaaacaaaaagaggucauggccauugaaugaagcaaucauggcugugggcaugguuagcauucuggccaguucuuuacucaagaacgauauaccgaugacugggccucugguggccggaggucuucugaccgucugcuacguguugacgggccgcuccgcugaccucgagcuggaacgggcaacagauguaaaaugggaggaccaggccgagaucagcgggucgucacccauucuaucuaucaccauuagugaagauggauccaugagcaucaagaaugaggaagaggagcagacucugacaauacuuaucagaaccggccuccuggugauuucugguuuguuuccagucagcauccccauuacugcggcugccugguauuuaugggaaguuaaaaagcagagggcaggggugcugugggacgugccuuccccacccccuaugggaaaagccgagcucgaagauggcgcuuaccgaaucaagcaaaagggcauacugggguauucacagauuggagcaggagucuacaaagagggcacauuccauaccauguggcacgugacgcgcggggccguucuuaugcacaagggaaaacggaucgaaccgaguugggcggacguaaagaaagaucugaucagcuacggcgguggguggaaguuggagggagaguggaaggaaggcgaggaagugcagguccuagcucuggagccaggcaaaaaccccagagccgugcagacuaagccugggcucuuuaaaaccaauacaggaaccauuggugcaguuucucuggacuucuccccaggcacaucagggagucccaucauagauaagaaaggaaagguggucggccuuuaugguaacggggugguaacuaggagcggagccuacgucuccgcuauugcccaaaccgaaaagucuaucgaggacaacccugagauugaagaugacaucuuucguaaacgccgguuaacgauaauggaccugcauccgggcgcaggcaagacaaaaagauaucuccccgcuauugugagggaggccaucaagcgaggguugcggacucugauccucgcgccaacccgcguuguggccgcagaaauggaggaagcucugagaggacuuccuauuagguaccagacacccgccauccgggcugagcacaccggucgagagauugucgaucugaugugucaugcaacuuucaccaugagauugcuaucgccagugcgcguuccuaauuauaaccugauaaucauggacgaagcccacuucacagaucccgccagcauugcugcgaggggcuacaucucaacgcguguggagaugggggaagcagccggaaucuuuaugacugcuaccccaccgggcucccgggacccuuucccccagaguaaugccccaauuauagaugaggagagagaaauccccgagaggucuuggaacagcggucaugaaugggucacagacuuuaaagggaagaccgugugguucguaccuuccauuaaggcaggaaaugauaucgccgcuugccuccgcaaaaacggcaagaaagugauucaauuaucacgaaagacuuuugacucugaguauguuaaaacaagaaccaaugauugggacuucgucgugacgacugauaucagcgaaaugggcgcgaacuuuaaggccgaccgggugauagacccaaggcgcuguaugaaacccgucauccugacagauggggaggagcguguaauucuugcaggaccuaugccggugacccacaguuccgcugcccagagacgggguaggaucggccgcaauccaaagaacgaaaaugaccaguacauuuacaugggggagccccuggaaaacgaugaggacugcgcacacuggaaggaagccaaaaugcucuuggauaauaucaacaccccugagggaauaauucccagcauguucgagccagaacgagagaagguugacgcuaucgauggcgaauauagacugcggggugaggccaggaaaacuuuuguggaccucaugcgcagaggggaucugccugucuggcuugcguacaagguggcagccgaaggcauuaauuaugcugacaggcggugguguuucgauggaaucaaaaacaaccagauacuagaggagaauguugaaguggagaucuggacaaaggaaggcgagcguaagaaacugaagccccgcugguuggacgcccgaauuuacucugauccauuagcucugaaagaguuuaaggaguucgcagccgggagaaaaucacucacccugaaccuuaucacagagaugggaaggcugccuacuuucaugacgcaaaagacccgggacgcucucgacaauuuggccguccugcauacagcagaagcggguggccgcgccuauaaccacgcucuauccgagcugccggaaacucucgagacccuucuguuauugacacugcucgccaccgugacugggggaauuuuucuguuccuuaugaguggcagagguaucgggaagaugacgcugggcaugugcugcauaauuaccgcaagcauccucuugugguacgcucagauccagccccauuggauugccgcaucgaucauacuggaguuuuucuuaauuguacuacugaucccagaaccugagaaacagaggacaccccaagauaaucagcucacuuaugugguuauugccauccuuaccgucguggcugcgacaauggccaacgaaaugggauuucuggagaagaccaaaaaggacuugggccuggggucuauagcaacucagcagccagaauccaauauccucgauauugaccugcggccugcuagcgccuggacacuuuacgccguggcaacgaccuucgucacucccaugcuccgacacucaaucgagaacaguucuguuaaugugucccugacagcuauugccaaccaagcgaccguauugaugggacuggguaaaggcuggccguuaagcaagauggauaucggggugccacuacuggcuauuggauguuacucacaggucaauccuaucacccucacagccgcacuucuguugcugguggcccacuaugcuauaauuggccccggucuccaggcaaaggccacuagagaggcgcagaaacgcgcugccgcagggaucaugaagaacccaacgguugacggcaucaccgugauugaucuggaccccauaccuuacgauccgaaauuugaaaagcaacuuggacaggucauguuacugauccucugcguaacacagguguugaugaugaggacuaccugggcccugugugaggcucuaacacuggccaccggccccauuaguacucucugggaagggaauccaggacgguucuggaacacgacaaucgcaguuagcauggcuaauauuuuucguggcuccuaucuugccggugcggggcuguuguucucuaucaugaaaaacaccacuaauaccagaaggggaacaggcaacauaggugagacucugggcgaaaaguggaaaagccgccucaacgcccuggggaaguccgaguuucaaaccuacaagaaaucaggaauccaggagguggaccggacauuagcaaaggaaggcauuaaacgaggggagacggaucaucacgcugucucuagaggaagugccaaacuuaggugguucguggaacgcaauauggucaccccugagggcaaagugguugaccuggguugcgggcggggaggcuggucguauuacugugguggccucaagaacgugagagagguaaaggggcuaacuaaaggaggccccgggcaugaagaaccuaucccaaugagcacauauggauggaaucuggugcguuugcaguccggcgucgauguauuuuucauucccccugaaaagugcgacacccugcucugugacaucggugagucuucaccaaaccccacuguggaagcagggaggacacuucggguccugaauuugguggagaacuggcugaauaacaauacccaguucugcauaaaaguacucaacccguacaugccuagcgugauugagaagauggaggcuuuacaacgcaaauacggaggcgcccugguucgaaauccacuuuccagaaacaguacgcacgagauguauugggugucuaaugccagcggcaacaucgucucauccgugaauaugaucaguaggaugcugauuaaccgguuuaccaugcgccauaagaaggcgacauacgaacccgaugucgaccuagggagcggaacuagaaacauagguaucgagucugaaauuccuaaucucgauaucauuggcaaaaggaucgagaagauaaaacaggagcacgaaaccuccuggcacuaugaccaggaucauccauacaagacaugggcuuaucacgggucauacgagacuaaacagaccggaagcgcaucgucuauggugaacggcguuguacgacuguugacaaagcccugggacgugcugccgaccgucacucaaauggccaugacggauacaaccccuuucggucagcagcggguguuuaaggaaaaaguugacacucguacccaggagcccaaggaagggacuaagaagcucaugaaaaucacggcugaguggcuuuggaaggagcugggcaaaaagaagaccccaagaauguguacucgcgaagaguucacaaggaaagugcggaguaaugccgcauuaggcgccauuuuuaccgaugaaaacaaguggaaauccgcuagagaggcggucgaggacagccgcuucugggaacugguggauaaggagaggaauuugcaucucgaaggcaaaugcgagacuuguguauauaacaugauggggaagcgagaaaagaaacugggagaguuugguaaggccaaaggcucacgggcaaucugguacauguggcuaggggcuagauuccuugaguuugaagcccugggauuccucaaugaggaccacugguuuuccagggaaaacucucugagcggcguggagggugaaggguugcacaagcugggauacauucuccgcgacguuaguaaaaaggagggcggcgcaauguaugccgaugacacagcugggugggauacccguaucacacuugaggaccugaagaaugaagagauggucacuaaccauauggaaggagagcacaaaaaguuagccgaagcgauuuucaaacugaccuaccaaaauaagguggugcggguccagagaccuacgcccagggguaccguuauggauauaaucucccgccgagaccagcggggcagcgggcaagugggaacauauggcuugaacacuuuuaccaauauggaggcacagcucauuagacagauggagggugaagggguauucaaaaacauccagcaucugacagccacugaggaaguggcuguccaaaauuggcuagccagggugggacgcgagagacuuucucggauggcaaucucaggcgaugacugcguugugaagccacuggaugacagguucgcuaacgcccucaccgcucugaacgauaugggcaagauucguaaagacauacagcagugggagcccaguaagggguggaaugauuggacgcaggucccuuuuugcucccaccauuuccacgaauugaucaugaaagacggacgaguguuaguaguuccaugucgcaaccaagacgagcugauugguagagcccggaucagccagggcgcaggguggucucucagggaaacagcgugccuuggaaagucguacgcccagauguggucacugauguauuuucaccgcagagaucuacggcuggcugccaaugcaauuuguagcgcugugccgucccauuggguccccaccaguaggacuacauggucuauccacgccaaacaugaguggaugaccacugaagacaugcucaccguguggaaccgaguguggauacgugagaauccuuggauggaggauaagacaccagucgaaagcugggaggaaauccccuacuugggcaagagagaggaccaguggugcgguucccugauugggcuuacgucacgcgcaaccugggccaaaaacauccaagcggcuauuaaucagguucggagucugaucggaaacgaagaguauacugauuacaugccuucuaugaagagguucagacgcgaggaagaggaagccggcgugcucugguga

SEQ ID NO: 14410 - RNA, 9876 nt, Artificial Sequence
  derived and/or modified CDS sequence (opt3) from DENV-2__GU131897__SS-prME
agcgccggaaugaucauuaugcugauaccaaccgugauggcuuuccaccucacuacucggaacggggagccucauaugaucgucggcauucaggaaaaggguaaaucccuucuguuuaagacggaggacggaguuaauaugugcaccuugauggcaauggauuuaggggaacugugugaggacacaaucacuuacaaaugcccacuacucaggcaaaacgaaccggaggauauugacuguuggugcaauucuaccucaacaugggugaccuauggaacuuguacaaccacgggcgagcaccggcgcgaaaagcgaaguguagcccuggugccacaugucgguauggggcuugagacucguaccgaaacauggaugagcuccgagggagcguggaaacacgcucagagaaucgagacuuggauacugaggcauccuggcuucaccaucauggccgcaauuuuggccuacacaaucggcaccacgcacuuucagcgggugcucauuuucauccugcugacugcuguugcaccaucuaugacaaugcgcugcauagggauuucgaacagagauuuuguggaaggagucucagguggcagcuggguggacaucguacucgagcacgggaguuguguuaccacuauggccaagaauaagcccacauuagauuucgaacugauuaaaaccgaggcuaagcagccugccacgcuuaggaaauauugcaucgaagcgaaguugaccaacacaacuaccgagucccgguguccaacacaaggagagcccucucugaaagaggaacaggacaagcgcuuugugugcaagcauagcauggucgaucgaggcugggguaauggguguggacuauucggcaaaggcgggaucgugacuugcgcaauguuuaccugcaagaaaaacauggaaggaaagauugugcagccugagaaucucgaauacacaauagucguuaccccacacuccggugaggagcaugccgugggcaacgacacugggaaacacggaauggaaaucaagguaacgccgcagucaaguauuacagaggcugaacugaccggcuaugguacugugaccauggaguguagccccagaacagggcuugauuucaaugaaaugguccuguugcaaauggagaacaaagccuggcucgugcacaggcagugguuucuggacuuaccucugccauggcuccccggcgcagauaagcaggagucuaauuggauccagaaggaaacccuuguuacuuucaaaaacccucaugcuaagaaacaagacguggucgugcugggaucccaggagggcgccaugcacacagcguugacgggggccaccgaaauacagaugucaagcggaaaucuacuguuuacuggucaucucaagugccggcugcguauggacaaacuucaacugaagggcaugaguuacucuauguguacagggaaguucaaaguaguuaaggagauugcagagacccagcacggaacaaucgugauccgcguccaguaugaaggcgaugguuccccaugcaaaauucccuucgagaucauggacuuggaaaagagauacgugcucgggaggcugauuacugucaacccgauagugaccgagaaagauagcccuguuaacaucgaagcugagcccccauuuggcgacucguacauuaucaucggaguggagccuggccaguuaaagcugaauugguucaagaaagggucuuccauuggacaaauguuugaaacgaccaugcggggugccaagcgaauggcuauacuaggcgauacagccugggacuucgggucacucggaggcguauuuacaaguaucgguaaagcacugcaucaggucuucggggccauuuauggcgcugcguuuagcggaguguccuggaccaugaagauccuuauuggcguuaucauaacauggaucgggaugaacucucgcagcacuucauugagugugucccugguccucgugggaauuguaacccuguaccuuggcgugaugguucaggcagauagcgguugugucgugucuuggaaaaauaaggagcugaagugcgggucaggaaucuucauuacggacaacgugcacacauggaccgaacaguauaaauuucaacccgagaguccaagcaaguuggccuccgcuauccagaaagcccaggaagagggcauaugugguauuagaucugucacuaggcucgagaaucugauguggaagcagaucacacccgaauuaaaccacauucuggcagagaaugaaguuaaacuaaccaucaugacuggcgauauaaaggggaucaugcaagccggaaaacggucgcuccgcccucagccaaccgagcugaaguacagcuggaagacauggggcaaagcuaagaugcuuuccacggaaucauauaaccagaccuucuugauugacgggccggagacugccgagugccccaauacaaacagagcauggaauagucuggaaguggaggauuacggauuuggcguguucaccacaaacaucuggcucaaacugaaggaaaaacaggacgcguuuugugacucuaaguuaaugagcgcugccauuaaggauaauagggcaguacaugccgacauggguuauuggaucgaguccgcucugaacgauacuuggaaaauagagaaggccucauucauugaagucaaaaauugccacuggccuaagagccauacccuuuggucuaacgggguguuggaguccgaaaugaucauccccaagaaccucgcaggacccguuagucaacacaauuaccguccuggcuaccacacgcagauugcugguccauggcaucugggcaagcuagagauggacuucgauuuuugugacgggacaaccgugaucgucacugaagauugcggaaaccggggccccagccugcgaaccacaacugccucugggaagcucauuaccgaguggugcuguagauccugcacacugccgccucuuagguaucgcggagaggacggcuguugguacgguauggaaauacggccauugaaagagaaggaagagaaucugaucaacucauuagugacggcggggcacggacagguugauaauuucagucucggcgugcuggguauggcccuuuuucuggaagagauguugagaaccaggguaggcacuaaacaugcuauucuccuggucgcagugagcuucgugacacuaaucaccgggaacaugucguuuaaggaccugggacgcgucguugugaugguaggcgccacuauggcugaugacauugggaugggagugacauaucucgcccugcuugcagcguucaaaguccgacccaccuuugccgcuggcuugcuguuacggaagcucacguccaaggagcugaugaugacuaccaucgguauagugcuucugucucaaagcacaaucccugaaaccguucuagagcucacugaugcccuggcauuggggaugauggugcugaaaauuguccguaauauggaaaaguaccaguuagcugugacaaucauggccauucucugcguucccaacgcagugauccugcagaaugccuggaaagucucauguaccauacuugcuguagugaguguuuccccacuguugcucacaucuagccagcaaaagacugacuggauuccucuggcgcuaaccaucaaaggacugaaccccacggccaucuuccuuacaacccucuccagaacuaauaagaaaaggucauggccacugaacgaggcaauuauggcugugggcauggucagcauauuggccaguucucuguuaaagaaugacaucccgaugaccggcccucucguggccgggggacugcuuacaguaugcuaugugcugacuggucgcuccgcugauuuggaacucgagcgggcaaccgacgucaagugggaggaucaggccgaaauuagcggcucgucacccauccugucuauuacgaucagugaggacggguccaugagcaucaagaacgaagaggaggaacagacacuaaccauccugauuagaacuggacuucucguuaucucuggccuguuuccaauuagcauccccauaacagcggcugccugguacuugugggaggugaagaaacagagggccgguguguuaugggaugucccuuccccacccccuauggggaaggccgaacuggaggacggagcuuaucgaauuaaacaaaagggcauccucggcuacucacagaucggggcaggaguguacaaggaagguaccuuccacacuauguggcauguuacacgcggcgccguacugaugcacaaagggaagcggauugagccgaguugggcggaugugaaaaaggaccuuaucagcuauggaggcgguuggaaacuggagggggaauggaaggagggagaagagguccagguguuggcucuagaaccaggcaagaaucccagagccguucagaccaaaccuggccuguuuaagacgaacacugggaccauaggagcagugucucucgauuucuccccagguacaucaggcagucccauuaucgacaaaaaggggaaagucgugggacuguacggcaacgguguagucaccaggagcggggccuauguguccgcuauugcccaaacagagaagucuaucgaggauaauccugaaauagaggacgauauuuuucguaagcgccggcuuacuaucauggacuuacacccgggagcaggcaaaaccaagagauaccugcccgcuaucguuagggaagccauuaaacgaggccuccggacguugauccuggcgccaacacgcguggucgccgcagagauggaagaggcucucagagggcugccuauuagguaucagacucccgccauacgggcugagcauaccggacgagaaaucguggaccuuaugugucacgcaacauucaccaugagacuguugucgccaguucgcgugccuaacuacaaucuaauuaucauggaugaggcccauuucacugaccccgccagcaucgcugcgagggguuauauuucaacccgugucgaaaugggcgaggcagccgggauauuuaugacagcuacgccaccgggaucccgggauccuuucccccagaguaacgccccaaucauugacgaggaaagagagauccccgaaaggucuuggaauagcggccacgagugggugauggauuuuaaggguaaaacuguaugguucgugccuuccauuaaggcagggaacgacaucgccgcuugccugcgcaagaauggcaaaaagguuauacaacucucacgaaaaaccuuugauucugaauacgucaagacaagaaccaacgacugggauuucguggugacuacagacaucagcgagaugggcgcgaauuuuaaagccgagcgggucauugauccaaggcgcuguaugaagcccguaaucuuaaccgacggcgaggaacgugugauucuggcagggccuaugccgguuacgcauaguuccgcugcccagagacggggaaggaucggucgcaaccccaaaaaugaaaacgaccaguacauauauaugggcgagccccuugaaaaugaugaggacugcgcacacuggaaggaggccaagaugcugcucgauaacauuaauacuccugaagggaucauucccagcauguucgagccagaacgagagaaaguggacgcuaucgauggagaauacagauugcggggcgaggccaggaagacauuugucgaccugaugcgcagaggugaucucccuguguggcuggcguauaaaguugcagccgaggggauaaacuacgcugacaggcggugguguuucgauggcaucaagaacaaucagauucuugaagagaacguggaagucgagaucuggaccaaagagggagaacguaagaagcuaaaaccccgcuggcuggacgcccgaauuuauucugauccauuggcuuuaaaggaguuuaaagaguucgcagccggcagaaagucacugacccucaaucugaucacugagauggggaggcuuccuacauucaugacccagaaaacucgggacgcucuggauaaccucgccguguugcacacugcagaagcgggaggucgcgccuacaaucaugcucuguccgagcuaccggagacgcuggaaacccuccuucuguuaacauugcuggccacuguaaccggcgggauauuucucuuccugaugaguggaagaggcauugguaagaugacacuugggaugugcugcaucaucaccgcaagcauucugcucugguaugcucaaauccagccccacuggauagccgcaucgauuaucuuggaguuuuuccugauuguguuacuaaucccagaaccugagaagcagaggacuccccaagacaaccagcugacguacguugucauagccauccucaccgugguggcugcgacaauggccaaugaaaugggcuuucuugagaaaacuaagaaagaccugggauugggcucuauugcaacccagcagccagaguccaacauccuggauauugaccuccggccugcuagcgccuggacacuguacgccgucgcaaccacuuucguuacacccaugcuucgacauucaaucgaaaauaguucugugaacguaucccucacggcuauugccaaucaagcgaccgugcugaugggguugggaaaggguuggccgcugagcaaaauggauaucggcgucccauuacuagcuauaggguguuauucacaggugaacccuauuacucugacagccgcacuccuucuguugguugcccacuacgcuaucaucggacccggccugcaggcaaaggccaccagagaggcgcagaagcgcgcugccgcagguauuaugaaaaauccaaccguggacgggauaacagucaucgaucucgaccccauuccuuaugauccgaaguuugaaaaacaacugggccagguaaugcuuuuaauccugugcgugacucagguucucaugaugaggacgaccugggccuugugugaggcucugacacuagccacuggacccauuaguacccugugggaaggcaacccagggcgguucuggaauacaaccaucgcagugagcauggcuaacauauuucguggauccuaccucgccggcgcgggucuucuguucucuaucaugaagaauacuacgaacacaagaagggggaccggaaacauuggcgagacuuugggugagaaauggaaaagccgccugaaugcccucggcaaauccgaauuucaaaucuauaagaagucagggauucaggaggucgaccggacccuggcaaaagaaggaaucaagcgaggcgagacagaucaccaugcugugucuagagggagugccaaauuaaggugguucgucgagcgcaacauggugacuccugaaggaaagguuguggaccuuggcugcgguagagggggauggucguacuauuguggcggucugaaaaauguaagagaggugaagggccucaccaaagggggacccggccacgaggaaccuauaccaaugagcacauacggguggaaccuaguccgucugcaguccggaguugauguguuuuucauucccccugaaaaaugcgacacguugcugugugauaucggcgagucuucaccaaaucccaccgucgaggcagguaggacucuccgggugcuuaaccugguagaaaauugguugaacaauaacacacaguucugcaucaaggugcugaauccguacaugccuagcguuauugagaaaauggaagcucuccaacgcaaguaugggggagccuuagugcgaaacccacuguccagaaauaguacccaugagauguacugggucucuaacgccagcggcaauauagugucauccgucaacaugaucaguaggaugcuuauuaaccgguuuacuaugcgccacaaaaaggcgacauaugaacccgacguggaccugggcagcgggaccagaaauaucggaauugagucugagaucccuaaccuagauauaaucgguaagaggauugagaaaauaaaggaagaacaugagacguccuggcacuacgaccaggaucacccauauaaaaccugggcuuaccauggcucauaugaaacaaagcagacugggagcgcaucgucuaugguuaauggaguagugcgacuccugaccaaacccugggacgucuugccgacagugacucagauggccaugaccgauacaaccccuuucggccaacagcggguuuuuaaggagaagguggacacucguacgcaggagcccaaagaagguacaaagaaacugaugaagauuaccgcugaguggcucuggaaagaacuugggaagaaaaagacuccaagaauguguacccgcgaggaguucacaaggaagguccggaguaacgccgcacugggagccaucuuuacggaugaaaauaaauggaaguccgcuagagaggcgguggaagacagccgcuucugggaguuaguagauaaagaaaggaaccugcacuuggagggcaagugcgagaccuguguguacaauaugaugggcaaacgagaaaagaagcucggggaguuuggaaaagccaaggguucacgggcaauuugguacauguggcugggcgcuagauuccuagaauuugaggcccuuggguuccugaacgaagaccauugguuuuccagggaaaauucucucagcggaguugagggcgaaggucugcacaaauugggguauauacugcgcgaugucaguaagaaagagggaggcgcaauguacgccgacgacacugcuggcugggauacacguaucacccucgaagaccuuaagaacgaggaaauggugacuaaucacauggagggggagcauaagaaacuggccgaagcgauuuucaaguuaacauaucagaacaaagugguccggguucaaagaccuacccccaggggaacagugauggauaucaucucccgccgagaccagcgggguagcggccagguagggacuuacggacugaauaccuuuacgaacauggaggcacaauugauuagacagauggaaggcgaggguguguucaagaauauacagcaccucaccgucacagaggaagccgcugugcagaacuggcuggccaggguugggcgcgagagacuaucucggauggcaaucucaggagaugacugcguggucaaaccacuugaugacagguucgcuaacgcccugacugcucucaaugauaugggcaagauucguaaggacauccaacagugggaacccaguaaaggcuggaacgauuggacccaggugccuuuuugcucccaucacuuccaugagcugauuaugaaggacgggcgaguauugguugugccaugucgcaaucaggaugaauuaaucgguagagcacggauaagccaaggagcaggcuggucucugagggagacagcgugccucgggaaaucguaugcccagauguggucacuuauguacuuucaccgcagagaccugcggcuagcugccaacgcaaucuguagcgcugucccgucccacugggugcccacaaguaggaccacguggucuauucaugccaagcacgaguggaugacaaccgaagacaugcugacuguguggaaucgagucuggauccgugagaacccuuggauggaagauaaaacaccaguugagagcugggaagagauucccuaucucggaaagagagaggaccaguggugcggcuccuugaucggucugaccucacgcgcaacuugggccaagaauauacaggcggcuauuaaccaagugcggagucuuaucgggaaugaagaguacaccgauuacaugccuucuaugaaaagguucagacgcgaagaggaagaggccggaguacugugguga

SEQ ID NO: 14411 - RNA, 9876 nt, Artificial Sequence
  derived and/or modified CDS sequence (opt3) from DENV-2__GQ868631__SS-prME
agcgccggcaugauaauuaugcugauacccaccgugauggcuuuccaccucaccacuagaaacggggagccucauaugaucgucgguauucaagaaaagggaaaaucccuucuguuuaagacggaggacggcguuaauaugugcaccuugauggcaauggauuuaggggaacugugugaggacacaaucacuuacaaaugcccacuacucaggcaaaacgaaccggaggauauugacuguuggugcaauucuaccucaacaugggugaccuauggaacuuguacaaccaagggcgagcaccggcgcgaaaaacgaaguguagcccuggugccccaugucgguauggggcuugagacgcguacugaaaccuggaugagcuccgagggagcguggaagcacgcucagagaaucgagacauggauacugaggcauccuggcuucacuaucauggccgcaauuuuggccuacaccaucggcacaacccacuuucagcgggugcucauuuucauccugcugacggcuguugcaccaucuaugacuaugcgcugcauagggauuucgaacagagauuuuguggaaggagucucagguggcagcuggguggacaucguacucgagcacgggaguuguguuacaaccauggccaagaauaaacccacuuuagauuucgaacugauuaagacagaggcuaaacagccugccacccuuaggaaguauugcaucgaagcgaaauugacgaacaccacaacugagucccgguguccaacccaaggagagcccucucugaaggaggaacaggacaagcgcuuugugugcaaacauagcauggucgaucgaggcugggguaauggguguggacuauucggcaagggcgggaucgugacaugcgcaauguuuacuugcaaaaagaacauggaaggaaaaauugugcagccugagaaucucgaauacaccauagucguuacaccacacuccggugaggagcaugccgugggcaacgacaccgggaagcacggaauggaaaucaaaguaacuccgcagucaaguauuacggaggcugaacugacaggcuaugguaccgugacuauggaguguagccccagaaccgggcuugauuucaaugaaaugguccuguugcaaauggagaacaaggccuggcucgugcacaggcagugguuucuggacuuaccucugccauggcuccccggcgcagauaagcaggagucuaauuggauccagaaagaaacacuuguuaccuucaagaacccucaugcuaaaaagcaagacguggucgugcugggaucccaggagggcgccaugcacacugcguugacaggggccacggaaauacagaugucaagcggaaaucuacuguuuaccggucaucucaaaugccggcugcguauggacaaacuucaacugaagggcaugaguuacucuauguguacugggaaauucaagguaguuaaagagauugcagagacacagcacggaaccaucgugauccgcguccaguaugaaggcgaugguuccccaugcaagauucccuucgagaucauggacuuggagaagagauacgugcucgggaggcugauuacagucaacccgauagugacugagaaggauagcccuguuaacaucgaagcugagcccccauuuggcgacucguacauuaucaucggaguggagccuggccaguuaaagcugaauugguucaaaaaggggucuuccauuggacaaauguuugaaaccacgaugcggggugccaaacgaauggcuauacuaggcgauaccgccugggacuucgggucacucggaggcguauuuacaaguaucgguaaggcacugcaucaggucuucggggccauuuauggcguggcuuuuagcggaguuuccuggacuaugaaaauccuuauuggcgugaucauaaccuggaucgggaugaacucucgcagcacaucauugagugucucccuggugcucguaggaauugugacucuguaccuuggcguuaugguccaggcggauagcgguuguguggugucuuggaagaauaaggagcugaaaugcgggucaggaaucuucauuaccgacaacguccacacguggacagaacaguauaaguuucaacccgagaguccaagcaaauuggcauccgccauccagaaggcucaggaagagggcauaugugguauuagaucuguuaccaggcucgagaaucugauguggaaacagaucacucccgaauuaaaccacauucuggccgagaaugaagugaagcuaacaaucaugaccggcgauauaaaagggaucaugcaagcaggaaagcggucgcuccgcccucagccaacugagcugaaguacagcuggaaaaccuggggcaaggccaaaaugcuuuccacagaaucauauaaccagacguucuugauugacgggccggagaccgcugagugccccaauacuaacagagccuggaauagucuggaaguggaggauuacggauuuggcguauucacaaccaacaucuggcucaagcugaaagaaaagcaggacgcauuuugugacucuaaguuaaugagcgcggcuauuaaagauaauagggccguccaugcagacauggguuauuggaucgaguccgcccugaacgauacauggaagauagagaaggcuucauucauugaagugaagaauugccacuggccuaaaagccauacucuuuggucuaacgggguuuuggaguccgaaaugaucaucccaaagaaccucgccggacccgugagucaacacaauuaccguccuggcuaccacacccagauugcagguccauggcaucugggcaagcuagagauggacuucgauuuuugugacgggacgacagucaucgugaccgaagauugcggaaaccggggccccagccugcgaacuaccacagcuucugggaaacucauuacugaguggugcuguagauccugcacccugccgccucuuagguaucgcggagaggacggcuguugguacgguauggaaauacggccauugaaggagaaagaagagaaucugguuaacucauuagugacagccgggcacggacagguagauaauuucagucucggcguccuggguauggcgcuuuuucuggaagagauguugagaacgagggugggcaccaagcaugccauccuccugguggcugucagcuucguuacucuaauuacagggaacaugucguuuaaagaccugggacgcgugguagugauggucggcgcaaccauggccgaugacaucgggaugggagugacuuaucucgcucugcuugccgcauucaagguucgacccacauuugcggccggcuugcuguuacggaagcucaccuccaaagagcugaugauggcuacgauugguaucgugcuucugucucaaagcacuauaccugaaaccguccuagagcucacagaugcccuggcauuggggaugauggcucugaagaucgugcguaauauggaaaaauaccaguuagccguuaccauuauggcaauccucugcgugcccaacgccgucauucugcagaaugcuuggaagguaucauguacuauccuugcggugguuaguguguccccacuguugcucacaucuagccagcagaagacagacuggauaccucuggcccuaacaauuaagggacugaaccccacugcaaucuuccuuaccacgcucuccagaacaaauaaaaagaggucauggccacugaacgaggcuaucauggccgucggcauggugagcauuuuggccaguucucuguuaaagaaugacauaccgaugaccggcccucucguagcugggggacugcuuacugugugcuauguccugaccggucgcuccgcagauuuggaacucgagcgggccacagacguuaaaugggaggaucaggcggaaaucagcggcucgucacccauucugucuaucacuauuagugaggacggguccaugagcaucaagaacgaagaggaggaacagacccuaacgauacugaucagaacaggacuucucgugauuucuggccuguuuccaaucagcauucccaucaccgcugccgcaugguacuugugggaggugaaaaagcagagggccggugucuuaugggaugugccuuccccacccccuauggggaaagcugaacuggaggacggagcauaucgaauaaagcaaaagggcauucucggcuacucacagaucggggccggaguuuacaaagaagguacuuuccacacaauguggcauguaacccgcggcgcggugcugaugcacaaggggaaacggaucgagccgaguugggcugaugucaagaaagaccuuauuagcuauggaggcgguuggaagcuggagggggaauggaaggagggagaagaggugcagguuuuggcccuagaaccaggcaaaaaucccagagcagugcagacuaagccuggccuguuuaaaacaaacaccgggacgaucggagccgucucucucgauuucuccccagguacuucaggcagucccauaauugacaagaaagggaaggugguaggacuguacggcaacggugucgugaccaggagcggggcuuauguuuccgccaucgcacaaacagagaagucuauugaggauaauccugaaaucgaggacgauauauuucguaaacgccggcuuaccauuauggacuuacacccgggagcuggcaagacaaaaagauaccugcccgccaucgugagggaagcgaucaagcgaggccuccggacuuugauucuggccccaacccgcgucguggcagcugagauggaagaggcccucagagggcugccuaucagguaucagacgcccgcuauucgggcagagcauacaggacgagaaauaguugaccuuaugugucacgccacuuucaccaugagacuguugucgccagugcgcgucccuaacuacaaucuaaucauuauggaugaggcccauuucacagaccccgcuagcaucgcggcaagggguuauaucucaacccguguggaaaugggcgaggccgcugggauuuuuaugacugccaccccaccgggaucccgggauccuuucccccagaguaacgcaccaauaaucgacgaggaaagagagauucccgaaaggucuuggaauagcggccacgaguggguaacagauuuuaaagguaagacggugugguucguuccuuccaucaaggccgggaacgacauugcugcgugccugcgcaaaaauggaaagaaagucauccaacucucacgaaagacuuuugauucugaauacgugaaaaccagaacaaacgacugggauuucguggucaccacugacauaagcgagaugggcgccaauuuuaaggcagagcggguaaucgauccaaggcgcuguaugaaacccgugauuuuaacagacggcgaagaacguguuauccuggcugggccuaugccggugacccauaguuccgccgcacagagacggggaaggauuggucgcaacccaaagaaugaaaacgaccaguacaucuauaugggcgagccccuugaaaaugaugaggacugcgcccacuggaaggaggcuaaaaugcugcucgauaacauaaauacgccugaagggauuauccccagcauguucgagccagaacgagagaaggucgacgccauugauggagaauacagauugcggggcgaggcgaggaaaacuuuuguggaccugaugcgcagaggugaucucccuguuuggcuggcauauaagguggccgcugaggggaucaacuacgccgacaggcggugguguuucgauggcaucaaaaacaaucagauccuugaagagaacgucgaaguggagauuuggacaaaggagggagaacguaagaaacuaaagccccgcuggcuggacgcucgaaucuauucugauccauuggcauuaaaagaguuuaaggaguucgccgcuggcagaaaaucacugacccucaaucugauuaccgagauggggaggcuuccuacuuucaugacacaaaagacccgggacgcccuggauaaccucgcaguauugcacacagcggaagccggaggucgcgcuuacaaucaugcccuguccgagcuaccggagacucuggaaacgcuccuucuguuaaccuugcuggcaacagugacuggcgggaucuuucucuuccugaugaguggaagaggcauagguaagaugacccuugggaugugcugcauuaucacagcuagcauccugcucugguaugcccagauucagccccacuggaucgcagccucgauaauuuuggaguuuuuccugaucguuuuacuaauuccagaaccugagaaacagaggacaccccaagacaaccagcugacuuacgucgugaucgcuauacucacgguggucgcggccaccauggcaaaugaaaugggcuuucuugagaagaccaagaaagaccugggauugggcucuaucgcuacucagcagccagaguccaacauucuggauaucgaccuccggccugccagcgccuggacccuguacgcaguugcuacaaccuucgugacucccaugcuucgacauucaauugaaaauaguucuguaaacgugucccucacagccaucgcgaaucaagcuacgguccugaugggguugggaaaagguuggccgcugagcaaaauggauauuggcgugccauuacuagccaucggguguuauucacagguuaacccuauaacccugacugcagcccuccuucuguugguggcucacuacgcaauuaucggacccggccugcaggccaaggcgacaagagaggcucagaaacgcgccgcagccgguaucaugaagaauccaaccgucgacgggauuaccguaauagaucucgaccccaucccuuaugauccgaaauuugaaaagcaacugggccaggugaugcuuuuaauucugugcguuacacaggugcucaugaugaggacuacgugggcuuugugugaggcccugacccuagcaacaggacccaucaguacucugugggaaggcaacccagggcgguucuggaauaccacaauugcugucagcauggccaacaucuuucguggauccuaccucgcgggcgccggucuucuguucucuauaaugaaaaauaccacuaacacgagaagggggacaggaaacaucggcgagaccuugggugagaaguggaaaagccgccugaaugcacucggcaaguccgaauuucaaauuuauaagaaaucagggauccaggagguggaccggacucuggcuaaggaaggaauuaaacgaggcgagaccgaucaccaugccgucucuagagggagugcaaaguuaaggugguucguggagcgcaacaugguuacaccugaaggaaaagugguagaccuuggcugcgguagagggggauggucguacuauuguggcggucugaagaaugugagagaggucaagggccucacuaaagggggacccggccacgaggaaccuaucccaaugagcaccuacggguggaaccuaguucgucugcaguccggaguggaugucuuuuucauacccccugaaaagugcgacacauugcugugugauauuggcgagucuucaccaaaucccacgguggaggcugguaggacccuccggguacuuaaccugguggaaaauugguugaacaauaacacucaguucugcaucaaaguucugaauccguacaugccuagcgugaucgagaagauggaagccaugcaacgcaaauaugggggagcccucguccgaaacccauuauccagaaauaguacacaugagauguacugggugucuaacgcgagcggcaauauugucucauccgugaacaugauaaguaggaugcugaucaaccgguuuaccaugcgccacaagaaggcuacuuaugaacccgacguugaccuuggcagcgggacaagaaauauuggaaucgagucugagauuccuaaccuggauaucauagguaaaaggaucgaaaagauuaaagaggaacaugagaccuccuggcacuacgaccaggaucacccauauaagacgugggcauaccauggcucauaugaaaccaaacagacagggagcgccucgucuaugguaaauggagugguccgacuacucacuaagcccugggacgugcugccgaccguuacacagauggcuaugacugauaccacaccuuucggccaacagcggguguuuaaggagaaagucgacacccguacucaggagcccaaggaagguacgaaaaaguugaugaaaaucacagccgaguggcuguggaaggaacucgggaaaaagaagaccccaagaauguguacucgcgaggaguucaccaggaaagugcggaguaacgcagcccuuggagcuauuuuuacagaugaaaauaaguggaaauccgcgagagaggccguagaagacagccgcuucugggagcugguggauaaggaaaggaacuuacaccuggagggcaaaugcgagacguguguuuacaauaugaugggcaagcgagaaaagaaauugggggaguuuggaaaggcaaaagguucacgggcuaucugguacauguggcucggcgccagauuccuggaauuugaggcacuaggguuccuuaacgaagaccauugguuuuccagggaaaauucucugagcggagucgagggcgaaggucuccacaagcugggguauauuuugcgcgaugugaguaaaaaggagggaggcgccauguacgcugacgacaccgccggcugggauacucguauaacacuggaagaccucaagaacgaggaaauggugaccaaucacauggagggggagcauaagaaacuugcggaagcaaucuucaaacugacuuaucagaacaaagucguucgggugcaaagaccuacacccaggggaaccguaauggauauuaucucccgccgagaccagcgggguagcggccagguggggacauacggauuaaauacuuuuaccaacauggaggcccaacugaucagacagauggaaggcgagggugucuucaaaaauauucagcacuugacggugaccgaggaagcugccguucagaacuggcucgcaaggguggggcgcgagagacugucucggauggcuauaucaggagaugacugcgucgugaagccacuagaugacagguucgccaacgcucuuacagcccugaaugauaugggcaagauccguaaagacauucaacagugggaacccaguaagggcuggaacgauuggacucagguaccuuuuugcucccaucacuuccaugagcucaucaugaaagacgggcgaguucugguggucccaugucgcaaucaggaugaauugauuggacgggcacggaucagccaaggugcgggcuggucuuuaagggagaccgccugccuggggaagucguaugcucagauguggucacucauguacuuucaccgcagagaccuucggcuggccgcaaacgcuauauguagcgccgugccgucccacugggugcccacaaguaggacuaccuggucuauccaugcaaaacacgaguggaugacgacagaagacaugcuaaccgucuggaaucgaguuuggauucgugagaacccuuggauggaagauaagacuccaguggagagcugggaagagauccccuaucugggaaagagagaggaccaguggugcggcucccucauugguuugacaucacgcgccaccugggcgaaaaauauccaggcugccauaaaccaaguacggagucugauugggaaugaagaguacacugauuacaugccuucuaugaagagguucagacgcgaagaggaagaggcaggagugcuuugguga

SEQ ID NO: 14412 - RNA, 9876 nt, Artificial Sequence
  derived and/or modified CDS sequence (opt3) from DENV-2__GU131899__SS-prME
agcgcaggcaugaucauuaugcugauacccaccgugauggcuuuccaccucacuacuagaaacggggagccucauaugaucgucgguauucaagaaaagggaaaaucccuucuguuuaagacggaggacggcguuaauaugugcaccuugauggcaauggauuuaggggaacugugugaggacacgaucacuuacaaaugcccacuacucaggcaaaacgaaccggaggauauugacuguuggugcaauucuaccucaacaugggugaccuauggaacuuguacaaccacgggcgagcaccggcgcgaaaagcgaaguguagcacuggugccccaugucgguauggggcuugagacucguaccgaaacauggaugagcuccgagggagcguggaaacacgcucagagaaucgagacuuggauacugaggcauccuggcuucaccaucauggccgcaauuuuggccuacacaaucggcaccacgcacuuucagcgggugcucauuuucauccugcugacugcuguugcaccaucuaugacaaugcgcugcauagggauuucgaacagagauuuuguggaaggagucucagguggcagcuggguggacaucguacucgagcacgggaguuguguuaccacuauggccaagaauaagcccacauuagauuucgaacugauuaaaaccgaggcuaagcagccugccacgcuuaggaaauauugcaucgaagcgaaguugaccaacacaacuaccgagucccgguguccaacacaaggagagcccucucugaaagaagaacaggacaagcgcuuugugugcaagcauagcauggucgaucgaggcugggguaauggguguggacuauucggcaaaggcgggaucgugacuugcgcaauguuuaccugcaagaaaaacauggaaggaaagauugugcagccugagaaucucgaauacacaauagucguuaccccacacuccggugaggagcaugccgugggcaacgacacugggaaacacggaaaggaaaucaaaguaacgccgcagucaaguauuacagaggcugaacugaccggcuaugguacugugaccauggaguguagccccagaacagggcuugauuucaaugaaaugguccuguugcaaauggagaacaaggccuggcucgugcacaggcagugguuucuggacuuaccucugccauggcuccccggcgcagauaagcaggagucuaauuggauccagaaagaaacccuuguuacuuucaagaacccucaugcuaaaaagcaagacguggucgugcugggaucccaggagggcgccaugcacacagcguugacgggggccaccgaaauacagaugucaagcggaaaucuacuguuuacuggucaucucaaaugccggcugcguauggacaaacuucaacugaagggcaugaguuacucuauguguacagggaaauucaagguaguuaaagagauugcagagacccagcacggaacaaucgugauccgcguccaguaugaaggcgaugguuccccaugcaagauucccuucgagaucauggacuuggagaagagauacgugcucgggaggcugauuacugucaacccgauagugaccgagaaggauagcccuguuaacaucgaagcugagcccccauuuggcgacucguacauuaucaucggaguggagccuggccaguuaaagcugaauugguucaaaaaggggucuuccauuggacaaauguuugaaacgaccaugcggggugccaaacgaauggcuauacuaggcgauacagccugggacuucgggucacucggaggcguauuuacaaguaucgguaaggcacugcaucaggucuucggggccauuuauggcgcugcguuuagcggaguguccuggaccaugaaaauccuuauuggcguuaucauaacauggaucgggaugaacucucgcagcacuucauugagugugucccugguccucgugggaauuguaacccuguaccuuggcgugaugguucaggcagauagcgguugugucgugucuuggaagaauaaggagcugaaaugcgggucaggaaucuucauuacggacaacgugcacacauggaccgaacaguauaaguuucaacccgagaguccaagcaaauuggccuccgcuauccagaaggcccaggaagagggcauaugugguauuagaucugucacuaggcucgagaaucugauguggaaacagaucacacccgaauuaaaccacauucuggcagagaaugaaguuaagcuaaccaucaugacuggcgauauaaaagggaucaugcaagccggaaagcggucgcuccgcccucagccaaccgagcugaaguacagcuggaaaacauggggcaaggcuaaaaugcuuuccacggaaucauauaaccagaccuucuugauugacgggccggagacugccgagugccccaauacaaacagagcauggaauagucuggaaguggaggauuacggauuuggcguguucaccacaaacaucuggcucaagcugaaagaaaagcaggacgcguuuugugacucuaaguuaaugagcgcugccauuaaagauaauagggcaguacaugccgacauggguuauuggaucgaguccgcucugaacgauacuuggaagauagagaaagccucauucauugaagucaagaauugccacuggccuaaaagccauacccuuuggucuaacgggguguuggaguccgaaaugaucaucccaaagaaccucgcaggacccguuagucaacacaauuaccguccuggcuaccacacgcagauugcugguccauggcaucugggcaagcuagagauggacuucgauuuuugugacgggacaaccgugaucgucacugaagauugcggaaaccggggccccagccugcgaaccacaacugccucugggaaacucauuaccgaguggugcuguagauccugcacacugccgccucuuagguaucgcggagaggacggcuguugguacgguauggaaauacggccauugaaggagaaagaagagaaucuggugaacucauuaguuacggcggggcacggacagguggauaauuucagucucggcguacuggguauggcccuuuuucuggaagagauguugagaaccagggucggcacuaagcaugcuauccuccugguggcagugagcuucgucacacuaauuaccgggaacaugucguuuaaagaccugggacgcguugugguaauggugggcgccacuauggcugaugacaucgggaugggagucacauaucucgcccugcuugcagcguucaaggugcgacccaccuuugccgcuggcuugcuguuacggaagcucacguccaaagagcugaugaugacuaccauugguaucguucuucugucucaaagcacaauaccugaaaccgugcuagagcucacugaugcccuggcauuggggaugaugguccugaagaucgugcguaauauggaaaaauaccaguuagcuguuacaauuauggccauccucugcgugcccaacgcagucauucugcagaaugccuggaagguaucauguaccauccuugcugugguuaguguguccccacuguugcucacaucuagccagcagaagacugacuggauaccucuggcgcuaaccauuaagggacugaaccccacggccaucuuccuuacaacccucuccagaacuaauaaaaagaggucauggccacugaacgaggcaaucauggcugucggcauggugagcauuuuggccaguucucuguuaaagaaugacauaccgaugaccggcccucucguagccgggggacugcuuacagugugcuauguccugacuggucgcuccgcugauuuggaacucgagcgggcaaccgacguuaaaugggaggaucaggccgaaaucagcggcucgucacccauucugucuaucacgauuagugaggacggguccaugagcaucaagaacgaagaggaggaacagacacuaaccauacugaucagaacuggacuucucgugauuucuggccuguuuccaaucagcauucccgugacagcggcugccugguacuugugggaggucaaaaagcagagggccgguguguuaugggauguuccuuccccacccccuauggggaaagccgaacuggaggacggagcuuaucgaaucaagcaaaagggcauacucggcuacucacagauuggggcaggaguauacaaagaagguaccuuccacacuauguggcaugugacacgcggcgccguccugaugcacaaggggaaacggaucgagccgaguugggcggaugugaagaaagaccuuaucagcuauggaggcgguuggaagcuggagggggaauggaaggagggagaagagguucagguguuggcucuagaaccaggcaaaaaucccagagccguccagaccaagccuggccuguuuaaaacgaacacugggaccauuggagcagugucucucgauuucuccccagguacaucaggcagucccaucauagacaagaaagggaagguagucggacuguacggcaacggugugguuaccaggagcggggccuauguguccgcuauugcccaaacagagaagucuaucgaggauaauccugaaauugaggacgauaucuuucguaaacgccggcuuacuauaauggacuuacacccgggagcaggcaagaccaaaagauaccugcccgcuauugucagggaagccaucaagcgaggccuccggacguugauccuggcgccaacacgcgugguugccgcagagauggaagaggcucucagagggcugccuauuagguaucagacucccgccauccgggcugagcauaccggacgagaaauuguggaccuuaugugucacgcaacauucaccaugagacuguugucgccaguccgcgugccuaacuacaaucuaauaaucauggaugaggcccauuucacugaccccgccagcauugcugcgagggguuauaucucaacccguguagaaaugggcgaggcagccgggaucuuuaugacagcuacgccaccgggaucccgggauccuuucccccagaguaacgccccaauuauagacgaggaaagagagauccccgaaaggucuuggaauagcggccacgagugggugacugauuuuaaagguaagaccguuugguucgucccuuccauuaaggcagggaacgacaucgccgcuugccugcgcaaaaauggaaagaaagugauucaacucucacgaaagacauuugauucugaauacgugaaaaccagaacuaacgacugggauuucgucguaacaaccgacaucagcgagaugggcgcgaauuuuaaggccgagcgggugauagauccaaggcgcuguaugaaacccguuaucuuaacggacggcgaagaacgugugauucuggcagggccuaugccggucacucauaguuccgcugcccagagacggggaaggaucggucgcaacccaaagaaugaaaacgaccaguacauuuauaugggcgagccccuugaaaaugaugaggacugcgcacacuggaaggaggccaaaaugcugcucgauaacaucaauacaccugaagggauaauucccagcauguucgagccagaacgagagaagguggacgcuaucgauggagaauacagauugcggggcgaggccaggaaaaccuuuguugaccugaugcgcagaggugaucucccuguguggcuggcguauaaggucgcagccgaggggauuaacuacgcugacaggcggugguguuucgauggcaucaaaaacaaucagauacuugaagagaacauggaaguggagaucuggaccaaggagggagaacguaagaaacuaaagccccgcuggcuggacgcccgaauuuauucugauccauuggcuuuaaaagaguuuaaggaguucgcagccggcagaaaaucacugacucucaaucugaucacagagauggggaggcuuccuaccuucaugacacaaaagacucgggacgcucuggauaaccucgccguauugcacacggcagaagcgggaggucgcgccuacaaucaugcucuguccgagcuaccggagacccuggaaacacuccuucuguuaacuuugcuggccaccgugacaggcgggauuuuucucuuccugaugaguggaagaggcaucgguaagaugacccuugggaugugcugcauaauuacugcaagcauccugcucugguaugcucagauccagccccacuggauugccgcaucgaucauauuggaguuuuuccugauuguuuuacuaaucccagaaccugagaaacagaggacgccccaagacaaccagcugaccuacgucgugauugccauccucacaguggucgcugcgacuauggccaaugaaaugggcuuucuugagaagaccaaaaaggaccugggauugggcucuauagcaacacagcagccagaguccaacauccuggauauugaccuccggccugcuagcgccuggacccuguacgccguugcaacuacauucgugacgcccaugcuucgacauucaaucgaaaauaguucuguaaacgugucccucaccgcuauugccaaucaagcgacuguccugaugggguugggaaaagguuggccgcugagcaagauggauaucggcgugccauuacuagcuauuggguguuauucacagguuaacccuaucacacugaccgccgcacuccuucuguugguggcccacuacgcuauaauuggacccggccugcaggcaaaggccaccagagaggcgcagaaacgcgcugccgcagguaucaugaagaauccaacagucgacgggaucacuguaauugaucucgaccccauaccuuaugauccgaaauuugaaaagcaacugggccaggugaugcuuuuaauccugugcguuacacaggugcucaugaugaggaccacaugggccuugugugaggcucugacucuagccaccggacccauuaguacacugugggaaggcaacccagggcgguucuggaauaccacuaucgcagucagcauggcuaacauuuuucguggauccuaccucgccggcgcgggucuucuguucucuaucaugaaaaauacgacaaacaccagaagggggacuggaaacaugggcgagaccuugggugagaaguggaaaagccgccugaaugcccucggcaaguccgaauuucaaauauauaagcggucagggauccaggagguggaccgaacacuggcaaaagaaggaauuaagagaggcgagacugaucaccaugcugucucuagggggagugccaaauuacgcugguucguggagcggaacaugguuaccccugaaggaaaggugguagaccuuggcugcgguagagggggauggucguacuauuguggcggucugaaaaaugugcgugaggucaagggccucacaaaagggggacccggccacgaagaaccuaucccaaugagcacguacggguggaaccuaguuaggcugcaguccggaguggaugucuuuuucauucccccugaaaaaugcgacaccuugcugugugauaucggcgagucuucaccaaaucccacuguggaggcaggucggacacuccgcguacuuaaccugguggaaaauugguugaacaauaacacccaguucugcauaaagguucugaauccguacaugccuagcgugauugagaaaauggaagcucuccaacgaaaguaugggggagccuuagucagaaacccacuguccaggaauaguacucaugagauguacugggugucuaacgccagcggcaauaucgucucauccgugaacaugaucagucggaugcuuauuaaccgcuuuacaaugagacacaaaaaggcgaccuaugaacccgacguugaccugggcagcgggacgaggaauauaggaaucgagucugagauuccuaaccuagauaucauugguaagcgaaucgagaaaauaaagcaggagcaugaaaccuccuggcacuacgaccaggaucacccauauaaaacaugggcuuaccauggcucauaugagacuaagcagaccgggagcgcaucgucuaugguaaauggagugguccggcuccugacaaaacccugggacguguugccgacuguuacccaaauggccaugacagauaccacuccuuucggccagcagcguguguuuaaggaaaaggucgacacgagaacacaggagcccaaagaggguaccaagaaacugaugaagaucacugcugaauggcucuggaaagagcuugggaagaaaaagaccccacgcauguguacaagggaagaguucacgcggaaggugagaaguaacgccgcacugggagccauuuuuaccgaugagaauaaauggaaguccgcucgcgaagcgguagaggacagcagguucugggaauuaguggauaaagagcgaaaccugcacuuggaaggcaagugcgagacuuguguuuacaauaugaugggcaaacgggagaagaagcucggggaauuuggaaaagccaaggguucaagagcaaucugguacauguggcugggcgcuagguuccuagaguuugaagcccuuggguuccugaacgaggaccauugguuuucccgcgaaaauucucucagcggagucgagggcgagggucugcacaaauugggguauauucugcgugaugugaguaagaaagaaggaggcgcaauguacgccgacgacacagcuggcugggauacccggaucacucucgaggaccuuaagaacgaagagauggugacaaaucacaugaagggggaacauaaaaagcuggccgaggcgauuuucaaauuaaccuaucaaaacaaggucguuagagugcagaggccuacaccccgcggaacuguaauggauauaaucucccgacgggaccagagagguagcggccaaguggggaccuacggacugaauacguuuaccaacauggaggcacaguugauuaggcagauggaaggcgagggugucuucaaaaauauccagcaccucacagugacugaagagguugccgugcaaaacuggcuggcucgcgucgggagagagcggcuaucuaggauggccaucucaggagaugacugcgugguaaagccacuugaugaccguuucgcaaacgcucugaccgcccucaaugauaugggcaagauucgaaaagacauacagcagugggaacccaguaagggcuggaacgauuggacacagguuccuuuuugcucccaucacuuccaugagcugaucaugaaagacgggcgcguguuggucgugccauguagaaaucaagaugaauuaauuggacgggcuaggaucagccagggugccggcuggucucugcgcgagacugcaugccucgggaagucguaugcgcagauguggucacuuauguacuuucacagacgggaccugaggcuagccgcuaacgccauuuguagcgcagugccgucccacuggguccccaccagucgaacgacauggucuauccaugcuaaacacgaauggaugaccacugaggacaugcugacaguuuggaaucguguguggauaagagagaacccuuggauggaagauaagaccccaguagagagcugggaagagauccccuaucucggaaagcgcgaagaccaguggugcggcuccuugauuggucugacuucacgggccaccugggccaaaaauauccaagccgcgauuaaccaggugaggagucuuaucgggaaugaggaguacacagauuacaugccuucuaugaagagauuccgccgggaagaggaagaggcuggaguccugugguga

SEQ ID NO: 14413 - RNA, 9876 nt, Artificial Sequence
  derived and/or modified CDS sequence (opt3) from DENV-2__GU131900__SS-prME
agcgccggaaugaucauuaugcugauaccaaccgugauggcuuuccaccucacuacucggaacggggagccucauaugaucgucgguauucaagaaaagggaaaaucccuucuguuuaagacggaggacggcguuaauaugugcaccuugauggcaauggauuuaggggaacugugugaggacacgaucacuuacaaaugcccacuacucaggcaaaacgaaccggaggauauugacuguuggugcaauucuaccucaacaugggugaccuauggaacuuguacaaccacgggcgagcaccggcgcgaaaagcgaaguguagcccuggugccacaugucgguauggggcuugagacucguaccgaaacauggaugagcuccgagggagcguggaaacacgcucagagaaucgagacuuggauacugaggcauccuggcuucaccaucauggccgcaauuuuggccuacacaaucggcaccacgcacuuucagcgggugcucauuuucauccugcugacugcuguugcaccaucuaugacaaugcgcugcauagggauuucgaacagagauuuuguggaaggagucucagguggcagcuggguggacaucguacucgagcacgggaguuguguuaccacuauggccaagaauaagcccacauuagauuucgaacugauuaaaaccgaggcuaagcagccugccacgcuuaggaaauauugcaucgaagcgaaguugaccaacacaacuaccgagucccgguguccaacacaaggagagcccucucugaaagaagaacaggacaagcgcuuugugugcaagcauagcauggucgaucgaggcugggguaauggguguggacuauucggcaaaggcgggaucgugacuugcgcaauguuuaccugcaagaaaaacauggaaggaaagauugugcagccugagaaucucgaauacacaauagucguuaccccacacuccggugaggagcaugccgugggcaacgacacugggaaacacggaauggaaaucaagguaacgccgcagucaaguauuacagaggcugaacugaccggcuaugguacugugaccauggaguguagccccagaacagggcuugauuucaaugaaaugguccuguugcaaauggagaacaaagccuggcucgugcacaggcagugguuucuggacuuaccucugccauggcuccccggcgcagauaagcaggagucuaauuggauccagaaggaaacccuuguuacuuucaaaaacccucaugcuaagaaacaagacguggucgugcugggaucccaggagggcgccaugcacacagcguugacgggggccaccgaaauacagaugucaagcggaaaucuacuguuuacuggucaucucaagugccggcugcguauggacaaacuucaacugaagggcaugaguuacucuauguguacagggaaguucaaaguaguuaaggagauugcagagacccagcacggaacaaucgugauccgcguccaguaugaaggcgaugguuccccaugcaaaauucccuucgagaucauggacuuggaaaagagauacgugcucgggaggcugauuacugucaacccgauagugaccgagaaagauagcccuguuaacaucgaagcugagcccccauuuggcgacucguacauuaucaucggaguggagccuggccaguuaaagcugaauugguucaagaaagggucuuccauuggacaaauguuugaaacgaccaugcggggugccaagcgaauggcuauacuaggcgauacagccugggacuucgggucacucggaggcguauuuacaaguaucgguaaagcacugcaucaggucuucggggccauuuauggcgcugcguuuagcggaguguccuggaccaugaagauccuuauuggcguuaucauaacauggaucgggaugaacucucgcagcacuucauugagugugucccugguccucgugggaauuguaacccuguaccuuggcgugaugguucaggcagauagcgguugugucgugucuuggaaaaauaaggagcugaagugcgggucaggaaucuucauuacggacaacgugcacacauggaccgaacaguauaaauuucaacccgagaguccaagcaaguuggccuccgcuauccagaaagcccaggaagagggcauaugugguauuagaucugucacuaggcucgagaaucugauguggaagcagaucacacccgaauuaaaccacauucuggcagagaaugaaguuaaacuaaccaucaugacuggcgauauaaaggggaucaugcaagccggaaaacggucgcuccgcccucagccaaccgagcugaaguacagcuggaagacauggggcaaagcuaagaugcuuuccacggaaucauauaaccagaccuucuugauugacgggccggagacugccgagugccccaauacaaacagagcauggaauagucuggaaguggaggauuacggauuuggcguguucaccacaaacaucuggcucaaacugaaggaaaaacaggacgcguuuugugacucuaaguuaaugagcgcugccauuaaggauaauagggcaguacaugccgacauggguuauuggaucgaguccgcucugaacgauacuuggaaaauagagaaggccucauucauugaagucaaaaauugccacuggccuaagagccauacccuuuggucuaacgggguguuggaguccgaaaugaucauccccaagaaccucgcaggacccguuagucaacacaauuaccguccuggcuaccacacgcagauugcugguccauggcaucugggcaagcuagagauggacuucgauuuuugugacgggacaaccgugaucgucacugaagauugcggaaaccggggccccagccugcgaaccacaacugccucugggaagcucauuaccgaguggugcuguagauccugcacacugccgccucuuagguaucgcggagaggacggcuguugguacgguauggaaauacggccauugaaagagaaggaagagaaucuggugaacucauuaguuacggcggggcacggacagguggauaauuucagucucggcguacuggguauggcccuuuuucuggaagagauguugagaaccagggucggcacuaaacaugcuauccuccugguggcagugagcuucgucacacuaauuaccgggaacaugucguuuaaggaccugggacgcguugugguaauggugggcgccacuauggcugaugacaucgggaugggagucacauaucucgcccugcuugcagcguucaaagugcgacccaccuuugccgcuggcuugcuguuacggaagcucacguccaaggagcugaugaugacuaccauugguaucguucuucugucucaaagcacaauaccugaaaccgugcuagagcucacugaugcccuggcauuggggaugaugguccugaaaaucgugcguaauauggaaaaguaccaguuagcuguuacaauuauggccauccucugcgugcccaacgcagucauucugcagaaugccuggaaaguaucauguaccauccuugcugugguuaguguguccccacuguugcucacaucuagccagcaaaagacugacuggauaccucuggcgcuaaccauuaaaggacugaaccccacggccaucuuccuuacaacccucuccagaacuaauaagaaaaggucauggccacugaacgaggcaaucauggcugucggcauggugagcauuuuggccaguucucuguuaaaggacgauauaccgaugaccggcccucucguagccgggggacugcuuacagugugcuauguccugacuggucgcuccgcugacuuggaacucgagcgggcaaccgauguuaagugggaggaccaggccgaaaucagcggcucgucacccauucugucuaucacgauuagugaggauggguccaugagcaucaaaaaugaagaggaggaacagacacuaaccauacugaucagaacuggacuucucgugauuucuggccuguuuccaaucagcauucccaucacagcggcugccugguacuugugggaggugaagaaacagagggccggugucuuaugggacgugccuuccccacccccuauggggaaggccgaacuggaggauggagcuuaucgaauaaaacaaaagggcauucucggcuacucacagaucggggcaggaguuuacaaggaagguaccuuccacacuauguggcauguaacacgcggcgccgugcugaugcacaaagggaagcggaucgagccgaguugggcggacgucaaaaaggaucuuauuagcuauggaggcgguuggaaacuggagggggaauggaaggagggagaagaggugcagguuuuggcucuagaaccaggcaagaaccccagagccgugcagaccaaaccuggccuguuuaagacgaauacugggaccaucggagcagucucucucgacuucuccccagguacaucaggcagucccauaauugauaaaaaggggaaagugguaggacuguacggcaacggugucgugaccaggagcggggccuauguuuccgcuaucgcccaaacagagaagucuauugaggacaacccugaaaucgaggaugacauauuucguaagcgccggcuuacuauuauggacuuacacccgggagcaggcaaaaccaagagauaccugcccgcuaucgugagggaagccaucaaacgaggccuccggacguugauucuggcgccaacacgcgucguggccgcagagauggaagaggcucucagagggcugccuaucagguaucagacucccgccauucgggcugagcauaccggacgagaaauaguugaucuuaugugucacgcaacauucaccaugagacuguugucgccagugcgcgucccuaauuacaaccuaaucauuauggacgaggcccauuucacugaucccgccagcaucgcugcgagggguuauaucucaacccguguggaaaugggcgaggcagccgggauuuuuaugacagcuacgccaccgggaucccgggacccuuucccccagaguaaugccccaauaaucgaugaggaaagagagauucccgaaaggucuuggaacagcggccacgaguggguaacugacuuuaaggguaaaaccgugugguucguuccuuccaucaaggcagggaaugauauugccgcuugccugcgcaagaacggcaagaaggucauccaacucucacgaaaaacauuugacucugaauacgugaagaccagaacuaaugauugggacuucguggucacaaccgauauaagcgagaugggcgcgaacuuuaaagccgagcggguaaucgacccaaggcgcuguaugaagcccgugauuuuaacggacggcgaagaacguguuauccuggcagggccuaugccggugacucauaguuccgcugcccagagacggggaaggauuggucgcaaucccaaaaacgaaaaugaucaguacaucuauaugggcgagccccuugaaaacgacgaggauugcgcacacuggaaggaggccaagaugcugcucgacaauauaaacacaccugaagggauuauccccagcauguucgagccagaacgagagaaagucgaugcuauugacggagaauacagauugcggggcgaggccaggaagaccuuuguggaucugaugcgcagaggugaccucccuguuuggcuggcguauaaaguggcagccgaggggaucaauuacgcugauaggcggugguguuucgacggcauaaagaacaaccagauccuugaagagaaugucgaaguggagauuuggaccaaagagggagaacguaagaagcuaaaaccccgcuggcuggaugcccgaaucuauucugacccauuggcuuuaaaggaguuuaaagaguucgcagccggcagaaagucacugacucucaaccugauuacagagauggggaggcuuccuaccuucaugacacagaaaacucgggaugcucuggacaaucucgccguauugcacacggcagaagcgggaggucgcgccuacaaccaugcucuguccgagcuaccggagacccuggaaacacuccuucuguuaacuuugcuggccaccgugacaggcgggaucuuucucuuccugaugaguggaagaggcauagguaagaugacccuugggaugugcugcauuaucacugcaagcauccugcucugguaugcucagauucagccccacuggaucgccgcaucgauaauuuuggaguuuuuccugaucguuuuacuaauuccagaaccugagaagcagaggacgccccaagacaaucagcugaccuacgucgugaucgccauacucacaguggucgcugcgacuauggccaacgaaaugggcuuucuugagaaaaccaagaaagaucugggauugggcucuaucgcaacacagcagccagaguccaauauucuggacaucgaucuccggccugcuagcgccuggacccuguacgccguugcaacuacauucgugacgcccaugcuucgacauucaauugaaaacaguucuguaaaugugucccucaccgcuaucgccaaccaagcgacuguccugaugggguugggaaaggguuggccgcugagcaaaauggacauuggcgugccauuacuagcuaucggguguuauucacagguuaauccuauaacacugaccgccgcacuccuucuguugguggcccacuacgcuauuaucggacccggccugcaggcaaaggccaccagagaggcgcagaagcgcgcugccgcagguaucaugaaaaacccaacagucgaugggauuacuguaauagaccucgaucccaucccuuaugacccgaaguuugaaaaacaacugggccaggugaugcuuuuaauucugugcguuacacaggugcucaugaugaggaccacaugggccuugugugaggcucugacucuagccaccggacccaucaguacacugugggaaggcaauccagggcgguucuggaacaccacuauugcagucagcauggcuaauaucuuucguggauccuaccucgccggcgcgggucuucuguucucuauaaugaagaacacgacaaauaccagaagggggacuggaaacaucggcgagaccuugggugagaaauggaaaagccgccugaacgcccucggcaaauccgaauuucaaauuuauaagaagucagggauccaggagguggaucggacacuggcaaaagaaggaauuaagcgaggcgagacugaccaccaugcugucucuagagggagugccaaauuaaggugguucguggagcgcaauaugguuaccccugaaggaaaggugguagaucuuggcugcgguagagggggauggucguacuauuguggcggucugaaaaacgugagagaggucaagggccucacaaaagggggacccggccacgaggaaccuaucccaaugagcacguacggguggaaucuaguucgucugcaguccggaguggacgucuuuuucauacccccugaaaaaugcgauaccuugcugugugacauuggcgagucuucaccaaaccccacuguggaggcagguaggacacuccggguacuuaaucugguggaaaacugguugaauaacaauacccaguucugcaucaagguucugaacccguacaugccuagcgugaucgagaaaauggaagcucuccaacgcaaguaugggggagccuuaguccgaaauccacuguccagaaacaguacucaugagauguacugggugucuaaugccagcggcaacauugucucauccgugaauaugauaaguaggaugcuuaucaaccgguuuacaaugcgccacaaaaaggcgaccuaugaacccgacguugaucugggcagcgggacgagaaacauuggaaucgagucugagauuccuaaucuagacaucauagguaagaggaucgagaaaauuaaggaggaacaugagaccuccuggcacuacgaucaggaccacccauauaaaacaugggcuuaccauggcucauaugaaacuaagcagaccgggagcgcaucgucuaugguaaacggagugguccgacuccugacaaaacccugggauguguugccgacuguuacccagauggccaugacagacaccacuccuuucggccaacagcggguguuuaaggagaaggucgauacgcguacacaggagcccaaagaagguaccaagaaacugaugaagaucacugcugaguggcucuggaaagaacuugggaagaaaaagaccccaagaauguguacacgcgaggaguucacgaggaaggugcggaguaaugccgcacugggagccauuuuuaccgacgaaaacaaauggaaguccgcuagagaggcgguagaagauagccgcuucugggaguuaguggacaaagaaaggaaucugcacuuggagggcaagugcgagacuuguguuuacaacaugaugggcaaacgagaaaagaagcucggggaguuuggaaaagccaaggguucacgggcaaucugguacauguggcugggcgcuagauuccuagaauuugaggcccuuggguuccugaaugaagaucauugguuuuccagggagaacucucucagcggagucgagggcgaaggucugcacaaauugggguauauucugcgcgacgugaguaagaaagagggaggcgcaauguacgccgacgauacagcuggcugggacacccguauaacucucgaagaucuuaagaaugaggaaauggugacaaaccacauggagggggagcauaagaaacuggccgaagcgaucuucaaguuaaccuaucagaauaaagucguucgggugcaaagaccuacacccaggggaacuguaauggacauuaucucccgccgagaucagcgggguagcggccagguggggaccuacggacugaacacguuuaccaauauggaggcacaauugaucagacagauggaaggcgagggugucuucaagaacauucagcaccucacagugacugaggaagccgcuguucagaauuggcuggccaggguggggcgcgagagacuaucucggauggcaauaucaggagacgauugcgucgugaaaccacuugacgauagguucgcuaacgcccugaccgcucucaacgacaugggcaagauccguaaggauauucaacagugggaacccaguaaaggcuggaaugacuggacacagguaccuuuuugcucccaucacuuccaugagcugaucaugaaggaugggcgaguuuugguggucccaugucgcaaccaggacgaauuaauugguagagcacggaucagccaaggagcaggcuggucucugagggagacugcgugccucgggaaaucguaugcccagauguggucacuuauguacuuucaccgcagagaccugcggcuagcugccaaugcaauauguagcgcugugccgucccacugggugcccaccaguaggacgacauggucuauccaugccaagcacgaguggaugaccacugaagauaugcugacagucuggaaccgaguuuggauucgugagaauccuuggauggaagacaaaaccccaguggagagcugggaagagauccccuaucucggaaagagagaggaucaguggugcggcuccuugauuggucugacuucacgcgcaaccugggccaagaacauccaggcggcuauaaaucaaguacggagucuuauugggaacgaagaguacacagacuacaugccuucuaugaaaagguucagacgcgaagaggaagaggccggagugcugugguga

SEQ ID NO: 14414 - RNA, 9876 nt, Artificial Sequence
  derived and/or modified CDS sequence (opt3) from DENV-2__GU131901__SS-prME
agcgccggaaugaucauuaugcugauaccaaccgugauggcuuuccaccucacuacucggaacggggagccucauaugaucgucgguauucaagaaaagggaaaaucccuucuguuuaagacggaggacggcguuaauaugugcaccuugauggcaauggauuuaggggaacugugugaggacacgaucacuuacaaaugcccacuacucaggcaaaacgaaccggaggauauugacuguuggugcaauucuaccucaacaugggugaccuauggaacuuguacaaccacgggcgagcaccggcgcgaaaagcgaaguguagcccuggugccccaugucgguauggggcuugagacucguaccgaaacauggaugagcuccgagggagcguggaaacacgcucagagaaucgagacuuggauacugaggcauccuggcuucaccaucauggccgcaauuuuggccuacacaaucggcaccacgcacuuucagcgggugcucauuuucauccugcugacugcuguugcaccaucuaugacaaugcgcugcauagggauuucgaacagagauuuuguggaaggagucucagguggcagcuggguggacaucguacucgagcacgggaguuguguuaccacuauggccaagaauaagcccacauuagauuucgaacugauuaaaaccgaggcuaagcagccugccacgcuuaggaaauauugcaucgaagcgaaguugaccaacacaacuaccgagucccgguguccaacacaaggagagcccucucugaaagaggaacaggacaagcgcuuugugugcaagcauagcauggucgaucgaggcugggguaauggguguggacuauucggcaaaggcgggaucgugacuugcgcaauguuuaccugcaagaaaaacauggaaggaaagauugugcagccugagaaucucgaauacacaauagucguuaccccacacuccggugaggagcaugccgugggcaacgacacugggaaacacggaauggaaaucaagguaacgccgcagucaaguauuacagaggcugaacugaccggcuaugguacugugaccauggaguguagccccagaacagggcuugauuucaaugaaaugguccuguugcaaauggagaacaaagccuggcucgugcacaggcagugguuucuggacuuaccucugccauggcuccccggcgcagauaagcaggagucuaauuggauccagaaggaaacccuuguuacuuucaaaaacccucaugcuaagaaacaagacguggucgugcugggaucccaggagggcgccaugcacacagcguugacgggggccaccgaaauacagaugucaagcggaaaucuacuguuuacuggucaucucaagugccggcugcguauggacaaacuucaacugaagggcaugaguuacucuauguguacagggaaguucaaaguaguuaaggagauugcagagacccagcacggaacaaucgugauccgcguccaguaugaaggcgaugguuccccaugcaaaauucccuucgagaucauggacuuggaaaagagauacgugcucgggaggcugauuacugucaacccgauagugaccgagaaagauagcccuguuaacaucgaagcugagcccccauuuggcgacucguacauuaucaucggaguggagccuggccaguuaaagcugaauugguucaagaaagggucuuccauuggacaaauguuugaaacgaccaugcggggugccaagcgaauggcuauacuaggcgauacagccugggacuucgggucacucggaggcguauuuacaaguaucgguaaagcacugcaucaggucuucggggccauuuauggcgcugcguuuagcggaguguccuggaccaugaagauccuuauuggcguuaucauaacauggaucgggaugaacucucgcagcacuucauugagugugucccugguccucgugggaauuguaacccuguaccuuggcgugaugguucaggcagauagcgguugugucgugucuuggaaaaauaaggagcugaagugcgggucaggaaucuucauuacggacaacgugcacacauggaccgaacaguauaaauuucaacccgagaguccaagcaaguuggccuccgcuauccagaaagcccaggaagagggcauaugugguauuagaucugucacuaggcucgagaaucugauguggaagcagaucacacccgaauuaaaccacauucuggcagagaaugaaguuaaacuaaccaucaugacuggcgauauaaaggggaucaugcaagccggaaaacggucgcuccgcccucagccaaccgagcugaaguacagcuggaagacauggggcaaagcuaagaugcuuuccacggaaucauauaaccagaccuucuugauugacgggccggagacugccgagugccccaauacaaacagagcauggaauagucuggaaguggaggauuacggauuuggcguguucaccacaaacaucuggcucaaacugaaggaaaaacaggacgcguuuugugacucuaaguuaaugagcgcugccauuaaggauaauagggcaguacaugccgacauggguuauuggaucgaguccgcucugaacgauacuuggaaaauagagaaggccucauucauugaagucaaaaauugccacuggccuaagagccauacccuuuggucuaacgggguguuggaguccgaaaugaucauccccaagaaccucgcaggacccguuagucaacacaauuaccguccuggcuaccacacgcagauugcugguccauggcaucugggcaagcuagagauggacuucgauuuuugugacgggacaaccgugaucgucacugaagauugcggaaaccggggccccagccugcgaaccacaacugccucugggaagcucauuaccgaguggugcuguagauccugcacacugccgccucuuagguaucgcggagaggacggcuguugguacgguauggaaauacggccauugaaagagaaggaagagaaucuggugaacucauuaguuacggcggggcacggacagguggauaauuucagucucggcguacuggguauggcccuuuuucuggaagagauguugagaaccagggucggcacuaaacaugcuauccuccugguggcagugagcuucgucacacuaauuaccgggaacaugucguuuaaggaccugggacgcguugugguaauggugggcgccacuauggcugaugacaucgggaugggagucacauaucucgcccugcuugcagcguucaaagugcgacccaccuuugccgcuggcuugcuguuacggaagcucacguccaaggagcugaugaugacuaccauugguaucguucuucugucucaaagcacaauaccugaaaccgugcuagagcucacugaugcccuggcauuggggaugaugguccugaaaaucgugcguaauauggaaaaguaccaguuagcuguuacaauuauggccauccucugcgugcccaacgcagucauucugcagaaugccuggaaaguaucauguaccauccuugcugugguuaguguguccccacuguugcucacaucuagccagcaaaagacugacuggauaccucuggcgcuaaccauuaaaggacugaaccccacggccaucuuccuuacaacccucuccagaacuaauaagaaaaggucauggccacugaacgaggcaaucauggcugucggcauggugagcauuuuggccaguucucuguuaaagaaugacauaccgaugaccggcccucucguagccgggggacugcuuacagugugcuauguccugacuggucgcuccgcugauuuggaacucgagcgggcaaccgacguuaagugggaggaucaggccgaaaucagcggcucgucacccauucugucuaucacgauuagugaggacggguccaugagcaucaaaaacgaagaggaggaacagacacuaaccauacugaucagaacuggacuucucgugauuucuggccuguuuccaaucagcauucccaucacagcggcugccugguacuugugggaggugaagaaacagagggccggugucuuaugggaugugccuuccccacccccuauggggaaggccgaacuggaggacggagcuuaucgaauaaaacaaaagggcauucucggcuacucacagaucggggcaggaguuuacaaggaagguaccuuccacacuauguggcauguaacacgcggcgccgugcugaugcacaaagggaagcggaucgagccgaguugggcggaugucaaaaaggaccuuauuagcuauggaggcgguuggaaacuggagggggaauggaaggagggagaagaggugcagguuuuggcucuagaaccaggcaagaaucccagagccgugcagaccaaaccuggccuguuuaagacgaacacugggaccaucggagcagucucucucgauuucuccccagguacaucaggcagucccauaauugacaaaaaggggaaagugguaggacuguacggcaacggugucgugaccaggagcggggccuauguuuccgcuaucgcccaaacagagaagucuauugaggauaauccugaaaucgaggacgauauauuucguaagcgccggcuuacuauuauggacuuacacccgggagcaggcaaaaccaagagauaccugcccgcuaucgugagggaagccaucaaacgaggccuccggacguugauucuggcgccaacacgcgucguggccgcagagauggaagaggcucucagagggcugccuaucagguaucagacucccgccauucgggcugagcauaccggacgagaaauaguugaccuuaugugucacgcaacauucaccaugagacuguugucgccagugcgcgucccuaacuacaaucuaaucauuauggaugaggcccauuucacugaccccgccagcaucgcugcgagggguuauaucucaacccguguggaaaugggcgaggcagccgggauuuuuaugacagcuacgccaccgggaucccgggauccuuucccccagaguaacgccccaauaaucgacgaggaaagagagauucccgaaaggucuuggaauagcggccacgaguggguaacugauuuuaaggguaaaaccgugugguucguuccuuccaucaaggcagggaacgacauugccgcuugccugcgcaagaauggcaagaaggucauccaacucucacgaaaaacauuugauucugaauacgugaagaccagaacuaacgacugggauuucguggucacaaccgacauaagcgagaugggcgcgaauuuuaaagccgagcggguaaucgauccaaggcgcuguaugaagcccgugauuuuaacggacggcgaagaacguguuauccuggcagggccuaugccggugacucauaguuccgcugcccagagacggggaaggauuggucgcaaccccaaaaaugaaaacgaccaguacaucuauaugggcgagccccuugaaaaugaugaggacugcgcacacuggaaggaggccaagaugcugcucgauaacauaaauacaccugaagggauuauccccagcauguucgagccagaacgagagaaagucgacgcuauugauggagaauacagauugcggggcgaggccaggaagaccuuuguggaccugaugcgcagaggugaucucccuguuuggcuggcguauaaaguggcagccgaggggaucaacuacgcugacaggcggugguguuucgauggcauaaagaacaaucagauccuugaagagaacgucgaaguggagauuuggaccaaagagggagaacguaagaagcuaaaaccccgcuggcuggacgcccgaaucuauucugauccauuggcuuuaaaggaguuuaaagaguucgcagccggcagaaagucacugacucucaaucugauuacagagauggggaggcuuccuaccuucaugacacagaaaacucgggacgcucuggauaaccucgccguauugcacacggcagaagcgggaggucgcgccuacaaucaugcucuguccgagcuaccggagacccuggaaacacuccuucuguuaacuuugcuggccaccgugacaggcgggaucuuucucuuccugaugaguggaagaggcauagguaagaugacccuugggaugugcugcauuaucacugcaagcauccugcucugguaugcucagauucagccccacuggaucgccgcaucgauaauuuuggaguuuuuccugaucguuuuacuaauuccagaaccugagaagcagaggacgccccaagacaaccagcugaccuacgucgugaucgccauacucacaguggucgcugcgacuauggccaaugaaaugggcuuucuugagaaaaccaagaaagaccugggauugggcucuaucgcaacacagcagccagaguccaacauucuggauaucgaccuccggccugcuagcgccuggacccuguacgccguugcaacuacauucgugacgcccaugcuucgacauucaauugaaaauaguucuguaaacgugucccucaccgcuaucgccaaucaagcgacuguccugaugggguugggaaaggguuggccgcugagcaaaauggauauuggcgugccauuacuagcuaucggguguuauucacagguuaacccuauaacacugaccgccgcacuccuucuguugguggcccacuacgcuauuaucggacccggccugcaggcaaaggccaccagagaggcgcagaagcgcgcugccgcagguaucaugaaaaauccaacagucgacgggauuacuguaauagaucucgaccccaucccuuaugauccgaaguuugaaaaacaacugggccaggugaugcuuuuaauucugugcguuacacaggugcucaugaugaggaccacaugggccuugugugaggcucugacucuagccaccggacccaucaguacacugugggaaggcaacccagggcgguucuggaauaccacuauugcagucagcauggcuaacaucuuucguggauccuaccucgccggcgcgggucuucuguucucuauaaugaagaauacgacaaacaccagaagggggacuggaaacgugggcgagaccuugggugagaaauggaaaagccgccugaaugcccucggcaaauccgaauuucaaaucuauaagaagucagggauucaggaggucgaccggacacuggcaaaagaaggaaucaagcgaggcgagacugaucaccaugcugugucuagagggagugccaaauuaaggugguucguugagcgcaacauggugaccccugaaggaaagguaguggaccuuggcugcgguagagggggauggucguacuauuguggcggucugaaaaaugucagagagguuaagggccucacaaaagggggacccggccacgaggaaccuauuccaaugagcacguacggguggaaccuagugcgucugcaguccggagucgauguguuuuucaucccaccugaaaaaugcgacaccuugcugugugauauaggcgagucuucaccaaaucccacuguagaggcagguaggacacuccgggugcuuaaccugguugaaaauugguugaacaauaacacccaguucugcauuaaggugcugaauccguacaugccuagcgucaucgagaaaauggaagcucuccaacgcaaguaugggggagccuuagugcgaaacccacuguccagaaauaguacucaugagauguacugggucucuaacgccagcggcaauaucgugucauccguuaacaugauuaguaggaugcuuauaaaccgguuuacaaugcgccacaaaaaggcgaccuaugaacccgacguagaccugggcagcgggacgagaaauaucggaauugagucugagaucccuaaccuagauauuaucgguaagaggauagagaaaaucaaggaggaacaugagaccuccuggcacuacgaccaggaucacccauauaaaacaugggcuuaccauggcucauaugaaacuaagcagaccgggagcgcaucgucuauggugaauggagucgugcgacuccugacaaaacccugggacguuuugccgacugugacccagauggccaugacagauaccacuccuuucggccaacagcgggucuuuaaggagaagguggacacgcguacacaggagcccaaagaagguaccaagaaacugaugaagauuacugcugaguggcucuggaaagaacuugggaagaaaaagaccccaagaauguguacacgcgaggaguucacgaggaagguacggaguaacgccgcacugggagccaucuuuaccgaugaaaauaaauggaaguccgcuagagaggcgguggaagacagccgcuucugggaguuaguugauaaagaaaggaaccugcacuuggagggcaagugcgagacuugugucuacaauaugaugggcaaacgagaaaagaagcucggggaguuuggaaaagccaaggguucacgggcaauuugguacauguggcugggcgcuagauuccuagaauuugaggcccuuggguuccugaacgaagaccauugguuuuccagggaaaauucucucagcggaguggagggcgaaggucugcacaaauugggguauauccugcgcgaugugaguaagaaagagggaggcgcaauguacgccgacgacacagcuggcugggauacccguauuacucucgaagaccuuaagaacgaggaaauggucacaaaucacauggagggggagcauaagaaacuggccgaagcgauauucaaguuaaccuaucagaacaaaguugugcggguacaaagaccuacacccaggggaacugugauggauaucauuucccgccgagaccagcgggguagcggccaggucgggaccuacggacugaauacguuuaccaacauggaggcacaauugaucagacagauggaaggcgaggguguguucaagaauauccagcaccucacaguuacugaggaagccgcugugcagaacuggcuggccagggucgggcgcgagagacuaucucggauggcaauuucaggagaugacugcgugguaaaaccacuugaugacagguucgcuaacgcccugaccgcucucaaugauaugggcaagauacguaaggacauccaacagugggaacccaguaaaggcuggaacgauuggacacagguuccuuuuugcucccaucacuuccaugagcugauuaugaaggacgggcgaguguuggucgugccaugucgcaaucaggaugaauuaaucgguagagcacggauuagccaaggagcaggcuggucucugagggagacugcgugccucgggaaaucguaugcccagauguggucacuuauguacuuucaccgcagagaccugcggcuagcugccaacgcaaucuguagcgcugugccgucccacuggguccccaccaguaggacgacauggucuauacaugccaagcacgaguggaugaccacugaagacaugcugacaguuuggaaucgaguguggauccgugagaacccuuggauggaagauaaaaccccaguagagagcugggaagagauucccuaucucggaaagagagaggaccaguggugcggcuccuugaucggucugacuucacgcgcaaccugggccaagaauauucaggcggcuaucaaccaagugcggagucuuauagggaaugaagaguacacagauuacaugccuucuaugaaaagguucagacgcgaagaggaagaggccggaguccugugguga

SEQ ID NO: 14415 - RNA, 9876 nt, Artificial Sequence
  derived and/or modified CDS sequence (opt3) from DENV-2__GU131902__SS-prME
agcgccggaaugaucauuaugcugauaccaaccgugauggcuuuccaccucacuacucggaacggggagccucauaugaucgucggcauucaggaaaaggguaaaucccuucuguuuaagacggaggacggaguuaauaugugcaccuugauggcaauggauuuaggggaacugugugaggacacaaucacuuacaaaugcccacuacucaggcaaaacgaaccggaggauauugacuguuggugcaauucuaccucaacaugggugaccuauggaacuuguacaaccacgggcgagcaccggcgcgaaaagcgaaguguagcccuggugccacaugucgguauggggcuugagacucguaccgaaacauggaugagcuccgagggagcguggaaacacgcucagagaaucgagacuuggauacugaggcauccuggcuucaccaucauggccgcaauuuuggccuacacaaucggcaccacgcacuuucagcgggugcucauuuucauccugcugacugcuguugcaccaucuaugacaaugcgcugcauagggauuucgaacagagauuuuguggaaggagucucagguggcagcuggguggacaucguacucgagcacgggaguuguguuaccacuauggccaagaauaagcccacauuagauuucgaacugauuaaaaccgaggcuaagcagccugccacgcuuaggaaauauugcaucgaagcgaaguugaccaacacaacuaccgagucccgguguccaacacaaggagagcccucucugaaagaggaacaggacaagcgcuuugugugcaagcauagcauggucgaucgaggcugggguaauggguguggacuauucggcaaaggcgggaucgugacuugcgcaauguuuaccugcaagaaaaacauggaaggaaagauugugcagccugagaaucucgaauacacaauagucguuaccccacacuccggugaggagcaugccgugggcaacgacacugggaaacacggaauggaaaucaagguaacgccgcagucaaguauuacagaggcugaacugaccggcuaugguacugugaccauggaguguagccccagaacagggcuugauuucaaugaaaugguccuguugcaaauggagaacaaagccuggcucgugcacaggcagugguuucuggacuuaccucugccauggcuccccggcgcagauaagcaggagucuaauuggauccagaaggaaacccuuguuacuuucaaaaacccucaugcuaagaaacaagacguggucgugcugggaucccaggagggcgccaugcacacagcguugacgggggccaccgaaauacagaugucaagcggaaaucuacuguuuacuggucaucucaagugccggcugcguauggacaaacuucaacugaagggcaugaguuacucuauguguacagggaaguucaaaguaguuaaggagauugcagagacccagcacggaacaaucgugauccgcguccaguaugaaggcgaugguuccccaugcaaaauucccuucgagaucauggacuuggaaaagagauacgugcucgggaggcugauuacugucaacccgauagugaccgagaaagauagcccuguuaacaucgaagcugagcccccauuuggcgacucguacauuaucaucggaguggagccuggccaguuaaagcugaauugguucaagaaagggucuuccauuggacaaauguuugaaacgaccaugcggggugccaagcgaauggcuauacuaggcgauacagccugggacuucgggucacucggaggcguauuuacaaguaucgguaaagcacugcaucaggucuucggggccauuuauggcgcugcguuuagcggaguguccuggaccaugaagauccuuauuggcguuaucauaacauggaucgggaugaacucucgcagcacuucauugagugugucccugguccucgugggaauuguaacccuguaccuuggcgugaugguucaggcagauagcgguugugucgugucuuggaaaaauaaggagcugaagugcgggucaggaaucuucauuacggacaacgugcacacauggaccgaacaguauaaauuucaacccgagaguccaagcaaguuggccuccgcuauccagaaagcccaggaagagggcauaugugguauuagaucugucacuaggcucgagaaucugauguggaagcagaucacacccgaauuaaaccacauucuggcagagaaugaaguuaaacuaaccaucaugacuggcgauauaaaggggaucaugcaagccggaaaacggucgcuccgcccucagccaaccgagcugaaguacagcuggaagacauggggcaaagcuaagaugcuuuccacggaaucauauaaccagaccuucuugauugacgggccggagacugccgagugccccaauacaaacagagcauggaauagucuggaaguggaggauuacggauuuggcguguucaccacaaacaucuggcucaaacugaaggaaaaacaggacgcguuuugugacucuaaguuaaugagcgcugccauuaaggauaauagggcaguacaugccgacauggguuauuggaucgaguccgcucugaacgauacuuggaaaauagagaaggccucauucauugaagucaaaaauugccacuggccuaagagccauacccuuuggucuaacgggguguuggaguccgaaaugaucauccccaagaaccucgcaggacccguuagucaacacaauuaccguccuggcuaccacacgcagauugcugguccauggcaucugggcaagcuagagauggacuucgauuuuugugacgggacaaccgugaucgucacugaagauugcggaaaccggggccccagccugcgaaccacaacugccucugggaagcucauugcggaguggugcuguagauccugcacccugccgccucuuagguaucgcggagaggacggcuguugguacgguauggaaauacggccauugaaagagaaggaagagaaucuggugaacucauuaguuacagccgggcacggacagguggauaauuucagucucggcguacuggguauggcucuuuuucuggaagagauguugagaacgagggucggcaccaaacaugcaauccuccugguggccgugagcuucgucacucuaauuacagggaacaugucguuuaaggaccugggacgcguugugguaauggugggcgcuaccauggccgaugacaucgggaugggagucacuuaucucgcacugcuugcggccuucaaagugcgacccacauuugcugccggcuugcuguuacggaagcucaccuccaaggagcugaugaugacgacuauugguaucguucuucugucucaaagcaccauaccugaaacagugcuagagcucaccgaugcacuggcuuuggggaugaugguccugaaaaucgugcguaauauggaaaaguaccaguuagccguuacuauuauggcaauccucugcgugcccaacgccgucauucugcagaaugcuuggaaaguaucauguacaauccuugcggugguuaguguguccccacuguugcucaccucuagccagcaaaagacagacuggauaccucuggcccuaacuauuaaaggacugaaccccaccgcaaucuuccuuacgacacucuccagaaccaauaagaaaaggucauggccacugaacgaggcuaucauggccgucggcauggugagcauuuuggccaguucucuguuaaagaaugacauaccgaugacuggcccucucguagcugggggacugcuuaccgugugcuauguccugacaggucgcuccgcagauuuggaacucgagcgggccacugacguuaagugggaggaucaggcggaaaucagcggcucgucacccauucugucuaucaccauuagugaggacggguccaugagcaucaaaaacgaagaggaggaacagacgcuaacaauacugaucagaaccggacuucucgugauuucuggccuguuuccaaucagcauucccaucacugcugccgcaugguacuugugggaggugaagaaacagagggccggugucuuaugggaugugccuuccccacccccuauggggaaggcugaacuggaggacggagcauaucgaauaaaacaaaagggcauucucggcuacucacagaucggggccggaguuuacaaggaagguacauuccacaccauguggcauguaacucgcggcgcggugcugaugcacaaagggaagcggaucgagccgaguugggcugaugucaaaaaggaccuuauuagcuauggaggcgguuggaaacuggagggggaauggaaggagggagaagaggugcagguuuuggcccuagaaccaggcaagaaucccagagcagugcagacaaaaccuggccuguuuaagaccaacacggggacuaucggagccgucucucucgauuucuccccagguaccucaggcagucccauaauugacaaaaaggggaaagugguaggacuguacggcaacggugucgugacaaggagcggggcuuauguuuccgccaucgcacaaaccgagaagucuauugaggauaauccugaaaucgaggacgauauauuucguaagcgccggcuuacaauuauggacuuacacccgggagcuggcaaaacuaagagauaccugcccgccaucgugagggaagcgaucaaacgaggccuccggaccuugauucuggccccaacgcgcgucguggcagcugagauggaagaggcccucagagggcugccuaucagguaucagacacccgcuauucgggcagagcauacuggacgagaaauaguugaccuuaugugucacgccaccuucacaaugagacuguugucgccagugcgcgucccuaacuacaaucuaaucauuauggaugaggcccauuucaccgaccccgcuagcaucgcggcaagggguuauaucucaacucguguggaaaugggcgaggccgcugggauuuuuaugaccgccacaccaccgggaucccgggauccuuucccccagaguaacgcaccaauaaucgacgaggaaagagagauucccgaaaggucuuggaauagcggccacgaguggguaacggauuuuaaggguaaaacugugugguucguuccuuccaucaaggccgggaacgacauugcugcgugccugcgcaagaauggcaagaaggucauccaacucucacgaaaaaccuuugauucugaauacgugaagacaagaaccaacgacugggauuucguggucacuacagacauaagcgagaugggcgccaauuuuaaagcagagcggguaaucgauccaaggcgcuguaugaagcccgugauuuuaaccgacggcgaagaacguguuauccuggcugggccuaugccggugacgcauaguuccgccgcacagagacggggaaggauuggucgcaaccccaaaaaugaaaacgaccaguacaucuauaugggcgagccccuugaaaaugaugaggacugcgcccacuggaaggaggcuaagaugcugcucgauaacauaaauacuccugaagggauuauccccagcauguucgagccagaacgagagaaagucgacgccauugauggagaauacagauugcggggcgaggcgaggaagacauuuguggaccugaugcgcagaggugaucucccuguuuggcuggcauauaaaguggccgcugaggggaucaacuacgccgacaggcggugguguuucgauggcauaaagaacaaucagauccuugaagagaacgucgaaguggagauuuggaccaaagagggagaacguaagaagcuaaaaccccgcuggcuggacgcucgaaucuauucugauccauuggcauuaaaggaguuuaaagaguucgccgcuggcagaaagucacugacccucaaucugauuacugagauggggaggcuuccuacauucaugacccagaaaacucgggacgcccuggauaaccucgcaguauugcacacugcggaagccggaggucgcgcuuacaaucaugcccuguccgagcuaccggagacgcuggaaacccuccuucuguuaacauugcuggcaacugugaccggcgggaucuuucucuuccugaugaguggaagaggcauagguaagaugacacuugggaugugcugcauuaucaccgcuagcauccugcucugguaugcccaaauucagccccacuggaucgcagccucgauaauuuuggaguuuuuccugaucguuuuacuaauuccagaaccugagaagcagaggacuccccaagacaaccagcugacguacgucgugaucgcuauacucaccguggucgcggccacaauggcaaaugaaaugggcuuucuugagaaaacuaagaaagaccugggauugggcucuaucgcuacccagcagccagaguccaacauucuggauaucgaccuccggccugccagcgccuggacacuguacgcaguugcuaccacuuucgugacacccaugcuucgacauucaauugaaaauaguucuguaaacgugucccucacggccaucgcgaaucaagcuaccguccugaugggguugggaaaggguuggccgcugagcaaaauggauauuggcgugccauuacuagccaucggguguuauucacagguuaacccuauaacucugacagcagcccuccuucuguugguggcucacuacgcaauuaucggacccggccugcaggccaaggcgaccagagaggcucagaagcgcgccgcagccgguaucaugaaaaauccaaccgucgacgggauuacaguaauagaucucgaccccaucccuuaugauccgaaguuugaaaaacaacugggccaggugaugcuuuuaauucugugcguuacucaggugcucaugaugaggacgaccugggcuuugugugaggcccugacacuagcaacuggacccaucaguacccugugggaaggcaacccagggcgguucuggaauacaaccauugcugucagcauggccaacaucuuucguggauccuaccucgcgggcgccggucuucuguucucuauaaugaagaauacuacgaacacaagaagggggaccggaaacaucggcgagacuuugggugagaaauggaaaagccgccugaaugcacucggcaaauccgaauuucaaauuuauaagaagucagggauccaggagguggaccggacccuggcuaaagaaggaauuaagcgaggcgagacagaucaccaugccgucucuagagggagugcaaaauuaaggugguucguggagcgcaacaugguuacuccugaaggaaaggugguagaccuuggcugcgguagagggggauggucguacuauuguggcggucugaaaaaugugagagaggucaagggccucaccaaagggggacccggccacgaggaaccuaucccaaugagcacauacggguggaaccuaguucgucugcaguccggaguggaugucuuuuucauacccccugaaaaaugcgacacguugcugugugauauuggcgagucuucaccaaaucccaccguggaggcugguaggacucuccggguacuuaaccugguggaaaauugguugaacaauaacacacaguucugcaucaagguucugaauccguacaugccuagcgugaucgagaaaauggaagcccuccaacgcaaguaugggggagccuuaguccgaaacccacuguccagaaauaguacccaugagauguacugggugucuaacgcgagcggcaauauugucucauccgugaacaugauaaguaggaugcuuaucaaccgguuuacuaugcgccacaaaaaggcuacauaugaacccgacguugaccugggcagcgggaccagaaauauuggaaucgagucugagauuccuaaccuagauaucauagguaagaggaucgagaaaauuaaggaggaacaugagacguccuggcacuacgaccaggaucacccauauaaaaccugggcauaccauggcucauaugaaacaaagcagacugggagcgccucgucuaugguaaauggagugguccgacuccugaccaaacccugggacguguugccgacaguuacucagauggcuaugaccgauacaaccccuuucggccaacagcggguguuuaaggagaaggucgacacucguacgcaggagcccaaagaagguacaaagaaacugaugaagaucaccgccgaguggcucuggaaagaacuugggaagaaaaagacuccaagaauguguacccgcgaggaguucacaaggaaggugcggaguaacgcagcccugggagcuauuuuuacggaugaaaauaaauggaaguccgcgagagaggccguagaagacagccgcuucugggaguuaguggauaaagaaaggaaccugcacuuggagggcaagugcgagaccuguguuuacaauaugaugggcaaacgagaaaagaagcucggggaguuuggaaaagcaaaggguucacgggcuaucugguacauguggcugggcgccagauuccuagaauuugaggcacuuggguuccugaacgaagaccauugguuuuccagggaaaauucucucagcggagucgagggcgaaggucugcacaaauugggguauauucugcgcgaugugaguaagaaagagggaggcgccauguacgcugacgacacugccggcugggauacacguauaacccucgaagaccuuaagaacgaggaaauggugacuaaucacauggagggggagcauaagaaacuggcggaagcaaucuucaaguuaacauaucagaacaaagucguucgggugcaaagaccuacccccaggggaacaguaauggauauuaucucccgccgagaccagcgggguagcggccagguggggacuuacggacugaauaccuuuacgaacauggaggcccaauugaucagacagauggaaggcgagggugucuucaagaauauucagcaccucaccgugacagaggaagcugccguucagaacuggcuggcaaggguggggcgcgagagacuaucucggauggcuauaucaggagaugacugcgucgugaaaccacuugaugacagguucgccaacgcucugacugcccucaaugauaugggcaagauccguaaggacauucaacagugggaacccaguaaaggcuggaacgauuggacccagguaccuuuuugcucccaucacuuccaugagcugaucaugaaggacgggcgaguuuugguggucccaugucgcaaucaggaugaauuaauugguagagcacggaucagccaaggagcgggcuggucucugagggagacagccugccucgggaaaucguaugcucagauguggucacuuauguacuuucaccgcagagaccugcggcuagccgcaaacgcuauauguagcgccgugccgucccacugggugcccacaaguaggaccacguggucuauccaugcaaagcacgaguggaugacaaccgaagacaugcugacugucuggaaucgaguuuggauucgugagaacccuuggauggaagauaaaacaccaguggagagcugggaagagauccccuaucucggaaagagagaggaccaguggugcggcuccuugauuggucugaccucacgcgccacuugggcgaagaauauccaggcugccauaaaccaaguacggagucuuauugggaaugaagaguacaccgauuacaugccuucuaugaaaagguucagacgcgaagaggaagaggcaggagugcugugguga

SEQ ID NO: 14416 - RNA, 9876 nt, Artificial Sequence
  derived and/or modified CDS sequence (opt3) from DENV-2__GU131924__SS-prME
agcgccggaaugaucauuaugcugauaccaaccgugauggcuuuccaccucacuacucggaacggggagccucauaugaucgucgguauucaagaaaagggaaaaucccuucuguuuaagacggaggacggcguuaauaugugcaccuugauggcaauggauuuaggggaacugugugaggacacgaucacuuacaaaugcccacuacucaggcaaaacgaaccggaggauauugacuguuggugcaauucuaccucaacaugggugaccuauggaacuuguacaaccacgggcgagcaccggcgcgaaaagcgaaguguagcccuggugccacaugucgguauggggcuugagacucguaccgaaacauggaugagcuccgagggagcguggaaacacgcucagagaaucgagacuuggauacugaggcauccuggcuucaccaucauggccgcaauuuuggccuacacaaucggcaccacgcacuuucagcgggugcucauuuucauccugcugacugcuguugcaccaucuaugacaaugcgcugcauagggauuucgaacagagauuuuguggaaggagucucagguggcagcuggguggacaucguacucgagcacgggaguuguguuaccacuauggccaagaauaagcccacauuagauuucgaacugauuaaaaccgaggcuaagcagccugccacgcuuaggaaauauugcaucgaagcgaaguugaccaacacaacuaccgagucccgguguccaacacaaggagagcccucucugaaagaggaacaggacaagcgcuuugugugcaagcauagcauggucgaucgaggcugggguaauggguguggacuauucggcaaaggcgggaucgugacuugcgcaauguuuaccugcaagaaaaacauggaaggaaagauugugcagccugagaaucucgaauacacaauagucguuaccccacacuccggugaggagcaugccgugggcaacgacacugggaaacacggaauggaaaucaagguaacgccgcagucaaguauuacagaggcugaacugaccggcuaugguacugugaccauggaguguagccccagaacagggcuugauuucaaugaaaugguccuguugcaaauggagaacaaagccuggcucgugcacaggcagugguuucuggacuuaccucugccauggcuccccggcgcagauaagcaggagucuaauuggauccagaaggaaacccuuguuacuuucaaaaacccucaugcuaagaaacaagacguggucgugcugggaucccaggagggcgccaugcacacagcguugacgggggccaccgaaauacagaugucaagcggaaaucuacuguuuacuggucaucucaagugccggcugcguauggacaaacuucaacugaagggcaugaguuacucuauguguacagggaaguucaaaguaguuaaggagauugcagagacccagcacggaacaaucgugauccgcguccaguaugaaggcgaugguuccccaugcaaaauucccuucgagaucauggacuuggaaaagagauacgugcucgggaggcugauuacugucaacccgauagugaccgagaaagauagcccuguuaacaucgaagcugagcccccauuuggcgacucguacauuaucaucggaguggagccuggccaguuaaagcugaauugguucaagaaagggucuuccauuggacaaauguuugaaacgaccaugcggggugccaagcgaauggcuauacuaggcgauacagccugggacuucgggucacucggaggcguauuuacaaguaucgguaaagcacugcaucaggucuucggggccauuuauggcgcugcguuuagcggaguguccuggaccaugaagauccuuauuggcguuaucauaacauggaucgggaugaacucucgcagcacuucauugagugugucccugguccucgugggaauuguaacccuguaccuuggcgugaugguucaggcagauagcgguugugucgugucuuggaaaaauaaggagcugaagugcgggucaggaaucuucauuacggacaacgugcacacauggaccgaacaguauaaauuucaacccgagaguccaagcaaguuggccuccgcuauccagaaagcccaggaagagggcauaugugguauuagaucugucacuaggcucgagaaucugauguggaagcagaucacacccgaauuaaaccacauucuggcagagaaugaaguuaaacuaaccaucaugacuggcgauauaaaggggaucaugcaagccggaaaacggucgcuccgcccucagccaaccgagcugaaguacagcuggaagacauggggcaaagcuaagaugcuuuccacggaaucauauaaccagaccuucuugauugacgggccggagacugccgagugccccaauacaaacagagcauggaauagucuggaaguggaggauuacggauuuggcguguucaccacaaacaucuggcucaaacugaaggaaaaacaggacgcguuuugugacucuaaguuaaugagcgcugccauuaaggauaauagggcaguacaugccgacauggguuauuggaucgaguccgcucugaacgauacuuggaaaauagagaaggccucauucauugaagucaaaaauugccacuggccuaagagccauacccuuuggucuaacgggguguuggaguccgaaaugaucauccccaaaaaccucgcaggacccguuagucaacacaauuaccguccuggcuaccacacgcagauugcugguccauggcaucugggcaagcuagagauggacuucgauuuuugugacgggacaaccgugaucgucacugaagauugcggaaaccggggccccagccugcgaaccacaacugccucugggaagcucauuaccgaguggugcuguagauccugcacacugccgccucuuagguaucgcggagaggacggcuguugguacgguauggaaauacggccauugaaagagaaggaagagaaucuggugaacucauuaguuacggcggggcacggacagguggauaauuucagucucggcguacuggguauggcccuuuuucuggaagagauguugagaaccagggucggcacuaaacaugcuauccuccugguggcagugagcuucgucacacuaauuaccgggaacaugucguuuaaggaccugggacgcguugugguaauggugggcgccacuauggcugaugacaucgggaugggagucacauaucucgcccugcuugcagcguucaaagugcgacccaccuuugccgcuggcuugcuguuacggaagcucacguccaaggagcugaugaugacuaccauugguaucguucuucugucucaaagcacaauaccugaaaccgugcuagagcucacugaugcccuggcauuggggaugaugguccugaaaaucgugcguaauauggaaaaguaccaguuagcuguuacaauuauggccauccucugcgugcccaacgcagucauucugcagaaugccuggaaaguaucauguaccauccuugcugugguuaguguguccccacuguugcucacaucuagccagcaaaagacugacuggauaccucuggcgcuaaccauuaaaggacugaaccccacggccaucuuccuuacaacccucuccagaacuaauaagaaaaggucauggccacugaacgaggcaaucauggcugucggcauggugagcauuuuggccaguucucuguuaaagaaugacauaccgaugaccggcccucucguagccgggggacugcuuacagugugcuauguccugacuggucgcuccgcugauuuggaacucgagcgggcaaccgacguuaagugggaggaucaggccgaaaucagcggcucgucacccauucugucuaucacgauuagugaggacggguccaugagcaucaaaaacgaagaggaggaacagacacuaaccauacugaucagaacuggacuucucgugauuucuggccuguuuccaaucagcauucccaucacagcggcugccugguacuugugggaggugaagaaacagagggccggugucuuaugggaugugccuuccccacccccuauggggaaggccgaacuggaggacggagcuuaucgaauaaaacaaaagggcauucucggcuacucacagaucggggcaggaguuuacaaggaagguaccuuccacacuauguggcauguaacacgcggcgccgugcugaugcacaaagggaagcggaucgagccgaguugggcggaugucaaaaaggaccuuauuagcuauggaggcgguuggaaacuggagggggaauggaaggagggagaagaggugcagguuuuggcucuagaaccaggcaagaaucccagagccgugcagaccaaaccuggccuguuuaagacgaacacugggaccaucggagcagucucucucgauuucuccccagguacaucaggcagucccauaauugacaaaaaggggaaagugguaggacuguacggcaacggugucgugaccaggagcggggccuauguuuccgcuaucgcccaaacagagaagucuauugaggauaauccugaaaucgaggacgauauauuucguaagcgccggcuuacuauuauggacuuacacccgggagcaggcaaaaccaagagauaccugcccgcuaucgugagggaagccaucaaacgaggccuccggacguugauucuggcgccaacacgcgucguggccgcagagauggaagaggcucucagagggcugccuaucagguaucagacucccgccauucgggcugagcauaccggacgagaaauaguugaccuuaugugucacgcaacauucaccaugagacuguugucgccagugcgcgucccuaacuacaaucuaaucauuauggaugaggcccauuucacugaccccgccagcaucgcugcgagggguuauaucucaacccguguggaaaugggcgaggcagccgggauuuuuaugacagcuacgccaccgggaucccgggauccuuucccccagaguaacgccccaauaaucgacgaggaaagagagauucccgaaaggucuuggaauagcggccacgaguggguaacugauuuuaaggguaaaaccgugugguucguuccuuccaucaaggcagggaacgacauugccgcuugccugcgcaagaauggcaaaaaggucauccaacucucacgaaaaacauuugauucugaauacgugaagaccagaacuaacgacugggauuucguggucacaaccgacauaagcgagaugggcgcgaauuuuaaagccgagcggguaaucgauccaaggcgcuguaugaagcccgugauuuuaacggacggcgaggaacguguuauccuggcagggccuaugccggugacucauaguuccgcugcccagagacggggaaggauuggucgcaaccccaaaaaugaaaacgaccaguacaucuauaugggcgagccccuugaaaaugaugaggacugcgcacacuggaaggaggccaagaugcugcucgauaacauaaauacaccugaagggauuauccccagcauguucgagccagaacgagagaaagucgacgcuauugauggagaauacagauugcggggcgaggccaggaagaccuuuguggaccugaugcgcagaggugaucucccuguuuggcuggcguauaaaguggcagccgaggggaucaacuacgcugacaggcggugguguuucgauggcauaaagaacaaucagauccuugaagagaacgucgaaguggagauuuggaccaaagagggagaacguaagaagcuaaaaccccgcuggcuggacgcccgaaucuauucugauccauuggcuuuaaaggaguuuaaagaguucgcagccggcagaaagucacugacucucaaucugauuacagagauggggaggcuuccuaccuucaugacacagaaaacucgggacgcucuggauaaccucgccguauugcacacggcagaagcgggaggucgcgccuacaaucaugcucuguccgagcuaccggagacccuggaaacacuccuucuguuaacuuugcuggccaccgugacaggcgggaucuuucucuuccugaugaguggaagaggcauagguaagaugacccuugggaugugcugcauuaucacugcaagcauccugcucugguaugcucagauucagccccacuggaucgccgcaucgauaauuuuggaguuuuuccugaucguuuuacuaauuccagaaccugagaagcagaggacgccccaagacaaccagcugaccuacgucgugaucgccauacucacaguggucgcugcgacuauggccaaugaaaugggcuuucuugagaaaaccaagaaagaccugggauugggcucuaucgcaacacagcagccagaguccaacauucuggauaucgaccuccggccugcuagcgccuggacccuguacgccguugcaacuacauucgugacgcccaugcuucgacauucaauugaaaauaguucuguaaacgugucccucaccgcuaucgccaaucaagcgacuguccugaugggguugggaaaggguuggccgcugagcaaaauggauauuggcgugccauuacuagcuaucggguguuauucacagguuaacccuauaacacugaccgccgcacuccuucuguugguggcccacuacgcuauuaucggacccggccugcaggcaaaggccaccagagaggcgcagaagcgcgcugccgcagguaucaugaaaaauccaacagucgacgggauuacuguaauagaucucgaccccaucccuuaugauccgaaguuugaaaaacaacugggccaggugaugcuuuuaauucugugcguuacacaggugcucaugaugaggaccacaugggccuugugugaggcucugacucuagccaccggacccaucaguacacugugggaaggcaacccagggcgguucuggaauaccacuauugcagucagcauggcuaacaucuuucguggauccuaccucgccggcgcgggucuucuguucucuauaaagaaaaauacgacaaacaccagaagggggacuggaaacaucggcgagaccuugggugagaaguggaaaagccgccugaaugcccucggcaaguccgaauuucaaauuuauaagaaaucagggauccaggagguggaccggacacuggcaaaggaaggaauuaaacgaggcgagacugaucaccaugcugucucuagagggagugccaaguuaaggugguucguggagcgcaacaugguuaccccugaaggaaaagugguagaccuuggcugcgguagagggggauggucguacuauuguggcggucugaagaaugugagagaggucaagggccucacaaaagggggacccggccacgaggaaccuaucccaaugagcacguacggguggaaccuaguucgucugcaguccggaguggaugucuuuuucauacccccugaaaagugcgacaccuugcugugugauauuggcgagucuucaccaaaucccacuguggaggcagguaggacacuccggguacuuaaccugguggaaaauugguugaacaauaacacccaguucugcaucaaaguucugaauccguacaugccuagcgugaucgagaagauggaagcucuccaacgcaaauaugggggagccuuaguccgaaacccacuguccagaaauaguacucaugagauguacugggugucuaacgccagcggcaauauugucucauccgugaacaugauaaguaggaugcuuaucaaccgguuuacaaugcgccacaagaaggcgaccuaugaacccgacguugaccugggcagcgggacgagaaauauuggaaucgagucugagauuccuaaccuagauaucauagguaaaaggaucgaaaagauuaaagaggaacaugagaccuccuggcacuacgaccaggaucacccauauaagacaugggcuuaccauggcucauaugaaacuaaacagaccgggagcgcaucgucuaugguaaauggagugguccgacuccugacaaagcccugggacguguugccgacuguuacccagauggccaugacagauaccacuccuuucggccaacagcggguguuuaaggagaaagucgacacgcguacacaggagcccaaggaagguaccaaaaagcugaugaaaaucacugcugaguggcucuggaaggaacuugggaaaaagaagaccccaagaauguguacacgcgaggaguucacgaggaaagugcggaguaacgccgcacugggagccauuuuuaccgaugaaaauaaguggaaauccgcuagagaggcgguagaagacagccgcuucugggaguuaguggauaaggaaaggaaccugcacuuggagggcaaaugcgagacuuguguuuacaauaugaugggcaagcgagaaaagaaacucggggaguuuggaaaggccaaagguucacgggcaaucugguacauguggcugggcgcuagauuccuagaauuugaggcccuuggguuccugaacgaagaccauugguuuuccagggaaaauucucucagcggagucgagggcgaaggucugcacaaguugggguauauucugcgcgaugugaguaaaaaggagggaggcgcaauguacgccgacgacacagcuggcugggauacccguauaacucucgaagaccuuaagaacgaggaaaucgugacaaaucacauggagggggagcauaaaaagcuggccgaagcgauuuucaaauuaaccuaucagaacaaggucguucgggugcaaagaccuacacccaggggaacuguaauggauaucaucucccgccgagaccagcgggguagcggccagguggggaccuacggacugaauacguuuaccaacauggaggcacaauugauuagacagauggaaggcgagggugucuucaaaaauauacagcaccucacagugacugaggaagccgcuguucagaacuggcuggccaggguggggcgcgagagacuaucucggauggcaaucucaggagaugacugcgucgugaagccacuugaugacagguucgcuaacgcccugaccgcucucaaugauaugggcaagauucguaaagacauccaacagugggaacccaguaagggcuggaacgauuggacacagguaccuuuuugcucccaucacuuccaugagcugauuaugaaagacgggcgaguuuugguggucccaugucgcaaucaggaugaauuaaucgguagagcacggauaagccaaggagcaggcuggucucugagggagacugcgugccucgggaagucguaugcccagauguggucacuuauguacuuucaccgcagagaccugcggcuagcugccaacgcaaucuguagcgcugugccgucccacugggugcccaccaguaggacgacauggucuauucaugccaaacacgaguggaugaccacugaagacaugcugacagucuggaaucgaguuuggauccgugagaacccuuggauggaagauaagaccccaguggagagcugggaagagauucccuaucucggaaagagagaggaccaguggugcggcuccuugaucggucugacuucacgcgcaaccugggccaaaaauauacaggcggcuauuaaccaaguacggagucuuaucgggaaugaagaguacacagauuacaugccuucuaugaagagguucagacgcgaagaggaagaggccggagugcugugguga

SEQ ID NO: 14417 - RNA, 9876 nt, Artificial Sequence
  derived and/or modified CDS sequence (opt3) from DENV-2__GQ868638__SS-prME
agcgccggaaugaucauuaugcugauacccaccgugauggcuuuccaccucacuacuagaaacggggagccucauaugaucgucgguauucaagaaaaggguaaaucccuucuguuuaagacggaggacggcguuaauaugugcaccuugauggcaauggauuuaggggaacugugugaggacacaaucacuuacaaaugcccacuacucaggcaaaacgaaccggaggauauugacuguuggugcaauucuaccucaacaugggugaccuauggaacuuguacaaccacgggcgagcaccggcgcgaaaagcgaaguguagcccuggugccccaugucgguauggggcuugagacucguaccgaaacauggaugagcuccgagggagcguggaaacacgcucagagaaucgagacuuggauacugaggcauccuggcuucaccaucauggccgcaauuuuggccuacacaaucggcaccacgcacuuucagcgggcucucauuuucauccugcugacugcaguggccccaucuaugacaaugcgcugcauagggauuucgaacagagauuuuguugaaggagugucagguggcagcugggucgacaucgugcucgagcacgggaguuguguuaccacuauggcuaagaauaagcccacauuagauuucgaacugauuaaaaccgaggccaagcagccugcgacgcuuaggaaauauugcaucgaagcaaaguugaccaacacaacuaccgagucccgguguccaacacaaggagagcccucucugaaagaagaacaggacaagcgcuuuguuugcaagcauagcaugguggaucgaggcugggguaauggguguggacuauucggcaaaggcgggaucgucacuugcgccauguuuaccugcaagaaaaacauggaaggaaagauugugcagccugagaaucucgaauacacaauaguggucaccccacacuccggugaggagcaugcuguuggcaacgacacugggaaacacggaaaggaaaucaaagugacgccgcagucaaguauuacagaggccgaacugaccggcuaugguacuguaaccauggaguguagccccagaacagggcuugauuucaaugaaauggugcuguugcaaauggagaacaaggcauggcucguccacaggcagugguuucuggacuuaccucugccauggcuccccggcgcugauaagcagggaucuaauuggauccagaaagagacccuugugacuuucaagaacccucaugccaaaaagcaagacguugugguccugggcucccaggaaggggcgaugcacacagccuugacgggagcaaccgagauacagaugucaagcgguaaucuacuguuuacuggccaucucaaaugccggcugcguauggacaaacuucaacugaaggggaugaguuacucuauguguacaggaaaauucaaggugguaaaagaaauugcugagacccagcacggcacaaucguuauccgcuugcaguaugagggugauggguccccaugcaagauucccuucgaaaucauggaccucgagaaaagauacgugcugggcagguuaauuacugucaacccgauagugaccgaaaaggauagcccugucaacaucgaggccgaacccccauuuggagacucguacauuaucaucggcguggagccugggcagcugaagcuaaauugguucaaaaagggaucuuccauuggucaaauguuugagacgaccaugcggggcgcuaaacgaauggccauacucggggauacagcaugggacuucggaucacugggcgguguuuuuacaaguguggggaaggcccuucaucagaucuucggcgcuauuuauggagcggcauuuagcggcguauccuggaccaugaaaaucuugauuggggucaucauaacauggaucggaaugaacucucgcagcacuucacugagugugucccucguucuggugggcauugucacccuuuaccugggugugaugguacaggccgauagcgggugugugguuucuuggaagaauaaggaauugaaaugcggaucaggcaucuucauuacggacaacguccacacauggaccgagcaguauaaguuucaacccgaaaguccaagcaaacucgcuuccgccauccagaaggcacaggaggaagguauauguggcauuagaucugugacuaggcuggagaauuuaauguggaaacagaucacacccgagcugaaccacauucuagccgaaaaugaggugaagcucaccaucaugacuggggauauaaaaggaaucaugcaagcuggcaagcggucgcugcgcccucagccaaccgaacuuaaguacagcuggaaaacaugggggaaggccaaaauguuguccacggagucacauaaccagaccuuccugauugacggaccggaaacugcagagugccccaauacaaacagagcguggaauagucucgaggucgaagauuauggcuuugguguuuucaccacaaacaucuggcugaaguuaaaagagaagcaggacgcuuuuugugacucuaagcugaugagcgccgcaauuaaagauaauagggccgugcacgcugacaugggguacuggaucgaauccgcccuuaacgauacuuggaagauagagaaagcaucauucauugaggugaagaauugccauuggccuaaaagccacaccuuguggucuaacggaguacucgaauccgagaugaucaucccaaagaaccuggcuggccccgucagucaacacaauuaucguccugguuaccauacgcagacagccggcccauggcaccuagggaagcuggaaauggacuucgauuuuugugacggaaccacugugauuguuaccgaggauugcggcaaccgggggcccagccuccgaacaacuaccgcgucuggaaaacugaucacagaauggugcuguagauccugcacgcuuccgccuuugagguaccgcggcgaggacgguuguugguaugggauggagauucggccacugaaggaaaaagaggaaaauuuagugaacucacucgucaccgccggacauggccagguggauaauuucagucuggguguucuuggcauggcucuguuuuuggaggaaaugcucagaacuaggguggggacaaagcacgcaauacugcuaguagccgucagcuucgugacccugaucacuggaaacaugucguuuaaagaccucggccgcguggucguuauggugggggcuacaaugaccgaugacauuggaaugggcguaacguaccuggcccuuuuggcagcguucaaggugcgacccacuuuugccgcuggucuguuacuccggaagcugaccuccaaagagcuuaugaugacaaccaucgggauuguccugcuaucucaaagcacuaucccugagacaauacucgaacugaccgaugccuuggcacugggaaugaugguguuaaagaucguucgugacauggagaaauaucagcucgcugugacaauuauggccauccugugcguccccaaugcagugauucuucagaacgccuggaagguuucauguacuauccuggcuguggucaguguauccccauugcuccugaccucuagccagcagaagacggacuggauaccucuagcgcugacaauuaagggccuuaaucccaccgccaucuuccucacuacccuguccagaacaaacaaaaagaggucauggccauugaaugaagcaaucauggcugugggcaugguuagcauucuggccaguucuuuacucaagaacgauauaccgaugacugggccucugguggccggaggucuucugaccgucugcuacguguugacgggccgcuccgcugaccucgagcuggaacgggcaacagauguaaaaugggaggaccaggccgagaucagcgggucgucacccauucuaucuaucaccauuagugaagauggauccaugagcaucaagaaugaggaagaggagcagacucugacaauacuuaucagaaccggccuccuggugauuucugguuuguuuccagucagcauccccauuacugcggcugccugguauuuaugggaaguuaaaaagcagagggcaggggugcugugggacgugccuuccccacccccuaugggaaaagccgagcucgaagauggcgcuuaccgaaucaagcaaaagggcauacugggguauucacagauuggagcaggagucuacaaagagggcacauuccauaccauguggcacgugacgcgcggggccguucuuaugcacaagggaaaacggaucgaaccgaguugggcggacguaaagaaagaucugaucagcuacggcgguggguggaaguuggagggagaguggaaggaaggcgaggaagugcagguccuagcucuggagccaggcaaaaaccccagagccgugcagacuaagccugggcucuuuaaaaccaauacaggaaccauuggugcaguuucucuggacuucuccccaggcacaucagggagucccaucauagauaagaaaggaaagguggucggccuuuaugguaacggggugguaacuaggagcggagccuacgucuccgcuauugcccaaaccgaaaagucuaucgaggacaacccugagauugaagaugacaucuuucguaaacgccgguuaacgauaauggaccugcauccgggcgcaggcaagacaaaaagauaucuccccgcuauugugagggaggccaucaagcgaggguugcggacucugauccucgcgccaacccgcguuguggccgcagaaauggaggaagcucugagaggacuuccuauuagguaccagacacccgccauccgggcugagcacaccggucgagagauugucgaucugaugugucaugcaacuuucaccaugagauugcuaucgccagugcgcguuccuaauuauaaccugauaaucauggacgaagcccacuucacagaucccgccagcauugcugcgaggggcuacaucucaacgcguguggagaugggggaagcagccggaaucuuuaugacugcuaccccaccgggcucccgggacccuuucccccagaguaaugccccaauuauagaugaggagagagaaauccccgagaggucuuggaacagcggucaugaaugggucacagacuuuaaagggaagaccgugugguucguaccuuccauuaaggcaggaaaugauaucgccgcuugccuccgcaaaaacggcaagaaagugauucaauuaucacgaaagacuuuugacucugaguauguuaaaacaagaaccaaugauugggacuucgucgugacgacugauaucagcgaaaugggcgcgaacuuuaaggccgaccgggugauagacccaaggcgcuguaugaaacccgucauccugacagauggggaggagcguguaauucuugcaggaccuaugccggugacccacaguuccgcugcccagagacgggguaggaucggccgcaauccaaagaacgaaaaugaccaguacauuuacaugggggagccccuggaaaacgaugaggacugcgcacacuggaaggaagccaaaaugcucuuggauaauaucaacaccccugagggaauaauucccagcauguucgagccagaacgagagaagguugacgcuaucgauggcgaauauagacugcggggugaggccaggaaaacuuuuguggaccucaugcgcagaggggaucugccugucuggcuugcguacaagguggcagccgaaggcauuaauuaugcugacaggcggugguguuucgauggaaucaaaaacaaccagauacuagaggagaauguugaaguggagaucuggacaaaggaaggcgagcguaagaaacugaagccccgcugguuggacgcccgaauuuacucugauccauuagcucugaaagaguuuaaggaguucgcagccgggagaaaaucacucacccugaaccuuaucacagagaugggaaggcugccuacuuucaugacgcaaaagacccgggacgcucucgacaauuuggccguccugcauacagcagaagcggguggccgcgccuauaaccacgcucuauccgagcugccggaaacucucgagacccuucuguuauugacacugcucgccaccgugacugggggaauuuuucuguuccuuaugaguggcagagguaucgggaagaugacgcugggcaugugcugcauaauuaccgcaagcauccucuugugguacgcucagauccagccccauuggauugccgcaucgaucauacuggaguuuuucuuaauuguacuacugaucccagaaccugagaaacagaggacaccccaagauaaucagcucacuuaugugguuauugccauccuuaccgucguggcugcgacaauggccaacgaaaugggauuucuggagaagaccaaaaaggacuugggccuggggucuauagcaacucagcagccagaauccaauauccucgauauugaccugcggccugcuagcgccuggacacuuuacgccguggcaacgaccuucgucacucccaugcuccgacacucaaucgagaacaguucuguuaaugugucccugacagcuauugccaaccaagcgaccguauugaugggacuggguaaaggcuggccguuaagcaagauggauaucggggugccacuacuggcuauuggauguuacucacaggucaauccuaucacccucacagccgcacuucuguugcugguggcccacuaugcuauaauuggccccggucuccaggcaaaggccacuagagaggcgcagaaacgcgcugccgcagggaucaugaagaacccaacgguugacggcaucaccgugauugaucuggaccccauaccuuacgauccgaaauuugaaaagcaacuuggacaggucauguuacugauccucugcguaacacagguguugaugaugaggacuaccugggcccugugugaggcucuaacacuggccaccggccccauuaguacucucugggaagggaauccaggacgguucuggaacacgacaaucgcaguuagcauggcuaauauuuuucguggcuccuaucuugccggugcggggcuguuguucucuaucaugaaaaacaccacuaauaccagaaggggaacaggcaacauaggugagacucugggcgaaaaguggaaaagccgccucaacgcccuggggaaguccgaguuucaaaccuacaagaaaucaggaauccaggagguggaccggacauuagcaaaggaaggcauuaaacgaggggagacggaucaucacgcugucucuagaggaagugccaaacuuaggugguucguggaacgcaauauggucaccccugagggcaaagugguugaccuggguugcgggcggggaggcuggucguauuacugugguggccucaagaacgugagagagguaaaggggcuaacuaaaggaggccccgggcaugaagaaccuaucccaaugagcacauauggauggaaucuggugcguuugcaguccggcgucgauguauuuuucauucccccugaaaagugcgacacccugcucugugacaucggugagucuucaccaaaccccacuguggaagcagggaggacacuucggguccugaauuugguggagaacuggcugaauaacaauacccaguucugcauaaaaguacucaacccguacaugccuagcgugauugagaagauggaggcuuuacaacgcaaauacggaggcgcccugguucgaaauccacuuuccagaaacaguacgcacgagauguauugggugucuaaugccagcggcaacaucgucucauccgugaauaugaucaguaggaugcugauuaaccgguuuaccaugcgccauaagaaggcgacauacgaacccgaugucgaccuagggagcggaacuagaaacauagguaucgagucugaaauuccuaaucucgauaucauuggcaaaaggaucgagaagauaaaacaggagcacgaaaccuccuggcacuaugaccaggaucauccauacaagacaugggcuuaucacgggucauacgagacuaaacagaccggaagcgcaucgucuauggugaacggcguuguacgacuguugacaaagcccugggacgugcugccgaccgucacucaaauggccaugacggauacaaccccuuucggucagcagcggguguuuaaggaaaaaguugacacucgugcucaggagcccaaggaagggaccaaaaagcucaugaaaaucacagccgaguggcuuuggaaggagcugggcaagaagaagacgccaagaauguguacccgcgaagaguucacuaggaaagugcggaguaaugcagccuuaggcgcuauuuuuacagaugaaaacaaguggaaauccgcgagagaggccgucgaggacagccgcuucugggaacugguggauaaggagaggaauuugcaucucgaaggcaaaugcgagaccuguguauauaacaugauggggaagcgagaaaagaaacugggagaguuugguaaggcaaaaggcucacgggcuaucugguacauguggcuaggggccagauuccuugaguuugaagcacugggauuccucaaugaggaccacugguuuuccagggaaaacucucugagcggcguggagggugaaggguugcacaagcugggauacauucuccgcgacguuaguaaaaaggagggcggcgccauguaugcugaugacacugccgggugggauacacguaucacccuugaggaccugaagaaugaagagauggucacaaaccauauggaaggagagcacaaaaaguuagcggaagcaauuuucaaacugacuuaccaaaauaagguggugcggguccagagaccuacccccagggguacgguuauggauauaaucucccgccgagaccagcggggcagcgggcaagugggaaccuauggcuugaacacauuuacuaauauggaggcccagcucauuagacagauggagggugaagggguauucaggaacauccagcaucugaccgcuacagaggaaguggccguccaaaauuggcuagcacgcgugggaagagagcggcuuucuaggauggcuaucucaggcgaugacugcguugugaaaccacuggaugaccguuucgccaacgcucucacugcccugaacgauaugggcaagauucgaaaggacauacagcagugggagcccaguaaaggguggaaugauuggacccaggucccuuuuugcucccaccauuuccacgaauugaucaugaaggacggacgcguguuaguaguuccauguagaaaccaagacgagcugauuggucgggcaaggaucagccagggcgcgggguggucucuccgcgaaacggccugccuuggaaaaucguacgcucagauguggucacugauguauuuucacagacgggaucuaaggcuggccgcaaaugcuauuuguagcgccgugccgucccauuggguccccacaagucgaaccacuuggucuauccacgcaaagcaugaguggaugacaaccgaagacaugcucacuguguggaaccguguguggauaagagagaauccuuggauggaggauaaaaccccagucgaaagcugggaggaaauccccuacuugggcaagcgcgaggaccaguggugcgguucccugauugggcuuacaucacgggccacgugggcgaagaacauccaagcugccauuaaucagguuaggagucugaucggaaacgaagaguauaccgauuacaugccuucuaugaaaagauuccgccgggaggaagaggaagcaggcgugcucugguga

SEQ ID NO: 14418 - RNA, 9876 nt, Artificial Sequence
  derived and/or modified CDS sequence (opt3) from DENV-2__GU131927__SS-prME
agcgccggcaugaucauuaugcugauacccaccgugauggcuuuccaccucacgacucgaaacggggagccucauaugaucgucgguauucaagaaaagggaaaaucccuucuguuuaagacggaggacggcguuaauaugugcaccuugauggcaauggauuuaggggaacugugugaggacacaaucacuuacaaaugcccauuacucaggcaaaacgaaccggaggauauugacuguuggugcaauucuaccucaacaugggugaccuauggaacuuguacaaccacgggcgagcaccggcgcgaaaagcgaaguguagcccuggugccccaugucgguauggggcuugagacucguaccgaaacauggaugagcuccgagggagcguggaaacacgcucagagaaucgagacuuggauacugaggcauccuggcuucaccaucauggccgcaauuuuggccuacacaaucggcaccacgcacuuucagcgggcucucauuuucauccugcugacugcaguggccccaucuaugacaaugcgcugcauagggauuucgaacagagauuuuguugaaggagugucagguggcagcugggucgacaucgugcucgagcacgggaguuguguaaccacuauggcuaggaauaagcccacauuagauuucgaacugauuaagaccgaggccaaacagccugcgacgcuucggaaguauugcaucgaagcaaaauugaccaacacaacuaccgagucccgcuguccaacacaaggagagcccucucugaaggaagaacaggacaaacgauuuguuugcaagcauagcaugguggauagaggcugggguaauggguguggacuauucggcaagggcgggaucgucacuugcgccauguuuaccugcaaaaagaacauggaaggaaaaauugugcagccugagaaucucgaauacacaauaguggucaccccacacuccggugaggagcaugcuguuggcaacgacacugggaagcacggaaaagaaaucaaggugacgccgcagucaaguauuacagaggccgaacugaccggcuaugguacuguaaccauggaguguagccccaggacagggcuugauuucaaugaaauggugcuguugcaaauggagaacaaagcauggcucguccaccggcagugguuucuggacuuaccucugccauggcuccccggcgcugauaagcaggagucuaauuggauccagaaggaaacccuugugacuuucaaaaacccucaugccaagaaacaagacguugugguccugggaucccaggagggcgcgaugcacacagccuugacgggggcaaccgaaauacagaugucaagcggaaaucuacuguuuacuggucaucucaagugccgucugcgcauggacaaacuucaacugaagggcaugaguuacucuauguguacagggaaguucaaagugguaaaggagauugcugagacccagcacggaacaaucguuaucagagugcaguaugaaggcgaugguuccccaugcaaaauucccuucgagaucauggacuuggaaaagagguacguccucgggcggcugauuacugugaacccgauagucaccgagaaagauagcccugugaacaucgaagccgagcccccauuuggcgacucguacauuaucaucggaguugagccuggccaguuaaagcugaauugguucaagaaagggucuuccauuggacaaauguuugaaacgaccaugcgaggugcuaagcgcauggccauacuaggcgauacagcaugggacuucgggucacucggaggcguguuuacaaguguagguaaagcccugcaucaggucuucggggcuaucuauggcgcggcauuuagcggaguguccuggaccaugaagauucuuaucggcguuauuaucacauggauagggaugaacucuagaagcacuucauugagugugucccugguccucgugggaaucguaacccuguaccuuggcgugaugguucaggccgauagcgguugugucgugucuuggaaaaauaaggagcugaagugcgggucaggaauuuucaucacggacaacgugcacacauggaccgaacaguauaaauuucaacccgagaguccaagcaaguuggcuuccgccauucagaaagcacaggaagagggcaucugugguauaaggucugucacucggcucgagaaucugauguggaagcagauuacacccgaauuaaaccacauccuggccgagaaugaaguuaaacuaaccauuaugacuggcgauaucaaggggauaaugcaagcuggacgcagaucgcucaggccucagccaaccgagcugaaauacagcuggaagacauggggcaaggccaaaaugcuuuccacggaaucauauaaccagaccuucuugaucgacgggccggagacuacagagugccccaaugcaaaccgugcguggaauagucuggaaguggaggauuacggauuuggcguguucaccacaaacauuuggcucaagcugaaagaaaagcaggacgcuuuuugugacucuaaauuaaugagcgccgcaaucaaggauaaucgggccguacaugcugacauggguuauuggauugaguccgcccugaacgauacuuggaagaucgagaaagcaucauucauagaagucaagaauugccacuggccuaaaagccauacccuuuggucuaacgggguguuggaguccgaaaugauuaucccaaagagucucgcuggacccguuagccaacacaacuaccgaccuggcuaccacacgcagaucgccgguccauggcaucugggcaaacuagagauggacuucgauuuuugugacgggacaaccgugauugucacugaagauugcggaaauagaggccccucucugaggaccacaacugcguccgggaagcucaucaccgaguggugcugucgcucaugcacacugccgccucuucgguauagaggagaggacggcuguugguacgguauggaaauuaggccauugaaggagaaagaagagaaccuggugaauaguuuaguuacggccgggcacggacagguggauaacuucagccucggcguacuggguauggcucuuuuucuggaagagauguugcgcacccgagucggcacuaagcaugcaauacuccugguggccgugucguucgucacacuaaucaccgggaauauguccuuuaaagaccugggacggguugugguaauggugggcgcuacuauggccgaugacauugggaugggagucacauaucucgcacugcuugcggccuucaaggugcgucccaccuuugcugccggcuugcuguuaagaaaacucacgucuaaggagcugaugaugacuaccaucgguauuguucuucugagccaaucaacaaucccugaaaccauacuagagcucacugaugcacuggcuuuggggaugauggugcugaagaucgucaggaacauggaaaaauaccaguuagccgugacaauuauggcaauccucugcguucccaaugccgugauucugcagaacgcuuggaaggucaguuguaccauccuugcgguaguguccguuucuccacuguugcucacaagcucccagcagaagacugacuggauaccucuggcccuaaccauuaagggacugaaucccacggcaaucuuccuuacaacccucucacgcacuaacaaaaagcggagcuggccacugaaugaggcuaucauggccgugggcauggucaguauuuuggccucuucccugcucaaaaacgacauaccgaugaccggcccucuaguggcugggggacugcuuacaguaugcuaugugcugacugguagaagcgcagauuuggaacucgagagggccaccgacgucaagugggaggaacaggcggagaucucgggcucaucucccauucugaguaucacgauuuccgaagaugggagcaugucuaucaagaaugaggaggaggaacagacacuaaccauacugauccgaacuggacuucucguuauuagcggccuguuuccaaucuccauucccaucacagcugccgcaugguacuugugggaagugaaaaagcagcgcgccgguguguuaugggacgucccuucaccacccccuauggggaaagcugagcuggaagauggagcauaucggauaaagcaaaaaggcauucucggcuacagucagaucggggccggaguguacaaggaggguaccuuccacacuauguggcauguuacaagaggcgcgguacugaugcacaaggggaaaaggaucgagccgagcugggcugacgugaagaaagaucuuauuucuuauggaggcgguuggaagcuggaaggggaguggaaagaaggagaggaaguccagguguuggcccuagagccaggcaagaacccccgugcaguucagaccaagccuggccuguuuaaaacgaauacugggaccaucggagccgugucccucgacuucucaccagguacaaguggcagccccauaauugauaagaaagggaaggucgugggacuguacggcaacgguguagucacccgcuccggggcuuaugugucugccaucgcacaaacagagaaaucgacugaagacaacccugagauugaagaugacaucuuucggaagagaaggcuuaccauaauggauuuacacccgggagcuggcaagacgaaacgauaccugcccgccauuguucgggaggcgaucaagcgcggccucagaacauugauccuggccccaacuaggguggucgcagcugaaauggaggaggcccuccgggggcugccuauucgauaucagacccccgcuaucagagcagaacauacaggacgcgagauuguggaccuuaugugucacgccaccuucacuaugaggcuguugagcccaguucgugugccuaauuacaaccuaauaaucauggacgaagcccauuucaccgaucccgcuucaauugcggcacgggguuauaucuccacaagagucgagaugggcgaggccgcugggaucuuuaugacggccacuccaccgggaaguagggacccuuucccccagucuaaugcaccaauuauagaugaagaacgcgaaauccccgagcgaagcuggaacuccggccacgaaugggugaccgacuuuaaagguaagacaguaugguucgugccuucaauuaaagccgggaaugauaucgcugcgugccugagaaagaacggaaagaaaguuauucaacucucucggaagaccuuugacagcgaguacgucaaaacuaggacaaaugauugggacuucguggugaccacggauaucagugagaugggcgccaacuuuaaggcagaacgcgucauagacccacguagauguaugaaacccguaaucuuaacugauggcgaggaacgggugauucuggcugggccuaugccgguuacacauuccagcgccgcacagaggcgcggacgaaucgguagaaauccaaagaacgagaaugaccaguacauuuauaugggcgaaccccuugagaacgacgaggauugcgcccacuggaaagaagcuaagaugcugcucgacaauaucaacaccccugaggggauaauucccucuauguucgaaccagagcgggaaaagguggaugccaucgacggagaguacagguugcgcggcgaggcgagaaaaaccuuugucgaucugaugaggcggggugaccucccuguguggcuggcauauaagguugccgcugaagggauuaauuacgccgaucgucgcugguguuucgacggcaucaaaaacaaccagauacuugaggaaaauguggaggucgagaucuggacuaaggaaggagagaggaaaaagcuaaagcccagauggcuggaugcuagaauuuauucagacccauuggcauuaaaagaauuuaaggaguucgccgcuggccggaaaucccugacacucaaccugaucaccgaaauggggcgccuuccuacauucaugacucaaaagacgagagaugcccuggacaaucucgcaguguugcacaccgcggaggccggagguagggcuuacaaccaugcccugagugagcuaccggaaacacuggagacucuccuucuguuaaccuugcuggcaacaguaaccggcgggauuuuucucuuccugaugagcggacggggcaucgguaaaaugacucuugggaugugcugcauaauuacggcuucgauccugcucugguaugcccagauccagccccacuggauugcagccucuaucauauuggaauuuuuccugauuguguuacuaaucccagagccugaaaagcagcgaacaccccaagauaaucagcugacauacguugucauugcuauccucacugugguggcggccaccauggcaaacgagaugggcuuucuugagaagacuaaaaaggaccugggauugggcuccauagcuacccagcagccagaaagcaauauccuggacauugaucucagaccugccucagccuggacucuguacgcagucgcuacaacguucaucacccccaugcuucgccauaguauugagaacucuuccguuaauacuagccucacagccaucgcgaaccaagcuaccgugcugaugggguugggaaaagguuggccgcugucaaagauggacauuggcguaccauuacuagccaucggguguuauagucaggugaauccuauaacccugacagcagcccuccuucuguuggucgcucacuacgcaauuaucggacccggccugcaggccaaagcgacuagggaagcucagaagcgggccgcagccgguaucaugaagaacccaacgguggaugggauuaccguuauagaccucgaucccaucccuuaugacccgaaauuugagaagcaacugggccaggugaugcuuuuaauucugugcgucacacagguacucaugaugcguacuaccugggcuuugugugaagcccugacacuagcaaccggacccaucagcacucugugggagggcaauccagggagauucuggaacacgacaauugcuguguccauggccaauaucuuuaggggaucuuaccucgcgggcgccggucuucuguucagcauaaugaaaaacaccacuaauacccgccgggggacaggaaacaucggcgagacuuugggugaaaaguggaaaucccgacugaacgcacucggcaagucagaguuucaaauuuauaaaaagucugggauccaggaaguugauagaacccuggcuaaggagggaauuaaaaggggcgagacagaccaccaugccgugagucgcgggucggcaaaguuacggugguucgucgaaagaaauauggugacgccugagggaaaagucguggaucuuggcugcggucgugggggauggagcuacuauuguggcggucugaagaacguuaaagaagugaagggccucaccaaagggggacccggccacgaggaaccuaucccaauguccacuuacggguggaaucuaguaaggcugcagucuggaguggacgucuuuuucauacccccugagaaaugcgauacauugcugugugacauuggcgagucaagcccaaaccccaccguugaagcuggucggacucuccgcgugcuuaaucuggucgagaacugguugaauaacaauacacaguucugcaucaaggugcugaacccguacaugccuuccguaaucgagaaaauggaggcccuccaacgaaaguaugggggagccuuagugagaaauccacugaguaggaacucuacccaugaaauguacuggguuagcaaugcgucaggcaacauuguguccagugucaauaugauaagccggaugcuuaucaaccgcuuuacgaugagacacaaaaaggcuaccuaugagcccgauguggaccugggcucugggacaaggaacauuggaaucgaguccgaagucccuaaucuagacauuaucgguaagcgaauagagaaaaucaagcaggaacaugagacuucauggcacuacgaucaggaccacccauauaaaaccugggcauaccauggcagcuaugaaacaacucagaccgggucggccucuaguauggugaacggaguuguacggcuccugacaaagcccugggauguguugccgaccgucacucaaauggcuaugacggacacaaccccuuucggccagcagcguguguuuaaagagaagguugauacuagaacccaggagcccaaggaagguaccaaaaagcugaugaaaauuacggccgaguggcucuggaaggaacuugggaaaaagaaaaccccacgcauguguacuagggaggaguucacacggaaggugagauccaaugcagcccugggagcuaucuuuaccgacgaaaacaaguggaaaagcgcgcgcgaggccgucgaagauucaagguucugggaguuaguggacaaggaacgaaaucugcacuuggagggcaaaugcgagacuuguguauacaacaugaugggcaagcgggagaaaaagcucggggaguuuggaaaggcaaaagguuccagagcuauuugguacauguggcugggcgccagguuccuagaauuugaggcacuuggguuccugaaugaagaucauugguuuucucgcgagaacagccucaguggaguggagggcgaaggucugcacaaguugggguauauccugcgugacguuuccaaaaaggagggaggcgccauguacgcugaugacacagccggcugggacacccggauuacacucgaagaucuuaaaaaugaggaaauggucacuaaccacaugaagggggagcauaagaaacuggcggaggcaauauucaaguuaaccuaucaaaauaaaguggugagaguccagaggccuacgccccgcggaaccguuauggacaucauuagccgacgggaucagagagguucuggccaaguggggacauacggacugaacacuuuuaccaauauggaagcccaguugaucaggcagauggagggcgaagguguauucaagaacauccagcaccucacagugacugaggaggucgcugugcaaaauuggcuggcccgcguugggagagaacggcuaucaaggauggcaauuaguggagacgauugcguggucaaaccacuugacgaucguuucgcuaacgcccugaccgcucucaacgacaugggcaagauacgaaaggauauccagcagugggagcccuccaaaggcuggaaugacuggacacaggugccuuuuugcagccaucacuuccaugaacugauuaugaaggaugggcgcguauugguugugccauguagaaaccaagacgaguuaaucggacgggccaggauuucucagggugcaggcuggucgcugcgcgaaacagcgugccucgggaaaucauaugcccagauguggagccuuauguacuuucacagacgggaucugaggcuagcugccaaugcaaucuguuccgcugucccgagucacugggugcccaccucucgaacuacauggagcauacaugccaagcacgaguggaugaccacugaggacaugcugaccguguggaaccgugucuggaucagagaaaauccuuggauggaggacaaaacaccaguugaauccugggaggaaauucccuaucucggaaagcgcgaggaucaguggugcggcucauugaucggucugacgagucgggcaaccugggccaagaacauucaagcggcuaucaaucaggugaggucucuuauagggaacgaggaauacacugacuacaugccuagcaugaaaagauuccgccgggaggaagaggaagccggaguacugugguga

SEQ ID NO: 14419 - RNA, 9876 nt, Artificial Sequence
  derived and/or modified CDS sequence (opt3) from DENV-2__GU131928__SS-prME
agcgccggaaugaucauuaugcugauaccaaccgugauggcuuuccaccucacuacucggaacggggagccucauaugaucgucgguauucaagaaaagggaaaaucccuucuguuuaagacggaggacggcguuaauaugugcaccuugauggcaauggauuuaggggaacugugugaggacacaaucacuuacaaaugcccacuacucaggcaaaacgaaccggaggauauugacuguuggugcaauucuaccucaacaugggugaccuauggaacuuguacaaccacgggcgagcaccggcgcgaaaagcgaaguguagcccuggugccacaugucgguauggggcuugagacucguaccgaaacauggaugagcuccgagggagcguggaaacacgcucagagaaucgagacuuggauacugaggcauccuggcuucaccaucauggccgcaauuuuggccuacacaaucggcaccacgcacuuucagcgggugcucauuuucauccugcugacugcuguugcaccaucuaugacaaugcgcugcauagggauuucgaacagagauuuuguggaaggagucucagguggcagcuggguggacaucguacucgagcacgggaguuguguuaccacuauggccaagaauaagcccacauuagauuucgaacugauuaaaaccgaggcuaagcagccugccacgcuuaggaaauauugcaucgaagcgaaguugaccaacacaacuaccgagucccgguguccaacacaaggagagcccucucugaaagaggaacaggacaagcgcuuugugugcaagcauagcauggucgaucgaggcugggguaauggguguggacuauucggcaaaggcgggaucgugacuugcgcaauguuuaccugcaagaaaaacauggaaggaaagauugugcagccugagaaucucgaauacacaauagucguuaccccacacuccggugaggagcaugccgugggcaacgacacugggaaacacggaauggaaaucaagguaacgccgcagucaaguauuacagaggcugaacugaccggcuaugguacugugaccauggaguguagccccagaacagggcuugauuucaaugaaaugguccuguugcaaauggagaacaaagccuggcucgugcacaggcagugguuucuggacuuaccucugccauggcuccccggcgcagauaagcaggagucuaauuggauccagaaggaaacccuuguuacuuucaaaaacccucaugcuaagaaacaagacguggucgugcugggaucccaggagggcgccaugcacacagcguugacgggggccaccgaaauacagaugucaagcggaaaucuacuguuuacuggucaucucaagugccggcugcguauggacaaacuucaacugaagggcaugaguuacucuauguguacagggaaguucaaaguaguuaaggagauugcagagacccagcacggaacaaucgugauccgcguccaguaugaaggcgaugguuccccaugcaaaauucccuucgagaucauggacuuggaaaagagauacgugcucgggaggcugauuacugucaacccgauagugaccgagaaagauagcccuguuaacaucgaagcugagcccccauuuggcgacucguacauuaucaucggaguggagccuggccaguuaaagcugaauugguucaagaaagggucuuccauuggacaaauguuugaaacgaccaugcggggugccaagcgaauggcuauacuaggcgauacagccugggacuucgggucacucggaggcguauuuacaaguaucgguaaagcacugcaucaggucuucggggccauuuauggcguggcuuuuagcggaguuuccuggaccaugaagauccuuauuggcgugaucauaacauggaucgggaugaacucucgcagcacuucauugagugucucccuggugcucguaggaauugugacccuguaccuuggcguuaugguccaggcggauagcgguuguguggugucuuggaaaaauaaggagcugaagugcgggucaggaaucuucauuacggacaacguccacacauggaccgaacaguauaaauuucaacccgagaguccaagcaaguuggcauccgccauccagaaagcucaggaagagggcauaugugguauuagaucuguuacuaggcucgagaaucugauguggaagcagaucacacccgaauuaaaccacauucuggccgagaaugaagugaaacuaaccaucaugacuggcgauauaaaggggaucaugcaagcaggaaaacggucgcuccgcccucagccaaccgagcugaaguacagcuggaagacauggggcaaagccaagaugcuuuccacggaaucauauaaccagaccuucuugauugacgggccggagacugcugagugccccaauacaaacagagccuggaauagucuggaaguggaggauuacggauuuggcguauucaccacaaacaucuggcucaaacugaaggaaaaacaggacgcauuuugugacucuaaguuaaugagcgcggcuauuaaggauaauagggccguccaugcagacauggguuauuggaucgaguccgcccugaacgauacuuggaaaauagagaaggcuucauucauugaagugaaaaauugccacuggccuaagagccauacccuuuggucuaacgggguuuuggaguccgaaaugaucauccccaagaaccucgccggacccgugagucaacacaauuaccguccuggcuaccacacgcagauugcagguccauggcaucugggcaagcuagagauggacuucgauuuuugugacgggacaaccgucaucgugacugaagauugcggaaaccggggccccagccugcgaaccacaacugcuucugggaagcucauuaccgaguggugcuguagauccugcacacugccgccucuuagguaucgcggagaggacggcuguugguacgguauggaaauacggccauugaaagagaaggaagagaaucugguuaacucauuagugacggccgggcacggacagguagauaauuucagucucggcguccuggguauggcgcuuuuucuggaagagauguugagaaccagggugggcacuaaacaugccauccuccugguggcugucagcuucguuacacuaauuaccgggaacaugucguuuaaggaccugggacgcgugguagugauggucggcgcaacuauggccgaugacaucgggaugggagugacauaucucgcucugcuugccgcauucaaaguucgacccaccuuugcggccggcuugcuguuacggaagcucacguccaaggagcugaugaugacuaccauugguaucgugcuucugucucaaagcacaauaccugaaaccguccuagagcucacugaugcucuggccuuggggaugauggugcugaaaaucguucguaauauggaaaaguaccaguuagcagugacaauuauggcuauccucugcguccccaacgccguaauucugcagaaugcauggaaagugucauguaccauccuugccguugugagugucuccccacuguugcucacaucuagccagcaaaagacugacuggauaccucuggcucuaaccauuaaaggacugaaccccacggcgaucuuccuuacaacccucuccagaacuaauaagaaaaggucauggccacugaacgaggccaucauggcagugggcaugguaagcauuuuggcuaguucucuguuaaagaaugacauaccgaugaccggcccucucguggccgggggacugcuuacagucugcuauguucugacuggucgcuccgccgauuuggaacucgagcgggcuaccgacgugaagugggaggaucaggcagaaaucagcggcucgucacccauucugucuaucacgauuagugaggacggguccaugagcaucaaaaacgaagaggaggaacagacacuaaccauacugaucagaacuggacuucucgugauuucuggccuguuuccaaucagcauucccaucacagccgcggcuugguacuugugggaggucaagaaacagagggccgguguguuaugggauguuccuuccccacccccuauggggaaggcagaacuggaggacggagccuaucgaauaaaacaaaagggcauucucggcuacucacagaucggggcuggaguauacaaggaagguaccuuccacacuauguggcaugugacacgcggcgcaguccugaugcacaaagggaagcggaucgagccgaguugggccgaugugaaaaaggaccuuauuagcuauggaggcgguuggaaacuggagggggaauggaaggagggagaagagguucagguguuggcgcuagaaccaggcaagaaucccagagcuguccagaccaaaccuggccuguuuaagacgaacacugggaccaucggagccgugucucucgauuucuccccagguacaucaggcagucccauaauugacaaaaaggggaaaguagucggacuguacggcaacggugugguuaccaggagcggggcauauguguccgccaucgcucaaacagagaagucuauugaggauaauccugaaaucgaggacgauauauuucguaagcgccggcuuacuauuauggacuuacacccgggagccggcaaaaccaagagauaccugcccgcaaucgucagggaagcuaucaaacgaggccuccggacguugauucuggccccaacacgcgugguugcggccgagauggaagaggcacucagagggcugccuaucagguaucagacucccgcuauucgggccgagcauaccggacgagaaauaguggaccuuaugugucacgcuacauucaccaugagacuguugucgccaguccgcgugccuaacuacaaucuaaucauuauggaugaggcacauuucacugaccccgccagcaucgccgcuagggguuauaucucaacccguguagaaaugggcgaggcggcagggauuuuuaugacagccacgccaccgggaucccgggauccuuucccccagaguaacgcuccaauaaucgacgaggaaagagagauucccgaaaggucuuggaauagcggccacgagugggugacugauuuuaaggguaaaaccguuugguucgucccuuccaucaaggccgggaacgacauugcagccugccugcgcaagaauggcaagaaggugauccaacucucacgaaaaacauuugauucugaauacgugaagaccagaacuaacgacugggauuucgucguaacaaccgacauaagcgagaugggcgcuaauuuuaaagcggagcgggugaucgauccaaggcgcuguaugaagcccguuauuuuaacggacggcgaagaacgugugauccuggccgggccuaugccggucacucauaguuccgcagcucagagacggggaaggauuggucgcaaccccaaaaaugaaaacgaccaguacaucuauaugggcgagccccuugaaaaugaugaggacugcgcccacuggaaggaggcaaagaugcugcucgauaacauaaauacaccugaagggauuauccccagcauguucgagccagaacgagagaaaguggacgccauugauggagaauacagauugcggggcgaggcuaggaagaccuuuguugaccugaugcgcagaggugaucucccuguguggcuggccuauaaagucgcggcagaggggaucaacuacgccgacaggcggugguguuucgauggcauaaagaacaaucagauccuugaagagaacguggaaguagagauuuggaccaaagagggagaacguaagaagcuaaaaccccgcuggcuggacgcucgaaucuauucugauccauuggccuuaaaggaguuuaaagaguucgcugcaggcagaaagucacugacucucaaucugauuacagagauggggaggcuuccuaccuucaugacacagaaaacucgggacgcccuggauaaccucgcuguguugcacacggccgaagcaggaggucgcgcguacaaucaugcccuguccgagcuaccggagacccuggaaacacuccuucuguuaacuuugcuggcuaccguuacaggcgggaucuuucucuuccugaugaguggaagaggcauagguaagaugacccuugggaugugcugcauuaucacugccagcauccugcucugguaugcacagauucagccccacuggaucgcugccucgauaauuuuggaguuuuuccugaucgucuuacuaauuccagaaccugagaagcagaggacgccccaagacaaccagcugaccuacguggugaucgcaauacucacagucguugccgcuacuauggcgaaugaaaugggcuuucuugagaaaaccaagaaagaccugggauugggcucuaucgccacacagcagccagaguccaacauucuggauaucgaccuccggccugcaagcgcuuggacccuguacgccguggccacuacauucguaacgcccaugcuucgacauucaauugaaaauaguucugugaacgucucccucaccgcaaucgcuaaucaagccacugugcugaugggguugggaaaggguuggccgcugagcaaaauggauauuggcguuccauuacuagcgaucggguguuauucacaggugaacccuauaacacugaccgcugcccuccuucuguuggucgcacacuacgccauuaucggacccggccugcaggcuaaggcaaccagagaggcccagaagcgcgcggcugccgguaucaugaaaaauccaacaguagacgggauuacugugauagaucucgaccccaucccuuaugauccgaaguuugaaaaacaacugggccagguuaugcuuuuaauucugugcgugacgcagguccucaugaugaggaccacaugggcauugugugaggcccugacucuagcuaccggacccaucaguacacugugggaaggcaacccagggcgguucuggaauaccacuauugccgugagcauggcaaacaucuuucguggauccuaccucgcuggcgccggucuucuguucucuauaaugaagaauacgacaaacaccagaagggggacuggaaacaucggcgagaccuugggugagaaauggaaaagccgccugaaugcgcucggcaaauccgaauuucaaauuuauaagaagucagggauccaggaggucgaccggacacuggccaaagaaggaauuaagcgaggcgagacugaucaccaugcagugucuagagggagugcuaaauuaaggugguucguugagcgcaacauggugaccccugaaggaaagguaguggaccuuggcugcgguagagggggauggucguacuauuguggcggucugaaaaaugucagagagguuaagggccucacaaaagggggacccggccacgaggaaccuaucccaaugagcacguacggguggaaccuagugcgucugcaguccggagucgauguguuuuucauacccccugaaaaaugcgacaccuugcugugugauauuggcgagucuucaccaaaucccacuguagaggccgguaggacacuccgggugcuuaaccugguugaaaauugguugaacaauaacacccaguucugcaucaaggugcugaauccguacaugccuagcgucaucgagaaaauggaagcacuccaacgcaaguaugggggagcuuuagugcgaaacccacuguccagaaauaguacucaugagauguacugggucucuaacgccagcggcaauauugugucauccguuaacaugauaaguaggaugcuuaucaaccgguuuacaaugcgccacaaaaaggccaccuaugaacccgacguagaccugggcagcgggacgagaaauauuggaaucgagucugagaccccuaaccuagauauuaucgguaagaggauagagaaaaucaaggaggaacaugagacauccuggcacuacgaccaggaucacccauauaaaacuugggcguaccauggcucauaugaaaccaagcagacagggagcgcuucgucuauggugaauggagucgugcgacuccugacuaaacccugggacguuuugccgaccgugacacagauggcaaugaccgauacuacgccuuucggccaacagcgggucuuuaaggagaagguggacacacguacccaggagcccaaagaagguacuaagaaacugaugaagauuaccgccgaguggcucuggaaagaacuugggaagaaaaagacaccaagaauguguacgcgcgaggaguucaccaggaagguacggaguaacgcugcccugggagcaaucuuuacugaugaaaauaaauggaaguccgccagagaggcuguggaagacagccgcuucugggaguuaguugauaaagaaaggaaccugcacuuggagggcaagugcgagacaugugucuacaauaugaugggcaaacgagaaaagaagcucggggaguuuggaaaagcgaaggguucacgggccauuugguacauguggcugggcgcaagauuccuagaauuugaggcucuuggguuccugaacgaagaccauugguuuuccagggaaaauucucucagcggaguggagggcgaaggucugcacaaauugggguauauccugcgcgaugugaguaagaaagagggaggcgccauguacgcagacgacaccgccggcugggauacucguauuacacucgaagaccuuaagaacgaggaaauggucaccaaucacauggagggggagcauaagaaacuggcugaagccauauucaaguuaacauaucagaacaaaguugugcggguacaaagaccuacucccaggggaaccgugauggauaucauuucccgccgagaccagcgggguagcggccaggucgggacguacggacugaauaccuuuacaaacauggaggcgcaauugaucagacagauggaaggcgaggguguguucaagaauauccagcaccucacuguuaccgaggaagcagccgugcagaacuggcuggcuagggucgggcgcgagagacuaucucggauggccauuucaggagaugacugcgugguaaaaccacuugaugacagguucgcaaacgcucugacagcccucaaugauaugggcaagauacguaaggacauccaacagugggaacccaguaaaggcuggaacgauuggacucagguuccuuuuugcucccaucacuuccaugagcugauuaugaaggacgggcgaguguuggucgugccaugucgcaaucaggaugaauuaaucgguagagcucggauuagccaaggagccggcuggucucugagggagaccgcaugccucgggaaaucguaugcgcagauguggucacuuauguacuuucaccgcagagaccugcggcuagccgcuaacgccaucuguagcgcagugccgucccacuggguccccacgaguaggacaaccuggucuauacaugcuaagcacgaguggaugacuacagaagacaugcugaccguuuggaaucgaguguggauccgugagaacccuuggauggaagauaaaacuccaguagagagcugggaagagauucccuaucucggaaagagagaggaccaguggugcggcuccuugaucggucugaccucacgcgccacaugggcaaagaauauucaggccgcgaucaaccaagugcggagucuuauagggaaugaagaguacacggauuacaugccuucuaugaaaagguucagacgcgaagaggaagaggcuggaguccugugguga

SEQ ID NO: 14420 - RNA, 9876 nt, Artificial Sequence
  derived and/or modified CDS sequence (opt3) from DENV-2__GU131929__SS-prME
agcgccggaaugauaauuaugcugauaccaaccgugauggcuuuccaccucacuacuagaaacggggagccucauaugaucgucgggauucaagaaaaggguaaaucccuucuguuuaagacggaggacggaguuaauaugugcaccuugauggcaauggauuuaggggaacugugugaggacacaaucacuuacaaaugcccacuacucaggcaaaacgaaccggaggauauugacuguuggugcaauucuaccucaacaugggugaccuauggaacuuguacaaccacgggcgagcaccggcgcgaaaagcgaaguguagcccuggugccacaugucgguauggggcuugagacucguaccgaaacauggaugagcuccgagggagcguggaaacacgcucagagaaucgagacuuggauacugaggcauccuggcuucaccaucauggccgcaauuuuggccuacacaaucggcaccacgcacuuucagcgggugcucauuuucauccugcugacugcuguugcaccaucuaugacaauacgcugcauugggaucucgaacagagauuuuguggaaggagucucagguggcagcuggguggacauuguacucgagcacgggaguuguguuaccacuauggccaagaauaagcccacauuagauuucgaacugaucaaaaccgaggcuaagcagccugccacgcuuaggaaauauugcaucgaagcgaaguugaccaacacaacuaccgagucccgguguccaacacaaggagagcccucucugaaagaagaacaggacaagcgcuuugugugcaagcauagcauggucgaucgaggcugggguaauggguguggacuauucggcaaaggcgggauugugacuugcgcaauguuuaccugcaagaaaaacauggaaggaaagauagugcagccugagaaucucgaauacacaaucgucguuaccccacacuccggugaggagcaugccgugggcaacgacacugggaaacacggaauggaaauuaagguaacgccgcagucaaguaucacagaggcugaacugaccggcuaugguacugugaccauggaguguagccccagaacagggcuugauuucaaugaaaugguccuguugcaaauggagaacaaagccuggcucgugcacaggcagugguuucuggacuuaccucugccauggcuccccggcgcagauaagcaggagucuaauuggauacagaaggaaacccuuguuacuuucaaaaacccucaugcuaagaaacaagacguggucgugcugggaucccaggagggcgccaugcacacagcguugacgggggccaccgaaauucagaugucaagcggaaaucuacuguuuacuggucaucucaagugccggcugcguauggacaaacuucaacugaagggcaugaguuacucuauguguacagggaaguucaaaguaguuaaggagaucgcagagacccagcacggaacaaucgugauucgcguccaguaugaaggcgaugguuccccaugcaaaauccccuucgagauuauggacuuggaaaagagauacgugcucgggaggcugauaacugucaacccgaucgugaccgagaaagauagcccuguuaacauugaagcugagcccccauuuggcgacucguacaucaucauuggaguggagccuggccaguuaaagcugaauugguucaagaaagggucuuccauaggacaaauguuugaaacgaccaugcggggugccaagcgaauggcuauccuaggcgauacagccugggacuucgggucacucggaggcguauuuacaaguauugguaaagcacugcaucaggucuucggggccaucuauggcguggcuuuuagcggaguuuccuggaccaugaagauucuuaucggcgugauaaucacauggauugggaugaacucucgcagcacuucauugagugucucccuggugcucguaggaaucgugacccuguaccuuggcguuaugguccaggcggauagcgguuguguggugucuuggaaaaauaaggagcugaagugcgggucaggaauuuucaucacggacaacguccacacauggaccgaacaguauaaauuucaacccgagaguccaagcaaguuggcauccgccauacagaaagcucaggaagagggcauuugugguaucagaucuguuacuaggcucgagaaucugauguggaagcagauuacacccgaauuaaaccacauccuggccgagaaugaagugaaacuaaccauaaugacuggcgauaucaaggggauuaugcaagcaggaaaacggucgcuccgcccucagccaaccgagcugaaguacagcuggaagacauggggcaaagccaagaugcuuuucacggaauccuauaaccagaccuuuuugaucgacgggccggagacugcugagugccccaauacaaacagagccuggaacucacuggaaguggaggauuacggauucggcguauuuaccacaaacauuuggcucaaacugaaggaaaaacaggacgcauucugugacaguaaguuaaugucugcggcuaucaaggauaauagggccguccaugcagacauggguuauuggauagagagcgcccugaacgauacuuggaaaauugagaaggcuuccuucaucgaagugaaaaauugccacuggccuaagucacauacccuuuggagcaacgggguuuuggagucugaaaugaucauucccaagaaucucgccggacccgugucccaacacaauuaccguccuggcuaccacacgcagaucgcagguccauggcaucugggcaagcuagagauggacuuugauuucugugacgggacaaccgucauugugacugaagauugcggaaaccggggccccagucugcgaaccacaacugcuagcgggaagcucauaaccgaguggugcuguagaucuugcacacugccgccucuuagguaucgcggagaggacggcuguugguacgguauggaaauccggccauugaaagagaaggaagagaaucugguuaacuccuuagugacggccgggcacggacagguagauaauuuuucacucggcguccuggguauggcgcuuuuccuggaagagauguugagaaccagggugggcacuaaacaugccauucuccugguggcugucaguuuuguuacacuaaucaccgggaacaugagcuucaaggaccugggacgcgugguagugauggucggcgcaacuauggccgaugacauugggaugggagugacauaucucgcucugcuugccgcauuuaaaguucgacccaccuucgcggccggcuugcuguuacggaagcucacgucgaaggagcugaugaugacuaccaucgguauagugcuucugucccaaucuacaaucccugaaaccguccuagagcucacugaugcucuggccuuggggaugauggugcugaaaauuguucguaauauggaaaaguaccaguuagcagugacaaucauggcuauucucugcguccccaacgccguaauccugcagaaugcauggaaagugagcuguaccauacuugccguugugucagucaguccacuguugcucacauccucucagcaaaagacugacuggauuccucuggcucuaaccaucaaaggacugaaccccacggcgaucuuucuuacaacccucagcagaacuaauaagaaaagguccuggccacugaacgaggccauuauggcagugggcaugguaucaauauuggcuagcagucuguuaaagaaugacaucccgaugaccggcccucucguggccgggggacugcuuacagucugcuauguucugacuggucgcucugccgauuuggaacucgagcgggcuaccgacgugaagugggaggaucaggcagaaauuuccggcagcucgcccauccugucaauuacgaucucugaggacgggaguauguccaucaaaaaugaagaggaggaacagacacuaaccauccugauuagaacuggacuucucgugaucagcggccuguucccaauuucuauccccauaacagccgcggcuugguacuugugggaggucaagaaacagagggccgguguguuaugggauguuccuagcccacccccuauggggaaggcagaacuggaggacggagccuaucgaauuaaacaaaagggcauccucggcuacucccagaucggggcuggaguauacaaggaagguaccuuucacacuauguggcaugugacacgcggcgcaguccugaugcacaaagggaagcggauugagccgucaugggccgaugugaaaaaggaccuuaucaguuauggaggcgguuggaaacuggagggggaauggaaggagggagaagagguucagguguuggcgcuagaaccaggcaagaaucccagagcuguccagaccaaaccuggccuguucaagacgaacacugggaccauaggagccgugagccucgauuuuucuccagguacauccggcucacccauuaucgacaaaaaggggaaaguagucggacuguacggcaacggugugguuaccaggaguggggcauaugugagcgccauugcucaaacagagaaguccaucgaggauaauccugaaauagaggacgauauuuuccguaagcgccggcuuacuaucauggacuuacacccgggagccggcaaaaccaagagauaccugcccgcaaucgucagggaagcuauuaaacgaggccuccggacguugauccuggccccaacacgcgugguugcggccgagauggaagaggcacucagagggcugccuauuagguaucagacucccgcuauacgggccgagcauaccggacgagaaaucguggaccuuaugugucacgcuacauucaccaugagacuguugucuccaguccgcgugccuaacuacaaucuaauuaucauggaugaggcacauuuuacugaccccgccucgaucgccgcuagggguuauauuagcacccguguagaaaugggcgaggcggcagggauauucaugacagccacgccaccgggaucacgggauccuuuuccccaguccaacgcuccaaucauugacgaggaaagagagauccccgaaaggaguuggaacucuggccacgagugggugacugauuucaaggguaaaaccguuugguuugucccuagcauuaaggccgggaacgacaucgcagccugccugcgcaagaauggcaaaaaggugauacaacucucccgaaaaacauucgauucagaauacgugaagaccagaacuaacgacugggauuuugucguaacaaccgacaucucugagaugggcgcuaauuucaaagcggagcgggugauugauccaaggcgcuguaugaagcccguuaucuuaacggacggcgaagaacgugugauucuggccgggccuaugccggucacucauagcagugcagcucagagacggggaaggaucggucgcaaccccaaaaaugaaaacgaccaguacauauauaugggcgagccccuugaaaaugaugaggacugcgcccacuggaaggaggcaaagaugcugcucgauaacauuaauacaccugaagggaucauucccuccauguuugagccagaacgagagaaaguggacgccaucgauggagaauacagauugcggggcgaggcuaggaagaccuucguugaccugaugcgcagaggugaucucccuguguggcuggccuauaaagucgcggcagaggggauaaacuacgccgacaggcggugguguuuugauggcaucaagaacaaucagauucuugaagagaacguggaaguagagaucuggaccaaagagggagaacguaagaagcuaaaaccccgcuggcuggacgcucgaauuuauagcgauccauuggccuuaaaggaguucaaagaguucgcugcaggcagaaagucucugacucucaaucugaucacagagauggggaggcuuccuaccuuuaugacacagaaaacucgggacgcccuggauaaccucgcuguguugcacacggccgaagcaggaggucgcgcguacaaucaugcccugucagagcuaccggagacccuggaaacacuccuucuguuaacuuugcuggcuaccguuacaggcgggauauuccucuuucugauguccggaagaggcauugguaagaugacccuugggaugugcugcaucaucacugccaguauucugcucugguaugcacagauccagccccacuggauagcugccagcauuaucuuggaguucuuucugauugucuuacuaaucccagaaccugagaagcagaggacgccccaagacaaccagcugaccuacguggugauagcaauccucacagucguugccgcuacuauggcgaaugaaaugggcuuccuugagaaaaccaagaaagaccugggauugggcucgauugccacacagcagccagagucuaacauccuggauauugaccuccggccugcauccgcuuggacccuguacgccguggccacuacauuuguaacgcccaugcuucgacauagcaucgaaaauucaagugugaacgucucucucaccgcaauugcuaaucaagccacugugcugaugggguugggaaaggguuggccgcuguccaaaauggauaucggcguuccauuacuagcgauaggguguuauagccaggugaacccuauuacacugaccgcugcccuccuucuguuggucgcacacuacgccaucaucggacccggccugcaggcuaaggcaaccagagaggcccagaagcgcgcggcugccgguauuaugaaaaauccaacaguagacgggauaacugugaucgaucucgaccccauuccuuaugauccgaaguucgaaaaacaacugggccagguuaugcuuuuaauccugugcgugacgcagguccucaugaugaggaccacaugggcauugugugaggcccugacucuagcuaccggacccauuucaacacugugggaaggcaacccagggcgguuuuggaauaccacuaucgccgugaguauggcaaacauauuccguggaagcuaccucgcuggcgccggucuucuguuuuccaucaugaagaauacgacaaacaccagaagggggacuggaaacauuggcgagaccuugggugagaaauggaagucucgccugaaugcgcucggcaaaagcgaguuccaaaucuauaagaaguccgggauucaggaggucgaccggacacuggccaaagaaggaaucaagcgaggcgagacugaucaccaugcagugucaagagggucugcuaaauuaaggugguuuguugagcgcaacauggugaccccugaaggaaagguaguggaccuuggcugcggucggggaggauggaguuacuauuguggcggucugaaaaaugucagagagguuaagggccucacaaaagggggacccggccacgaagaaccuauaccaaugucgacguacggguggaaccuagugcgucugcagagcggagucgauguguucuucauucccccugaaaaaugcgacaccuugcugugugauaucggcgaguccucuccaaaucccacuguagaggccgguaggacacuccgggugcuuaaccugguugaaaauugguugaacaauaacacccaguuuugcaucaaggugcugaauccguacaugccuucagucauugagaaaauggaagcacuccaacgcaaguaugggggagcuuuagugcgaaacccacugagcagaaauuccacucaugagauguacugggucaguaacgccucuggcaauauagugagcucaguuaacaugaucuccaggaugcuuauuaaccgguucacaaugcgccacaaaaaggccaccuaugaacccgacguagaccugggcagugggacgagaaauaucggaauugagagcgagaccccuaaccuagauaucauagguaagaggaucgagaaaauuaaggaggaacaugagacaucuuggcacuacgaccaggaucacccauauaaaacuugggcguaccauggcuccuaugaaaccaagcagacagggucagcuagcucgauggugaauggagucgugcgacuccugacuaaacccugggacguuuugccgaccgugacacagauggcaaugaccgauacuacgccuuuuggccaacagcgggucuucaaggagaagguggacacacguacccaggagcccaaagaagguacuaagaaacugaugaagaucaccgccgaguggcucuggaaagaacuugggaagaaaaagacaccaagaauguguacgcgcgaggaguuuaccaggaagguacggucuaacgcugcccugggagcaauuuucacugaugaaaauaaauggaagagugccagagaggcuguggaagacucccgcuuuugggaguuaguugauaaagaaaggaaccugcacuuggagggcaagugcgagacaugugucuacaauaugaugggcaaacgagaaaagaagcucggggaguucggaaaagcgaaggguagccgggccaucugguacauguggcugggcgcaagauuucuagaguucgaggcucuuggguuucugaacgaagaccauugguucucaagggaaaauucccucucuggaguggagggcgaaggucugcacaaauugggguauauucugcgcgaugugagcaagaaagagggaggcgccauguacgcagacgacaccgccggcugggauacucguauaacacucgaagaccuuaagaacgaggaaauggucaccaaucacauggagggggagcauaagaaacuggcugaagccaucuuuaaguuaacauaucagaacaaaguugugcggguacaaagaccuacucccaggggaaccgugauggauauuaucagucgccgagaccagcgggguuccggccaggucgggacguacggacugaauaccuucacaaacauggaggcgcaauugaucagacagauggaaggcgaggguguguucaagaauauucagcaccucacuguuaccgaggaagcagccgugcagaacuggcuggcuagggucgggcgcgagagacuaagccggauggccauaucuggagaugacugcgugguaaaaccacuugaugacagguuugcaaacgcucugacagcccucaaugauaugggcaagauccguaaggacauucaacagugggaacccucaaaaggcuggaacgauuggacucagguuccuuucugcagucaucacuuucaugagcugaucaugaaggacgggcgaguguuggucgugccaugucgcaaucaggaugaauuaauuggcagagcucggaucucccaaggugccggcuggagccugagggagaccgcaugccucgggaaaucuuaugcgcagauguggucgcuuauguacuuccaccgcagagaccugcggcuagccgcuaacgccauauguucagcagugccgagccacuggguccccacguccaggacaaccuggaguauccaugcuaagcacgaguggaugacuacagaagacaugcugaccguuuggaaucgaguguggauucgugagaacccuuggauggaagauaaaacuccaguagagucuugggaagagauccccuaucucggaaagagagaggaccaguggugcggcagcuugauuggucugaccucccgcgccacaugggcaaagaauauccaggccgcgauaaaccaagugcggucacuuauugggaaugaagaguacacggauuacaugccuaguaugaaaagguuuagacgcgaagaggaagaggcuggaguccugugguga

SEQ ID NO: 14421 - RNA, 9876 nt, Artificial Sequence
  derived and/or modified CDS sequence (opt3) from DENV-2__GU131930__SS-prME
agcgcaggaaugaucauuaugcugauacccaccgugauggcuuuccaccucaccacuagaaacggggagccucauaugaucgucggcauucaggaaaaggguaaaucccuucuguuuaagacggaggacggcguuaauaugugcaccuugauggcaauggauuuaggggaacugugugaggacacaaucacuuacaaaugcccacuacucaggcaaaacgaaccggaggauauugacuguuggugcaauucuaccucaacaugggugaccuauggaacuuguacaaccacgggcgagcaccggcgcgaaaagcgaaguguagcccuggugccccaugucgguauggggcuugagacucguaccgaaacauggaugagcuccgagggagcguggaaacacgcucagagaaucgagacuuggauacugaggcauccuggcuucaccaucauggccgcaauuuuggccuacacaaucggcaccacgcacuuucagcgggcucucauuuucauccugcugacugcaguggccccaucuaugacaaugcgcugcauagggauuucgaacagagauuuuguugaaggagugucagguggcagcugggucgacaucgugcucgagcacgggaguuguguaaccacuauggcuaagaauaagcccacauuagauuucgaacugauuaaaaccgaggccaagcagccugcgacgcuuaggaaauauugcaucgaagcaaaguugaccaacacaacuaccgagucccgguguccaacacaaggagagcccucucugaaagaggaacaggacaagcgcuuuguuugcaagcauagcaugguggaucgaggcugggguaauggguguggacuauucggcaaaggcgggaucgucacuugcgccauguuuaccugcaagaaaaacauggaaggaaagauugugcagccugagaaucucgaauacacaauaguggucaccccacacuccggugaggagcaugcuguuggcaacgacacugggaaacacggaaaggaaaucaaagugacgccgcagucaaguauuacagaggccgaacugaccggcuaugguacuguaaccauggaguguagccccagaacagggcuugauuucaaugaaauggugcuguugcaaauggagucuaaggcauggcucguccacaggcagugguuucuggacuuaccucugccauggcuccccggcgcugauaagcagggauccaacuggauccagaaagagacccuugugacuuucaagaauccucaugccaaaaagcaagacguugugguccugggcucacaggaaggggcgaugcacacagccuugacgggagcaaccgagauacagaugagcagugguaaccuacuguuuacuggccaucucaaaugccggcugcguauggacaaacuucaacugaaggggaugucuuacuccauguguacaggaaaauucaaggugguaaaagaaauugcugagacccagcacggcacaaucguuauccgcgugcaguaugagggugaugggagcccaugcaagauucccuucgaaaucauggacuuggagaaaagauacguccucggcaggcugauuacugugaauccgauagucaccgaaaaggauucgccugugaacaucgaggccgaacccccauuuggagacucuuacauuaucaucggcguugagccugggcaguuaaagcugaacugguucaaaaagggauccucaauuggucaaauguuugagacgaccaugcggggcgcuaaacgaauggccauacuaggggauacagcaugggacuucggaagucucggcgguguguuuacuagcaucgggaaggcccugcaucagguauucggcgcuauuuauggagcggcauuuuccggcgucucuuggaccaugaaaauccuuauuggggugaucauaacauggaucggaaugaauagccgcucaacaaguuuguccguuagccuggugcucgucggcauugugacccuguaccuugguguaauggugcaggccgauucuggguguguugucucauggaagaacaaggaacugaaaugcggaaguggcaucuucauuacggacaaugugcacacauggaccgagcaguauaaguuucaacccgaaagcccauccaaauuggcuucugccauccagaaggcacaggaggaagguauauguggcauuagaucggugacuaggcucgagaaccugauguggaaacagaucacacccgaguuaaaucacauucuggccgaaaacgaggucaagcuaaccaucaugacuggggauauaaaaggaaucaugcaagcuggcaagcggagccuccgcccucagccaaccgaacugaaguacuccuggaaaacaugggggaaggccaaaaugcuuucaacggagagucauaaucagaccuucuugauugacggaccggaaacugcagagugccccaacacaaauagagcguggaacucucuggagguugaagauuauggcuuugguguguucaccacaaauaucuggcucaagcugaaagagaagcaggacgcuuuuugugacagcaaguuaauguccgccgcaauuaaagauaacagggccgugcacgcugacaugggguacuggaucgaaucagcccugaaugauacuuggaagauagagaaagccagcuucauugagguaaagaacugccauuggccuaaaucucacacccuuugguccaauggagucuuggaaagugagaugaucaucccaaagaaccucgcuggccccgugagccaacacaacuaucguccugguuaccauacgcagacagccggcccauggcaccuggggaagcuagaaauggacuucgauuuuugugacggaaccacuguuauugugaccgaggauugcggcaaucgggggcccucucugcgaacaacuaccgcguccggaaaacucaucacagaauggugcuguagaucaugcacgcugccgccucuuagguaccgcggcgaggacgguuguugguaugggauggagauucggccauugaaggaaaaagaggaaaaccuggucaauaguuuagugaccgccggacauggccagguugauaacuucagccucggugugcugggcauggcucuuuuucuggaggaaauguugagaacuaggguagggacaaagcacgcaauacuccuggucgccgugucguucgugacccuaaucacuggaaauauguccuuuaaagaccugggccgcgucguugugaugguagggacaaccaugacggaugacauuggaaugggcgugacuuaccucgcucugcuugccgcauucaagguccgacccaccuuugcggccgguuugcuguuacggaagcucacaucuaaagagcugaugaugaccacuaucgggauugugcuucugagccaaucaacaaucccugagaccauacuagaacucacagaugcucuggccuugggaaugaugguucugaagaucgugcgugacauggagaaauaucaguuagcagucacuauuauggcuauccucugcgugcccaacgccguuauucugcagaaugcauggaaggugaguuguaccauccuugccgucguauccgugucuccacuguugcucacgagcucccagcaaaagacugacuggauaccucuggcucuaaccauuaagggccugaaccccacugcgaucuuccuuaccacacucucaagaacuaauaaaaagaggagcuggccacugaacgaagccaucauggcaguuggcauggugaguauuuuggcuucuucccuguuaaagaaugauauaccgaugaccgggccucucgucgccggaggucugcuuacggugugcuacguacugacaggccgcagcgccgacuuggagcucgaacgggcuaccgaugugaaaugggaggaccaggcagagaucucggggucaucucccauucugaguaucacuauuuccgaagauggaagcaugucuaucaagaacgaggaagaggagcagacacuaaccauacugaucagaacuggccuucucgucauuagcggucuguuuccaguuuccauccccauuacagccgcggcuugguauuugugggaagugaaaaagcagagggccgggguguuaugggacgucccuucaccacccccuaugggaaaagcagagcuggaagauggcgccuaccgaaucaagcaaaagggcauacucggguauagucagauuggagcugguguguacaaagagggcaccuuccauacgauguggcacguuacucgcggggcaguacugaugcacaagggaaaacggaucgaaccgagcugggccgacgugaagaaagaucuuaucucuuacggcgguggguggaagcuggagggagaguggaaggaaggcgaggaaguccagguguuggcgcuagagccaggcaaaaaucccagagcuguucagaccaagccugggcuguuuaaaacaaacaccggaacaauuggugccgugucccucgacuucucaccaggcacaagugggagccccaucauagauaagaaaggaaaggucgugggccuguaugguaaugggguagucaccagguccggagcauacgugucugccauugcucaaacggaaaagucgaucgaggacaacccugagauugaagaugacaucuuucguaaacgccggcuuacaauaauggacuuacauccgggcgccggcaagacuaaaagauaucugcccgcaauuguuagggaggcuaucaagcgagggcuccggaccuugauccuggccccaacacgcguggucgcggccgaaauggaggaagcacucagaggacugccuauuagguaccagacccccgcuauccgggccgagcacacuggucgagagauuguggaucuuaugugucaugcuaccuucacaaugagacuguugagcccaguucgcgugccuaacuauaaucuaauaaucauggacgaagcacacuucacggaucccgccucaauugccgcuaggggcuacaucuccacucgugucgagaugggggaagcggcaggaaucuuuaugaccgccacaccaccgggcagucgggacccuuucccccagucuaacgcuccaauuauagaugaggagagagaaauccccgagaggagcuggaauaccggucaugaaugggugacugacuuuaaagggaagacaguaugguucgugccuuccauuaaggccggaaacgauaucgcagccugccugcgcaaaaauggcaagaaaguuauucaacucucacgaaagaccuuugacucugaguaugucaaaacgagaacuaacgauugggacuucguggugacaaccgauaucagcgaaaugggcgcuaauuuuaaggcggagcgggucauagacccaaggcgcuguaugaaacccguaaucuuaaccgacggggaggaacgugugauucuggccggaccuaugccgguuacucacaguuccgcagcucagagacgggguaggaucggccgcaacccaaagaaugagaacgaucaguacauuuacaugggggaaccccuugagaaugacgaagauugcgcccacuggaaggaggcaaaaaugcugcucgacaacaucaauacaccugagggaauaauucccagcauguucgaaccagagcgagaaaagguggaugccaucgacggcgaguauagauugcggggugaagcuaggaaaaccuuugucgaucugaugcgcagaggggaccucccuguguggcuggccuacaagguugcggcagagggcauuaacuaugccgauaggcggugguguuucgacggaaucaaaaauaaccagauacuugaggaaaacguggaggucgaaaucuggacaaaggagggcgagcguaagaaacuaaagccccgcuggcuggaugcucgaauuuacucugacccauuggccuuaaaagaauuuaaggaguucgcugcagggagaaaaucacugacucucaaucugaucacggaaaugggaaggcuuccuaccuucaugacacaaaagacucgggaugcccuggacaaccucgcuguguugcauaccgccgaggcggguggacgcgcauauaaucacgcccuguccgaacuaccggagacacuggagacccuccuucuguuaacuuugcuggcuacgguaaccgggggaauuuuucucuuccugaugaguggcagagguaucgggaagaugacacuuggcaugugcugcauaauuacugccagcauccugcucugguacgcacagauccagccccauuggauugcugccucgaucauauuggaauuuuuccugauuguguuacuaaucccagagccugaaaaacagaggacaccccaagacaaccagcugacauauguugucauugcaauccucaccgugguggccgcuacuauggcgaaugagaugggauuucuugaaaagacuaaaaaggaucugggcuuggggucuauagccacgcagcagccagaguccaacauccuggacauugaucuccggccugcaagcgcuuggacccuguacgccgucgccacuacauucguuacccccaugcuucgacacucaaucgagaauaguucugugaacguaucccucaccgcaauugcuaaucaagccacagugcugaugggauuggguaaaggcuggccgcugagcaagauggacaucggggucccauuacuagcgauuggauguuacucacaggugaacccuaucacucugacggcugcccuccuucuguugguugcacacuaugccauaauuggccccggucugcaggcuaaggcaaccagagaagcccagaaacgcgcggcugccgggaucaugaagaauccaacaguggauggcaucacugucauugaccucgaucccauaccuuacgacccgaaauuugagaagcaacugggacagguaaugcuuuuaauccugugcgugacccagguucucaugaugaggacaaccugggcauugugugaagcccugacucuagcuacgggccccauuaguacacugugggaggggaacccaggacgguucuggaauaccacuaucgccgugagcauggcaaacauuuuucguggcuccuaucucgcuggugccgggcuucuguucucuaucaugaaaaauaccacaaacacuagaaggggaaccggcaauauaggugaaacauugggcgagaaguggaaaagccgccugaacgcgcucgggaaguccgaguuucaaacguacaagaaaucaggaauccaggaagucgaucggacccuggccaaggagggcauuaaacgaggggaaacugaccaucacgcagugucuagaggaagugcuaaguuaaggugguucgucgagcgcaacauggugacaccugagggcaaaguuguggaucuugguugcgggcggggaggcuggucguauuacugugguggccugaagaauguaagagaagugaaggggcucaccaaaggaggccccgggcaugaggaaccuaucccaaugagcacuuauggauggaaccuaguccgucugcaguccggcguugacguguuuuucauucccccugagaagugcgauacauugcugugugacaucggugaaucuucaccaaaucccaccgucgaggccgggaggacgcuccgggugcuuaaccugguagagaauugguugaacaauaacacccaguucugcauaaaagugcugaauccguacaugccuagcguuauugaaaagauggaggcacuccaacgcaaauacggaggcgcuuuagugcgaaacccacuguccagaaauaguacacacgaaauguauugggucucuaacgccagcggcaauaucgugucauccgucaacaugaucaguaggaugcuuauuaaucgguuuacuaugcgccauaagaaggccaccuacgagcccgacguggaucuggggagcggaacaagaaacauagguaucgaaucugagauuccuaaccuagacaucauuggcaaaaggaucgagaagauaaaacaggaacacgagacuuccuggcacuaugaucaggaccauccauacaagaccugggcguaucacgggucauacgaaacaaaacagaccggaagcgcuucgucuaugguuaauggcguagugcgacuccugacuaagcccugggaugucuugccgacggugacacaaauggcaaugaccgacacuaccccuuucggucagcagcggguuuuuaaggagaaaguggauacacguacgcaggaacccaaggaggggaccaaaaagcugaugaaaaucacugccgaguggcucuggaaggaacuuggcaaaaagaagacaccaagaauguguacccgcgaggaguucacuaggaaaguccggaguaacgcugcccugggcgcaauuuuuacagacgagaauaaguggaaauccgccagagaggcuguggaagauagccgcuucugggaguuaguagacaaggaaaggaaccugcauuuggagggcaaaugcgaaaccuguguguauaauaugauggggaagcgagagaagaaacucggagaguuugguaaggcgaaaggcucacgggccaucugguacauguggcugggggcaagauuccuagaauuugaggcucuuggauuccugaacgaagaucacugguuuuccagggaaaauucucucagcggcguugaaggugaggggcugcacaaguugggauacauucugcgcgacgucaguaaaaaggagggcggcgccauguaugcagacgauacagccgggugggacacucguaucacccucgaagaucuuaagaacgaggaaauggugacgaaucauauggagggagaacacaaaaagcuggcugaggccauuuucaaauuaaccuaccaaaacaaggugguccggguucagagaccuacacccagggguacugugauggacauaaucucccgccgagaucagcggggcagcgggcaaguaggaaccuauggccugaauacauuuacuaacauggaggcgcaguugauuagacagauggaaggugaggggguguucaaaaauauccagcaucucaccgcaacggaagaggucgccgugaagaacuggcuggcuaggguuggacgcgagagacuaucucggauggccaucucaggcgacgauugcguggucaagccacuugacgauagguucgcaaaugcucugacagcccucaacgacaugggcaaaauucguaaggauauacaacagugggaacccaguaaaggguggaacgacuggacccaggugccuuuuugcucccaccauuuccacgagcugaucaugaaggauggacgaguauugguugugccaugucgcaaucaggacgaauuaauugguagagcucggaucagccaaggcgccggguggucucugagggagacugcaugccucggaaaaucguacgcgcagauguggucacuuauguauuuucaccgcagagaccugcggcuagccgcuaacgccauuuguagcgcagucccgucccauugggugcccacaaguaggaccacuuggucuauccacgcuaagcaugaauggaugaccacagaggauaugcugacgguguggaaucgagucuggauacgugagaacccuuggauggaagacaagaccccaguugagagcugggaagagauccccuaccucggcaaaagagaagaucaguggugcgguuccuugauugggcugacuucacgcgccacaugggcaaagaauauccaggccgcgauuaaccaagugcggagucuuaucggaaaugaggaguauaccgacuacaugccuucuaugaaaagguucagacgcgaagaggaagaggcuggcguacugugguga

SEQ ID NO: 14422 - RNA, 9876 nt, Artificial Sequence
  derived and/or modified CDS sequence (opt3) from DENV-2__GU131931__SS-prME
agcgccggaaugaucauuaugcugauaccaaccgugauggcuuuccaccucacuacucggaacggggagccucauaugaucguagguauucaagaaaagggaaaaucccuucuguuuaagacggaggacggcguuaauaugugcaccuugauggcaauggauuuaggggaacugugugaggacacaaucacuuacaaaugcccacuacucaggcaaaacgaaccggaggauauugacuguuggugcaauucuaccucaacaugggugaccuauggaacuuguacaaccacgggcgagcaccggcgcgaaaagcgaaguguagcccuggugccacaugucgguauggggcuugagacucguaccgaaacauggaugagcuccgagggagcguggaaacacgcucagagaaucgagacuuggauacugaggcauccuggcuucaccaucauggccgcaauuuuggcccacacaaucggcaccacgcacuuucagcgggugcucauuuucauccugcugacugcuguugcaccaucuaugacaaugcgcugcauagggauuucgaacagagauuuuguggaaggagucucagguggcagcuggguggacaucguacucgagcaugggaguuguguuaccacuauggccaagaauaagcccacauuagauuucgaacugauuaaaaccgaggcuaagcagccugccacgcuuaggaaauacugcaucgaagcgaaguugaccaacacaacuaccgagucccgguguccaacacaaggagagcccucucugaaagaggaacaggacaagcgcuuugugugcaagcacagcauggucgaucgaggcugggguaauggguguggacuauucggcaaaggcgggaucgugacuugcgcaauguuuaccugcaagaaaaacauggaaggaaagauugugcagccugagaaucucgaauauacaauagucguuaccccacauuccggugaggagcacgccgugggcaacgacacugggaaacacggaauggaaaucaagguaacgccgcagucaaguauuacagaggcugaacugaccggcuacgguacugugaccauggaguguagccccagaacagggcuugauuucaaugaaaugguccuguugcaaauggagaacaaagccuggcucgugcauaggcagugguuucuggacuuaccucugccauggcuccccggcgcagauaagcaggagucuaauuggauccagaaggaaacccuuguuacuuucaaaaacccucacgcuaagaaacaagacguggucgugcugggaucccaggagggcgccaugcauacagcguugacgggggccaccgaaauacagaugucaagcggaaaucuacuguuuacuggucaccucaagugccggcugcguauggacaaacuucaacugaagggcaugaguuauucuauguguacagggaaguucaaaguaguuaaggagauugcagagacccagcauggaacaaucgugauccgcguccaguacgaaggcgaugguuccccaugcaaaauucccuucgagaucauggacuuggaaaagagauaugugcucgggaggcugauuacugucaacccgauagugaccgagaaagauagcccuguuaacaucgaagcugagcccccauuuggcgacucguacauuaucaucggaguggagccuggccaguuaaagcugaauugguucaagaaagggucuuccauuggacaaauguuugaaacgaccaugcggggugccaagcgaauggcuauacuaggcgauacagccugggacuucgggucacucggaggcguauuuacaaguaucgguaaagcacugcaccagauuuucggggccaucuacggcgcugcguuuagcggagucuccuggaccaugaagauucuuaucggcgugauaaucacauggauugggaugaacucucgcagcacuucauugaguguuucccuggugcucgucggaaucgugacccuguaucuuggcguaauggugcaggcagauagcgguuguguugucucuuggaaaaauaaggagcugaagugcgggucaggaauuuucaucacggacaacgugcacacauggaccgaacaguacaaauuucaacccgagaguccaagcaaguuggccuccgcuauacagaaagcccaggaagagggcauuugugguaucagaucugugacuaggcucgagaaucugauguggaagcagauuacacccgaauuaaaccauauccuggcagagaaugaagucaaacuaaccauaaugacuggcgauaucaaggggauuaugcaagccggaaaacggucgcuccgcccucagccaaccgagcugaaguauagcuggaagacauggggcaaagcuaagaugcuuuccacggaaucacacaaccagaccuucuugaucgacgggccggagacugccgagugccccaauacaaacagagcauggaauagucuggaaguugaggauuacggauuuggcguguucaccacaaacauuuggcucaaacugaaggaaaaacaggacgcguuuugugacucuaaguuaaugagcgcugccaucaaggauaauagggcagugcaugccgacauggguuauuggauagaguccgcucugaacgauacuuggaaaauugagaaggccucauucaucgaagucaagaauugccacuggccuaagagccacacccuuuggucuaacggggucuuggaguccgaaaugaucauucccaagaaccucgcaggacccgugagucaacauaauuaccguccuggcuaucacacgcagaucgcugguccauggcaucugggcaagcuagagauggacuucgauuuuugugacgggacaaccguuauugugacugaagauugcggaaaccggggccccagccugcgaaccacaacugccucugggaagcucauaaccgaguggugcuguagauccugcacacugccgccucuuagguaccgcggagaggacggcuguugguacgguauggaaauccggccauugaaagagaaggaagagaaucuggucaacucauuagugacggcggggcacggacagguugauaauuucagucucggcgugcuggguauggcccuuuuucuggaagagauguugagaaccaggguaggcacuaaacaugcuauucuccuggucgcagugagcuucgugacacuaaucaccgggaacaugucguuuaaggaccugggacgcgucguugugaugguaggcgccacuauggcugaugacauugggaugggagugacauaucucgcccugcuugcagcguucaaaguccgacccaccuuugccgcuggcuugcuguuacggaagcucacguccaaggagcugaugaugacuaccaucgguauagugcuucugucucaaagcacaaucccugaaaccguucuagagcucacugaugcccuggcauuggggaugauggugcugaaaauuguccguaauauggaaaaguaccaguuagcugugacaaucauggccauucucugcguucccaacgcagugauccugcagaaugccuggaaagucucauguaccauacuugcuguagugaguguuuccccacuguugcucacaucuagccagcaaaagacugacuggauuccucuggcgcuaaccaucaaaggacugaaccccacggccaucuuccuuacaacccucuccagaacuaauaagaaaaggucauggccacugaacgaggcaauuauggcugugggcauggucagcauauuggccaguucucuguuaaagaaugacaucccgaugaccggcccucucguggccgggggacugcuuacaguaugcuaugugcugacuggucgcuccgcugauuuggaacucgagcgggcaaccgacgucaagugggaggaucaggccgaaauuagcggcucgucacccauccugucuauuacgaucagugaggacggguccaugagcaucaaaaacgaagaggaggaacagacacuaaccauccugauuagaacuggacuucucguuaucucuggccuguuuccaauuagcauccccauaacagcggcugccugguacuugugggaggugaagaaacagagggccgguguguuaugggaugucccuuccccacccccuauggggaaggccgaacuggaggacggagcuuaucgaauuaaacaaaagggcauccucggcuacucacagaucggggcaggaguguauaaggaagguaccuuccacacuauguggcacguuacacgcggcgccguacugaugcauaaagggaagcggauugagccgaguugggcggaugugaaaaaggaccuuaucagcuacggaggcgguuggaaacuggagggggaauggaaggagggagaagagguccagguguuggcucuagaaccaggcaagaaucccagagccguucagaccaaaccuggccuguuuaagacgaacacugggaccauaggagcagugucucucgauuucuccccagguacaucaggcagucccauuaucgacaaaaaggggaaagucgugggacuguacggcaacgguguagucaccaggagcggggccuauguguccgcuauugcccaaacagagaagucuaucgaggauaauccugaaauagaggacgauauuuuucguaagcgccggcuuacuaucauggacuuacacccgggagcaggcaaaaccaagagauaccugcccgcuaucguuagggaagccauuaaacgaggccuccggacguugauccuggcgccaacacgcguggucgccgcagagauggaagaggcucucagagggcugccuauuagguaucagacucccgccauacgggcugagcauaccggacgagaaaucguggaccuuaugugucacgcaacauucaccaugagacuguugucgccaguucgcgugccuaacuacaaucuaauuaucauggaugaggcccauuucacugaccccgccagcaucgcugcgagggguuauauuucaacccgugucgaaaugggcgaggcagccgggauauuuaugacagcuacgccaccgggaucccgggauccuuucccccagaguaacgccccaaucauugacgaggaaagagagauccccgaaaggucuuggaauagcggccacgagugggugacugauuuuaaggguaaaaccguaugguucgugccuuccauuaaggcagggaacgacaucgccgcuugccugcgcaagaauggcaaaaagguuauacaacucucacgaaaaacauuugauucugaauacgucaagaccagaacuaacgacugggauuucguggugacaaccgacaucagcgagaugggcgcgaauuuuaaagccgagcgggucauugauccaaggcgcuguaugaagcccguaaucuuaacggacggcgaggaacgugugauucuggcagggccuaugccgguuacucacaguuccgcugcccagagacggggaaggaucggucgcaaccccaaaaaugaaaacgaccaguauauauacaugggcgagccccuugaaaaugaugaggacugcgcacauuggaaggaggccaagaugcugcucgauaacauuaauacaccugaagggaucauucccagcauguucgagccagaacgagagaaaguggacgcuaucgauggagaauacagauugcggggcgaggccaggaagaccuuugucgaccugaugcgcagaggugaucucccuguguggcuggcguauaaaguugcagccgaggggauaaacuacgcugacaggcggugguguuucgauggcaucaagaacaaucagauucuugaagagaacguggaagucgagaucuggaccaaagagggagaacguaagaagcuaaaaccccgcuggcuggacgcccgaauuuauucugauccauuggcuuuaaaggaguuuaaagaguucgcagccggcagaaagucacugacucucaaucugaucacagagauggggaggcuuccuaccuucaugacacagaaaacucgggacgcucuggauaaccucgccguguugcacacggcagaagcgggaggucgcgccuacaaucaugcucuguccgagcuaccggagacccuggaaacacuccuucuguuaacuuugcuggccaccguaacaggcgggauauuucucuuccugaugaguggaagaggcauugguaagaugacccuugggaugugcugcaucaucacugcaagcauucugcucugguaugcucagauccagccccacuggauagccgcaucgauuaucuuggaguuuuuccugauuguguuacuaaucccagaaccugagaagcagaggacgccccaagacaaccagcugaccuacguugucauagccauccucacagugguggcugcgacuauggccaaugaaaugggcuuucuugagaaaaccaagaaagaccugggauugggcucuauugcaacacagcagccagaguccaacauccuggauauugaccuccggccugcuagcgccuggacccuguaugccgucgcaacuacauucguuacgcccaugcuucgacacucaaucgaaaauaguucugugaacguaucccucaccgcuauugccaaucaagcgacugugcugaugggguugggaaaggguuggccgcugagcaaaauggauaucggcgucccauuacuagcuauaggguguuacucacaggugaacccuauuacacugaccgccgcacuccuucuguugguugcccauuacgcuaucaucggacccggccugcaggcaaaggccaccagagaggcgcagaagcgcgcugccgcagguauuaugaaaaauccaacaguggacgggauaacugucaucgaucucgaccccauuccuuaugauccgaaguuugaaaaacaacugggccagguaaugcuuuuaauccugugcgugacgcagguucucaugaugaggaccacaugggccuugugugaggcucugacucuagccaccggacccauuaguacacugugggaaggcaacccagggcgguucuggaauaccacuaucgcagugagcauggcuaacauauuucguggauccuaccucgccggcgcgggucuucuguucucuaucaugaagaauacgacaaacaccagaagggggacuggaaacauuggcgagaccuugggugagaaauggaaaagccgccugaaugcccucggcaaauccgaauuucaaaucuauaagaagucagggauucaggaggucgaccggacacuggcaaaagaaggaaucaagcgaggcgagacugaucaccaugcugugucuagagggagugccaaauuaaggugguucgucgagcgcaacauggugaccccugaaggaaagguuguggaccuuggcugcgguagagggggauggucguacuauuguggcggucugaaaaauguaagagaggugaagggccucacaaaagggggacccggccacgaggaaccuauaccaaugagcacguacggguggaaccuaguccgucugcaguccggaguugauguguuuuucauucccccugaaaaaugcgacaccuugcugugugauaucggcgagucuucaccaaaucccacugucgaggcagguaggacacuccgggugcuuaaccugguagaaaauugguugaacaauaacacccaguucugcaucaaggugcugaauccguauaugccuagcguuauugagaaaauggaagcucuccaacgcaaguacgggggagccuuagugcgaaacccacuguccagaaauaguacucaugagauguacugggucucuaacgccagcggcaauauagugucauccgucaacaugaucaguaggaugcuuauuaaccgguuuacaaugcgccacaaaaaggcgaccuaugaacccgacguggaccugggcagcgggacgagaaauaucggaauugagucugagaucccuaaccuagauauaaucgguaagaggauugagaaaauaaaggaagaacacgagaccuccuggcauuacgaccaggaucacccauauaaaacaugggcuuaccauggcucauaugaaacuaagcagaccgggagcgcaucgucuaugguuaauggaguagugcgacuccugacaaaacccugggacgucuugccgacugugacccagauggccaugacagauaccacuccuuucggccaacagcggguuuuuaaggagaagguggacacgcguacacaggagcccaaagaagguaccaagaaacugaugaagauuacugcugaguggcucuggaaagaacuugggaagaaaaagaccccaagaauguguacacgcgaggaguucacgaggaagguccggaguaacgccgcacugggagccaucuuuaccgaugaaaauaaauggaaguccgcuagagaggcgguggaagacagccgcuucugggaguuaguagauaaagaaaggaaccugcacuuggagggcaagugcgagacuuguguguacaauaugaugggcaaacgagaaaagaagcucggggaguuuggaaaagccaaggguucacgggcaauuugguauauguggcugggcgcuagauuccuagaauuugaggcccuuggguuccugaacgaagaccacugguuuuccagggaaaauucucucagcggaguugagggcgaaggucugcauaaauugggguacauacugcgcgaugucaguaagaaagagggaggcgcaauguacgccgacgacacagcuggcugggauacccguaucacucucgaagaccuuaagaacgaggaaauggugacaaaucacauggagggggagcauaagaaacuggccgaagcgauuuucaaguuaaccuaucagaacaaagugguccggguucaaagaccuacacccaggggaacugugauggauaucaucucccgccgagaccagcgggguagcggccagguagggaccuacggacugaauacguuuaccaacauggaggcacaauugauuagacagauggaaggcgaggguguguucaagaauauacagcaccucacagucacugaggaagccgcugugcagaacuggcuggccaggguugggcgcgagagacuaucucggauggcaaucucaggagaugacugcguggucaaaccacuugaugacagguucgcuaacgcccugaccgcucucaaugauaugggcaagauucguaaggacauccaacagugggaacccaguaaaggcuggaacgauuggacacaggugccuuuuugcucccaucacuuccacgagcugauuaugaaggacgggcgaguauugguugugccaugucgcaaucaggaugaauuaaucgguagagcacggauaagccaaggagcaggcuggucucugagggagacugcgugccucgggaaaucguaugcccagauguggucacuuauguacuuucaucgcagagaccugcggcuagcugccaacgcaaucuguagcgcugucccgucccacugggugcccaccaguaggacgacauggucuauucaugccaagcacgaguggaugaccacugaagacaugcugacaguguggaaucgagucuggauccgugagaacccuuggauggaagauaaaaccccaguugagagcugggaagagauucccuaucucggaaagagagaggaccaguggugcggcuccuugaucggucugacuucacgcgcaaccugggccaagaauauacaggcggcuauuaaccaagugcggagucuuaucgggaaugaagaguacacagauuauaugccuucuaugaaaagguucagacgcgaagaggaagaggccggaguacugugguga

SEQ ID NO: 14423 - RNA, 9876 nt, Artificial Sequence
  derived and/or modified CDS sequence (opt3) from DENV-2__GU131932__SS-prME
agcgccggaaugaucauuaugcugauaccaaccgugauggcuuuccaccucacuacucggaacggggagccucauaugaucgucgguauucaagaaaagggaaaaucccuucuguuuaagacggaggacggcguuaauaugugcaccuugauggcaauggauuuaggggaacugugugaggacacgaucacuuacaaaugcccacuacucaggcaaaacgaaccggaggauauugacuguuggugcaauucuaccucaacaugggugaccuauggaacuuguacaaccacgggcgagcaccggcgcgaaaagcgaaguguagcccuggugccacaugucgguauggggcuugagacucguaccgaaacauggaugagcuccgagggagcguggaaacacgcucagagaaucgagacuuggauacugaggcauccuggcuucaccaucauggccgcaauuuuggccuacacaaucggcaccacgcacuuucagcgggugcucauuuucauccugcugacugcuguugcaccaucuaugacaaugcgcugcauagggauuucgaacagagauuuuguggaaggagucucagguggcagcuggguggacaucguacucgagcacgggaguuguguuaccacuauggccaagaauaagcccacauuagauuucgaacugauuaaaaccgaggcuaagcagccugccacgcuuaggaaauauugcaucgaagcgaaguugaccaacacaacuaccgagucccgguguccaacacaaggagagcccucucugaaagaagaacaggacaagcgcuuugugugcaagcauagcauggucgaucgaggcugggguaauggguguggacuauucggcaaaggcgggaucgugacuugcgcaauguuuaccugcaagaaaaacauggaaggaaagauugugcagccugagaaucucgaauacacaauagucguuaccccacacuccggugaggagcaugccgugggcaacgacacugggaaacacggaauggaaaucaagguaacgccgcagucaaguauuacagaggcugaacugaccggcuaugguacugugaccauggaguguagccccagaacagggcuugauuucaaugaaaugguccuguugcaaauggagaacaaagccuggcucgugcacaggcagugguuucuggacuuaccucugccauggcuccccggcgcagauaagcaggagucuaauuggauccagaaggaaacccuuguuacuuucaaaaacccucaugcuaagaaacaagacguggucgugcugggaucccaggagggcgccaugcacacagcguugacgggggccaccgaaauacagaugucaagcggaaaucuacuguuuacuggucaucucaagugccggcugcguauggacaaacuucaacugaagggcaugaguuacucuauguguacagggaaguucaaaguaguuaaggagauugcagagacccagcacggaacaaucgugauccgcguccaguaugaaggcgaugguuccccaugcaaaauucccuucgagaucauggacuuggaaaagagauacgugcucgggaggcugauuacugucaacccgauagugaccgagaaagauagcccuguuaacaucgaagcugagcccccauuuggcgacucguacauuaucaucggaguggagccuggccaguuaaagcugaauugguucaagaaagggucuuccauuggacaaauguuugaaacgaccaugcggggugccaagcgaauggcuauacuaggcgauacagccugggacuucgggucacucggaggcguauuuacaaguaucgguaaagcacugcaucaggucuucggggccauuuauggcgcugcguuuagcggaguguccuggaccaugaagauccuuauuggcguuaucauaacauggaucgggaugaacucucgcagcacuucauugagugugucccugguccucgugggaauuguaacccuguaccuuggcgugaugguucaggcagauagcgguugugucgugucuuggaaaaauaaggagcugaagugcgggucaggaaucuucauuacggacaacgugcacacauggaccgaacaguauaaauuucaacccgagaguccaagcaaguuggccuccgcuauccagaaagcccaggaagagggcauaugugguauuagaucugucacuaggcucgagaaucugauguggaagcagaucacacccgaauuaaaccacauucuggcagagaaugaaguuaaacuaaccaucaugacuggcgauauaaaggggaucaugcaagccggaaaacggucgcuccgcccucagccaaccgagcugaaguacagcuggaagacauggggcaaagcuaagaugcuuuccacggaaucauauaaccagaccuucuugauugacgggccggagacugccgagugccccaauacaaacagagcauggaauagucuggaaguggaggauuacggauuuggcguguucaccacaaacaucuggcucaaacugaaggaaaaacaggacgcguuuugugacucuaaguuaaugagcgcugccauuaaggauaauagggcaguacaugccgacauggguuauuggaucgaguccgcucugaacgauacuuggaaaauagagaaggccucauucauugaagucaaaaauugccacuggccuaagagccauacccuuuggucuaacgggguguuggaguccgaaaugaucauccccaagaaccucgcaggacccguuagucaacacaauuaccguccuggcuaccacacgcagauugcugguccauggcaucugggcaagcuagagauggacuucgauuuuugugacgggacaaccgugaucgucacugaagauugcggaaaccggggccccagccugcgaaccacaacugccucugggaagcucauuaccgaguggugcuguagauccugcacacugccgccucuuagguaucgcggagaggacggcuguugguacgguauggaaauacggccauugaaagagaaggaagagaaucuggugaacucauuaguuacggcggggcacggacagguggauaauuucagucucggcguacuggguauggcccuuuuucuggaagagauguugagaaccagggucggcacuaaacaugcuauccuccugguggcagugagcuucgucacacuaauuaccgggaacaugucguuuaaggaccugggacgcguugugguaauggugggcgccacuauggcugaugacaucgggaugggagucacauaucucgcccugcuugcagcguucaaagugcgacccaccuuugccgcuggcuugcuguuacggaagcucacguccaaggagcugaugaugacuaccauugguaucguucuucugucucaaagcacaauaccugaaaccgugcuagagcucacugaugcccuggcauuggggaugaugguccugaaaaucgugcguaauauggaaaaguaccaguuagcuguuacaauuauggccauccucugcgugcccaacgcagucauucugcagaaugccuggaaaguaucauguaccauccuugcugugguuaguguguccccacuguugcucacaucuagccagcaaaagacugacuggauaccucuggcgcuaaccauuaaaggacugaaccccacggccaucuuccuuacaacccucuccagaacuaauaagaaaaggucauggccacugaacgaggcaaucauggcugucggcauggugagcauuuuggccaguucucuguuaaagaaugacauaccgaugaccggcccucucguagccgggggacugcuuacagugugcuauguccugacuggucgcuccgcugauuuggaacucgagcgggcaaccgacguuaagugggaggaucaggccgaaaucagcggcucgucacccauucugucuaucacgauuagugaggacggguccaugagcaucaaaaacgaagaggaggaacagacacuaaccauacugaucagaacuggacuucucgugauuucuggccuguuuccaaucagcauucccaucacagcggcugccugguacuugugggaggugaagaaacagagggccggugucuuaugggaugugccuuccccacccccuauggggaaggccgaacuggaggacggagcuuaucgaauaaaacaaaagggcauucucggcuacucacagaucggggcaggaguuuacaaggaagguaccuuccacacuauguggcauguaacacgcggcgccgugcugaugcacaaagggaagcggaucgagccgaguugggcggaugucaaaaaggaccuuauuagcuauggaggcgguuggaaacuggagggggaauggaaggagggagaagaggugcagguuuuggcucuagaaccaggcaagaaucccagagccgugcagaccaaaccuggccuguuuaagacgaacacugggaccaucggagcagucucucucgauuucuccccagguacaucaggcagucccauaauugacaaaaaggggaaagugguaggacuguacggcaacggugucgugaccaggagcggggccuauguuuccgcuaucgcccaaacagagaagucuauugaggauaauccugaaaucgaggacgauauauuucguaagcgccggcuuacuauuauggacuuacacccgggagcaggcaaaaccaagagauaccugcccgcuaucgugagggaagccaucaaacgaggccuccggacguugauucuggcgccaacacgcgucguggccgcagagauggaagaggcucucagagggcugccuaucagguaucagacucccgccauucgggcugagcauaccggacgagaaauaguugaccuuaugugucacgcaacauucaccaugagacuguugucgccagugcgcgucccuaacuacaaucuaaucauuauggaugaggcccauuucacugaccccgccagcaucgcugcgagggguuauaucucaacccguguggaaaugggcgaggcagccgggauuuuuaugacagcuacgccaccgggaucccgggauccuuucccccagaguaacgccccaauaaucgacgaggaaagagagauucccgaaaggucuuggaauagcggccacgaguggguaacugauuuuaaggguaaaaccgugugguucguuccuuccaucaaggcagggaacgacauugccgcuugccugcgcaagaauggcaaaaaggucauccaacucucacgaaaaacauuugauucugaauacgugaagaccagaacuaacgacugggauuucguggucacaaccgacauaagcgagaugggcgcgaauuuuaaagccgagcggguaaucgauccaaggcgcuguaugaagcccgugauuuuaacggacggcgaagaacguguuauccuggcagggccuaugccggugacucauaguuccgcugcccagagacggggaaggauuggucgcaaccccaaaaaugaaaacgaccaguacaucuauaugggcgagccccuugaaaaugaugaggacugcgcacacuggaaggaggccaagaugcugcucgauaacauaaauacaccugaagggauuauccccagcauguucgagccagaacgagagaaagucgacgcuauugauggagaauacagauugcggggcgaggccaggaagaccuuuguggaccugaugcgcagaggugaucucccuguuuggcuggcguauaaaguggcagccgaggggaucaacuacgcugacaggcggugguguuucgauggcauaaagaacaaucagauccuugaagagaacgucgaaguggagauuuggaccaaagagggagaacguaagaagcuaaaaccccgcuggcuggacgcccgaaucuauucugauccauuggcuuuaaaggaguuuaaagaguucgcagccggcagaaagucacugacucucaaucugauuacagagauggggaggcuuccuaccuucaugacacagaaaacucgggacgcucuggauaaccucgccguauugcacacggcagaagcgggaggucgcgccuacaaucaugcucuguccgagcuaccggagacccuggaaacacuccuucuguuaacuuugcuggccaccgugacaggcgggaucuuucucuuccugaugaguggaagaggcauagguaagaugacccuugggaugugcugcauuaucacugcaagcauccugcucugguaugcucagauucagccccacuggaucgccgcaucgauaauuuuggaguuuuuccugaucguuuuacuaauuccagaaccugagaagcagaggacgccccaagacaaccagcugaccuacgucgugaucgccauacucacaguggucgcugcgacuauggccaaugaaaugggcuuucuugagaaaaccaagaaagaccugggauugggcucuaucgcaacacagcagccagaguccaacauucuggauaucgaccuccggccugcuagcgccuggacccuguacgccguugcaacuacauucgugacgcccaugcuucgacauucaauugaaaauaguucuguaaacgugucccucaccgcuaucgccaaucaagcgacuguccugaugggguugggaaaggguuggccgcugagcaaaauggauauuggcgugccauuacuagcuaucggguguuauucacagguuaacccuauaacacugaccgccgcacuccuucuguugguggcccacuacgcuauuaucggacccggccugcaggcaaaggccaccagagaggcgcagaagcgcgcugccgcagguaucaugaaaaauccaacagucgacgggauuacuguaauagaucucgaccccaucccuuaugauccgaaguuugaaaaacaacugggccaggugaugcuuuuaauucugugcguuacacaggugcucaugaugaggaccacaugggccuugugugaggcucugacucuagccaccggacccaucaguacacugugggaaggcaacccagggcgguucuggaauaccacuauugcagucagcauggcuaacaucuuucguggauccuaccucgccggcgcgggucuucuguucucuauaaugaagaauacgacaaacaccagaagggggacuggaaacaucggcgagaccuugggugagaaauggaagaaucgccugaacgcccucggcaaaagcgaauuucaaauuuauaagaaguccgggauccaggagguggaccggacacuggcaaaagaaggaauuaagcgaggcgagacugaucaccaugcugucucaagagggucugccaaauuaaggugguucguggagcgcaauaugguuaccccugaaggaaaggugguagaccuuggcugcgguagagggggauggaguuacuauuguggcggucugaaaaacgugagagaggucaagggccucacaaaagggggacccggccacgaggaaccuaucccaaugucgacguacggguggaaucuaguucgucugcagagcggaguggaugucuuuuucauacccccugaaaaaugcgacaccuugcugugugauauuggcgaguccucuccaaaccccacuguggaggcagguaggacacuccggguacuuaaucugguggaaaacugguugaauaacaauacccaguucugcaucaagguucugaacccguacaugccuucagugaucgagaaaauggaagcucuccaacgcaaguaugggggagccuuaguccgaaauccacugagcagaaacuccacucaugagauguacugggugaguaaugccucuggcaacauugucagcucagugaacaugauauccaggaugcuuaucaaucgguuuacaaugcgccacaaaaaggcgaccuaugaacccgacguugaccugggcagugggacgagaaacauuggaaucgagagcgagauuccuaaucuagauaucauagguaagaggaucgagaaaauuaaggaggaacaugagaccucuuggcacuacgaccaggaucacccauauaaaacaugggcuuaccauggcuccuaugaaacuaagcagaccgggucagcaagcucgaugguaaacggagugguccgacuccugacaaaacccugggacguguugccgacuguuacccagauggccaugacagauaccacuccuuucggccaacagcggguguuuaaggagaaggucgacacgcguacacaggagcccaaagaagguaccaagaaacugaugaagaucacugcugaguggcucuggaaagaacuugggaagaaaaagaccccaagaauguguacacgcgaggaguucacgaggaaggugcggucuaaugccgcacugggagccauuuuuaccgaugaaaacaaauggaagagugcuagagaggcgguagaagacucccgcuucugggaguuaguggauaaagaaaggaaucugcacuuggagggcaagugcgagacuuguguuuacaacaugaugggcaaacgagaaaagaagcucggggaguuuggaaaagccaaggguagccgggcaaucugguacauguggcugggcgcuagauuccuagaauuugaggcccuuggguuccugaaugaagaccauugguuuucaagggagaacucccucucuggagucgagggcgaaggucugcacaaauugggguauauucugcgcgaugugagcaagaaagagggaggcgcaauguacgccgacgacacagcuggcugggauacccguauaacucucgaagaccuuaagaaugaggaaauggugacaaaccacauggagggggagcauaagaaacuggccgaagcgaucuucaaguuaaccuaucagaauaaagucguucgggugcaaagaccuacacccaggggaacuguaauggauauuaucagucgccgagaccagcgggguuccggccagguggggaccuacggacugaacacguuuaccaauauggaggcacaauugaucagacagauggaaggcgagggugucuucaagaacauucagcaccucacagugacugaggaagccgcuguucagaacuggcuggccaggguggggcgcgagagacuaagccggauggcaauaucuggagaugacugcgucgugaaaccacuugaugacagguucgcuaaugcccugaccgcucucaacgauaugggcaagauccguaaggacauucaacagugggaacccucaaaaggcuggaaugauuggacacagguaccuuuuugcagucaucacuuccaugagcugaucaugaaggacgggcgaguuuugguggucccaugucgcaaccaggaugaauuaauugguagagcacggaucucccaaggagcaggcuggagccugagggagacugcgugccucgggaaaucuuaugcccagauguggucgcuuauguacuuucaccgcagagaccugcggcuagcugccaaugcaauauguucagcugugccgagccacugggugcccaccuccaggacgacauggaguauccaugccaagcacgaguggaugaccacugaagacaugcugacagucuggaaccgaguuuggauucgugagaauccuuggauggaagauaaaaccccaguggagucuugggaagagauccccuaucucggaaagagagaggaccaguggugcggcagcuugauuggucugacuucccgcgcaaccugggccaagaacauccaggcggcuauaaaucaaguacggucacuuauugggaacgaagaguacacagauuacaugccuaguaugaaaagguucagacgcgaagaggaagaggccggagugcugugguga

SEQ ID NO: 14424 - RNA, 9876 nt, Artificial Sequence
  derived and/or modified CDS sequence (opt3) from DENV-2__GQ199892__SS-prME
accgccggcgugaucgucaugcugauucccacagcuauggcauuccaccucacuacgagaaacggggagccucauaugauaguuggaaggcaggaaaaggguaaaagccuucuguuuaagaccgaggacggcgugaauaugugcacauugauggccaucgauuuaggggaacugugugaggacacuauuaccuacaaaugcccacuacuccggcaaaacgaaccggaggauaucgacuguuggugcaauuccacaucuaccuggguaacuuauggaacauguaccacgacuggcgagcaccgccgagaaaagcguucaguggcgcuggucccccauguggguauggggcuugagaccagaacagaaacuuggaugaguagcgagggagcuuggaaacacguucagaggauugagaccuggauccugcggcauccuggcuucacaauaauggccgcaaucuuggccuacaccauuggcacgacucacuuucagcgcgcucucaucuucauucugcugacagcaguggccccauccaugaccaugagaugcaucgggauaucuaacagggauuuugucgaaggagugucggguggcucauggguagacauuguucucgagcacgggagcugugugacuacaauggcuaagaauaagcccaccuuagauuucgaacugaucaaaacggaggccaagcagccugcgacccuucggaaauauugcauugaagcaaaguugacaaacacuaccacagagagucgcuguccaacucaaggagagcccucccugaaugaagagcaggacaaacgauuuaucugcaagcauucuauggucgauagaggcugggguaacggguguggacuauucggcaagggcgggaucgugaccugcgccauguuuacaugcaaaaagaauauggaaggaaaaauugugcagccugagaaccucgaauacaccauagucaucacuccacacagcggugaggagcaugcuguuggcaaugacacggggaagcacggaaaagaaauuaagaucacaccgcaguccucaaccacugaggccgaacugaccggcuaugguacagugaccauggaguguagucccaggacugggcuugauuucaacgaaaugguacuguugcaaauggaggacaaagcauggcucgugcaccggcagugguuucuggauuuaccucugccauggcuccccggcgcugacacacagggaagcaauuggauacagaaggagacgcuugucaccuucaagaacccucaugccaaaaagcaagacgugguugugcugggcucucaggaaggggcgaugcacacugccuugacaggagcaaccgagauucagauguccucagguaaucuacuguuuacaggccaucucaaaugccgucugcgcauggauaagcuucaacugaaagggaugagcuacaguauguguacuggaaaguucaagaucgucaaagaaaucgcugagacccagcacggcacgauugugaucagaguacaguaugagggugacggggccccaugcaagauucccuucgaaauaaccgauuuggagaaaaggcauguucucggccggcugaucacagugaacccgauugucacugaaaaggacucuccugugaacaucgaggcugaacccccauuuggagauuccuacaucauugucggcguggagccugggcaguuaaaacugaauugguucaagaagggaagcucgauaggucaaauguuugagaccacaaugcgaggcgccaaacgcauggcaauccuaggggacacugccugggauuucggaucucucggcgguguuuuuaccuccauugggaaggcucugcaccagguguucggcgcgaucuacggagcagccuuuucaggcguaaguuggacgaugaaaauucuuaucggggucauaaucacauggauuggaaugaacagcagauccaccucuuugagcgugucacugguucucgugggcgucgugacucuguaucuuggugcuaugguacaggccgacaguggguguaucguguccuggaagaauaaagaacugaagugcggaagcggcauuuucaucacagauaacguucacaccuggacugagcaguacaaguuucaacccgaaucuccaucaaaauuggcaagugccauacagaaggcucaugaggaagguauuuguggcaucaggagcgucacccggcucgagaaucugauguggaaacagauuacacccgaguuaaaccacauccuguccgaaaaugaggugaagcuaacgauaaugaccggggacaucaaaggaauuaugcaggccggcaagcgcucucucagaccucaaccaacugaacugaaauauucguggaagacaugggggaaggcaaaaaugcuuagcaccgagucccauaaccagacauucuugaucgauggaccggaaacugcggagugccccaauaccaacagggcuuggaauucacuggagguggaagacuacggcuuuggugucuucaguacgaacauuuggcucaagcugcgugagaaacaggacguuuuuugugauucuaaguuaaugagcgccgcaaucaaagacaaucgggccgugcacgcugauaugggguauuggauagaauccgcccugaacgacacauggaagauggagaaggcaucauucauugaggugaaaagcugccacuggccuaagucucauacccuuugguccaauggaguauuggaaagugagaugaucaucccaaaaaacuucgcuggccccgucagccagcacaacuaccgaccugguuaucauacucaaaccgccggcccauggcaccucgggaagcuggaaauggauuuugacuucugugagggaacaacugugguugugaccgaagauugcggcaauagagggcccucucuaaggacaacgaccgcguccggaaaacugauuacugaguggugcugucgcucaugcacacucccgccucugcgguacagaggcgaggacgguuguugguacgggauggaaaucaggccacuuaaggagaaggaagagaacuuggucaauagucuggugaccgccggacauggccagauugauaacuuuagcuuagguauacucggcauggcucuguuccuugaagagaugcugcgcacucgaguugggacaaaacacgcaaucuugcucguggcccugucguuuguaacccuaauuacgggaaauauguccuuccgggaccugggccgugucauggugauggugggggcuacuaugaccgaugacaucggaaugggcgucacauaucucgcccugcuugcagcguuuaagguuagacccaccuucgccgcugguuugcuguuaaggaaacucacuucuaaggagcugaugauggccacaauugggaucgcacuucugagccagucaacccuaccugaaacaauacucgagcugacugaugcuuuggcccugggaaugauggcauuaaaaaucgugcgcaacauggaaaaguaccaacucgccguaaccauuauggcuaucaguugcgugcccaaugcggucauucugcagaacgccuggaagguguccuguacgauccuugcagcuguuucugugagcccacuguugcucacauccucacagcagaaagccgacuggauaccucuggcccuaaccauuaagggccugaaucccacugcuaucuuucuuaccacacucagccggacuaguaaaaagagaucuuggccacugaacgaggcaaucauggccgucggcaugguguccauuuuggcgagcucgcuguuaaaaaaugacauaccgaugaccgggccucucguugcuggaggucugcuuacggugugcuauguccugacaggcaggucagccgauuuggaacucgagcgagcagccgacguaaagugggaggaucaagcugaaaucucugggaguucccccauucugagcaucaccauuucugaggacggaagcauguccaucaaaaacgaagaggaggaacagacucuaacaauacugauccgcaccggccuucucgugauuucagguguuuucccagugaguauccccauuacugcagccgcgugguaccugugggaggucaagaagcagcgggcugggguguugugggauguaccuagcccacccccugugggaaaagccgaauuagaggacggcgcauauagaaucaagcagaggggcauacugggguacucucaaauuggagccggugucuauaaagaaggcacauuucacaccauguggcauguuacgcguggggcugugcucaugcaccgcggaaagcggaucgagccguccugggccgaugugaaaaaggaccugaucucauacggcgguggguggaagcuugagggagaauggaaagagggcgaagagguccaggugcuggcauuggaaccaggcaagaaucccagagcuguucagacuaaaccugggauuuucaagaccaacacaggaaccaucggugccguaagucuagauuuuagcccaggcacauccgggucucccauaguggacaggaaaggaaaggucgugggccuguacgguaaugggguugugacucgaucgggagcguaugucagcgccauugcacagaccgagaagucaaucgaggauaacccugaaauugaggacgauaucuuccggaaaaagcgccucacgauaauggaccugcauccgggcgcuggcaaaacaaagagauaccuucccgccauugugagggaagcuaucaaacggggguuacgaacucugauccucgcaccaaccagaguagucgccgccgagauggaagaggcuuugcgcggacugccuauuagguaucaaacacccgcgauccgugcagagcacaccggucgggaaauuguggaccucaugugucaugccacuuucaccaugagacugcuuuccccaguuagggugccuaacuacaaucugauaaucauggaugaggcucacuuuacagaccccgccaguauugcagcccgcggcuauaucucuacgcgagucgaaaugggggaggcugcgggaaucuucaugacugccaccccaccgggcagcagagauccuuuuccccaguccaacgcaccaauuauggacgaggaacgggagauacccgaaaggucauggaauucuggucacgagugggugacagauuucaaggggaagaccguuugguuugugccuagcaucaaagcuggaaacgacauugccgcaugcuugcgcaagaauggcaaaaaggucauccagcuaagucguaaaacuuucgauuccgaauacgugaagacaagagccaacgacugggauuuuguagugaccacggacauuagcgagaugggcgcuaauuucaaggccgagcggguuaucgauccaaggcgcuguaugaaacccgucauacugacugacggggaagagcgagugauccucgcgggaccuaugccggugacacauucuucagcagcccaaagacgggguaggauuggccgcaacccaaagaaugaaaacgaccaguauaucuacaugggggagcccuuagaaaaugaugaggacugcgcucacuggaaagaggccaagaugcugcuugauaacauuaauaccccugaaggaaucauacccuccauguuugagccagaaagagagaaagucgacgcuauugauggcgaauacaggcugcggggugaggcacguaagaccuucguagaccucaugcgccgaggggauuugccuguguggcuggccuauaaaguugcugccgagggcaucaacuacgcagacagaaagugguguuuugauggaauuaagaauaaccagauccucgaagagaacguggaagucgagauauggacuaaagagggcgaaaggaagaaacugaagccccgguggcuugacgcgcgcaucuauagugauccacuagcccugaaagaguucaaggaauucgcugccgggagaaagagcuugacauuaaaucugauuaccgagaugggaaggcucccuacauuuaugacucagaaagcacggaacgcucuggacaaucuugccgugcugcauacggcagaaguugguggccgagccuacacccacgcucucucggaguugccggagacacuggaaacucuacugcuccuuacccuguuagcgacagugaccgggggaaucuucuuguuucugaugucuggcaaggguauugggaaaaugacucucggcaugugcugcaucauaacggccuccauucugcuuugguaugcacaaauccagccccacuggaucgcugccagcauuauccuggaguucuuucucauagucuugcugauuccagaaccugagaagcagagaaccccccaggauaaccaauuaacauacgugguaaucgccauucuaacugugguugcagcuaccauggccaaugaaaugggauuccuggagaaaacaaagaaggaccucggcuuugggucaaucaccacucaggagagugaaucuaacauacuugacaucgaucugcgcccagcguccgcuuggacauuguaugccgucgcaacgaccuucgugacuccuaugcugaggcauagcauugagaauucaagugugaacgucagccucacagccaucgcuaaucaggcaaccguucugaugggacuugguaaaggcuggccccucuccaagauggacauuggggugccgcuguuggccaucggauguuacucucagguaaacccaauuacccugacagcggcuuuacuacugcucguggcccacuacgcaaucauaggcccuggucuucaagccaaagcuacucgggaagcccagaagcgugcagcugccgggauuaugaaaaaucccacggucgauggcaucaccgugaucgaccuggagccaauucccuaugauccuaaguuugaaaagcaguugggacagguuaugcugcucauacugugcgugacacaaguccuuaugaugagaacuaccugggcguuaugugaggcccugacacucgcaaccggcccgaucagcacuuugugggaggggaaccccggaagguucuggaauacgacaauugcuguauccauggccaacaucuuucgcggcucauaccuggcaggugcugggcuacuguucucuauuaugaaaaauaccacuaacacccggcgaggaacaggcaaugugggugaaacucucggcgagaaguggaaaaguagacuuaacgcccuggggaagucggaauuucagaucuauaaaaagagcggaauacaggagguugacaggaccuuggccaaagagggcaucaagcgcggggaaacagaucaucacgcggugucccggggaucugcuaagcugagaugguucgucgagcguaacauggugacgccagaaggcaaagucguggaccucgguugcgggaggggaggcuggucauacuauugugguggccugaagaauguucgggaggugaaaggguuaaccaagggaggcccugggcaugaagagcccauuccuaugagcacuuacggauggaaccuuguacgccugcaauccggcguggaugucuucuuuacaccacccgagaaaugcgacacccuccuaugugauaucggugaaaguucuccuaauccaacuauugaggcagggcgaacacugagaguuuugaaccugguggaaaauuggcucaacaauaacacccaguucugcaucaagguccuuaaucccuauaugccgagcgugauagagaagauggaaacgcugcagaggaaauacggaggcgccuugguacggaacccucugucacgcaauuccacccacgagauguacugggugaguaacgcuacaggcaauauuguuagcucugugaacaugaucuccagaaugcucaucaauagguuuacuaugaagcacaaaaaggccaccuaugagccagacgucgauuuagggucaggaacacgaaacauugguauagaaagcgagauccccaaccuggacauuaucggcaaacggauugaaaagaucaagcaggagcaugaaacuucguggcacuacgaccaagaucauccuuauaaaaccugggcauaccacgggucuuaugagacaaagcagaccggaagugccuccagcauggugaauggcgucgugcgucuucugacuaaaccaugggacguuguacccauggugacgcagauggcuaugacagauaccacuccguucggucagcaaagagucuuuaaggagaaaguggacacccgcacacaggaaccuaaggaggggacgaagaaacuaaugaagauaaccgcggaauggcucuggaaagagcugggaaaggagaaaacucccaggauguguacacgggaagaguucaccagaaagguucgcucaaacgccgcauugggcgcuaucuuuacugaugaaaauaaauggaaguccgccagggaggcaguggaagacggccgauucugggagcuggucgaucgggagagaaaccuccaccuugaagggaagugcgagacauguguguacaauaugaugggaaaaagggaaaagaaacugggugaguuuggcaaggccaaagggucucgcgcuauuugguauaugugguuaggagcccguuuccuggaauuugaggcguugggcuuccucaacgaggaccauugguuuagccgggguaauagucuguccgggguagaaggagagggccuacacagacuuggcuacauccugagggaaguggggaagaaggagggaggugcaauguacgccgaugacaccgcuggcugggauacacgcauuacucucgaagaccugaaaaacgaggagaugguuaccaaucauaugaagggggaacacaaaaaguuggccgaggcaaucuucaaacugacguaucagaacaaggucgugcgagugcagcggccaaccccuagaggaacagucauggacauuauaagcaggaaggaucaacgcggcucuggucagguugggacuuacggacucaauaccuucacaaacauggaagcucagcuuaucagacaaauggagggcgagggcauuuuuaaaucaauccagcaucugacugccaccgaagagaucgcugugcagaauugguuagcccggguagggagggaacgucugagucgaauggcaauuuccggagacgauugcguggucaagcccauagacgaucgcuucgcgagcgccuugacggcucucaacgacauggguaaagugagaaaggauauccagcaaugggagccaucucggggcuggaaugacuggacacagguucccuuuugcucgcaccacuuccaugaacuggugaugaaagaugggaggguccuagugguaccuugucgcaaccaggacgagcuuauuggaagagcccggaucucacagggcgcagguuggagccugaaggagaccgcuugccucgggaaguccuaugcccaaauguggacucugauguacuuucacaggcgagauuugcguuuagcagccaacgcgauuuguagugcuguuccaucucauugggugccgacaagcagaaccacuugguccauccacgccaaacacgaauggaugaccacagaggacaugcuggcagucuggaaucgcguguggauacaggaaaaccccuggauggaggauaagacgccuguggaaucaugggaggaggucccauaucucggaaaacgggaagaccaguggugcggcagucuuaucggccugaccucuagggccacuugggcuaagaauauucagacagccaucaaccaaguuagaagccuaauugggaaugagggauacaccgacuauaugcccuccaugaaacgcuuccggagggaagaggaagaggcaggugugcugugguga

SEQ ID NO: 14425 - RNA, 9876 nt, Artificial Sequence
  derived and/or modified CDS sequence (opt3) from DENV-2__JF730044__SS-prME
accgccggcgugaucauuaugcugauacccacagcuauggcauuccaccucacuacgcggaacggggaaccucauaugaucgucggaaggcaggaaaaggguaaaagccuucuguuuaagaccgaagacggcguuaauaugugcacauugauggccauugauuuaggggaacugugugaagacacuaucaccuacaaaugcccauuacuccggcaaaacgaaccggaggauauugacuguuggugcaauuccacaucuaccugggugacuuauggaacauguaccacgacuggcgagcaccgccgagaaaagcguucaguagcgcuggugccccaugucgguauggggcuugagaccagaacagaaacuuggaugaguagcgagggagcuuggaaacacgugcagaggaucgagaccuggauacugcggcauccuggcuucacaaucauggccgcaauuuuggccuacaccaucggcacgacucacuuucagcgcgcucucauuuucauccugcugacagcaguugccccauccaugaccaugagaugcauagggauuucuaacagggauuuuguggaaggagucucggguggcucauggguggacaucguacucgagcacgggagcuguguuacuacaauggcuaagaauaagcccaccuuagauuucgaacugauuaaaacggaggccaaggaaccugcgacccuucggaaauauugcaucgaggcaaaguugacaaacacuaccacagagagucgcuguccaacucagggagaacccucccugaaugaggaacaagacaaacgauuugugugcaagcauucuauggucgauagaggcugggguaacggguguggacuauucggcaagggcgggaucgugaccugcgccauguuuacaugcaaaaagaauauggagggaaaaauugugcagccugaaaaccucgaguacaccauagucaucacuccacacagcggugaggaacaugcuguuggcaaugacacggggaagcacggaaaagagauuaagaucacaccgcaguccucaaguaccgaagccgagcugacuggcuaugguaccgugacaauggaauguagccccaggaccgggcuugauuucaacgagaugguacuguugcagauggaggacaaagcauggcucgugcaccggcaaugguuucuggauuuaccucugccauggcuccccggcgcugacacucagggaucuaauuggauacagaaggaaacacuugucacguucaagaacccucaugccaaaaagcaggacgugguugugcugggcucccaagagggggcgaugcacaccgccuugacuggagcaacagaaauucagaugucaagcgguaaucuacuguuuaccggccaucucaaaugccgucugcgcauggauaaacuucagcugaaagggaugaguuacucuauguguacaggaaaguucaagaucgucaaagagaucgcugagacucaacacggcaccauugugaucagaguacaguaugaaggugacggguccccaugcaagauucccuucgagauaauggauuuggagaagaggcauguucucggccggcugaucacggugaacccgauugucaccgagaaggacagcccugugaacaucgaagccgagcccccauuuggagauucguacaucauuauaggcgucgagccugggcaguuaaaacugaauugguucaagaagggaucuuccaucggucagauguuugaaacaacuaugcgaggcgcuaaacgcauggccauucuaggggacaccgcaugggauuucggaucacucggcgguguguuuacaaguauggggaaggcccugcaccaaguuuucggcgcuaucuacggagcggcauuuagcggcguguccuggacuaugaaaauucuuaucgggguaauaaucaccuggauuggaaugaacucuagaagcacgucauugagugucucccuggugcucguuggcgugaucacacuguaucuuggugccaugguccaggcugacagcgggugugugguaucuuggaagaauaaagagcugaagugcggaucaggcauuuucaucaccgauaacgugcacacuuggacagaacaguacaaguuucagcccgagaguccaagcaaauuggccuccgcaauacaaaaggcccaugaagaggguauuuguggcaucaggucuguuacccggcucgagaaucugauguggaaacagauuacucccgaauuaaaccacauccugucggagaaugaagucaagcuaaccauaaugacaggggacaucaaaggaauuaugcaggcuggcaagcgcagccucagaccucagccaacggagcugaaauauuccuggaagaccugggggaaggccaaaaugcuuucaacugaaagucauaaccaaacauucuugaucgauggaccggagaccgcagagugccccaauacaaacagggcguggaacucucuggaaguggaggacuacggcuuugguguguucacuaccaacauuuggcucaagcugcgugaaaaacaggacgucuuuugugauagcaaguuaauguccgcugccaucaaagacaaucgggcaguucacgccgauaugggguauuggauagagucagcucugaacgacacguggaagauggagaaggccagcuucauugaagugaaaucuugccacuggccuaagucccauacacuuuggaguaauggaguguuggagagcgaaaugaucaucccaaaaucuuucgcaggccccguaucccagcacaacuaccgaccugguuauuacacccagacugcuggcccauggcaucucgggaagcuggagauggauuuugacuucugugaaggaaccacagucgugguuacugaggauugcggcaacagagggcccucacuaaggaccacaacggccaguggaaaacugauuaccgaguggugcugucgcagcugcacucucccgccucugcgguacagaggcgaagacgguuguugguaugggauggagaucaggccacuuaaggaaaaggaggaaaauuuggugaacucgcuggucacagcgggacacggccaaauugauaauuuuuccuuaggugugcucggcauggcccuguuccuugaggagaugcugcgcacccgaguugggacuaaacaugcuauauugcucguggcaguaucuuuugucacacugaucaccggaaacaugagcuuccgggaccuaggccgugugauggugauggucggggccacgaugacugaugacauuggaaugggcguuaccuaccuggcucuccuggccgcauuuaaggugagacccacauucgcggccggucuuuugcugaggaaauuaaccucaaaggaacucaugauggcuacuaucgggauugcccugcuuagucaguccacaaucccugagaccauacuggaacuaacagaugcacucgcucugggaaugaugguauugaaaaucgugcgcaauauggagaaguaucagcuggccgucacuauuauggcaaucucuugcgugcccaacgccguuauuuuacaaaaugcuuggaaggugagcuguaccauccucgcggccgucuccgugucaccacugcuucugacgagcagucagcagaaagcagacuggauaccuuuggcucucacaauuaagggccugaaccccaccgccaucuuucuaacuacccugucucggacauccaaaaagagaagcuggccacuuaaugaagccaucauggcuguuggcauggugucgauucucgcaucaucucuguugaaaaacgacauaccgaugacugggccucuggucgccggagguuuacucaccguaugcuacgugcugacgggcaggagugcggaucuugagcuggagcgagcuacagacguuaagugggaagaucaggccgagaucuccgggagcucucccauuuugagcaucaccauuuccgaagacggaucaaugaguaucaaaaaugaggaggaagaacaaacucucacaauacugauccgcaccggccuacuggugauuagcggucuuuucccagucucuauccccauuacugcagccgcuugguaucucugggaagugaagaagcagcgggcagggguacugugggaugugccuuccccacccccugucggaaaagccgaguuggaagacggcgcguacagaaucaagcagaaaggcauauuaggguauucacagauuggagcugguguuuacaaggagggcacauuucacaccauguggcacgugacgagaggggcagugcugaugcaucguggaaaacgcaucgagccgaguugggcagaugucaagaaggaccucaucagcuacggcgguggguggaaacuggaaggagaguggaaggaaggcgaggaagugcaaguucuugcccuggagccaggcaaaaacccccgggcuguacagacuaagccuggguuguucaaaaccaauacaggaaccauuggugccgugucccuagauuuuucuccaggcacaucggggagccccaucgucgacagaaagggaaaggugguuggccuguaugguaacgggguggucacuaggucaggagcauacguguccgcuauagcccagaccgagaaaaguauugaagauaauccugagaucgaagacgauauuuuccgaaagaaacggcucacgaucauggaccugcacccgggcgcgggcaagacaaaacgcuaucuucccgccauaguaagagaggcaauuaagaggggguuacggacucugauccucgcuccaacccgagucguggccgcugaaauggaggaggcauugagaggacugccuauccgcuaccagacacccgccauuagggccgaacauaccggucgugagaucguugaccucaugugucacgcuacuuucaccaugcggcugcuuucuccagugagagucccuaacuauaaccugauuauaauggaugaagcgcauuuuacagaccccgcaagcaucgccgcuaggggcuacauuuccacgcgcguggagaugggggaggccgcaggaaucuucaugacugccaccccaccgggcucacgagauccuuuuccccaaucuaaugcuccaaucauggacgaagagagagaaauucccgagcggagcuggaacaguggucacgaauggguuacagauuucaaggggaaaaccgugugguuugucccuuccauaaaggcgggaaaugacaucgccgcaugcuugaggaaaaacggcaagaaagugauucagcuaagccgcaagacuuucgauucugaguauguaaagacacguaccaaugacugggauuuugugguuacgacugacaucucagagaugggcgcuaacuucaaagccgaaagagucauugauccacggagguguaugaagcccgugauccugacagacggggaggaacgcgugauacucgcaggaccuaugccggucacccacuccagugccgcucagcgaagaggucggaucggcaggaaucccaagaaugagaaugaccaauacauuuacaugggggaacccuuagagaacgaugaggacugcgcccauuggaaggaagcgaaaaugcugcuugauaauaucaacaccccugagggaauuauccccagcauguuugaaccagagcgcgaaaagguagacgcaauagauggcgaguauagacugaggggugaggcccggaaaacuuucguggaccucaugcgucgcggggauuugccuguuuggcuggcuuaccgaguggccgcugaaggcauuaauuaugcagacagaaggugguguuuugauggagucaagaacaaucagauccucgaggaaaacguggagguugagauuuggacaaaggaaggcgagcggaaaaagcugaaaccccgcuggcuugacgccagaaucuacucggauccacuagcucugaaggaguucaaagaguucgccgcagggaggaagucuuugaccuuaaaccugauaacagaaaugggacggcucccuacuuuuaugacgcagaaggcgcgagacgcccuggauaaucuugcugugcugcacaccgccgaggccgguggcagagcuuauaaccaugcccucuccgaguugccggaaacacuggagacucuacugcuccuuacccuguuagcaacagucaccgggggaaucuucuuguuucugaugagcggcaaagguguggggaagaugacucucggcaugugcugcauuaucacggccucaauucugcuuugguacgcucagauccaaccccacuggauagcggccaguauuauccuggaguucuuucucaucguauugcugauuccagagccugaaaaacagcgcacaccacaagacaaucaguuaacauaugugguuaucgcaauacuaacugucguggcugccaccauggccaacgagaugggauuccuggagaagaccaaaaaggaccucggccuugggucuauugcaacccaagaaccagaguccaauauccuggauauugacuugaggccugcuagcgccuggacucuguacgcgguggcuacaacguuugucacccccaugcuccggcacucaaucgaaaacaguagcguuaaugugucccugacugccauagcaaaccaggccacaguacuuaugggacucgguaagggcuggccgcugucuaaaauggauaucggggugccauugcuggcuauuggauguuacagccaggucaauccugugaccuuaaccgcagcccuacugcuccuuguugcgcauuaugcuaucauuggccccggucugcaggccaaggcaacacgugaggcccagaaaagggcugccgcagggaucaugaagaacccaacuguggacggcauuacggucaucgauuuggaccccauaccuuacgauccgaaauucgaaaagcagcugggacagguaaugcuccugauucuuugcgugacccagguuuuaaugaugaggacaacuugggcucugugugaggcccucaccuuggcgacaggccccaucuccacccugugggaggggaauccaggacgcuuuuggaacacuacgaucgccgugucaauggcaaauauuuuccggggcucuuaucuagcuggugccgggcugcucuuuaguauaaugaagaacacaaccaauacucgaagaggaaccggcaacaucggugaaacacuuggcgagaaauggaagucgaggcugaaugcauuggggaaaagcgaguuccaaauuuacaagaaauccggaauccaggaggucgaccgcacucuggcuaaggagggcauuaaaagaggggaaaccgaucaccaugccgugucuagaggaucagccaagcuccguugguuugucgagaggaacauggugacaccugaaggcaagguuguggaccuggguugcgggcggggaggcuggagcuauuacugugguggccuuaaaaacguaaaggaggugaaagggcuaacgaagggaggccccgggcacgaagaaccuaucccaauguccaccuauggauggaaucugguccgccuccagaguggcguugauguguucuucacucccccugagaaaugcgacacacuacugugugauauaggugaaucuagcccaaaccccaccaucgaggcggggcgaacuuugagaguccugucacucguggaaaauuggcuuaacaaugacacacaauuuugcauuaagguacugaacccguacaugccuuccgugaucgagaagauggaaaccuugcagaggaaauacggaggcgcucugguucggaauccacucagucgcaacagcacgcaugagauguauugggugucuaaugcaaccggcaacauugucuccucagugaauaugaucagcagaauguuaauaaacagguucacaaugaagcacaaaaaggccacuuacgagcccgacgucgaucuggggucgggaacccgaaauauugguaucgaaucugagaucccuaaccuugacauuauaggcaaacggaucgaaaagauuaagcaggagcacgaaacaaguuggcauuaugaucaggaccacccauacaaaacuugggcuuaucauggguccuacgagaccaagcaaacaggaagcgccucauccauggugaauggcguuguacgucugcuaaccaaacccugggauguggucccgauggugacucagauggcaaugacggacacaaccccuuuuggucagcagagaguuuucaaggagaaaguggauacucgcacccaagaacccaaggaggggacaaagaaacucaugaagaucacggccgaauggcuguggaaagaguugggaaagaaaaagaccccaaggauguguacucgggaggaauuuacaagaaaaguccgcucuaacgcugcgcugggcgccauuuucaccgacgagaacaaguggaaaagcgcaagggaagcuguggaggauagucgauuuugggaacucguagacaaagagcggaaucuucaccuggagggcaagugcgaaacuuguguguauaacaugauggggaaaagagagaagaaauuaggagaguucgguaaggccaagggcuccagggcaaucugguacauguggcugggggcccgcuuuuuggaguucgaagcucucggauuucugaaugaggaucacugguucagccgugagaacucucuaucaggcguugaaggugaggggcuucauaaacugggauacauacuccgggacgucggcaagaaagaaggcggggccauguaugcggacgauacagcaggaugggacaccagaaucacacuggaggauuugaagaaugaagagauggugacuaaccacauggagggugaacauaaaaagcuggccgaggcuauuuuuaagcucaccuaccagaauaaaguggucaggguucagcgcccuacgccccgaggcaccgugauggacaucauuagucggagagaucagaggggguccggacaaguaggcacauauggucuuaacacuuucaccaauauggaagcccagcugauccgccagauggagggggagggaauuuucaagagcauacaacacuuaacagcaacugaagagaucgcugugcagaacuggcuggccagagucggccgggaaagguugucucguauggcuauuucgggcgacgauugcgugguuaaaccacucgacgaucgauuugccucagcacugaccgcgcuaaaugacauggggaaggugcgcaaagauauccagcagugggagcccagcagaggauggaacgacuggacgcaagucccuuucugcucccaucacuuucacgaacuuaucaugaaggauggucgggugcugguaguuccauguaggaaucaggacgagcucauuggccgcgccagaauaagucagggggcuggauggucucugaaggagacagccugcuugggcaaaagcuacgcacagaugugguccuuaauguauuuccaucggagggaccugcgacucgcugccaacgcaaucuguucagccgugccgagucacuggguccccaccucucguacuacauggagcauucaugcgaagcacgaauggaugaccacugaggauaugcuuaccguguggaauagaguguggauccaagaaaacccuuggauggaggacaaaacaccagucgaauccugggaggagguucccuaccuggguaagcgcgaagaucaguggugcgggucacuaauuggacugacgagccgggcuaccugggccaaaaacauccagacugcaauaaaucaggugaggucucucaucggcaacgaggaauauacagacuacaugccuuccaugaagagauuucgccgggaggaagaggaggccggcguauugugguga

SEQ ID NO: 14426 - RNA, 9876 nt, Artificial Sequence
  derived and/or modified CDS sequence (opt3) from DENV-2__FJ639697__SS-prME
accgccggcgugaucauuaugcugauacccacagcuauggcauuccaccucacuacgcggaacggggaaccucauaugaucgucggaaggcaggaaaaggguaaaagccuucuguuuaagaccgaagacggcguuaauaugugcacauugauggccauugauuuaggggaacugugugaagacacuaucaccuacaaaugcccauuacuccggcaaaacgaaccggaggauauugacuguuggugcaauuccacaucuaccugggugacuuauggaacauguaccacgacuggcgagcaccgccgagaaaagcguucaguagcgcuggugccccaugucgguauggggcuugagaccagaacagaaacuuggaugaguagcgagggagcuuggaaacacgugcagaggaucgagaccuggauacugcggcauccuggcuucacaaucauggccgcaauuuuggccuacaccaucggcacgacucacuuucagcgcgcucucauuuucauccugcugacagcaguugccccauccaugaccaugagaugcauagggauuucuaacagggauuuuguggaaggagucucggguggcucauggguggacaucguacucgagcacgggagcuguguuacuacaauggcuaagaauaagcccaccuuagauuucgaacugauuaaaacggaggccaaggaaccugcgacccuucggaaauauugcaucgaggcaaaguugacaaacacuaccacagagagucgcuguccaacucagggagaacccucccugaaugaggaacaagacaaacgauuugugugcaagcauucuauggucgauagaggcugggguaacggguguggacuauucggcaagggcgggaucgugaccugcgccauguuuacaugcaaaaagaauauggagggaaaaauugugcagccugaaaaccucgaguacaccauagucaucacuccacacagcggugaggaacaugcuguuggcaaugacacggggaagcacggaaaagagauuaagaucacaccgcaguccucaaguaccgaagccgagcugacuggcuaugguaccgugacaauggaauguagccccaggaccgggcuugauuucaacgagaugguacuguugcagauggaggacaaagcauggcucgugcaccggcaaugguuucuggauuuaccucugccauggcuccccggcgcugacacucagggaucuaauuggauacagaaggaaacacuugucacguucaagaacccucaugccaaaaagcaggacgugguugugcugggcucccaagagggggcgaugcacaccgccuugacuggagcaacagaaauucagaugucaagcgguaaucuacuguuuaccggccaucucaaaugccgucugcgcauggauaaacuucagcugaaagggaugaguuacucuauguguacaggaaaguucaagaucgucaaagagaucgcugagacucaacacggcaccauugugaucagaguacaguaugaaggugacggguccccaugcaagauucccuucgagauaauggauuuggagaagaggcauguucucggccggcugaucacggugaacccgauugucaccgagaaggacagcccugugaacaucgaagccgagcccccauuuggagauucguacaucauuauaggcgucgagccugggcaguuaaaacugaauugguucaagaagggaucuuccaucggucagauguuugaaacaacuaugcgaggcgcuaaacgcauggccauucuaggggacaccgcaugggauuucggaucacucggcgguguguuuacaaguauggggaaggcccugcaccaaguuuucggcgcuaucuacggagcggcauuuagcggcguguccuggacuaugaaaauucuuaucgggguaauaaucaccuggauuggaaugaacucuagaagcacgucauugagugucucccuggugcucguuggcgugaucacacuguaucuuggugccaugguccaggcugacagcgggugugugguaucuuggaagaauaaagagcugaagugcggaucaggcauuuucaucaccgauaacgugcacacuuggacagaacaguacaaguuucagcccgagaguccaagcaaauuggccuccgcaauacaaaaggcccaugaagaggguauuuguggcaucaggucuguuacccggcucgagaaucugauguggaaacagauuacucccgaauuaaaccacauccugucggagaaugaagucaagcuaaccauaaugacaggggacaucaaaggaauuaugcaggcuggcaagcgcagccucagaccucagccaacggagcugaaauauuccuggaagaccugggggaaggccaaaaugcuuucaacugaaagucauaaccaaacauucuugaucgauggaccggagaccgcagagugccccaauacaaacagggcguggaacucucuggaaguggaggacuacggcuuugguguguucacuaccaacauuuggcucaagcugcgugaaaaacaggacgucuuuugugauagcaaguuaauguccgcugccaucaaagacaaucgggcaguucacgccgauaugggguauuggauagagucagcucugaacgacacguggaagauggagaaggccagcuucauugaagugaaaucuugccacuggccuaagucccauacacuuuggaguaauggaguguuggagagcgaaaugaucaucccaaaaucuuucgcaggccccguaucccagcacaacuaccgaccugguuauuacacccagacugcuggcccauggcaucucgggaagcuggagauggauuuugacuucugugaaggaaccacagucgugguuacugaggauugcggcaacagagggcccucacuaaggaccacaacggccaguggaaaacugauuaccgaguggugcugucgcagcugcacucucccgccucugcgguacagaggcgaagacgguuguugguaugggauggagaucaggccacuuaaggaaaaggaggaaaauuuggugaacucgcuggucacagcgggacacggccaaauugauaauuuuuccuuaggugugcucggcauggcccuguuccuugaggagaugcugcgcacccgaguugggacuaaacaugcuauauugcucguggcaguaucuuuugucacacugaucaccggaaacaugagcuuccgggaccuaggccgugugauggugauggucggggccacgaugacugaugacauuggaaugggcguuaccuaccuggcucuccuggccgcauuuaaggugagacccacauucgcggccggucuuuugcugaggaaauuaaccucaaaggaacucaugauggcuacuaucgggauugcccugcuuagucaguccacaaucccugagaccauacuggaacuaacagaugcacucgcucugggaaugaugguauugaaaaucgugcgcaauauggagaaguaucagcuggccgucacuauuauggcaaucucuugcgugcccaacgccguuauuuuacaaaaugcuuggaaggugagcuguaccauccucgcggccgucuccgugucaccacugcuucugacgagcagucagcagaaagcagacuggauaccuuuggcucucacaauuaagggccugaaccccaccgccaucuuucuaacuacccugucucggacauccaaaaagagaagcuggccacuuaaugaagccaucauggcuguuggcauggugucgauucucgcaucaucucuguugaaaaacgacauaccgaugacugggccucuggucgccggagguuuacucaccguaugcuacgugcugacgggcaggagugcggaucuugagcuggagcgagcuacagacguuaagugggaagaucaggccgagaucuccgggagcucucccauuuugagcaucaccauuuccgaagacggaucaaugaguaucaaaaaugaggaggaagaacaaacucucacaauacugauccgcaccggccuacuggugauuagcggucuuuucccagucucuauccccauuacugcagccgcuugguaucucugggaagugaagaagcagcgggcagggguacugugggaugugccuuccccacccccugucggaaaagccgaguuggaagacggcgcguacagaaucaagcagaaaggcauauuaggguauucacagauuggagcugguguuuacaaggagggcacauuucacaccauguggcacgugacgagaggggcagugcugaugcaucguggaaaacgcaucgagccgaguugggcagaugucaagaaggaccucaucagcuacggcgguggguggaaacuggaaggagaguggaaggaaggcgaggaagugcaaguucuugcccuggagccaggcaaaaacccccgggcuguacagacuaagccuggguuguucaaaaccaauacaggaaccauuggugccgugucccuagauuuuucuccaggcacaucggggagccccaucgucgacagaaagggaaaggugguuggccuguaugguaacgggguggucacuaggucaggagcauacguguccgcuauagcccagaccgagaaaaguauugaagauaauccugagaucgaagacgauauuuuccgaaagaaacggcucacgaucauggaccugcacccgggcgcgggcaagacaaaacgcuaucuucccgccauaguaagagaggcaauuaagaggggguuacggacucugauccucgcuccaacccgagucguggccgcugaaauggaggaggcauugagaggacugccuauccgcuaccagacacccgccauuagggccgaacauaccggucgugagaucguugaccucaugugucacgcuacuuucaccaugcggcugcuuucuccagugagagucccuaacuauaaccugauuauaauggaugaagcgcauuuuacagaccccgcaagcaucgccgcuaggggcuacauuuccacgcgcguggagaugggggaggccgcaggaaucuucaugacugccaccccaccgggcucacgagauccuuuuccccaaucuaaugcuccaaucauggacgaagagagagaaauucccgagcggagcuggaacaguggucacgaauggguuacagauuucaaggggaaaaccgugugguuugucccuuccauaaaggcgggaaaugacaucgccgcaugcuugaggaaaaacggcaagaaagugauucagcuaagccgcaagacuuucgauucugaguauguaaagacacguaccaaugacugggauuuugugguuacgacugacaucucagagaugggcgcuaacuucaaagccgaaagagucauugauccacggagguguaugaagcccgugauccugacagacggggaggaacgcgugauacucgcaggaccuaugccggucacccacuccagugccgcucagcgaagaggucggaucggcaggaaucccaagaaugagaaugaccaauacauuuacaugggggaacccuuagagaacgaugaggacugcgcccauuggaaggaagcgaaaaugcugcuugauaauaucaacaccccugagggaauuauccccagcauguuugaaccagagcgcgaaaagguagacgcaauagauggcgaguauagacugaggggugaggcccggaaaacuuucguggaccucaugcgucgcggggauuugccuguuuggcuggcuuaccgaguggccgcugaaggcauuaauuaugcagacagaaggugguguuuugauggagucaagaacaaucagauccucgaggaaaacguggagguugagauuuggacaaaggaaggcgagcggaaaaagcugaaaccccgcuggcuugacgccagaaucuacucggauccacuagcucugaaggaguucaaagaguucgccgcagggaggaagucuuugaccuuaaaccugauaacagaaaugggacggcucccuacuuuuaugacgcagaaggcgcgagacgcccuggauaaucuugcugugcugcacaccgccgaggccgguggcagagcuuauaaccaugcccucuccgaguugccggaaacacuggagacucuacugcuccuuacccuguuagcaacagucaccgggggaaucuucuuguuucugaugagcggcaaagguguggggaagaugacucucggcaugugcugcauuaucacggccucaauucugcuuugguacgcucagauccaaccccacuggauagcggccaguauuauccuggaguucuuucucaucguauugcugauuccagagccugaaaaacagcgcacaccacaagacaaucaguuaacauaugugguuaucgcaauacuaacugucguggcugccaccauggccaacgagaugggauuccuggagaagaccaagaaggaccucggccuugggucuauugcaacccaagaaccagaguccaauauccuggauauugacuugaggccugcuagcgccuggacucuguacgcgguggcuacaacguuugucacccccaugcuccggcacucaaucgaaaacaguagcguuaaugugucccugacugccauagcaaaccaggccacaguacuuaugggacucgguaagggcuggccgcugucuaaaauggauaucggggugccauugcuggcuauuggauguuacagccaggucaauccugugaccuuaaccgcagcccuacugcuccuuguugcgcauuaugcuaucauuggccccggucugcaggccaaggcaacacgugaggcccagaaaagggcugccgcagggaucaugaagaacccaacuguggacggcauuacggucaucgauuuggaccccauaccuuacgauccgaaauucgaaaagcagcugggacagguaaugcuccugauucuuugcgugacccagguuuuaaugaugaggacaacuugggcucugugugaggcccucaccuuggcgacaggccccaucuccacccugugggaggggaauccaggacgcuuuuggaacacuacgaucgccgugucaauggcaaauauuuuccggggcucuuaucuagcuggugccgggcugcucuuuaguauaaugaagaacacaaccaauacucgaagaggaaccggcaacaucggugaaacacuuggcgagaaauggaagucgaggcugaaugcauuggggaaaagcgaguuccaaauuuacaagaaauccggaauccaggaggucgaccgcacucuggcuaaggagggcauuaaaagaggggaaaccgaucaccaugccgugucuagaggaucagccaagcuccguugguuugucgagaggaacauggugacaccugaaggcaagguuguggaccuggguugcgggcggggaggcuggagcuauuacugugguggccuuaaaaacguaaaggaggugaaagggcuaacgaagggaggccccgggcacgaagaaccuaucccaauguccaccuauggauggaaucugguccgccuccagaguggcguugauguguucuucacucccccugagaaaugcgacacacuacugugugauauaggugaaucuagcccaaaccccaccaucgaggcggggcgaacuuugagaguccugucacucguggaaaauuggcuuaacaaugacacacaauuuugcauuaagguacugaacccguacaugccuuccgugaucgagaagauggaaaccuugcagaggaaauacggaggcgcucugguucggaauccacucagucgcaacagcacgcaugagauguauugggugucuaaugcaaccggcaacauugucuccucagugaauaugaucagcagaauguuaauaaacagguucacaaugaagcacaaaaaggccacuuacgagcuggacgucgaucuugggucgggaacccgaaauauugguaucgaaucugagauccccaaccuggacauuauaggcaaacggaucgaaaagauuaagcaggagcacgaaacaaguuggcauuaugaucaggaccacccuuacaaaacuugggcuuaucauggguccuacgagaccaagcaaacaggaagcgccucauccauggugaauggcguuguacgucuacucaccaaaccaugggaugugguccccauggugacucagauggcaaugacggacacaaccccguuuggucagcagagaguuuucaaggagaaaguggauacucgcacccaagaaccuaaggaggggacaaagaaacugaugaagaucacggccgaaugguuguggaaagagcugggaaagaaaaagacccccaggauguguacucgggaggaauuuacaagaaaaguccgcucuaacgcugcgcucggcgccauuuucaccgacgagaacaaguggaaaagcgcaagggaagcuguggaggauagucgauuuugggaacuuguagacaaagagcggaaucugcacuuagagggcaagugcgaaacuuguguguauaacaugauggggaaaagagagaagaaacugggagaguucgguaaggccaagggcuccagggcaaucugguacaugugguugggggcccgcuuucucgaguucgaagcucugggauuucuaaaugaggaucacugguucagccgugagaacucucuuucaggcguugaaggugaggggcugcauaaacucggauacauacugcgggacgucggcaagaaagaaggcggggccauguaugcggacgauacagcaggaugggacaccagaaucacauuggaggaucugaagaaugaagagauggugacuaaccacauggagggugaacauaaaaagcucgccgaggcuauuuuuaaacuuaccuaccagaauaaaguggucaggguucagcgcccaacgccucgaggcaccgugauggacaucauuagucggagagaucagaggggguccggacaaguaggcacauauggucugaacacuuucaccaauauggaagcccaguuaauccgccagauggagggggagggaauuuucaagagcauacaacaccugacagugacugaagagaucgcaguccagaacugguuggcuagagugggccgggaaaggcucucucguauggccauuucgggcgacgauugcguugugaaaccccuggacgaucgauuugcuucagcccuaaccgcacuuaaugacauggggaagguccgcaaagauauccagcagugggagccaagcagaggauggaacgacuggacgcaagugcccuucugcucccaucacuuucacgaacugaucaugaaggauggucggguacucguugugccuuguaggaaucaggacgagcugauuggccgcgcgagaauaagucagggggccggauggucuuugaaggagacagcuugcuuaggcaaaagcuacgcccagauguggucccugauguauuuccaucggagggaccuccgacuugcagcuaacgccaucuguucagcagucccaagucacugggugccgaccucucguacuacauggagcauucaugccaagcacgaauggaugaccacugaggauaugcugaccguguggaauagagucuggauccaagaaaaccccuggauggaggacaaaacaccuguugaauccugggaggaggugccauaccuagguaagcgcgaagaucaguggugcgggucacugauuggacucacgagccggaccacuugggcgaaaaacauccagacagcuauaaaucagguaaggucuuugaucggcaacgaggaauauaccgacuacaugcccuccaugaagagauuucgccgggaggaagaggaggccggcgugcugugguga

SEQ ID NO: 14427 - RNA, 9876 nt, Artificial Sequence
  derived and/or modified CDS sequence (opt3) from DENV-2__FJ639698__SS-prME
accgccggcgugaucauuaugcugauacccacagcuauggcauuccaccucacuacgagaaacggggagccucauaugaucgucggaaggcaggaaaaggguaaaagccuucuguuuaagaccgaggacggcguuaauaugugcacauugauggccauugauuuaggggaacugugugaggacacuaucaccuacaaaugcccacuacuccggcaaaacgaaccggaggauauugacuguuggugcaauuccacaucuaccugggugacuuauggaacauguaccacgacuggcgagcaccgccgagaaaagcguucaguagcgcuggugccccaugucgguauggggcuugagaccagaacagaaacuuggaugaguagcgagggagcuuggaaacacgcccagaggaucgagaccuggauacugcggcauccuggcuucacaaucauggcagccauuuuggcuuacaccaucggcacgacucacuuucagcgcgcacucauuuucauccugcugacagccguggcuccauccaugaccaugagaugcauagggauuucuaacagggauuuuguugaaggagugucggguggcucaugggucgacaucgugcucgagcacgggagcuguguaacuacaauggccaagaauaagcccaccuuagauuucgaacugauuaaaacggaggcgaaggaaccugcaacccuucggaaauauugcaucgaggccaaguugacaaacacuaccacagagagucgcuguccaacucagggagaacccucccugaaugaggaacaagacaaacgauuuguuugcaagcauucuaugguggauagaggcugggguaacggguguggacuauucggcaagggcgggaucgucaccugcgcuauguuuagcugcaaaaagaauauggagggaaaaauugugcagccugaaaaccucgaguacacaauagugaucaccccacacuccggugaggaacaugccgucggcaaugacacugggaagcacggaaaagagauuaagaucacgccgcagucaaguauaacagaagcagagcugaccggcuaugguacuguuaccauggaauguagccccaggacagggcuugauuucaacgagauggugcuguugcagauggaggacaaagcuuggcucguacaccggcaaugguuucuggauuuaccucugccauggcuccccggcgccgacacccagggaucuaauuggauucagaaggaaacucuugugacauucaagaacccucaugcgaaaaagcaggacgucgugguucugggcucccaagagggggccaugcacacggcauugaccggagcuacugaaauccagaugucaagcgguaaucuacuguuuacaggccaucucaaaugccgucugcgcauggauaagcuucagcugaaagggaugaguuacucuauguguaccggaaaguucaagaucgugaaagagauugccgagacacaacacggcacuaucgucauuagagugcaguaugaaggugacggguccccaugcaagauacccuucgagaucauggauuuggaaaaaaggcauguacucggccggcugauuaccguuaacccgaucaucacggagaaggacagcccugugaacauugaagcugagcccccauuuggagauucguacauaaucauuggcgucgagccugggcaguuaaaacugaauugguucaagaagggaucuuccaucggucagauguuugaaaccacaaugcgaggcgccaaacgcauggcaauucuaggggacacugccugggauuucggaucacucggcgguguguuuaccaguaucgggaaggcucugcaccaagucuucggcgcgauauacggagcagccuuuagcggcguguccuggacaaugaaaauccuuauugggguuaucauuacuuggaucggaaugaacucuagaagcaccucauugagugugucccugguacucgucggcgugauaacgcuguaucuuggugcuaugguucaggccgacagcggguguguggucucuuggaagaauaaagagcugaagugcggaucaggcauuuucaucacagauaacgugcacaccuggacugaacaguacaaguuucagcccgagaguccaagcaaauuggcauccgccauucaaaaggcucaugaagaggguaucuguggcauaaggucuguaacacggcucgagaaucugauguggaaacagaucacccccgaauuaaaccacauucugucggagaaugaagugaagcuaacuaucaugaccggggacauuaaaggaaucaugcaggccggcaagcgcagccucagaccucagccaacagagcugaaauauuccuggaagacgugggggaaggcaaaaaugcuuucaaccgaaagucauaaccaaacuuucuugauagauggaccggagacagcggagugccccaauaccaacagggcuuggaauucucuggaaguugaggacuacggcuuuggugucuucacaacuaacauuuggcucaagcugaaagaaaagcaggacguguuuugugauccuaaauuaaugagcgccgcaaucaaggacaaucgugccgugcacgcugauaugggguauuggaucgaguccgcccugaacgacaccuggaagauggagaaagcaucauucauugaagucaagagcugccacuggccaaaaucucauacgcuuugguccaauggaguuuuggagagugaaaugaucauucccaagggcuucgcugguccugugagccagcacaacuaccggccaggcuauuacacacagaccgccgggcccuggcaucucggaaaacuggagauggauuuugacuucugugaaggcacuaccgugguagucacagaggauugcgggaaccgaggaccgucucuaagaacuaccacagcguccggcaagcugauaacggaguggugcuguaggucaugcacccucccuccacugcgcuaccggggugaagacggguguugguauggaauggagaucagaccccuuaaggaaaaagaggaaaauuuggugaacagucugguuacugccggccacggucaaauugauaauuuuagcuuaggcgugcucgggauggcucuguuccuugaggagaugcugaggacacgcgucggaaccaagcaugcaaucuugcucguggccguuucguuugugacucugauuacaggcaacauguccuuccgagaccuagggcggguaauggucauggugggagcuaccaugacggaugacaucggcaugggugugacuuaccuggcccuccuggcagcguuuaaaguccguccuaccuucucugccgggcuuuugcugagaaaguuaacaagcaaagaacucaugauggcuaccauaggaaucgcccugcuuucacagaguacuauucccgagacaauccuggaacuaaccgaugcacucgcucugggcaugaugguuuugaagauugugaggaauauggagaaguaucagcuggccguaacaaucauggcaauauccugcgugccaaacgccgucauuuuacaaaaugcuuggaaagugucuuguacuauccucgcggccguuagcguguccccucugcuucugaccucaagccagcagaaggcagacuggauccccuuggcucucacgauuaaaggccugaacccaacagccauauuucuaaccacucugagucgcaccucuaagaaacgguccuggccgcuuaaugaagccaucauggcugucgggauggugagcauucucgcaucgucacuguugaagaacgacaucccuaugacaggaccccugguugccgguggcuuacucacugugugcuacguccugaccgggagaucugcggaucuugagcuggagagggcuacggacguaaaaugggaagaucaggccgagauuaguggauccagcccaaucuugucuauaacaaucagcgaagacggcuccaugucaauuaagaaugaggaggaagagcaaacccucacuauccugauucgaacaggucuacuggugaucagugggcuuuuccccguuagcauaccuauuaccgcagccgcuugguaucucugggaagugaagaaacagcgcgcaggaguccugugggaugugccaucucccccuccgguaggcaaggccgaguuggaagacggcgcguaccggaucaaacagaaggggaucuuaggauauucccagauuggugcuggcguguacaaagaggggacuuuucacacaauguggcacgucaccagaggagccguucugaugcauaggggcaagcguaucgagccaucaugggcagaugugaagaaagaccucauaaguuacggugggggauggaagcuggaaggcgaguggaaagaaggcgaggaagugcaaguccuugcccuggagcccgggaagaacccucgcgcugugcagacgaaaccaggauuguucaagacuaauaccgguacaauuggcgccguuagccuagauuuuucccccgggaccucuggaucgccuaucguagaccggaagggcaaaguggucggucuguaugggaacggagugguuacaagaagcggcgcauacgugucagcuauugcccagacugagaaguccaucgaagauaauccggagauagaagacgauauuuucaggaaaaagcgacucaccaucauggaccugcaccccggcgcggggaaaacgaagcgguaucuuccagccaucguccgcgaggcaauuaagagaggauuaaggacacugauccucgcuccuacucgggugguagccgcugaaauggaggaggcauugcgaggucugcccauuagauaccagaccccagccauacgcgccgaacauacaggcagggagaucgucgaccucaugugucacgcuaccuucacuaugcgucugcuuaguccugugcggguucccaacuauaaccugauuaucauggaugaagcgcauuuuaccgacccagcaucuaucgccgcuagaggguacauuagcacaaggguggagaugggagaggccgcaggcauauucaugacggccacuccgccugguucccgcgaucccuuuccacaaucaaaugcucccaucauggacgaagagcgagaaauuccugagagaucuuggaacagcgggcacgaaugggucaccgauuucaaaggaaagacagugugguuuguuccaaguaucaaagcgggcaaugacauugccgcaugcuugcggaagaacggcaaaaaggugauccagcuauccaggaagaccuucgauagcgaguaugucaaaacucgcacaaaugacugggauuuugugguaaccacggacauaucugagaugggggcuaacuucaaggccgaacgugugaucgaucccagacgguguaugaaaccuguuauucugacugacggagaggaaagggucauccucgcagguccgaugccagugacacacucauccgccgcucagcgccgaggcagaauugggcggaaucccaagaacgagaaugaccaauacaucuacaugggagaaccuuuagagaacgaugaggacugcgcccauuggaaagaagcgaagaugcugcuugauaauauaaacacccccgagggcauuaucccaaguauguuugaaccugagagggaaaaaguggacgcaauugauggugaguaucgccugagaggggaggccaggaagaccuucgucgaccucaugcggcguggcgauuugcccguauggcuggcuuaccgcguggccgcugaaggaaucaauuaugcagaccgaagaugguguuuugauggcguuaagaacaaucagauacucgaggaaaacguggaggucgagaucuggacuaaagaaggggagaggaagaaacugaagccacgguggcuugacgcccgcauuuacagcgauccucuagcucugaaagaauucaaggaguucgccgcaggaagaaagucguugacauuaaaccugaucaccgaaauggguaggcucccgacauuuaugacucagaaagcgcgggacgcccuggauaaucuugcugugcugcacacggccgagguuggcgggcgagcauauaaccaugcucucucugaguugcccgaaacccuggagacacuacugcuccuuacucuguuagccaccgugacaggaggcauuuucuuguuucugauguccgguaagggggucggcaaaaugacccucggaaugugcugcaucauaacugcaagcauucugcuuugguacgcccagauccaaccacacuggaucgcugcgucaauuauccuggaauucuuucucauaguguugcugauuccugagcccgaaaagcagagaacgccacaggacaaucaguuaaccuauguagugaucgccauucuaacaguugucgcagcuacuauggccaacgagaugggcuuccuggagaaaaccaagaaggaccucgggcuuggaaguaucgccacacaagaaccugagucuaauauacuggauaucgacuugcgccccgcauccgcuuggacccuguacgccguggcgacuacauuugugacgccgaugcucaggcacagcauugaaaacucaagugucaauguuagccugaccgcuaucgccaaccaggcaacugugcuuaugggucucggcaaaggguggccacuguccaagauggauauuggaguaccuuugcuggccaucggcuguuacucucaggugaaucccauuacauuaaccgcugcacuacugcuccuugucgcccauuaugcgaucauagguccagggcugcaggcuaaagccacccgggaggcacaaaagcgugccgcugccggcauuaugaaaaaccccacaguggacggaaucacuguuaucgauuuggacccuauuccguacgaucccaaguucgaaaagcagcugggccaggugaugcuccugauacuuugcgucacgcagguauuaaugaugagaaccacaugggcacugugugaggcucucacuuuggccaccgggccaaucagcacacugugggagggaaauccuggcagguuuuggaacaccacuauugcgguguccauggccaauaucuuccgcgguucauaucuagcaggggcuggacugcucuuuucuauuaugaaaaacacgacaaauacccggcgaggcacugguaacaucggcgaaacccuuggggagaaguggaaaaguagacugaaugccuugggaaagaacgaauuccaaauauacaaaaagucgggcauccaggagguugacaggacacuggcaaaagaggggauuaagcgcggagaaacugaucaccaugcugugagccggggcuccgccaagcucagaugguuugucgagcguaacauggugacccccgaagguaaagucguggaccuggggugcggaaggggcgguuggucuuauuacuguggcggguuaaagaauguucgggaggugaaaggacuuacaaagggcgggccuggacacgaagagccaauccccaugucaacguauggcuggaaccugguacgccuccagagcgguguggaugucuucuucaccccuccagagaaaugcgacacucuacugugugauauuggggaauccagucccaauccgacaaucgaggccggacgaaccuugagaguucugucucucguggaaaacuggcuuaauaacgacacucaauuuugcauaaagguccugaauccuuacaugccaagcgugauugagaagauggaaacauugcagaggaaauacggcggcgcgcugguacggaacccccucucacgcaauuccacccaugagauguauugggugaguaacgcuacggggaauaucguuagcucugugaacaugaucuccagaauguuaauuaauagguucaccaugaagcacaaaaaggcaacauacgagccugacgucgaucugggaucagguacucgaaacauaggcaucgaaagcgagauuccaaaucuugacaucauugggaaacggaucgaaaagauaaagcaggagcacgaaaccucguggcauuaugaucaggaccaccccuacaaaacaugggccuaucauggaucuuacgagacuaagcaaaccggcagugcuuccagcauggugaacggugucgugcgucugcuaacaaaaccgugggauguuguaccuauggugacccagauggccaugacugacacgacacccuuugggcagcagagagucuucaaggagaaaguggauacccgcacucaagaaccaaaggagggaaccaagaaacucaugaagaucacagcaaaauggcuguggaaggaauugggcaaaaagaaaacgccuaggauuuguacccgggaggaguuuacuaagaagguuagaucaaacgccgcucugggcgcgaucuucacagacgaaaauaaauggaaguccgcccgcgaggcaguggaagauucuagguuuugggagcucgucgacaaagaacgaaaccuucaccuggaggggaagugcgagaccuguguguauaauaugaugggaaaacgggaaaagaaguuaggugaguucggcaaagcuaaggggagcagagccauuugguacauguggcugggagcaagguuuuuggaauucgaggcccucggcuuucugaacgaagaucacugguucagucgcgagaauucccuaagcgguguagagggggaaggacuucauaaacugggcuacauccuccgugacgugucuaagaaagagggcggggcuauguaugccgacgauacugcgggaugggacacacggauuacccuggaagauuugaagaacgaggaaaugguuacaaaucacauggagggugagcauaagaaacuggcagaagccauauuuaagcucacuuaccagaacaaagucgugagagugcagaggcccaccccacgcggcacggucauggacaucauuucacgacgggaucagagagggaguggacaaguuggcaccuauggucuuaauacauucacuaacauggaggcucagcugaucaggcagauggaaggggagggaaucuucaaguccauucaacacuuaaccgugacagaggaaguagccgugcagaauuggcuggcacgcgucggcagagagcgguugagcaggauggcuauaucuggcgacgauugcgugguuaaaccccucgacgaucguuuugccucggcucugacugcccuaaacgacauggggaaggugcgaaaggauauccagcagugggaaccuucacgcggauggaaugacuggacccaagucccauucugcagccaucacuuucacgagcuuauuaugaaagaugguagagugcugguaguuccgugucggaaccaggacgaacucaucggcagggcacgcauuucccagggggcgggauggagucugaaggagacggccugcuugggcaaaucuuacgcucagauguggagcuuaauguauuuccauagacgggaccugaggcucgccgcaaaugcuaucuguuccgccgugcccucacacugggucccuacaagucgaaccacuuggucuauacaugcaaagcacgaguggaugacaaccgaagauaugcuuacuguguggaaccguguguggauccaagagaacccauggauggaagacaaaacccccgucgagagcugggaagagguuccuuaccuggguaagagagaggaucaguggugcgggucccuaauuggacugacaucacgcgccacgugggcgaagaauauccagaccgcuauuaaccaggugcggagccucaucggcaaugaagaguauacugacuacaugccaucuaugaaaagguuuagacgcgaagaggaagaggccggcguauugugguga

SEQ ID NO: 14428 - RNA, 9876 nt, Artificial Sequence
  derived and/or modified CDS sequence (opt3) from DENV-2__FJ639699__SS-prME
accgccggcgugaucauuaugcugauacccacagcuauggcauuccaccucacuacgagaaacggggagccucauaugaucgucggaaggcaggaaaaggguaaaagccuucuguuuaagaccgaggacggcguuaauaugugcacauugauggccauugauuuaggggaacugugugaggacacuaucaccuacaaaugcccacuacuccggcaaaacgaaccggaggauauugacuguuggugcaauuccacaucuaccugggugacuuauggaacauguaccacgacuggcgagcaccgccgagaaaagcguucaguagcgcuggugccccaugucgguauggggcuugagaccagaacagaaacuuggaugaguagcgagggagcuuggaaacacgcccagaggaucgagaccuggauacugcggcauccuggcuucacaaucauggcagccauuuuggcuuacaccaucggcacgacucacuuucagcgcgcacucauuuucauccugcugacagccguggcuccauccaugaccaugagaugcauagggauuucuaacagggauuuuguugaaggagugucggguggcucaugggucgacaucgugcucgagcacgggagcuguguaacuacaauggccaagaauaagcccaccuuagauuucgaacugauuaaaacggaggcgaaggaaccugcaacccuucggaaauauugcaucgaggccaaguugacaaacacuaccacagagagucgcuguccaacucagggagaacccucccugaaugaggaacaagacaaacgauuuguuugcaagcauucuaugguggauagaggcugggguaacggguguggacuauucggcaagggcgggaucgucaccugcgcuauguuuagcugcaaaaagaauauggagggaaaaauugugcagccugaaaaccucgaguacacaauagugaucaccccacacuccggugaggaacaugccgucggcaaugacacugggaagcacggaaaagagauuaagaucacgccgcagucaaguauaacagaagcagagcugaccggcuaugguacuguuaccauggaauguagccccaggacagggcuugauuucaacgagauggugcuguugcagauggaggacaaagcuuggcucguacaccggcaaugguuucuggauuuaccucugccauggcuccccggcgccgacacccagggaucuaauuggauucagaaggaaacucuugugacauucaagaacccucaugcgaaaaagcaggacgucgugguucugggcucccaagagggggccaugcacacggcauugaccggagcuacugaaauccagaugucaagcgguaaucuacuguuuacaggccaucucaaaugccgucugcgcauggauaagcuucagcugaaagggaugaguuacucuauguguaccggaaaguucaagaucgugaaagagauugccgagacacaacacggcacuaucgucauuagagugcaguaugaaggugacggguccccaugcaagauacccuucgagaucauggauuuggaaaaaaggcauguacucggccggcugauuaccguuaacccgaucaucacggagaaggacagcccugugaacauugaagcugagcccccauuuggagauucguacauaaucauuggcgucgagccugggcaguuaaaacugaauugguucaagaagggaucuuccaucggucagauguuugaaaccacaaugcgaggcgccaaacgcauggcaauucuaggggacacugccugggauuucggaucacucggcgguguguuuaccaguaucgggaaggcucugcaccaagucuucggcgcgauauacggagcagccuuuagcggcguguccuggacaaugaaaauccuuauugggguuaucauuacuuggaucggaaugaacucuagaagcaccucauugagugugucccugguacucgucggcgugauaacgcuguaucuuggugcuaugguucaggccgacagcggguguguggucucuuggaagaauaaagagcugaagugcggaucaggcauuuucaucacagauaacgugcacaccuggacugaacaguacaaguuucagcccgagaguccaagcaaauuggcauccgccauucaaaaggcucaugaagaggguaucuguggcauaaggucuguaacacggcucgagaaucugauguggaaacagaucacccccgaauuaaaccacauucugucggagaaugaagugaagcuaacuaucaugaccggggacauuaaaggaaucaugcaggccggcaagcgcagccucagaccucagccaacagagcugaaauauuccuggaagacgugggggaaggcaaaaaugcuuucaaccgaaagucauaaccaaacuuucuugauagauggaccggagacagcggagugccccaauaccaacagggcuuggaauucucuggaaguugaggacuacggcuuuggugucuucacaacuaacauuuggcucaagcugaaagaaaagcaggacguguuuugugauagcaaauuaauguccgccgcaaucaaggacaaucgugccgugcacgcugauaugggguauuggaucgagucagcccugaacgacaccuggaagauggagaaagcaagcuucauugaagucaagucuugccacuggccuaaaucccauacgcuuuggaguaauggaguuuuggagagcgaaaugaucauuccaaagggcuucgcuggucccgugucucagcacaacuaccggccuggcuauuacacacagaccgccgggccauggcaucucggaaaacuggagauggauuuugacuucugugaaggcacuaccgugguagucacagaggauugcgggaaccgaggacccucccuaagaacuaccacagcgucaggcaagcugauaacggaguggugcuguaggaguugcacccucccgccucugcgcuaccggggugaagacggguguugguauggaauggagaucagaccacuuaaggaaaaagaggaaaauuuggugaacagccugguuacugccggccacggucaaauugauaauuuuucguuaggcgugcucgggauggcucuguuccuugaggagaugcugaggacacgcgucggaaccaagcaugcaaucuugcucguggccguuuccuuugugacucugauuacaggcaacaugucuuuccgagaccuagggcggguaauggucauggugggagcuaccaugacggaugacaucggcaugggugugacuuaccuggcccuccuggcagcguuuaaaguccgucccaccuucgccgcugggcuuuugcugagaaaguuaacaagcaaagaacucaugauggccaccauaggaaucgcacugcuuucacagaguacuauuccugagacaauccuggaacuaaccgaugcucucgcccugggcaugaugauuuugaagaucguuaggaauauggagaaguaucagcuggcagugacaauaauggccauuuccugcguacccaacgcugugaucuuacaaaaugcguggaaagucucuuguacuauccucgccgcagugagcguuuccccacugcuucugaccucaagccagcagaaggcugacuggauuccuuuggcccucacgauaaaaggccugaaccccacagccaucuuucuaaccacucugagucgcaccucuaagaaacgguccuggccacuuaaugaagcuauuauggcaguggggauggucagcauccucgccucgucacuguugaagaacgacauuccgaugacaggaccucugguggcggguggcuuacucacuguuugcuacgugcugaccgggagaucugcugaucuugagcuggagagggccacggacgucaaaugggaagaucaggcagagaucaguggauccagccccauauugucuaucacaauuagcgaagacggcuccaugucaaucaagaaugaggaggaagagcaaacccucacuauucugauccgaacaggucuacugguaauaagugggcuuuucccagugagcauucccaucaccgccgcugcaugguaucucugggaaguuaagaaacagcgcgccggagugcugugggaugucccuucuccacccccugugggcaaggcggaguuggaagacggcgcuuaccggaucaaacagaaggggauuuuaggauauucccagaucggugccggcguauacaaagaggggacuuuucacacaauguggcacgugaccagaggagcaguccugaugcauaggggcaagcguauagagccgucaugggccgauguuaagaaagaccucauuaguuacggugggggauggaagcuggaaggcgaguggaaagaaggcgaggaagugcaagugcuugcucuggagccagggaagaacccccgcgccguccagacgaaaccuggauuguucaagacuaauaccgguacaaucggcgcagugagccuagauuuuuccccagggaccucuggaucgcccauuguugaccggaagggcaaaguagugggucuguaugggaacggagucgugacaagaagcggcgcuuacguuucagccaucgcgcagacugagaaguccauagaagauaauccugagauugaagacgauaucuucaggaaaaagcgacucaccaucauggaccugcacccgggcgccgggaaaacgaagcgguaucuucccgcaauugugcgcgaggcuaucaagagaggauuaaggacacugauucucgccccaacucgggucguggcugcagaaauggaggaggccuugcgaggucugccuauaagauaccagacccccgccauccgcgcugaacauacaggcagggagauuguagaccucaugugucacgcgaccuucacuaugcgucugcuuaguccaguccgggugccuaacuauaaccugaucaucauggaugaagcacauuuuaccgaccccgccucuauugcugccagaggguacauaagcacaaggguugagaugggagaggcagccggcaucuucaugacggcuacuccaccggguucccgcgauccuuuuccccaaucaaaugcgccaauuauggacgaagagcgagaaauccccgagagaucuuggaacagcgggcacgaaugggugaccgauuucaaaggaaagacagucugguuugugccuaguauuaaagccggcaaugacaucgcagcuugcuugcggaagaacggcaaaaagguuauacagcuauccaggaagaccuucgauagcgaguaugugaaaacucgcacaaaugacugggauuuugucgugaccacggacaucucugagaugggggccaacuucaaggcagaacguguaauugauccaagacgguguaugaaacccgugauccugacugacggagaggaaaggguuauucucgccgguccuaugccggucacacacucauccgcugcccagcgccgaggcagaaucgggcggaauccaaagaacgagaaugaccaauacauauacaugggagaacccuuagagaacgaugaggacugcgcgcauuggaaagaagcaaagaugcugcuugauaauauuaacaccccugagggcaucauucccaguauguuugaaccagagagggaaaaaguggacgccaucgauggugaguaucgccugagaggggaggcuaggaagaccuucguggaccucaugcggcguggcgauuugccugucuggcuggccuaccgcguagcugcagaaggaauaaauuaugccgaccgaagaugguguuuugauggcgugaagaacaaucagauccucgaggaaaacguugagguggagauuuggacuaaagaaggggagaggaagaaacugaagccccgguggcuugacgcucgcaucuacagcgauccacuagcccugaaagaauucaaggaguucgcagcgggaagaaagucguugacauuaaaccugauuaccgaaauggguaggcucccuacauuuaugacucagaaagcccgggacgcucuggauaaucuugccguccugcacacggcagaggugggcgggcgagcuuauaaccaugcccucucugaguugccggaaacccuggagacacuacugcuccuuacucuguuagcaaccguuacaggaggcaucuucuuguuucugauguccgguaagggggugggcaaaaugacccucggaaugugcugcauaauuacugccagcauccugcuuugguacgcucagauccaaccccacuggauugcggccucaaucauacuggaauucuuucucauugucuugcugaucccagagccugaaaagcagagaacgccccaggacaaucaguuaaccuaugugguaauugcaauccuaacagugguugcugccacuauggccaacgagaugggcuuccuggagaaaaccaagaaggaccucgggcuuggaaguauagcaacacaagaaccagagucuaauauccuggauauugacuugcgcccugcuuccgccuggacccuguacgcggucgcuacuacauuugugacgcccaugcucaggcacagcaucgaaaacucaagugugaaugucagccugaccgccauugcaaaccaggccacuguucuuaugggucucggcaaaggguggccgcuguccaagauggauaucggagugccauugcuggcuauuggcuguuacucucagguaaauccuaucacauuaaccgcagcccuacugcuccuuguggcgcauuaugcuauaauuggucccgggcugcaggccaaagcaacccgggaggcccaaaagcgugcugccgcaggcaucaugaaaaacccaacagucgacggaaucacugugauugauuuggaccccauaccuuacgauccgaaguucgaaaagcagcugggccagguuaugcuccugauccuuugcgugacgcaggucuuaaugaugagaaccacaugggcucugugugaggcccucacuuuggcgaccgggcccauuagcacacugugggagggaaauccaggcagguuuuggaacaccacuaucgccguauccauggcaaauauuuuccgcgguucauaucuagcuggggccggacugcucuuuucuaucaugaaaaacacgacaaauacccggcgaggcacugguaacauaggcgaaacccuuggggagaaguggaaaaguagacugaaugcauugggaaagaacgaauuccaaaucuacaaaaagucgggcauucaggagguggacaggacacuggcuaaagaggggaucaagcgcggagaaacugaucaccaugccguuagccggggcuccgccaagcucagaugguuuguggagcguaacauggucaccccugaagguaaaguggucgaccuggggugcggaaggggcgguuggucuuauuacuguggcggguuaaagaaugugcgggagguuaaaggacuuacaaagggcgggcccggacacgaagagccuauuccaaugucaacguauggcuggaaccuggugcgccuccagagcgguguagauguguucuucacccccccugagaaaugcgacacucuacugugugauaucggggaauccaguccaaaucccacaauagaggcgggacgaaccuugagaguccugucucucguugaaaacuggcuuaauaacgacacucaauuuugcauuaaggugcugaauccguacaugccuagcgucaucgagaagauggaaacauugcagaggaaauacggcggcgcucuggugcggaacccacucucacgcaauuccacccaugagauguauuggguaaguaacgcaacggggaauaucgugagcucuguuaacaugauuuccagaauguuaauaaauagguucaccaugaagcacaaaaaggccacauacgagcccgacguggaucugggaucagguacucgaaacaucggcauugaaagcgagaucccuaaucuugacauuaucgggaaacggauagaaaagaucaagcaggagcacgaaaccucguggcauuaugaucaggaccacccauacaaaacaugggcuuaucauggaucuuacgagacuaagcaaaccggcagugccuccagcauggucaacggugugguccgucugcuaacaaaacccugggaugugguuccgaugguaacccagauggcaaugacugacacgacaccuuuugggcagcagagaguguucaaggagaaagucgauacccgcacucaagaacccaaggagggaaccaagaaacucaugaagauuacagccaaauggcuguggaaggaauugggcaaaaagaaaacgccaaggaucuguacccgggaggaguuuacuaagaaggugagaucaaacgcugcgcugggcgccauuuucacagacgaaaauaaauggaaguccgcacgcgaggcuguugaagauucuagguuuugggagcucguggacaaagaacgaaaccuucaccuggaggggaagugcgagaccugugucuauaauaugaugggaaaacgggaaaagaaguuaggugaguucggcaaagccaaggggagcagagcaaucugguacauguggcugggagccagguuuuuggaauucgaggcucucggcuuucugaacgaagaucacugguucagucgcgagaauucccuaagcgguguggagggggaaggacuucauaaacugggcuacauucuccgugacguaucuaagaaagagggcggggccauguaugcggacgauacugcaggaugggacacacggauaacccuggaagauuugaagaacgaggaaauggugacaaaucacauggagggugagcauaagaaacuggccgaagcuaucuuuaagcucacuuaccagaacaaaguugucagagugcagaggccuaccccccgcggcacggugauggacauuaucucacgacgggaucagagagggaguggacaagucggcaccuauggucuuaauacauucacuaacauggaggcccagcugaucaggcagauggaaggggagggaauuuucaaguccauacaauacuuaaccguuacagaggaaguggcaguacagaauuggcuggcucgcgugggcagagagcgguugagcaggauggccaucucuggcgacgauugcgucgugaaaccacucgacgaucguuuugcuucggcccugacugcacuaaacgacauggggaagguucgaaaggauauucagcagugggaacccucacgcggauggaaugacuggacccaagugccuuucugcagccaccauuuucacgagcuuaucaugaaagaugguagaguccuggugguaccaugucggaaccaggacgaacucauuggcagggcgcgcaucucccagggggccggauggagucugaaggagacggcuugcuugggcaaaucuuaugcccagauguggagcuuaauguacuuccacagacgggaccugaggcucgcagcuaaugccauauguuccgcaguuccgucacauugggugcccacaagucgaaccacuuggucuauccacgccaagcaugaguggaugacaaccgaagauaugcuuacugucuggaaccguguguggauucaagagaacccuuggauggaagacaaaaccccaguggagagcugggaagagguccccuaucuggguaagagagaggaucaguggugcgggucccuaaucggacugacaucacgcgcgacgugggcuaagaauauucagaccgccaucaaccagguucggagccucauaggcaaugaagaguacacugacuacaugccuucuaugaaaagguuuagacgcgaagaggaagaggcaggcguguugugguga

SEQ ID NO: 14429 - RNA, 9876 nt, Artificial Sequence
  derived and/or modified CDS sequence (opt3) from DENV-2__FJ639700__SS-prME
accgccggcgugaucauuaugcugauacccacagcuauggcauuccaccucacuacgagaaacggggagccucauaugaucgucggaaggcaggaaaaggguaaaagccuucuguuuaagaccgaggacggcguuaauaugugcacauugauggccauugauuuaggggaacugugugaggacacuaucaccuacaaaugcccacuacuccggcaaaacgaaccggaggauauugacuguuggugcaauuccacaucuaccugggugacuuauggaacauguaccacgacuggcgagcaccgccgagaaaagcguucaguagcgcuggugccccaugucgguauggggcuugagaccagaacagaaacuuggaugaguagcgagggagcuuggaaacacgcccagaggaucgagaccuggauacugcggcauccuggcuucacaaucauggcagccauuuuggcuuacaccaucggcacgacucacuuucagcgcgcacucauuuucauccugcugacagccguggcuccauccaugaccaugagaugcauagggauuucuaacagggauuuuguugaaggagugucggguggcucaugggucgacaucgugcucgagcacgggagcuguguaacuacaauggccaagaauaagcccaccuuagauuucgaacugauuaaaacggaggcgaaggaaccugcaacccuucggaaauauugcaucgaggccaaguugacaaacacuaccacagagagucgcuguccaacucagggagaacccucccugaaugaggaacaagacaaacgauuuguuugcaagcauucuaugguggauagaggcugggguaacggguguggacuauucggcaagggcgggaucgucaccugcgcuauguuuagcugcaaaaagaauauggagggaaaaauugugcagccugaaaaccucgaguacacaauagugaucaccccacacuccggugaggaacaugccgucggcaaugacacugggaagcacggaaaagagauuaagaucacgccgcagucaaguauaacagaagcagagcugaccggcuaugguacuguuaccauggaauguagccccaggacagggcuugauuucaacgagauggugcuguugcagauggaggacaaagcuuggcucguacaccggcaaugguuucuggauuuaccucugccauggcuccccggcgccgacacccagggaucuaauuggauucagaaggaaacucuugugacauucaagaacccucaugcgaaaaagcaggacgucgugguucugggcucccaagagggggccaugcacacggcauugaccggagcuacugaaauccagaugucaagcgguaaucuacuguuuacaggccaucucaaaugccgucugcgcauggauaagcuucagcugaaagggaugaguuacucuauguguaccggaaaguucaagaucgugaaagagauugccgagacacaacacggcacuaucgucauuagagugcaguaugaaggugacggguccccaugcaagauacccuucgagaucauggauuuggaaaaaaggcauguacucggccggcugauuaccguuaacccgaucaucacggagaaggacagcccugugaacauugaagcugagcccccauuuggagauucguacauaaucauuggcgucgagccugggcaguuaaaacugaauugguucaagaagggaucuuccaucggucagauguuugaaaccacaaugcgaggcgccaaacgcauggcaauucuaggggacacugccugggauuucggaucacucggcgguguguuuaccaguaucgggaaggcucugcaccaagucuucggcgcgauauacggagcagccuuuagcggcguguccuggacaaugaaaauccuuauugggguuaucauuacuuggaucggaaugaacucuagaagcaccucauugagugugucccugguacucgucggcgugauaacgcuguaucuuggugcuaugguucaggccgacagcggguguguggucucuuggaagaauaaagagcugaagugcggaucaggcauuuucaucacagauaacgugcacaccuggacugaacaguacaaguuucagcccgagaguccaagcaaauuggcauccgccauucaaaaggcucaugaagaggguaucuguggcauaaggucuguaacacggcucgagaaucugauguggaaacagaucacccccgaauuaaaccacauucugucggagaaugaagccaagcuaacuaucaugaccggggacauuaaaggaaucaugcaggcaggcaagcgcagccucagaccucagccaacagagcugaaauauuccuggaagacgugggggaaggcgaaaaugcuuucaaccgaaagucauaaccaaacuuucuugauagauggaccggagacagcugagugccccaauaccaacagggccuggaauucucuggaaguggaggacuacggcuuugguguuuucacaacuaacauuuggcucaagcugaaagaaaagcaggacgucuuuugugauagcaaauuaauguccgcagccaucaaggacaaucgugcugugcacgccgauaugggguauuggaucgagucagcacugaacgacaccuggaagauggagaaagcuagcuucauugaagugaagucuugccacuggccuaaaucccauacgcuuuggaguaauggagucuuggagagcgaaaugaucauuccaaagggcuucgccggucccguuucucagcacaacuaccggccuggcuaucauacacagaccgcggggccauggcaccucggaaaacuggagauggauuuugacuucugugaaggcacuaccguggugguaacagaggauugcgggaaccgaggacccucccuaagaacuaccacagccucaggcaagcugauaacggaguggugcuguaggaguugcacccucccgccucugcgcuaccggggugaagacggguguugguacggaauggagaucagaccacuuaaggaaaaagaggaaaauuuggucaacagccuggugacugcuggccauggucaaauugauaauuuuucguuaggcguucucgggauggcacuguuccuugaggagaugcugaggacacgcgugggaaccaagcacgccaucuugcucgucgcuguguccuuuguuacucugauuacaggcaacaugucuuuccgagaccuagggcgggugaugguaauggucggagccaccaugacggaugacaucggcaugggugugacuuaucuggcacuccuggcggccuuuaaagugcgucccaccuucgcugccgggcuuuugcugagaaaguuaacaagcaaagaacucaugauggcaaccauaggaaucgcucugcuuucacagaguacuauuccugagacaauccuggaacuaaccgaugcccucgcacugggcaugaugauuuugaagaucgucaggaauauggagaaguaccagcuggccguuacaauaauggcuauuuccugcgugcccaacgcgguaaucuuacaaaaugccuggaaagugucuuguacuauccucgcagcugucagcguguccccacugcuucugaccucaagccagcagaaggccgacuggauuccuuuggcccucacgauaaaaggccugaaccccacagcuaucuuucuaaccacucugagucgcaccucuaagaaacgguccuggccacuuaaugaagcaauuauggccguugggauggugagcauccucgcgucgucacuguugaagaacgacauuccgaugacaggaccucuggucgcugguggcuuacucacugugugcuauguucugaccgggagaucugccgaucuugagcuggagagggcaacggacgugaaaugggaagaucaggccgagaucaguggauccagccccauauugucuaucacaauuagcgaagacggcuccaugucaaucaagaaugaggaggaagagcaaacccucacuauucugauccgaacaggucuacuggucauaagugggcuuuucccaguaagcauucccaucaccgcugcagccugguaccucugggaagugaagaaacagcgcgcgggaguucugugggaugugccuucuccacccccugucggcaaggcugaguuggaagacggcgccuaucggaucaaacagaaggggauuuuaggauacucccagaucggugcaggcguguauaaagaggggacuuuucacacaauguggcauguaaccagaggagccgugcugaugcacaggggcaagcguauagagccgucaugggcugaugucaagaaagaccucauuaguuacggugggggauggaagcuggaaggcgaguggaaagaaggcgaggaaguucaagugcuugcccuggagccagggaagaacccccgcgcagugcagacgaaaccuggauuguucaagacuaauaccgguacaaucggcgcugucagccuagauuuuuccccagggaccucuggaucgcccauuguggaccggaagggcaaaguuguaggucuguacgggaacggaguggucacaagaagcggcgccuaugugucagcgaucgcccagacugagaaguccauagaagauaauccugagauugaagacgauaucuucaggaaaaagcgacucaccaucauggaccugcauccgggcgcagggaaaacgaagcgguaccuucccgcuauuguucgcgaggccaucaagagaggauuaaggacacugauucucgcuccaacucggguggucgcagccgaaauggaggaggccuugcgaggucugccuauaagauaucagacccccgcuauccgcgcggaacacacaggcagggagauuguggaccucaugugucaugcaaccuucacuaugcgucugcuuaguccaguacgggucccuaacuacaaccugaucaucauggaugaagcccacuuuaccgaccccgcuucuauugccgcaagaggguauauaagcacaaggguggagaugggagaggccgcuggcaucuucaugacggcgacuccaccggguucccgcgauccuuuuccccaaucaaaugccccaauuauggacgaagagcgagaaauccccgagagaucuuggaacagcgggcacgaauggguuaccgauuucaaaggaaagacagugugguuugucccuaguauuaaagcaggcaaugacaucgcugccugcuugcggaagaacggcaaaaaggugauacagcuauccaggaagaccuucgauagcgaguacguuaaaacucgcacaaaugacugggauuuuguggucaccacggacaucucugagaugggggcaaacuucaaggccgaacgugugauugauccaagacgguguaugaaacccguaauccugacugacggagaggaaagggugauucucgcugguccuaugccgguuacacauucauccgccgcgcagcgccgaggcagaaucgggcggaauccaaagaacgagaaugaccaauauauauacaugggagaacccuuagagaacgaugaggacugcgcacacuggaaagaagccaagaugcugcuugauaauauuaacaccccugagggcaucauucccaguauguuugaaccagagagggaaaaagucgacgcuaucgauggugaguaccgccugagaggggaggccaggaagaccuucguggaccucaugcggcguggcgauuugccuguguggcuggcuuaucgcgucgcagccgaaggaauaaauuacgcugaccgaagaugguguuuugauggcguaaagaacaaucagauccucgaggaaaacguggagguugagauuuggacuaaagaaggggagaggaagaaacugaagccccgguggcuugacgcccgcaucuauagcgauccacuagcacugaaagaauucaaggaguucgcggccggaagaaagucguugacauuaaaccugauuaccgaaauggguaggcucccuacauuuaugacucagaaagcucgggacgcccuggauaaucuugcagugcugcauacggcugaggucggcgggcgagccuacaaccacgcacucucugaguugccggaaacccuggagacacuacugcuccuuacucuguuagccaccgugacaggaggcaucuucuuguuucugauguccgguaaggggguuggcaaaaugacccucggaaugugcugcauaauuacugcuagcauccugcuuugguaugcgcagauccaaccccacuggauugccgcaucaaucauacuggaauucuuucucauuguguugcugaucccagagccugaaaagcagagaacgccccaggacaaucaguuaaccuacgucgugauugcuauccuaacaguaguggccgccacuauggcaaacgagaugggcuuccuggagaaaaccaagaaggaccucgggcuuggaaguauagcuacacaagaaccagagucuaauauccuggauauugacuugcgcccugccuccgcguggacccuguaugcuguugccacuacauuugucacgcccaugcucaggcauagcaucgaaaacucaagugugaaugugagccugaccgcaauugccaaccaggcuacuguccuuaugggucucggcaaaggguggccgcuguccaagauggauaucggaguuccauugcuggcaauuggcuguuacucucaggugaauccuaucacauuaaccgccgcgcuacugcuccuuguagcucacuacgccauaauuggucccgggcugcaggcaaaagccacccgggaggcucaaaagcgugccgcagcuggcaucaugaaaaacccaacaguggacggaaucacugucauugauuuggaccccauaccuuaugauccgaaguucgaaaagcagcugggccaggugaugcuccugauccuuugcguuacgcagguguuaaugaugagaaccacaugggcccugugugaggcgcucacuuuggccaccgggcccauuagcacacugugggagggaaauccaggcagguuuuggaacaccacuaucgcagucuccauggcuaauauuuuccgcgguucauaccuagccggggcaggacugcucuuuucuaucaugaaaaacacgacaaauacccggcgaggcacugguaacauaggcgaaacccuuggggagaaguggaaaaguagacugaaugcuuugggaaagaacgaauuccaaaucuauaaaaagucgggcauucaggagguagacaggacacuggccaaagaggggaucaagcgcggagaaacugaucaucacgccgugagccggggcuccgcgaagcucagaugguuuguugagcguaacauggugaccccugaagguaaagucguggaccuggggugcggaaggggcgguuggucuuacuauuguggcggguuaaagaauguccgggaggugaaaggacuuacaaagggcgggcccggacaugaagagccuauuccaaugucaacguacggcuggaaccugguucgccuccagagcgguguggauguauucuucacccccccugagaaaugcgacacucuacugugugauaucggggaauccaguccaaaucccacaauagaggcuggacgaaccuugagagugcugucucucgucgaaaacuggcuuaauaacgacacucaauuuugcauuaagguucugaauccguauaugccuagcgugaucgagaagauggaaacauugcagaggaaauacggcggcgcacugguccggaacccacucucacgcaauuccacccacgagauguacugggugaguaacgccacggggaauaucguaagcucugugaacaugauuuccagaauguuaauaaauagguucaccaugaagcacaaaaaggcuacauaugagcccgacguugaucugggaucagguacucgaaacaucggcauugaaagcgagaucccuaaucuugacauuaucgggaaacggauagaaaagaucaagcaggagcaugaaaccucguggcacuacgaucaggaccauccauauaaaacaugggccuaccacggaucuuaugagacuaagcaaaccggcagugcauccagcauggugaacggugucgugcgucugcuaacaaaacccugggaugucgugccgaugguuacccagauggccaugacugacacgacaccuuuugggcagcagagaguauucaaggagaaaguggauacccgcacucaagaacccaaggagggaaccaagaaacucaugaagauuacagcuaaauggcuguggaaggaauugggcaaaaagaaaacgccaaggaucuguacccgggaggaguuuacuaagaaggucagaucaaacgcggcccugggcgcaauuuucacagacgaaaauaaauggaaguccgcucgcgaggccguggaagauucuagguuuugggagcucguugacaaagaacgaaaccuucaccuggaggggaagugcgagaccuguguguacaauaugaugggaaaacgggaaaagaaguuaggugaguucggcaaagcaaaggggagcagagccaucugguauauguggcugggagcuagguuuuuggaauucgaggcccucggcuuucugaacgaagaucauugguucagucgcgagaauucccuaagcggugucgagggggaaggacuucacaaacugggcuacauucuccgugacgugucuaagaaagagggcggggcgauguacgcagacgauacugccggaugggacacacggauaacccuggaagauuugaagaacgaggaaaugguaacaaaucauauggagggugagcacaagaaacuggcugaagccaucuuuaagcucacuuaucagaacaaagugguuagaguccagaggccuaccccccgcggcacggugauggacauuaucucacgaaaggaucagcgggggaguggacaagugggcaccuacggucuuaauacauucacuaacauggaggcacagcugaucagacagauggaaggggagggaauuuucaaauccauacaauauuuaaccgucacagaggaaguugcugugcagaauuggcuggccaggguaggccgcgagagauugagccggauggcuaucucuggcgacgauugcguggucaagccacucgacgauagguuugccucggcacugacugcgcuaaacgacauggggaaggugcguaaagauauucagcagugggaacccucacgaggauggaaugacuggacccaaguuccuuucugcagccaucacuuucacgagcuuaucaugaaggauggucgcgugcuggucgugccauguagaaaccaggacgaacucauuggccgggccaggaucucccagggggcuggauggagucugaaagagacggccugcuugggcaagucuuacgcacagauguggagcuuaauguauuuccaucgcagagaccugcggcucgcugccaaugcaauauguuccgccguaccgucacacuggguucccacaaguaggaccacuuggucuauccaugcgaaacacgaguggaugacaaccgaagauaugcuuacuguguggaaccgagucuggauucaagagaacccuuggauggaagacaagaccccaguggagagcugggaagaggugcccuaccuggguaagcgugaggaucaguggugcgggucccuaaucggacugacaucaagagcuacgugggccaaaaauauucagaccgcaaucaaccagguccgcagccucauaggcaaugaagaguauacugacuacaugccuucuaugaagcgguuuaggagagaagaggaagaggccggcguuuugugguga

SEQ ID NO: 14430 - RNA, 9876 nt, Artificial Sequence
  derived and/or modified CDS sequence (opt3) from DENV-2__GQ868620__SS-prME
agcgccggaaugauaauuaugcugauacccaccgugauggcuuuccaccucaccacuagaaacggggagccucauaugaucgucgguauucaagaaaaggguaaaucccuucuguuuaagacggaggacggcguuaauaugugcaccuugauggcaauggauuuaggggaacugugugaggacacaaucacuuacaaaugcccacuacucaggcaaaacgaaccggaggauauugacuguuggugcaauucuaccucaacaugggugaccuauggaacuuguacaaccacgggcgagcaccggcgcgaaaagcgaaguguagcccuggugccccaugucgguauggggcuugagacucguaccgaaacauggaugagcuccgagggagcguggaaacacgcucagagaaucgagacuuggauacugaggcauccuggcuucaccaucauggccgcaauuuuggccuacacaaucggcaccacgcacuuucagcgggcucucauuuucauccugcugacugcaguggccccaucuaugacaaugcgcugcauagggauuucgaacagagauuuuguugaaggagugucagguggcagcugggucgacaucgugcucgagcacgggaguuguguaaccacuauggcuaagaauaagcccacauuagauuucgaacugauuaaaaccgaggccaagcagccugcgacgcuuaggaaauauugcaucgaagcaaaguugaccaacacaacuaccgagucccgguguccaacacaaggagagcccucucugaaagaggaacaggacaagcgcuuuguuugcaagcauagcaugguggaucgaggcugggguaauggguguggacuauucggcaaaggcgggaucgucacuugcgccauguuuaccugcaagaaaaacauggaaggaaagauugugcagccugagaaucucgaauacacaauaguggucaccccacacuccggugaggagcaugcuguuggcaacgacacugggaaacacggaaaggaaaucaaagugacgccgcagucaaguauuacagaggccgaacugaccggcuaugguacuguaaccauggaguguagccccagaacagggcuugauuucaaugaaauggugcuguugcaaauggagaacaaggcauggcucguccacaggcagugguuucuggacuuaccucugccauggcuccccggcgcugauaagcagggaucuaauuggauccagaaagagacccuugugacuuucaagaacccucaugccaaaaagcaagacguugugguccugggcucccaggaaggggcgaugcacacagccuugacgggagcaaccgagauacagaugucaagcgguaaucuacuguuuacuggccaucucaaaugccggcugcguauggacaaacuucaacugaaggggaugaguuacucuauguguacaggaaaauucaaggugguaaaagaaauugcugagacccagcacggcacaaucguuauccgcgugcaguaugagggugauggguccccaugcaagauucccuucgaaaucauggacuuggagaaaagauacguccucggcaggcugauuacugugaacccgauagucaccgaaaaggauagcccugugaacaucgaggccgaacccccauuuggagacucguacauuaucaucggcguugagccugggcaguuaaagcugaauugguucaaaaagggaucuuccauuggucaaauguuugagacgaccaugcggggcgcuaaacgaauggccauacuaggggauacagcaugggacuucggaucacucggcgguguguuuacaaguaucgggaaggcccugcaucagguauucggcgcuauuuauggagcggcauuuagcggcgucuccuggaccaugaaaauccuuauuggggugaucauaacauggaucggaaugaacucucgcagcacuucauugaguguuucccuggugcucgucggcauugugacccuguaccuugguguaauggugcaggccgauagcggguguguugucucuuggaagaauaaggaacugaaaugcggaucaggcaucuucauuacggacaacgugcacacauggaccgagcaguauaaguuucaacccgaaaguccaagcaaauuggcuuccgccauccagaaggcacaggaggaagguauauguggcauuagaucugugacuaggcucgagaaucugauguggaaacagaucacacccgaguuaaaccacauucuggccgaaaaugaggucaagcuaaccaucaugacuggggauauaaaaggaaucaugcaagcuggcaagcggucgcuccgcccucagccaaccgaacugaaguacagcuggaaaacaugggggaaggccaaaaugcuuuccacggagucacauaaccagaccuucuugauugacggaccggaaacugcagagugccccaauacaaacagagcguggaauagucuggagguugaagauuauggcuuugguguguucaccacaaacaucuggcucaagcugaaagagaagcaggacgcuuuuugugacucuaaguuaaugagcgccgcaauuaaagauaauagggccgugcacgcugacaugggguacuggaucgaauccgcccugaacgauacuuggaagauagagaaagcaucauucauugagguaaagaauugccauuggccuaaaagccacacccuuuggucuaacggagucuuggaauccgagaugaucaucccaaagaaccucgcuggccccgugagucaacacaauuaucguccugguuaccauacgcagauugccggcccauggcaccuggggaagcuagaaauggacuucgauuuuugugacggaacaaccguuaucgugacugaggauugcggcaaccgggggcccagccugcgaaccacaacugcgucuggaaaacucauuaccgaauggugcuguagauccugcacacugccgccucuuagguaccgcggcgaggacgguuguugguaugggauggagauacggccauugaaggaaaaagaggaaaaucuggucaacucauuagugacggccggacauggccagguugauaauuucagucucggugugcugggcauggcucuuuuucuggaggaaauguugagaaccaggguagggacuaagcacgcaauccuccuggucgccgugagcuucgugacacuaauuaccggaaacaugucguuuaaagaccugggccgcgucguugugaugguaggggcuacuaugacagaugacaucggaaugggcgugaccuaccucgcccugcuugcagcguucaagguccgacccacguuugccgcugguuugcuguuacggaagcucacuuccaaagagcugaugaugaccacaauugggaucgugcuucugucucaaagcaccauaccugagacuauccuagaacucacagaugcccuggcauugggaaugaugguucugaagauugugcguaauauggagaaauaucaguuagcugucaccaucauggccauucucugcgugcccaacgcaguuauccugcagaaugccuggaaggugucauguacaauacuugcugucguaaguguguccccacuguugcucacuucuagccagcagaagacagacuggauuccucuggcgcuaacgaucaagggccugaaccccacagccaucuuccuuaccacucucuccagaaccaauaaaaagaggucauggccacugaacgaagcaauuauggcuguuggcauggugagcauauuggccaguucucuguuaaagaaugacaucccgaugacagggccucucgucgccggaggucugcuuacugugugcuacguacugaccggccgcuccgcugauuuggagcucgaacgggcaacggacgugaaaugggaggaucaggccgagauuagcgggucgucacccauccugucuauuacaaucagugaagacggauccaugagcauaaagaacgaggaagaggagcagacccuaacuauccugauuagaacaggccuucucgucaucucuggucuguuuccaguuagcauucccaucaccgcggcugccugguauuugugggaagugaaaaagcagagggcagggguguuaugggaugucccuuccccacccccuaugggaaaagccgagcuggaagacggcgcuuaccgaauaaagcaaaagggcauucucggguauucacagaucggagcaggaguguacaaagagggcacuuuccauacaauguggcacguuacccgcggggccguacugaugcacaagggaaaacggaucgaaccgaguugggcggaugugaagaaagaccuuauuagcuacggcgguggguggaagcuggagggagaguggaaggaaggcgaggaaguccagguguuggcucuagagccaggcaaaaaucccagaguugugcagacgaagccugggcuguuuaaaacuaacaccggaacaaucggugccgucucucucgauuucuccccaggcaccucagggagucccauaauugacaagaaaggaaaggugguaggccuguaugguaacggggucgugacaaggagcggagcauacguuuccgccaucgcucaaacugaaaagucuauugaggauaauccugagaucgaagacgauauauuucguaaacgccggcuuaccauuauggacuuacauccgggcgccggcaagacgaaaagauaucugcccgcaaucgugagggaggcuaucaagcgagggcuccggacauugauucuggccccaacucgcgucguggcggccgaaauggaggaagcacucagaggacugccuaucagguaccagacccccgcuauucgggccgagcacacaggucgagagauaguugaccuuaugugucaugcuaccuucacuaugagacuguugucgccagugcgcgucccuaacuauaaucuaaucauuauggaugaagcacacuucaccgaccccgccagcaucgccgcuaggggcuacaucucaacacguguggagaugggggaagcggcaggaauuuuuaugacggccacuccaccgggcucccgggauccuuucccccagaguaacgcuccaauaaucgacgaggagagagaaauucccgagaggucuuggaauagcggucaugaauggguaaccgauuuuaaagggaagacagugugguucguuccuuccaucaaggccggaaacgacauugcagccugccugcgcaaaaauggcaagaaagucauccaacucucacgaaagaccuuugauucugaguaugugaaaacuagaacaaacgacugggauuucguggucaccacggacauaagcgaaaugggcgcuaauuuuaaggcggagcggguaaucgauccaaggcgcuguaugaaacccgugauuuuaacugacggggaggaacguguuauccuggccggaccuaugccggugacacacaguuccgcagcucagagacgggguaggauuggccgcaacccaaagaaugagaacgaccaguacaucuacaugggggaaccccuugagaaugaugaagacugcgcccacuggaaggaggcaaaaaugcugcucgauaacauaaauaccccugagggaauuauccccagcauguucgaaccagagcgagaaaaggucgacgccauugauggcgaguauagauugcggggugaagcuaggaaaaccuuuguggaccugaugcgcagaggggaucucccuguuuggcuggccuacaagguggcggcagagggcaucaacuaugccgacaggcggugguguuucgauggaaucaaaaacaaucagauccuugaggaaaacgucgagguggaaauuuggacuaaggagggcgagcguaagaaacuaaagccccgcuggcuggacgcucgaaucuacucugauccauuggccuuaaaagaauuuaaggaguucgcugcagggagaaaaucacugacacucaaucugauuaccgaaaugggaaggcuuccuacauucaugacucaaaagacgcgggacgcccuggauaaccucgcuguauugcauaccgccgaggcggguggacgcgcauauaaucacgcccuguccgaacuaccggagacacuggagacucuccuucuguuaaccuugcuggcuacagugaccgggggaaucuuucucuuccugaugaguggcagagguauagggaagaugacucuuggcaugugcugcauuaucacggccagcauccugcucugguacgcacagauucagccccauuggaucgcugccucgauaauuuuggaauuuuuccugaucguuuuacuaauuccagagccugaaaaacagaggacaccccaagacaaccagcugacauaugucgugaucgcaauacucacuguggucgccgcuaccauggcgaaugagaugggauuucuugaaaagacuaaaaaggaccugggcuuggggucuaucgccacccagcagccagaguccaacauucuggauaucgaccuccggccugcaagcgcuuggacucuguacgccguugccacaacguucgugacccccaugcuucgacacucaauugagaauaguucuguaaacgugucccucacugcaaucgcuaaucaagccacaguccugaugggauuggguaaaggcuggccgcugagcaagauggauauuggggugccauuacuagcgaucggauguuacucacagguuaacccuauaacccugaccgcugcccuccuucuguugauugcacacuaugccaucaucggccccggucugcaggcuaaggcaacaagagaagcccagaaacgcgcggcugccgggauuaugaagaauccaacuguggacggcauaacggucaucgaucucgaccccauuccuuacgauccgaaauuugagaagcaacugggacagguaaugcuuuuaauccugugcgugacccagguucucaugaugaggacaacuugggcauugugugaagcccugacccuagcuacaggccccauuaguacccugugggaggggaacccaggacgguucuggaauacuacgaucgccgugagcauggcaaacauauuucguggcuccuaucucgcuggugccgggcuucuguucucuaucaugaaaaaugcgaacaacacaagaaggggaaccggcaauauuggugaaacuuugggcgagaaguggaaaagccgccugaacgcccucgggaaguccgaguuucaaaucuacaagaaaucaggcauucaggaagucgaccggacccuggcaaaggagggcaucaaacgaggggaaacagaucaucacgcugugucuagaggaagugccaaguuaaggugguucgucgagcgcaauauggugacuccugagggcaaaguuguggaccuugguugcgggcggggaggcuggucguauuacugugguggccugaagaacguaagagaagugaaggggcucaccaaaggaggccccgggcaugaggaaccuauaccaaugagcacauauggauggaaucuaguccgucugcaguccggcguugauguguuuuucauucccccugagaagugcgacacguugcugugugauaucggugaaucuucaccaaaccccaccgucgaggcagggaggacucuccgggugcuuaaucugguagagaacugguugaauaacgacacacaguucugcaucaaagugcugaauccguacaugccuagcguuauugaaaagauggaggcucuccaacgcaaauacggaggcgccuuagugcgaaacccacuguccagaaauaguacccacgaaauguauugggucucuaacgccagcggcaauauagugucauccgucaacaugaucaguaggaugcuuauuaaccgguuuacuaugcgccauaagaaggcgacauacgagcccgacguggaucuggggagcggaaccagaaauaucgguauugaaucugagaucccuaaccuagacauaaucggcaaaaggauugagaagaucaaacaggaacacgagacguccugguauuacgaucaggaccacccauauaagaccugggcuuaccaugggucauaugaaacaaaacagacuggaagcgcaucgucuaugguuaauggcguagugcgacuccugaccaagcccugggaugucuugccgacagugacucaaauggccaugaccgacacaaccccuuucggucagcagcggguuuuuaaggagaaaguggauacucguacgcaggaacccaaggaggggaccaaaaagcugaugaaaauuaccgcugaguggcucuggaaggaacuuggcaaaaagaagacuccaagaauguguacccgcgaggaguucaucaggaaaguccggaguaacgccgcacugggcgccauuuuuacagacgagaauaaguggaaauccgcuagagaggcgguggaagauagccgcuucugggaguuaguagacaaggaaaggaaccugcacuuggagggcaaaugcgaaacguguguguacaauaugauggggaagcgagagaagaaacucggagaguuugguaaggccaaaggcucacgggcaauaugguacauguggcugggggcuagauuccuagaauuugaggcccuuggauuccugaacgaagaucauugguuuuccagggaaaauucucucagcggcguugaaggugaggggcugcacaaguugggauauauccugcgcgacgucaguaaaaaggagggcggcgcaauguacgccgacgauaccgcugggugggacacucguauuacacucgaagaucuuaagaacgaggaaauggugaccaaucacauggagggagaacauaaaaagcuggccgaggcgaucuucaaauuaacuuaucaaaacaaggugguccggguucagagaccuacacccagggguaccgugauggacaucauuucccgccgagaucagcggggcagcgggcaaguaggaacauacggccugaauacuuuuaccaacauggaggcacaguugauaagacagauggaaggugaggggguguucgaaaauauccagcaccucacggucaccgaggagguggccguucaaaacuggcuggcuagggugggacgcgaaagacuaucucggauggccauuucaggcgacgauugcgucgugaaaccacuugacgauagguucgcaaacgcucugacagcccucaaugacaugggcaagauccguaaggauauucagcagugggagcccaguaaaggguggaacgacuggacucagguaccuuuuugcucccaucacuuccaugaacugaucaugaaggauggacgaguuuugguggucccaugucgcaaucaagacgaguuaauagguagagcucggaucagccagggcgccggguggucucugagggaaaccgcaugccucggaaaaucguaugcgcagauguggucacuuauguacuuucaccgcagagaccugcggcuagccgcuaacgccauuuguagcgcagugccgucccacugggugcccacaaguaggacuaccuggucuauccaugcuaagcacgaguggaugacgacagaggauaugcugaccgucuggaaucgaguuuggauucgugaaaacccuuggauggaggacaaaacuccaguggaaagcugggaggaaauccccuaucucggcaagagagaggaucaguggugcgguuccuugauagggcugacaucacgcgccaccugggcaaagaauauucaagccgcgaucaaccagguacggagucuuauuggaaaugaggaauacacugacuacaugccuucuaugaaaagguucagacgcgaggaagaggaagcuggcgugcugugguga

SEQ ID NO: 14431 - RNA, 9876 nt, Artificial Sequence
  derived and/or modified CDS sequence (opt3) from DENV-2__FJ639702__SS-prME
accgccggagugaucauuaugcugauacccacagcuauggcauuccaccucacuacgaggaauggggagccucauaugaucgucgggaggcaggaaaaggguaaaagccuucuguuuaagaccgaggacggcguuaauaugugcacauugauggccauugauuuaggggaacugugugaggacacuaucaccuacaaaugcccacuacuccggcaaaacgaaccggaggauauugacuguuggugcaauuccacaucuaccugggugacuuauggaacauguaccacgacuggcgagcaccgccgagaaaagcguucaguagcgcuggugccccaugucgguauggggcuugagaccagaacagaaacuuggaugaguagcgagggagcuuggaaacacgugcagaggaucgagaccuggauacugcggcauccuggcuucacaaucauggccgcaauuuuggccuacaccaucggcacgacucacuuucagcgcgcucucauuuucauccugcugacagcaguugccccauccaugaccaugagaugcauagggauuucuaacagggauuuuguggaaggagucucggguggcucauggguggacaucguacucgagcacgggagcuguguuacuacaauggcuaagaauaagcccaccuuagauuucgaacugauuaaaacggaggccaaggaaccugcgacccuucggaaauauugcaucgaggcaaaguugacaaacacuaccacagagagucgcuguccaacucagggagaacccucccugaaugaggaacaagacaaacgauuugugugcaagcauucuauggucgauagaggcugggguaacggguguggacuauucggcaagggcgggaucgugaccugcgccauguuuacaugcaaaaagaauauggagggaaaaauugugcagccugaaaaccucgaguacaccauagucaucacuccacacagcggugaggaacaugcuguuggcaaugacacggggaagcacggaaaagagauuaagaucacaccgcaguccucaaguaccgaagccgagcugacuggcuaugguaccgugacaauggaauguagccccaggaccgggcuugauuucaacgagaugguacuguugcagauggaggacaaagcauggcucgugcaccggcaaugguuucuggauuuaccucugccauggcuccccggcgcugacacucagggaucuaauuggauacagaaggaaacacuugucacguucaagaacccucaugccaaaaagcaggacgugguugugcugggcucccaagagggggcgaugcacaccgccuugacuggagcaacagaaauucagaugucaagcgguaaucuacuguuuaccggccaucucaaaugccgucugcgcauggauaaacuucagcugaaagggaugaguuacucuauguguacaggaaaguucaagaucgucaaagagaucgcugagacucaacacggcaccauugugaucagaguacaguaugaaggugacggguccccaugcaagauucccuucgagauaauggauuuggagaagaggcauguucucggccggcugaucacggugaacccgauugucaccgagaaggacagcccugugaacaucgaagccgagcccccauuuggagauucguacaucauuauaggcgucgagccugggcaguuaaaacugaauugguucaagaagggaucuuccaucggucagauguuugaaacaacuaugcgaggcgcuaaacgcauggccauucuaggggacaccgcaugggauuucggaucacucggcgguguguuuacaaguauggggaaggcccugcaccaaguuuucggcgcuaucuacggagcggcauuuagcggcguguccuggacuaugaaaauucuuaucgggguaauaaucaccuggauuggaaugaacucuagaagcacgucauugagugucucccuggugcucguuggcgugaucacacuguaucuuggugccaugguccaggcugacagcgggugugugguaucuuggaagaauaaagagcugaagugcggaucaggcauuuucaucaccgauaacgugcacacuuggacagaacaguacaaguuucagcccgagaguccaagcaaauuggccuccgcaauacaaaaggcccaugaagaggguauuuguggcaucaggucuguuacccggcucgagaaucugauguggaaacagauuacucccgaauuaaaccacauccugucggagaaugaagucaagcuaaccauaaugacaggggacaucaaaggaauuaugcaggcuggcaagcgcagccucagaccucagccaacggagcugaaauauuccuggaagaccugggggaaggccaaaaugcuuucaacugaaagucauaaccaaacauucuugaucgauggaccggagaccgcagagugccccaauacaaacagggcguggaacucucuggaaguggaggacuacggcuuugguguguucacuaccaacauuuggcucaagcugcgugaaaaacaggacgucuuuugugauagcaaguuaauguccgcugccaucaaagacaaucgggcaguucacgccgauaugggguauuggauagagucagcucugaacgacacguggaagauggagaaggccagcuucauugaagugaaaucuugccacuggccuaagucccauacacuuuggaguaauggaguguuggagagcgaaaugaucaucccaaaaucuuucgcaggccccguaucccagcacaacuaccgaccugguuauuacacccagacugcuggcccauggcaucucgggaagcuggagauggauuuugacuucugugaaggaaccacagucgugguuacugaggauugcggcaacagagggcccucacuaaggaccacaacggccaguggaaaacugauuaccgaguggugcugucgcagcugcacucucccgccucugcgguacagaggcgaagacgguuguugguaugggauggagaucaggccacuuaaggaaaaggaggaaaauuuggugaacucgcuggucacagcgggacacggccaaauugauaauuuuuccuuaggugugcucggcauggcccuguuccuugaggagaugcugcgcacccgaguugggacuaaacaugcuauauugcucguggcaguaucucuggucacacuaaucaccggaaacaugagcuuucgggaccugggccgugugauggugauggucggggccacgaugacugaugacauuggaaugggcguuaccuaccucgcucugcuugccgcauucaaggugagacccacauuugcggccgguuugcuguuaaggaaacucaccucaaaggaacugaugauggcuacuaucgggauugcccuucugagucaguccacaaucccugagaccauacuagaacucacagaugcacuggcuuugggaaugaugguacugaaaaucgugcgcaauauggagaaguaucaguuagccgucacuauuauggcaaucucuugcgugcccaacgccguuauucuccaaaaugcuuggaaggugagcuguaccauccuggcggccgucuccgugucaccacuucuguugacgagcagucagcagaaagcagacuggauaccucucgcucugacaauuaagggccuaaaccccaccgccaucuuccugacuacccuuucucggacauccaaaaagagaagcuggccacucaaugaagccaucauggcuguuggcauggugucgauucuggcaucaucuuugcugaaaaacgacauaccgaugacugggccuuuagucgccggaggucuccugaccguaugcuacgugcuuacgggcaggagugcggaucuggaguuggagcgagcuacagacguuaagugggaagaucaggccgagaucuccgggagcucucccauucucagcaucaccauuuccgaagacggaucaaugaguaucaaaaaugaggaggaagaacaaacucugacaauacuaauccgcaccggccugcuugugauuagcggucucuuuccagucucuauccccauuacugcagccgcuugguaucugugggaagugaagaagcagcgggcagggguauugugggaugugccuuccccacccccugucggaaaagccgaguuagaagacggcgcguacagaaucaagcagaaaggcauacugggguauucacagauuggagcugguguuuacaaggagggcacauuccacaccauguggcacgugacgagaggggccgugcucaugcaucguggaaaacgcaucgagccgaguugggcagaugucaagaaggaccugaucagcuacggcgguggguggaaacuugaaggagaguggaaggaaggcgaggaagugcaaguucuggccuuggagccaggcaaaaacccccgggcuguacagacuaagccugggcuauuuaaaaccaauacaggaaccauuggugccgugucccuggauuucucuccaggcacaucggggagccccaucgucgacagaaagggaaaggugguuggccucuaugguaacgggguggucacuaggucaggagcauacguguccgcuauagcccagaccgagaaaaguauugaagauaauccugagaucgaagacgauauuuuucgaaagaaacggcugacgaucauggaccuucacccgggcgcgggcaagacaaaacgcuauuuacccgccauaguaagagaggcaauuaagagggggcugcggacucucaucuuggcuccaacccgagucguggccgcugaaauggaggaggcacugagaggacucccuauccgcuaccagacacccgccauuagggccgaacauaccggucgugagaucguugaccugaugugucacgcuacuuucaccaugcggcuucugucuccagugagagucccuaacuauaacuugauuauaauggaugaagcgcauuucacagaccccgcaagcaucgccgcuaggggcuacauuuccacgcgcguggagaugggggaggccgcaggaaucuuuaugacugccaccccaccgggcucaaaggauccuuucccccaaucuaaugcuccaaucauggacgaagaacgagaaauucccgagagaagcuggaacaguggucacgaauggguuacagauuuuaaagggaagaccgugugguucgucccuuccauaaaagcgggaaaugacaucgccgcaugccuacggaagaacggcaaaaaggugauucagcugagcaggaagacuuuugauucugaguauguaaaaacacgcaccaaugacugggauuucgugguuacgacugacaucucagagaugggcgcuaacuuuaaggccgaacgugucauugauccaagacgguguaugaaacccgugauccucacagacggggaggaaagggugauauuagcaggaccuaugccggucacccacuccagugccgcucagcgccgagguagaaucggccggaauccaaagaacgagaaugaccaauacauuuacaugggggaaccccuggagaacgaugaggacugcgcccauuggaaagaagcgaagaugcuucuggauaauaucaacaccccugagggaauuauccccagcauguucgaaccagagagggaaaaaguagacgcaauagauggcgaguaucgccucagaggugaggccaggaagacuuuuguggacuugaugcggcguggggaucugccuguuuggcucgcuuaccgcguggccgcugaaggcauuaauuaugcagaccgaagaugguguuucgauggagucaagaacaaucagauccuggaggaaaacguggagguugagauuuggacaaaagaaggcgagaggaagaaacuuaagccccgguggcuagacgcccgcaucuacucggauccacuggcuuugaaagaauuuaaggaguucgccgcagggagaaagucuuuaacccugaaccucauaacagaaaugggaaggcugccuacuuucaugacgcagaaagcgcgggacgcccuugauaaucuggcugugcuccacaccgccgaggcugguggacgagcauauaaccaugccuuguccgagcugccggaaacacuagagacucugcuccuucugaccuuauuggcaacagucaccgggggaguguuucuguuccucaugagcggcaaggguguagggaaaaugacucugggcaugugcugcaucauuacggccucaauccuucugugguacgcucagauucaaccccacuggaucgcggccaguauaauucucgaauuuuucuugaucgugcuguuaaucccagagccugaaaagcagagaacaccccaggacaaucagcuaacauauguugucauugcaauccugacugugguggcugccaccauggccaacgagaugggauuucucgagaaaacaaagaaggaccuuggccuggggucuauagcaacccaagaaccagaguccaauauuuuggauaucgaccugcgcccugcuagcgccuggacucucuacgcggucgcuacaacguucguuacccccaugcugaggcacucaauugaaaacaguagcgugaauguaucccuuacugccaucgcaaaccaggccacagugcucaugggacuggguaaaggcuggccguugucuaagauggauauaggggucccacuguuagcuaucggauguuacagccaggugaauccuguuacccuaaccgcagcccugcuccuucugguggcgcauuaugcuauuaucggccccgguuugcaggccaaagcaacacgggaggcccaaaagcgugcugccgcagggauuaugaaaaacccaacugucgacggcaucacgguaauugaucuggaccccaucccuuacgauccgaaguuugaaaagcagcucggacaggugaugcugcuuauauuaugcguuacccaggugcugaugaugagaacaacuugggcucucugugaggccuugacccuggcgacaggccccauuuccacccuaugggaggggaauccaggaagguucuggaacacuacgaucgccgucucaauggcaaauaucuuucgcggcucuuaucuggcuggugccgggcuccuuuucaguauuaugaaaaacacaaccaauacucggcgaggaaccggcaacauaggugaaacacugggcgagaaguggaaaucgagauugaaugcacugggaaagagcgaauuucaaaucuacaaaaaguccggcauucaggagguggacaggacucucgcuaaagagggcaucaagcgcggggaaaccgaucaccaugccgucucucggggaucagccaagcugagaugguucguggagcguaacaugguuacaccugaaggcaaagugguagacuuagguugcgggaggggaggcuggagcuauuacugugguggccuuaagaacgugaaagaggucaaggggcugacgaaaggaggccccgggcacgaggaaccuauuccaauguccaccuauggauggaaucucguucggcuacagaguggcguggaugucuuuuucacucccccugagaagugcgacacacuguugugugauaucggugaaucuagcccaaaccccaccauagaggcggggcgcacucugcgagugcucucacuuguagaaaauuggcugaacaaugacacacaauucugcaucaagguguugaacccguacaugccuuccguuauugagaaaauggaaacccugcagagaaaguacggaggcgcucucgugaggaauccauuaagucggaacagcacgcaugagauguauugggucucuaaugcaaccggcaacaucguguccucagucaauaugauuagccgcaugcugaucaacagauuuacaaugaaacacaagaaagccacuuacgagcccgacguggaucuugggucgggaaccaggaauauagguauugaaucugagaucccuaaccuggacaucauuggcaagcgaauagaaaagaucaaacaggagcacgaaacaaguuggcauuaugaucaggaccacccauacaagacuugggcuuaucauggguccuacgagaccaaacaaacaggaagcgccucauccaugguuaauggcguagugcggcuacucaccaagcccugggaugucgugccgaugguuacucagauggcaaugacggacacaaccccuuucggucagcagcguguguuuaaagagaaggucgauacuagaacccaagaacccaaggaggggaccaaaaagcugaugaaaauuacggccgaaugguuguggaaggagcugggcaaaaagaaaaccccacgcauguguacuagggaggaguucacacggaaggugagaucuaacgcugcgcucggcgccaucuuuaccgacgagaacaaguggaaaagcgcacgcgaagcuguagaggauaguagguucugggaacuuguggacaaggagcgaaaucugcacuuagagggcaaaugcgaaacuuguguuuauaacaugauggggaagcgggagaaaaagcugggagaauuugguaaggccaaaggcuccagagcaauuugguacaugugguugggggccagguuccucgaguuugaagcucugggauuccuaaaugaggaucacugguuuagccgcgagaacucucuuucaggcgucgaaggugaggggcugcauaagcucggauacauccugcgugacgugggcaaaaaggaaggcggggccauguaugcggacgauacagcaggaugggacacccggauaacauuggaggaucugaaaaaugaagagauggugacuaaccacauggagggugaacauaagaagcucgccgaggcuaucuucaaacuuaccuaccagaauaaggucguuagagugcagaggccuacgccccgcggcaccguaauggacauuaucagucgacgggaucagagaggguccggacaagugggcacauauggucugaacacuuuuaccaauauggaagcccaguuaauuaggcagauggagggggagggaaucuucaaaagcauucaacaccugacagcaacugaagagauagcuguccagaacugguuggcccgcgugggcagagaacggcucucuaggauggcuaucucgggcgacgauugcguugugaagccacuggacgaucguuucgccucagcacuaaccgcgcuuaaugacauggggaaaguccgaaaggauauucagcagugggagcccagccgcggauggaacgacuggacgcaagugccuuuuugcucccaucacuuccacgaacugaucaugaaggaugguagaguacucguugugccaugucggaaucaggacgagcugaucggcagggcccgcauuagucagggggcuggauggucuuugaaagagacagccugcuuaggcaagagcuacgcacagauguggucccugauguauuuucauagacgggaccucaggcuugcugccaacgcaauauguucagccgucccgagucacugggugcccaccucucgaacuacauggagcauccaugcgaaacacgaauggaugaccacugaggauaugcugaccguguggaaucgugucuggauucaagaaaacccuuggauggaggacaagacaccaguugaauccugggaggaggugcccuaccuagguaaaagagaagaucaguggugcgggucacugaucggacucacgagccgcgcuaccugggccaagaacauucagacugcaaucaaucagguacggucuuugauaggcaacgaggaauauacagacuacaugccuuccaugaagagguucagacgcgaggaagaggaggccggcgugcugugguga

SEQ ID NO: 14432 - RNA, 9876 nt, Artificial Sequence
  derived and/or modified CDS sequence (opt3) from DENV-2__GQ868621__SS-prME
agcgcaggcaugaucauuaugcugauacccaccgugauggcuuuccaccucacuacuagaaacggggagccucauaugaucgucgguauucaagaaaagggaaaaucccuucuguuuaagacggaggacggcguuaauaugugcaccuugauggcaauggauuuaggggaacugugugaggacacgaucacuuacaaaugcccacuacucaggcaaaacgaaccggaggauauugacuguuggugcaauucuaccucaacaugggugaccuauggaacuuguacaaccacgggcgagcaccggcgcgaaaagcgaaguguagcacuggugccccaugucgguauggggcuugagacucguaccgaaacauggaugagcuccgagggagcguggaaacacgcucagagaaucgagacuuggauacugaggcauccuggcuucaccaucauggccgcaauuuuggccuacacaaucggcaccacgcacuuucagcgggugcucauuuucauccugcugacugcuguugcaccaucuaugacaaugcgcugcauagggauuucgaacagagauuuuguggaaggagucucagguggcagcuggguggacaucguucucgagcacgggaguuguguuaccacuauggccaagaauaagcccacauuagauuucgaacugauuaaaaccgaggcuaagcagccugccacgcuuaggaaauauugcaucgaagcgaaguugaccaacacaacuaccgagucccgguguccaacacaaggagagcccucucugaaagaagaacaggacaagcgcuuugugugcaagcauagcauggucgaucgaggcugggguaauggguguggacuauucggcaaaggcgggaucgugacuugcgcaauguuuaccugcaagaaaaacauggaaggaaagauugugcagccugagaaucucgaauacacaauagucguuaccccacacuccggugaggagcaugccgugggcaacgacacugggaaacacggaaaggaaaucaaaguaacgccgcagucaaguauuacagaggcugaacugaccggcuaugguacugugaccauggaguguagccccagaacagggcuugauuucaaugaaaugguccuguugcaaauggagaacaaggccuggcucgugcacaggcagugguuucuggacuuaccucugccauggcuccccggcgcagauaagcaggagucuaauuggauccagaaagaaacccuuguuacuuucaagaacccucaugcuaaaaagcaagacguggucgugcugggaucccaggagggcgccaugcacacagcguugacgggggccaccgaaauacagaugucaagcggaaaucuacuguuuacuggucaucucaaaugccggcugcguauggacaaacuucaacugaagggcaugaguuacucuauguguacagggaaauucaagguaguuaaagagauugcagagacccagcacggaacaaucgugauccgcguccaguaugaaggcgaugguuccccaugcaagauucccuucgagaucauggacuuggagaagagauacauucucgggaggcugauaacugugaacccgaucgucaccgagaaggauagcccugugaacauugaagcugagcccccauuuggcgacucguacaucaucauuggaguugagccuggccaguuaaagcugaauugguucaaaaaggggucuuccauaggacaaauguuugaaacgaccaugcggggugccaaacgaauggcuauccuaggcgauacagccugggacuucgggucacucggaggcguguuuacaaguauugguaaggcacugcaucagguauucggggccaucuauggcgcugcguuuagcggagucuccuggaccaugaaaauucuuaucggcgugauaaucacauggauugggaugaacucucgcagcacuucauugaguguuucccuggugcucgucggaaucgugacccuguaccuuggcguaauggugcaggcagauagcgguuguguugucucuuggaagaauaaggagcugaaaugcgggucaggaauuuucaucacggacaacgugcacacauggaccgaacaguauaaguuucaacccgagaguccaagcaaauuggccuccgcuauacagaaggcccaggaagagggcauuugugguaucagaucugugacuaggcucgagaaucugauguggaaacagauuacacccgaauuaaaccacauccuggcagagaaugaagucaagcuaaccauaaugacuggcgauaucaaagggauuaugcaagccggaaagcggucgcuccgcccucagccaaccgagcugaaguacagcuggaaaacauggggcaaggcuaaaaugcuuuccacggaaucauauaaccagaccuucuugaucgacgggccggagacugccgagugccccaauacaaacagagcauggaauagucuggaaguugaggauuacggauuuggcguguucaccacaaacauuuggcucaagcugaaagaaaagcaggacgcguuuugugacucuaaguuaaugagcgcugccaucaaagauaauagggcagugcaugccgacauggguuauuggauagaguccgcucugaacgauacuuggaagauugagaaagccucauucaucgaaguaaagaauugccacuggccuaaaagccauacccuuuggucuaacggggucuuggaguccgaaaugaucauuccaaagaaccucgcaggacccgugagucaacacaauuaccguccuggcuaccacacgcagaucgcugguccauggcaucugggcaagcuagagauggacuucgauuuuugugacgggacaaccguuauugugacugaagauugcggaaaccggggccccagccugcgaaccacaacugccucugggaaacucauaaccgaguggugcuguagauccugcacacugccgccucuuagguaucgcggagaggacggcuguugguacgguauggaaauccggccauugaaggagaaagaagagaaucuggucaacucauuagugacggcggggcacggacagguugauaauuucagucucggcgugcuggguauggcccuuuuucuggaagagauguugagaaccaggguaggcacuaagcaugcuauucuccuggucgcagugagcuucaugacacuaaucaccgggaacaugucguuuaaagaccugggacgcguggucguuauggugggcgccacuauggcugaugacauugggaugggaguaacauaucucgcccugcuugcagcguucaaggugcgacccaccuuugccgcuggcuugcuguuacggaagcucacguccaaagagcugaugaugacuaccaucgguauaguccuucugucucaaagcacaaucccugaaaccgugcuagagcucacugaugcccuggcauuggggaugaugguucugaagauugugcguaauauggaaaaauaccaguuagcugucacaaucauggccauucucugcgugcccaacgcaguuauccugcagaaugccuggaaggugucauguaccauacuugcugucguaaguguguccccacuguugcucacaucuagccagcagaaaacugacuggauuccucuggcgcuaaccaucaagggacugaaccccacggccaucuuccuuacaacccucuccagaacuaauaaaaagaggucauggccacugaacgaggcaauuauggcuguuggcauggugagcauauuggccaguucucuguuaaagaaugacaucccgaugaccggcccucucgucgccgggggacugcuuacagugugcuauguacugacuggucgcuccgcugauuuggaacucgagcgggcaaccgacgugaaaugggaggaucaggccgaaauuagcggcucgucacccauccugucuauuacgaucagugaggacggguccaugagcauaaagaacgaagaggaggaacacacacuaaccauccugauuagaacuggacuucucgucaucucuggccuguuuccaauuagcauccccauaacagcggcugccugguacuugugggagguuaaaaagcagagggccgguguguuaugggaugugccuuccccacccccuauggggaaagccgaacuggaggacggagcuuaucgaauuaagcagaagggcauccucggcuacucacaaaucggggcaggagucuacaaagaagguaccuuccauacuauguggcacgugacacgcggcgccguucugaugcacaaggggaaacggauugagccgaguugggcggauguaaagaaagaccuuaucagcuauggaggcgguuggaagcuggagggggaauggaaggagggagaagaggugcaggucuuggcucuagaaccaggcaaaaaucccagagccgugcagaccaagccuggccuguuuaaaacgaacacugggaccauaggagcaguuucucucgauuucuccccagguacaucaggcagucccauuaucgacaagaaagggaagguggucggacuguacggcaacggugugguaaccaggagcggggccuaugucuccgcuauugcccagacagagaagucuaucgaggauaauccugaaauagaggacgauauuuuucguaaacgccggcuuacuaucauggacuuacauccgggagcaggcaagaccaaaagauaccugcccgcuaucgugagggaagccauuaagcgaggccuccggacguugauccuggcgccaacacgcguuguggccgcagagauggaagaggcucucagagggcugccuauuagguaucaaacucccgccauacgggcugagcacaccggacgagaaaucgucgaccuuaugugucaugcaacauucaccaugagacuguugucgccagugcgcguuccuaacuacaaucuaauuaucauggaugaggcccacuucacugaccccgccagcaucgcugcgagggguuauauuucaacccguguggaaaugggcgaggcagccgggauauuuaugacagcuacgccaccgggaucccgggauccuuucccccagaguaacgccccaaucauugacgaggaaagagagauccccgaaaggucuuggaauagcggccaugagugggucacugauuuuaaagguaagaccgugugguucguaccuuccauuaaggcagggaacgacaucgccgcuugccugcgcaaaaauggaaagaaagugauacagcucucacgaaagacauuugauucugaauacguuaaaaccagaacuaacgacugggauuucgucgugacaaccgacaucagcgagaugggcgcgaauuuuaaggccgagcgggugauugauccaaggcgcuguaugaaacccgucaucuuaacggacggcgaagaacguguaauucuggcagggccuaugccggugacucacaguuccgcugcccaaagacggggaaggaucggucgcaacccaaagaaugaaaacgaccaguacauauauaugggcgagccccuugaaaaugaugaggacugcgcacacuggaaggaggccaaaaugcugcucgauaacauuaauacaccugaagggaucauucccagcauguucgagccagaacgagagaagguugacgcuaucgauggagaauacagauugcggggcgaggccaggaaaaccuuuguggaccugaugcgcagaggugaucucccugucuggcuggcguauaagguggcagccgaggggauaaacuacgcugacaggcggugguguuucgauggcaucaaaaacaaucagauucuugaagagaacguugaaguggagaucuggaccaaggagggagaacguaagaaacuaaagccccgcuggcuggacgcccgaauuuauucugauccauuggcuuuaaaagaguuuaaggaguucgcagccggcagaaaaucacugacucucaaucugaucacagagauggggaggcuuccuaccuucaugacacagaagacucgggacgcucuggauaaccucgccgucuugcauacggcagaagcgggaggucgcgccuacaaucacgcucuguccgagcuaccggagacccuggaaacacuccuucuguuaacuuugcuggccaccgugacaggcgggauauuucucuuccugaugaguggaagaggcauugguaagaugacccuugggaugugcugcaucaucacugcaagcauucugcucugguaugcucaaauccagccccauuggauagccgcaucgauuaucuuggaguuuuuccugauuguauuacuaaucccagaaccugagaaacagaggacgccccaggacaaccaacugaccuacgugguuauagccauccucacagucguggcugcgacuauggccaaugaaaugggcuuucuugagaagaccaaaaaggaccugggauugggcucuauugcaacacagcagccagaguccaacauccuggauauugaccuccggccugcuagcgccuggacccuguacgccguggcaacuacauucgucacgcccaugcuucgacacucaaucgaaaauaguucuguuaacgugucccucaccgcuauugccaaucaggcgacuguacugaugggguugggaaaagguuggccgcugagcaagauggauaucggcgugccauuacuagcuauaggguguuauucacaagucaacccuauuacacugaccgccgcacuccuucuguugguggcccacuacgcuaucaucggacccggccugcaggcaaaggccaccagagaggcgcagaaacgcgcugccgcagguauuaugaagaauccaacaguugacgggauaacugugaucgaucucgaccccauuccuuaugauccgaaauuugaaaagcagcugggccaagucaugcuuuuaauccugugcguaacacaggugcucaugaugaggaccacaugggccuugugugaggcucugacucuagccaccggacccauuaguacacugugggaaggcaacccagggcgguucuggaauaccacuaucgcaguuagcauggcuaacauauuucguggauccuaccucgccggcgcgggucuucuguucucuaucaugaaaaauacgacaaacaccagaagggggacuggaaacauuggcgagaccuugggugagaaguggaaaagccgccugaaugcccucggcaaguccgaauuucagaucuauaagaaaucagggauucaagagguggaccggacacuggcaaaggaaggaaucaaacgaggcgagacugaucaucacgcugucucuagagggagugccaaguuaaggugguucguggagcgcaacauggucaccccugaaggaaaagugguugaccuuggcugcgguagagggggauggucguacuauuguggcggucugaagaaugugagagagguaaagggccucacaaaagggggacccggccaugaggaaccuauaccaaugagcacguacggguggaaccuagugcgucugcaguccggagucgauguauuuuucauucccccugaaaagugcgacaccuugcugugugauaucggcgagucuucaccaaaucccacuguggaggcagguaggacacuccggguccuuaaccugguggaaaauugguugaacaauaacacccaguucugcaucaaaguacugaauccguacaugccuagcgugauugagaagauggaagcucuccagcgcaaauaugggggagccuuaguucgaaacccacuguccagaaauaguacucacgagauguacugggugucuaacgccagcggcaauauagucucauccgugaacaugaucaguaggaugcuuauuaaccgguuuacaaugcgccauaagaaggcgaccuaugaacccgacgucgaccugggcagcgggacgagaaauaucggaauugagucugaggugccuaaccuagauaucauagguaaaaggaucgaaaagauuaaacaagagcacgaaaccuccuggcacuacgaccaggaucauccauauaagacaugggcuuaccacggcucauaugagacuaaacagaccgggagcgcaucgucuaugguuaauggaguagugcgacuccugacaaagcccugggacgucuugccgacugugacccagauggccaugacagauaccacuccuuucggccaacagcggguuuuuaaggaaaaaguggacacgcguacacaggagcccaaggaggguaccaaaaagcugaugaaaaucacugcugaauggcucuggaaggagcuugggaaaaagaagaccccaagaauguguacacgcgaagaguucacgaggaaaguccggaguaacgccgcacugggagccauuuuuaccgaugagaauaaguggaaauccgcuagagaagcgguggaggacagccgcuucugggaauuaguagauaaggagaggaaccugcauuuggaaggcaaaugcgagacuuguguguacaauaugaugggcaagcgagagaagaaacucggggaauuuggaaaggccaaagguucacgggcaaucugguacauguggcugggcgcuagauuccuagaguuugaagcccuuggguuccugaacgaggaccacugguuuuccagggaaaauucucucagcggaguugagggcgagggucugcacaaguugggguauauucugcgcgaugucaguaaaaaggaaggaggcgcaauguacgccgacgacacagcuggcugggauacccguauaacucucgaggaccuuaagaacgaagagauggugacaaaucauauggaaggggagcacaaaaagcuggccgaggcgaucuucaaauuaaccuaucagaacaaggugguccggguucaaagaccuacacccaggggaacugugauggauauuaucucccgccgagaccagcgggguagcggccagguagggaccuacggacugaauacguuuaccaacauggaagcacaauugaucagacagauggagggcgaagguguguucaaaaauauucagcaucucacagucacugaggagguggccguucagaacuggcuggcuaggguggggcgcgaaagacuaucucggauggccauaucaggagaugacugcgucgugaagccacuugaugacagguucgcaaacgcucugaccgcccucaaugauaugggcaagauccguaaagacauucaacagugggagcccaguaagggcuggaacgauuggacacagguaccuuuuugcucccaccauuuccacgaacugaucaugaaagacgggcgaguuuugguggucccaugucgcaaucaggaugaguuaauuggacgggcucggaucagccaaggugccggcuggucucugagggaaacugcaugccucgggaagucguaugcgcagauguggucacuuauguacuuucaccgcagagaccugcggcuagccgcuaacgccauauguagcgcagugccgucccauugggugcccaccaguaggacgacauggucuauccacgcuaaacaugaguggaugaccacugaggacaugcugacagucuggaaucgaguuuggauucgugaaaacccuuggauggaggauaagaccccaguggaaagcugggaggaaauccccuaucucggaaagagagaggaccaguggugcggcuccuugauuggucugacuucacgcgccaccugggccaaaaauauccaggccgcgauaaaccaaguacggagucuuauugggaaugaggaauacacagauuacaugccuucuaugaagagguucagacgcgaggaagaggaagcuggagugcugugguga

SEQ ID NO: 14433 - RNA, 9876 nt, Artificial Sequence
  derived and/or modified CDS sequence (opt3) from DENV-2__FJ639704__SS-prME
agcgcaggaaugaucauuaugcugauccccaccguggucgcuuuccaccucaccacucggaacggggaaccucauaugaucguuggcauucaggaaaaggguaaaucccuucuguuuaagacggaggacggcgugaauaugugcaccuugauggcaauggauuuaggggaacugugugaggacacaaucacuuacaaaugcccacuacucaggcaaaacgaaccggaggauauugacuguuggugcaauucuaccucaacauggguaaccuauggaacuuguacaaccacgggcgagcaccggcgcgaaaagcgaaguguggcccuggucccccauguggguauggggcuugagacucguaccgaaacauggaugagcuccgagggagcguggaaacacgcucagagaaucgagacuuggauacugaggcauccuggcuucaccaucauggccgcaauuuuggccuacacaaucggcaccacgcacuuucagcgggcucucauuuucauccugcugacugcaguugccccaucuaugacaaugcgcugcauagggauuucgaacagagauuuuguggaaggagucucagguggcagcuggguggacaucguacucgagcacgggaguuguguuaccacuauggcuaagaauaagcccacauuagauuucgaacugauuaaaaccgaggccaagcagccugcgacgcuuaggaaauauugcaucgaagcaaaguugaccaacacaacuaccgagucccgguguccaacacaaggagagcccucucugaaagaagaacaggacaagcgcuuugugugcaagcauagcauggucgaucgaggcugggguaauggguguggacuauucggcaaaggcgggaucgugacuugcgccauguuuaccugcaagaaaaacauggaaggaaagauugugcagccugagaaucucgaauacacaauagucguuaccccacacuccggugaggagcaugcugugggcaacgacacugggaaacacggaaaggaaaucaaaguaacgccgcagucaaguauuacagaggccgaacugaccggcuaugguacugugaccauggaguguagccccagaacagggcuugauuucaaugaaaugguccuguugcaaauggagaacaaggcauggcucgugcacaggcagugguuucuggacuuaccucugccauggcuccccggcgcugauaagcaggagucuaauuggauccagaaagaaacccuuguuacuuucaagaacccucaugccaaaaagcaagacguggucgugcugggaucccaggagggcgcgaugcacacagccuugacgggggcaaccgaaauacagaugucaagcggaaaucuacuguuuacuggucaucucaaaugccggcugcguauggacaaacuucaacugaagggcaugaguuacucuauguguacagggaaauucaagguaguuaaagagauugcugagacccagcacggaacaaucgugauccgcguccaguaugaaggcgaugguuccccaugcaagauucccuucgagaucauggacuuggagaagagauacgugcucgggaggcugauuacugucaacccgauagugaccgagaaggauagcccuguuaacaucgaagccgagcccccauuuggcgacucguacauuaucaucggaguggagccuggccaguuaaagcugaauugguucaaaaaggggucuuccauuggacaaauguuugaaacgaccaugcggggugcuaaacgaauggccauacuaggcgauacagcaugggacuucgggucacucggaggcguauuuacaaguaucgguaaggcccugcaucaggucuucggggcuauuuauggcgcggcauuuagcggaguguccuggaccaugaaaauccuuauuggcguuaucauaacauggaucgggaugaacucucgcagcacuucauugagugugucccugguccucgugggaauuguaacccuguaccuuggcgugaugguucaggccgauagcgguugugucgugucuuggaagaauaaggagcugaaaugcgggucaggaaucuucauuacggacaacgugcacacauggaccgaacaguauaaguuucaacccgagaguccaagcaaauuggcuuccgccauccagaaggcacaggaagagggcauaugugguauuagaucugucacuaggcucgagaaucugauguggaaacagaucacacccgaauuaaaccacauucuggccgagaaugaaguuaagcuaaccaucaugacuggcgauauaaaagggaucaugcaagcuggaaagcggucgcuccgcccucagccaaccgagcugaaguacagcuggaaaacauggggcaagacgaaaaugcuuuccaccgaaucauauaaccagacuuucuugauugacgggccggagacaaccgagugccccaauacaaacagagccuggaauagucuggaaguggaggauuacggauuuggcguguucacuaccaacaucuggcucaagcugaaagaaaagcaggacgcauuuugugacucuaaguuaaugagcgcggcuauuaaagauaauagggccguacaugcagacauggguuauuggaucgaguccgcccugaacgauacguggaagauagagaaggcuucauucauugaagucaagaauugccacuggccuaaaagccauacacuuuggucuaacgggguguuggaguccgaaaugaucaucccaaagaaccucgccggacccguuagucaacacaauuaccguccuggcuaccacacccagauugcagguccauggcaucugggcaagcuagagauggacuucgauuuuugugacgggacuaccgugaucgucacagaagauugcggaaaccggggccccagccugcgaacuaccacagcuucugggaaacucauuacggaguggugcuguagauccugcacccugccgccucuuagguaucgcggagaggacggcuguugguacgguauggaaauacggccauugaaggagaaagaagagaaucuggugaacucauuaguuacugccgggcacggacagguggauaauuucagucucggcguacuggguauggcgcuuuuucuggaagagauguugagaacaagggucggcaccaagcaugccauccuccugguggcugugagcuucgucacucuaauuacagggaacaugucguuuaaagaccugggacgcguugugguaauggugggcgcaaccauggccgaugacaucgggaugggagucacguaucucgcucugcuugccgcauucaaggugcgacccacuuuugcggccggcuugcuguuacggaagcucaccuccaaagagcugaugaugacaaccauugguaucguucuucugucucaaagcacuauaccugaaacaauccuagagcucaccgaugcucuggccuuggggaugauggugcugaagauuguccguaauauggaaaaauaccaguuagcagugacaaucauggcuauucucugcguucccaacgccgugauccugcagaaugcauggaaggucucauguacuauacuugccguagugaguguuuccccacuguugcucaccucuagccagcaaaaagcugacuggauuccucuggcgcuaacgaucaagggacugaaccccacagccaucuuccuuaccacucucuccagaaccaauaaaaagaggucauggccacugaacgaggcaauuauggcugugggcauggucagcauauuggccaguucucuguuaaagaaugacaucccgaugacaggcccucucguggccgggggacugcuuacuguaugcuaugugcugaccggucgcuccgcugauuuggaacucgagcgggcaacggacgucaaaugggaggaacaggccgagauuagcggcucgucacccauccugucuauuacaaucagugaagauggguccaugagcauaaagaacgaggaggaagaacagacccuaacuauccugauuagaacaggacuucucguuaucucuggccuguuuccaauuagcauccccauaaccgcggcugccugguacuugugggaagugaaaaagcagagggccgguguguuaugggacgucccuuccccacccccuauggggaaagccgagcuggaagauggagcuuaucgaauuaagcaaaagggcauccucggcuacucacagaucggggcaggaguguacaaagaggguacuuuccacacaauguggcauguuacccgcggcgccguacugaugcacaaggggaaacggauugagccgaguugggcggacgugaagaaagaucuuaucagcuauggaggcgguuggaagcuggaaggggaguggaaggaaggagaggaaguccagguguuggcucuagagccaggcaaaaaucccagagccguucagacgaagccuggccuguuuaaaacuaacaccgggacaauaggagcagugucucucgacuucuccccagguaccucaggcagucccauuaucgauaagaaagggaaggucgugggacuguacggcaacgguguagucacaaggagcggggccuauguguccgcuauugcccaaacugagaagucuaucgaagacaauccugagauagaagaugacauuuuucguaaacgccggcuuaccaucauggauuuacacccgggagcaggcaagacgaaaagauaccugcccgcuaucguuagggaggccauuaagcgaggccuccggacauugauccuggcgccaacucgcguggucgccgcagaaauggaggaggcucucagagggcugccuauuagguaucagacccccgccauacgggcugaacauacaggacgagagaucguggaccuuaugugucacgcaaccuucacuaugagacuguugucgccaguucgcgugccuaacuacaaucuaauuaucauggacgaagcccauuucaccgaucccgccagcaucgcugcgagggguuauauuucaacacgugucgagaugggcgaggcagccgggauauuuaugacggcuacuccaccgggaucccgggacccuuucccccagaguaacgccccaaucauugaugaagagagagaaauccccgagaggucuuggaauagcggccacgaaugggugaccgacuuuaaagguaagacaguaugguucgugccuuccauuaaggcagggaacgauaucgccgcuugccugcgcaaaaauggaaagaaaguuauacaacucucacgaaagaccuuugacucugaguacgucaaaacuagaacaaacgauugggacuucguggugaccacggauaucagcgagaugggcgcgaauuuuaaggccgaacgggucauugacccaaggcgcuguaugaaacccguaaucuuaacugauggcgaggaacgugugauucuggcagggccuaugccgguuacacauaguuccgcugcccagagacggggaaggaucggucgcaacccaaagaaugagaacgaccaguacauauauaugggcgaaccccuugagaaugacgaggauugcgcacacuggaaggaagccaaaaugcugcucgacaacauuaauaccccugaggggaucauucccagcauguucgaaccagagcgagaaaagguggaugcuaucgacggagaguacagauugcggggcgaggccaggaaaaccuuugucgaucugaugcgcagaggugaccucccuguguggcuggcguauaagguugcagccgaagggauaaacuacgcugauaggcggugguguuucgacggcaucaaaaacaaucagauucuugaggaaaacguggaggucgagaucuggacuaaggaaggagagcguaagaaacuaaagccccgcuggcuggaugcccgaauuuauucugacccauuggcuuuaaaagaauuuaaggaguucgcagccggcagaaaaucacugacacucaaucugaucaccgaaauggggaggcuuccuacauucaugacucaaaagacgcgggaugcucuggacaaccucgccguguugcacaccgcagaggcgggaggucgcgccuacaaucaugcucuguccgagcuaccggaaacacuggagacucuccuucuguuaaccuugcuggccacaguaaccggcgggauauuucucuuccugaugaguggaagaggcauugguaagaugacucuugggaugugcugcaucaucacggcaagcauucugcucugguaugcucagauccagccccacuggauagccgcaucgauuaucuuggaauuuuuccugauuguguuacuaaucccagagccugaaaaacagaggacaccccaagauaaccagcugacauacguugucauagccauccucacugugguggcugcgaccauggccaaugagaugggcuuucuugagaagacuaaaaaggaccugggauugggcucuauugcaacccagcagccagaauccaacauccuggacauugaucuccggccugcuagcgccuggacucuguacgccgucgcaacaacguucaucacccccaugcuucgacauucaauugagaauaguucuguuaacaucucccucacugcuauagccaaucaagcgacagugcugaugggguugggaaaagguuggccgcugagcaagauggacauuggcguaccauuacuagcuaucggguguuauucacaggugaacccuaucacccugaccgccgcacuccuucuguuggucgcccacuacgcuauuauaggacccggccugcaggcaaaggccacaagagaagcgcagaaacgcgcugccgcagguaucaugaagaauccaacuguggaugggauuacgguuaucgaccucgaucccauuccuuaugacccgaaauuugagaagcaacugggccaggugaugcuuuuaauccugugcgucacccagguacucaugaugaggacaacuugggccuugugugaagcucugacccuagccacaggacccauaaguacccugugggagggcaacccagggcgguucuggaauacuacgaucgcagugagcauggcuaacauuuuucguggauccuaccucgccggcgcgggucuucuguucucuaucaugaaaaauacaaccaacacuagaagggggaccggaaacauuggcgagacauugggugaaaaguggaaaagccgccugaaugcccucggcaaguccgaguuucaaaucuauaagaaaucagggauacaggaaguugaucggacucuggcaaaggagggaauuaaacgaggcgagaccgaccaccaugcugugucuagagggagugccaaguuaaggugguucgucgaacgcaacauggugacaccugagggaaaagucguggaucuuggcugcgguagagggggauggucguacuauuguggcggucugaagaauguuaaggaagugaaaggccucacgaaagggggacccggccacgaggaaccuaucccaaugagcaccuacggguggaaccuaguaagacugcaguccggaguggacgucuuuuucauacccccugagaaaugcgauacuuugcugugugacauuggcgagucuucaccaaaucccacaguugaagcaggucguacccucagggugcuuaaccuggucgagaauugguugaacaauaacacucaguucugcauaaaggugcugaauccguacaugccuagcguaaucgagaaaauggaggcucuccaacggaaguaugggggagccuuagugcgcaacccacugucccgaaauaguacacaugaaauguacuggguuucuaacgccagcggcaauauugugucauccgucaacaugaucaguagaaugcuuauuaacagguuuaccaugcggcacaagaaagcgacguaugagcccgauguggaccugggcagcgggacccgcaauaucggaauagagucugaagucccuaaccuagacaucauugguaagagaaucgagaaaauuaagcaggaacaugagacauccuggcacuacgaucaggaccacccauauaaaacuugggcuuaccauggcucauaugaaaccaagcagacagggagcgcaucgucuauggugaauggaguuguaaggcuccugacuaagcccugggauguguugccgaccgucacacaaauggccaugaccgacacuacgccuuucggccagcagcgaguguuuaaagagaagguugauacacggacccaggagcccaaagaagguacuaagaaacugaugaagaucaccgcugaguggcucuggaaagaacuugggaagaagaaaacaccacguauguguacgagagaggaguucacccgcaaggugaggaguaacgccgcacugggagccauuuuuacugacgaaaauaaauggaaguccgcucgggaggcggucgaagauagcagauucugggaguuaguggacaaagaacgcaaccugcacuuggagggcaagugcgagacauguguauacaauaugaugggcaagagggagaaaaagcucggggaguuuggaaaagccaaggguucacgagcaauaugguacauguggcugggcgcucgguuccuagaauuugaggcccuuggguuccugaacgaagaucauugguuuuccagagaaaauucucucagcggaguggagggcgagggucugcacaaauugggguauauccugagggacguuaguaagaaggagggaggcgcaauguacgccgaugacaccgcuggcugggacacucgcauuacacucgaagaucuuaaaaacgaggaaauggucaccaaucacauggagggggagcauaagaaacuggccgaagcgaucuucaaguuaacauaucaaaacaaaguggugcguguccagcggccuacucccagaggaaccguuauggacaucauuuccaggcgcgaucagcgagguagcggccaaguggggacguacggacugaauaccuuuacaaacauggaggcacaguugauacggcagauggaaggcgaggguguauucaagaauauccagcaccucacugugaccgaggaagucgccgugcaaaacuggcuggcuagaguugggagggagcgccuaucuagaauggccauuucaggagacgauugcguggucaagccacuugacgaucgguucgcaaacgcucugacagcccucaaugacaugggcaaaaucaggaaggauauucagcagugggaacccaguaaaggcuggaacgacuggacucaggugccuuuuugcucccaucacuuccaugagcugaucaugaaggaugggcguguauugguugugccaugucgaaaucaagacgaauuaauaggacgcgcuagaaucagccagggugccggcuggucucugcgggagaccgcaugccucgggaaaucguaugcgcagauguggucacuuauguacuuucacaggcgcgaucugagacuagccgcuaacgccauuuguagcgcagucccgucccacugggugcccacgagucggacaaccuggucuauccaugcuaagcacgaguggaugacuacagaagacaugcugaccguguggaauagggucuggauucgagagaacccuuggauggaagacaagacuccaguugagagcugggaagagauccccuaucucggaaaacgugaggaucaguggugcggcuccuugauaggucugaccucaagagccacaugggcaaagaauauucaagccgcgaucaaccaggugcgcagucuuauugggaaugaagaguacacggacuacaugccuucuaugaaacgguucaggagagaagaggaagaggcuggaguacugugguga

SEQ ID NO: 14434 - RNA, 9876 nt, Artificial Sequence
  derived and/or modified CDS sequence (opt3) from DENV-2__GQ868622__SS-prME
agcgccggaaugaucauuaugcugauacccaccgugauggcuuuccaccucaccacucggaacggggaaccucauaugaucguagguauucaagaaaagggaaaaucccuucuguuuaagacggaggacggcguuaauaugugcaccuugauggcaauggauuuaggggaacugugugaggacacaaucacuuacaaaugcccacuacucaggcaaaacgaaccggaggauauugacuguuggugcaauucuaccucaacaugggugaccuauggaacuuguacaaccacgggcgagcaccggcgcgaaaagcgaaguguagcccuggugccccaugucgguauggggcuugagacucguaccgaaacauggaugagcuccgagggagcguggaaacacgcucagaggaucgagacuuggauacugaggcauccuggcuucaccaucauggccgcaauuuuggccuacacaaucggcaccacgcacuuucagcgggcucucauuuucauccugcugacugcaguggccccaucuaugacaaugcgcugcauagggauuucgaacagagauuuuguugaaggagugucagguggcagcugggucgacaucgugcucgagcacgggaguuguguaaccacuauggcuaagaauaagcccacauuagauuucgaacugauuaaaaccgaggccaggcagccugcgacgcuucggaaguauugcaucgaagcaaaauugaccaacacaacuaccgagucccgcuguccaacacaaggagagcccucucugaaggaagaacaggacaaacgauuuguuugcaagcauagcaugguggauagaggcugggguaauggguguggacuauucggcaagggcgggaucgucacuugcgccauguuuaccugcaaaaagaacauggaaggaaaaauugugcagccugagaaucucgaauacacaauaguggucaccccacacuccggugaggagcaugcuguuggcaacgacacugggaagcacggaaaagaaaucaaggugacgccgcagucaaguauuacagaggccgaacugaccggcuaugguacuguaaccauggaguguagccccaggacagggcuugauuucaaugaaauggugcuguugcaaauggagaacaaagcauggcucguccaccggcagugguuucuggacuuaccucugccauggcuccccggcgcugauaagcagggaucuaauuggauccagaaggagacccuugugacuuucaaaaacccucaugccaagaaacaagacguugugguccugggcucccaggaaggggcgaugcacacagccuugacgggagcaaccgagauacagaugucaagcgguaaucuacuguuuacuggccaucucaagugccgucugcgcauggacaaacuucaacugaaggggaugaguuacucuauguguacaggaaaguucaaagugguaaaggaaauugcugagacccagcacggcacaaucguuaucagagugcaguaugagggugauggguccccaugcaaaauucccuucgaaaucauggacuuggagaagagguacguccucggccggcugauuacugugaacccgauagucaccgaaaaagauagcccugugaacaucgaggccgaacccccauuuggagacucguacauuaucaucggcguugagccugggcaguuaaagcugaauugguucaagaaaggaucuuccauuggucaaauguuugagacgaccaugcgaggcgcuaagcgcauggccauacuaggggauacagcaugggacuucggaucacucggcgguguguuuacaaguaucgggaaagcccugcaucagguauucggcgcuauuuauggagcggcauuuagcggcgucuccuggaccaugaagauccuuauuggggugaucauaacauggaucggaaugaacucuagaagcacuucauugaguguuucccuggugcucgucggcauugugacccuguaccuugguguaauggugcaggccgauagcggguguguugucucuuggaaaaauaaggaacugaagugcggaucaggcaucuucauuacggacaacgugcacacauggaccgagcaguauaaauuucaacccgaaaguccaagcaaguuggcuuccgccauccagaaagcacaggaggaagguauauguggcauuaggucugugacucggcucgagaaucugauguggaagcagaucacacccgaguuaaaccacauucuggccgaaaaugaggucaaacuaaccaucaugacuggggauauaaagggaaucaugcaagcuggcaaacgcucgcucagaccucagccaaccgaacugaaguacagcuggaagacaugggggaaagccaagaugcuuuccacggagucacauaaccagaccuucuugauugacggaccggaaacugcagagugccccaauacaaacagggcguggaauagucuggagguugaagauuauggcuuugguguguucaccacaaacaucuggcucaaacugaaggagaaacaggacgcuuuuugugacucuaaguuaaugagcgccgcaauuaaggauaaucgugccgugcacgcugacaugggguacuggaucgaauccgcccugaacgauacuuggaaaauagagaaggcaucauucauugaggucaagaauugccauuggccuaagagccacacccuuuggucuaacggagucuuggaauccgagaugaucauccccaaaaaccucgcuggccccgugagucaacacaauuaucggccugguuaccauacgcagauugccggcccauggcaccuggggaagcuagaaauggacuucgauuuuugugacggaacaaccguuaucgugacugaggauugcggcaaccgagggcccagccugagaaccacaacugcgucuggaaagcucauuaccgaauggugcuguagguccugcacacugccgccucuucgcuaccggggcgaggacgguuguugguaugggauggagauaagaccauugaaagaaaaggaggaaaaucuggucaacucauuagugacggccggacauggccagguugauaauuucagucucggugugcugggcauggcucuuuuucuggaggaaauguugaggacccgcguagggacuaaacacgcaauccuccuggucgccgugagcuucgugacacuaauuaccggaaacaugucguuuaaggaccugggccgagucguugugaugguaggggcuacuaugacagaugacaucggaaugggcgugaccuaccucgcccugcuugcagcguucaaaguccggcccacguuugccgcugguuugcuguuacguaagcucacuuccaaggagcugaugaugaccacaauugggaucgugcuucugucucaaagcaccauaccugagacuauccuagaacucacagaugcccuggcauugggaaugaugguucugaaaauugugagagacauggagaaguaucaguuagcugucaccaucauggccauucucugcgugcccaaugcaguuauccugcagaacgccuggaaagugucauguacaauacuugcugucguaaguguguccccacuguugcucacuucuagccagcaaaagaccgacuggauuccucuggcgcuaacgaucaaaggccugaaucccacagccaucuuccuuaccacucucuccaggaccaacaagaaacgcucauggccacugaaugaagcaauuauggcuguuggcauggugagcauauuggccaguucucuguuaaagaacgauaucccgaugacagggccucucgucgccggaggucugcuuacugugugcuacguacugaccggccgguccgcugacuuggagcucgaaagagcaacggaugugaagugggaggaccaggccgagauuagcgggucgucacccauccugucuauuacaaucagugaagauggauccaugagcaucaaaaaugaggaagaggagcagacccuaacuauccugauuaggacaggccuucucgucaucucuggucuguuuccaguuagcauucccaucaccgcggcugccugguauuugugggaagugaagaaacagcgagcagggguguuaugggacgucccuuccccacccccuaugggaaaggccgagcuggaagauggcgcuuaccgcauaaaacaaaagggcauucucggguauucacagaucggagccgguguguacaaggagggcacuuuccauacaauguggcacguuaccagaggggcaguacugaugcacaaaggaaagagaaucgaaccgaguugggcggacgugaaaaaggaucuuauuagcuacggcgguggguggaaacuggagggagaguggaaggaaggcgaggaaguccagguguuggcucuagagccaggcaagaaccccagggccguucagacgaaaccugggcuguuuaagacuaauaccggaacaaucggugcagugucucucgacuucuccccaggcaccucagggagucccauaauugauaaaaagggaaaagucgugggccuguaugguaacgggguagucacacguagcggagccuacguguccgcuaucgcccaaacugaaaagucuauugaggacaacccugagaucgaagaugacauauuucgcaagcggagacuuaccauuauggacuuacauccgggcgcaggcaaaacgaagagguaucugcccgcuaucguucgagaggccaucaaacgggggcuccgcacauugauucuggcgccaacuagaguggucgccgcagaaauggaggaagcucucaggggacugccuauccgguaccagacccccgccauucgagcugagcacacagguagagagauaguggaucuuaugugucaugcaaccuucacuaugcgccuguugucgccaguuagggugccuaauuauaaccuaaucauuauggacgaagcccacuucaccgaucccgccagcaucgcugcgcguggcuacaucucaacacgggucgagaugggggaagcagccggaauuuuuaugacggcuacuccaccgggcuccagagacccuuucccccagaguaaugccccaauaaucgaugaggagagggaaauucccgagcgcucuuggaacagcggucaugaaugggugaccgacuuuaaggggaaaacaguaugguucgugccuuccaucaaggcaggaaaugauauugccgcuugccugcgaaagaacggcaaaaagguuauccaacucucaagaaaaaccuuugacucugaguaugucaagacucggacaaaugauugggacuucguggugaccacggauauaagcgaaaugggcgcgaacuuuaaagccgagagggucaucgacccacgccguuguaugaagcccguaauuuuaacugacggggaggaaagagugauccuggcaggaccuaugccgguuacacacaguuccgcugcccagcggaggggucgcauuggccgaaaucccaaaaacgagaaugaucaguacaucuacaugggggaaccccuugagaacgacgaagauugcgcacacuggaaggaggccaagaugcugcucgacaauauaaacaccccugagggaauuauccccagcauguucgaaccagagagagaaaaaguggaugcuauugacggcgaguaucgguugaggggugaagcccgcaagaccuuugucgaucugaugagaagaggggaccucccuguguggcuggcguacaaaguugcagccgagggcaucaauuaugcugaucggcguugguguuucgacggaauaaagaacaaccagauccuugaggaaaauguggaggucgaaauuuggacuaaagagggcgagcgcaagaagcuaaaaccccgauggcuggaugccagaaucuacucugacccauuggcuuuaaaggaauuuaaagaguucgcagccgggaggaagucacugacacucaaccugauuaccgaaaugggacggcuuccuacauucaugacucagaaaacgcgcgaugcucuggacaaucucgccguguugcauaccgcagaggcggguggcagagccuauaaccacgcucuguccgaacuaccggagacacuggagacucuccuucuguuaaccuugcuggccacaguaaccgggggaaucuuucucuuccugaugaguggcagggguauagggaagaugacucuuggcaugugcugcauuaucacggcaagcauccugcucugguacgcucagauucagccccauuggaucgccgcaucgauaauuuuggaauuuuuccugaucguguuacuaauuccagagccugaaaagcagcggaccccacaagacaaucagcugacauauguugucaucgccauacucacugugguggcugcgaccauggccaacgagaugggauuucuugagaaaacuaagaaagaucugggcuuggggucuaucgcaacccagcagccagaauccaauauucuggacaucgaucuccgaccugcuagcgccuggacucuguacgccgucgcaacaacguucguuacccccaugcuuagacacucaauugagaacaguucugugaauguaucccucacugcuaucgccaaccaagcgacagugcugaugggauuggguaagggcuggccgcugagcaaaauggacauuggggucccauuacuagcuaucggauguuacucacaggugaauccuauaacccugaccgccgcacuccuucuguugguugcccacuaugcuauuaucggccccggucugcaggcaaaggccacacgcgaagcgcagaagagggcugccgcagggaucaugaaaaacccaacuguggauggcauuacggucauagaccucgaucccaucccuuacgacccgaaguuugagaaacaacugggacagguaaugcuuuuaauucugugcgugacccagguucucaugaugcggacaacuugggccuugugugaagcucugacccuagccacaggccccaucaguacccugugggaggggaauccaggacguuucuggaacacuacgauugcagugagcauggcuaauaucuuuagaggcuccuaucucgccggugcggggcuucuguucucuauaaugaagaacacaaccaauacuaggcgcggaaccggcaacaucggugaaacauugggcgagaaauggaaaagccggcugaacgcccucgggaaauccgaguuucaaacuuacaagaagucaggcauucaggaagucgaucgaacccuggcaaaagagggcaucaagagaggggaaacagaccaucacgcugugucuaggggaagugccaaauuacgcugguucgucgagcggaauauggugacgccugagggcaagguuguggaucuugguugcgggagaggaggcuggucguauuacugugguggccugaaaaacguacgugaagugaaggggcucaccaagggaggccccgggcaugaggaaccuauuccaaugagcacuuauggauggaaucuagucaggcugcaguccggcguugacguguuuuucauaccaccugagaaaugcgauacauugcugugugacauaggugaaucuucaccaaaccccaccgucgaggcagggcggacucuccgcgugcuuaaucugguagagaacugguugaauaacaauacacaguucugcauuaaggugcugaacccguacaugccuagcguuaucgagaaaauggaggcucuccaacgaaaguacggaggcgccuuagugagaaauccacuguccaggaacaguacccacgaaauguauugggucucuaaugccagcggcaacaucgugucauccgucaauaugauuagucggaugcuuauaaaccgcuuuacgaugagacauaaaaaggcgaccuacgagcccgacguggaucuggggagcggaacaaggaacaucgguauugaaucugagaucccuaaucuagacauuaucggcaagcgaauagagaaaaucaagcaggaacacgagacuuccuggcacuaugaucaggaccauccauacaaaaccugggcuuaucacgggucauacgaaacaaagcagacuggaagcgcaucgucuaugguuaacggcguagugcggcuccugaccaaacccugggaugucuugccgacagugacccaaauggccaugacugacacgacaccuuucggucagcagcguguuuuuaaggagaagguggauaccagaacucaggaacccaaagaggggaccaagaaacugaugaagauuacagcugaguggcucuggaaagaacuuggaaagaaaaagacgccacgcauguguaccagggaggaguucacucggaaggucagaaguaaugccgcacugggcgccaucuuuacagacgagaacaaauggaaguccgcucgcgaggcgguggaagauaggcgauucugggaguuaguagacaaagaacggaaucugcauuuggagggcaagugcgaaaccuguguguauaacaugauggggaaaagagagaagaagcucggagaguuugguaaagccaagggcagcagggcaauuugguacauguggcugggggcucgcuuccuagaauuugaggcccuuggauuccugaaugaagaucacugguuuucacgugagaacucccucucuggcguugaaggugaggggcugcacaaauugggauacauccugcgggacgucagcaagaaagagggcggcgcaauguaugccgacgauacugcugggugggacacaagaauuacccucgaagaucuuaagaaugaggaaauggugacaaaccauauggagggagaacacaagaaacuggccgaggcgauauucaaguuaacuuaccaaaauaaaguggucaggguucagcgcccuacaccccgagguacggugauggacaucauuagucggagagaucagaggggcuccgggcaaguaggaaccuauggccugaacacauuuacuaauauggaggcacaguugauccgccagauggaaggugaggggguguucaagaacauccagcaucucaccgccacagaagaggucgcugugcaaaauuggcuggccagaguuggacgggagaggcuaagccguauggcaauuucuggcgacgauugcguggucaaaccacuugacgaucgauucgcuaacgcccugacugcucucaacgacaugggcaagauacgcaaggauauccagcagugggaacccucaaaaggguggaaugacuggacccaggugccuuuuugcagucaccauuuccacgagcugauuaugaaggauggaagaguauugguugugccaugucggaaccaagacgaauuaaucgguagggcccgcauuucccagggcgcaggguggagccugagagagacggcgugccucggaaaaucuuacgcccagauguggucgcuuauguauuuucaccggagggaccugcgacuagcugccaaugcaaucuguucagcugucccgagccauugggugcccacaucccguaccacuuggaguauacacgccaagcaugaauggaugacaaccgaggauaugcugacuguguggaacagagucuggauccgcgagaauccuuggauggaagacaaaaccccaguugagucuugggaagagauucccuaccucggcaagcgggaagaucaguggugcgguagcuugaucgggcugacauccagggcaacgugggccaagaacauucaagcggcuaucaaucaggugagaucacuuauaggaaacgaggaguauaccgacuacaugccuaguaugaaacgcuuccggagggaagaggaagaggccggcguacugugguga

SEQ ID NO: 14435 - RNA, 9876 nt, Artificial Sequence
  derived and/or modified CDS sequence (opt3) from DENV-2__FJ639705__SS-prME
agcgccggaaugaucauuaugcugauacccaccgugauggcuuuccaccucaccacucggaacggggaaccucauaugaucguagguauucaagaaaagggaaaaucccuucuguuuaagacggaagacggcguuaauaugugcaccuugauggcaauggauuuaggggaacugugugaggacacaaucacuuacaaaugcccacuacucaggcaaaacgaaccggaggauauugacuguuggugcaauucuaccucaacaugggugaccuauggaacuuguacaaccacgggcgagcaccggcgcgaaaagcgaaguguagcccuggugccccaugucgguauggggcuugagacucguaccgaaacauggaugagcuccgagggagcguggaaacacgcucagaggaucgagacuuggauacugaggcauccuggcuucaccaucauggccgcaauuuuggccuacacaaucggcaccacgcacuuucagcgggcucucauuuucauccugcugacugcaguggccccaucuaugacaaugcgcugcauagggauuucgaacagagauuuuguugaaggagugucagguggcagcugggucgacaucgugcucgagcacgggaguuguguaaccacuauggcuaagaauaagcccacauuagauuucgaacugauuaaaaccgaggccaggcagccugcgacgcuucggaaguauugcaucgaagcaaaauugaccaacacaacuaccgagucccgcuguccaacacaaggagagcccucucugaaggaagaacaggacaaacgauuuguuugcaagcauagcaugguggauagaggcugggguaauggguguggacuauucggcaagggcgggaucgucacuugcgccauguuuaccugcaaaaagaacauggaaggaaaaauugugcagccugagaaucucgaauacacaauaguggucaccccacacuccggugaggagcaugcuguuggcaacgacacugggaagcacggaaaagaaaucaaggugacgccgcagucaaguauuacagaggccgaacugaccggcuaugguacuguaaccauggaguguagccccaggacagggcuugauuucaaugaaauggugcuguugcaaauggagaacaaagcauggcucguccaccggcagugguuucuggacuuaccucugccauggcuccccggcgcugauaagcagggaucuaauuggauccagaaggagacccuugugacuuucaaaaacccucaugccaagaaacaagacguugugguccugggcucccaggaaggggcgaugcacacagccuugacgggagcaaccgagauacagaugucaagcgguaaucuacuguuuacuggccaucucaagugccgucugcgcauggacaaacuucaacugaaggggaugaguuacucuauguguacaggaaaguucaaagugguaaaggaaauugcugagacccagcacggcacaaucguuaucagagugcaguaugagggugauggguccccaugcaaaauucccuucgaaaucauggacuuggagaagagguacguccucggccggcugauuacugugaacccgauagucaccgaaaaagauagcccugugaacaucgaggccgaacccccauuuggagacucguacauuaucaucggcguugagccugggcaguuaaagcugaauugguucaagaaaggaucuuccauuggucaaauguuugagacgaccaugcgaggcgcuaagcgcauggccauacuaggggauacagcaugggacuucggaucacucggcgguguguuuacaaguaucgggaaagcccugcaucagguauucggcgcuauuuauggagcggcauuuagcggcgucuccuggaccaugaagauccuuauuggggugaucauaacauggaucggaaugaacucuagaagcacuucauugaguguuucccuggugcucgucggcauugugacccuguaccuugguguaauggugcaggccgauagcggguguguugucucuuggaaaaauaaggaacugaagugcggaucaggcaucuucauuacggacaacgugcacacauggaccgagcaguauaaauuucaacccgaaaguccaagcaaguuggcuuccgccauccagaaagcacaggaggaagguauauguggcauuaggucugugacucggcucgagaaucugauguggaagcagaucacacccgaguuaaaccacauucuggccgaaaaugaggucaaacuaaccaucaugacuggggauauaaagggaaucaugcaagcuggcaaacgcucgcucagaccucagccaaccgaacugaaguacagcuggaagacaugggggaaagccaagaugcuuuccacggagucacauaaccagaccuucuugauugacggaccggaaacugcagagugccccaauacaaacagggcguggaauagucuggagguugaagauuauggcuuugguguguucaccacaaacaucuggcucaaacugaaggagaaacaggacgcuuuuugugacucuaaguuaaugagcgccgcaauuaaggauaaucgugccgugcacgcugacaugggguacuggaucgaauccgcccugaacgauacuuggaaaauagagaaggcaucauucauugaggucaagaauugccauuggccuaagagccacacccuuuggucuaacggagucuuggaauccgagaugaucauccccaaaaaccucgcuggccccgugagucaacacaauuaucggccugguuaccauacgcagauugccggcccauggcaccuggggaagcuagaaauggacuucgauuuuugugacggaacaaccguuaucgugacugaggauugcggcaaccgagggcccagccugagaaccacaacugcgucuggaaagcucauuaccgaauggugcuguagguccugcacacugccgccucuucgcuaccggggcgaggacgguuguugguaugggauggagauaagaccauugaaagaaaaggaggaaaaucuggucaacucauuagugacggccggacauggccagguugauaauuucagucucggugugcugggcauggcucuuuuucuggaggaaauguugaggacccgcguagggacuaaacacgcaauccuccuggucgccgugagcuucgugacacuaauuaccggaaacaugucguuuaaggaccugggccgagucguugugaugguaggggcuacuaugacagaugacaucggaaugggcgugaccuaccucgcccugcuugcagcguucaaaguccggcccacguuugccgcugguuugcuguuacguaagcucacuuccaaggagcugaugaugaccacaauugggaucgugcuucugucucaaagcaccauaccugagacuauccuagaacucacagaugcccuggcauugggaaugaugguucugaaaauugugagagacauggagaaguaucaguuagcugucaccaucauggccauucucugcgugcccaaugcaguuauccugcagaacgccuggaaagugucauguacaauacuugcugucguaaguguguccccacuguugcucacuucuagccagcaaaagaccgacuggauuccucuggcgcuaacgaucaaaggccugaaucccacagccaucuuccuuaccacucucuccaggaccaacaagaaacgcucauggccacugaaugaagcaauuauggcuguuggcauggugagcauauuggccaguucucuguuaaagaacgauaucccgaugacagggccucucgucgccggaggucugcuuacugugugcuacguacugaccggccgguccgcugacuuggagcucgaaagagcaacggaugugaagugggaggaccaggccgagauuagcgggucgucacccauccugucuauuacaaucagugaagauggauccaugagcaucaaaaaugaggaagaggagcagacccuaacuauccugauuaggacaggccuucucgucaucucuggucuguuuccaguuagcauucccaucaccgcggcugccugguauuugugggaagugaagaaacagcgagcagggguguuaugggacgucccuuccccacccccuaugggaaaggccgagcuggaagauggcgcuuaccgcauaaaacaaaagggcauucucggguauucacagaucggagccgguguguacaaggagggcacuuuccauacaauguggcacguuaccagaggggcaguacugaugcacaaaggaaagagaaucgaaccgaguugggcggacgugaaaaaggaucuuauuagcuacggcgguggguggaaacuggagggagaguggaaggaaggcgaggaaguccagguguuggcucuagagccaggcaagaaccccagggccguucagacgaaaccugggcuguuuaagacuaauaccggaacaaucggugcagugucucucgacuucuccccaggcaccucagggagucccauaauugauaaaaagggaaaagucgugggccuguaugguaacgggguagucacacguagcggagccuacguguccgcuaucgcccaaacugaaaagucuauugaggacaacccugagaucgaagaugacauauuucgcaagcggagacuuaccauuauggacuuacauccgggcgcaggcaaaacgaagagguaucugcccgcuaucguucgagaggccaucaaacgggggcuccgcacauugauucuggcgccaacuagaguggucgccgcagaaauggaggaagcucucaggggacugccuauccgguaccagacccccgccauucgagcugagcacacagguagagagauaguggaucuuaugugucaugcaaccuucacuaugcgccuguugucgccaguuagggugccuaauuauaaccuaaucauuauggacgaagcccacuucaccgaucccgccagcaucgcugcgcguggcuacaucucaacacgggucgagaugggggaagcagccggaauuuuuaugacggcuacuccaccgggcuccagagacccuuucccccagaguaaugccccaauaaucgaugaggagagggaaauucccgagcgcucuuggaacagcggucaugaaugggugaccgacuuuaaggggaaaacaguaugguucgugccuuccaucaaggcaggaaaugauauugccgcuugccugcgaaagaacggcaaaaagguuauccaacucucaagaaaaaccuuugacucugaguaugucaagacucggacaaaugauugggacuucguggugaccacggauauaagcgaaaugggcgcgaacuuuaaagccgagagggucaucgacccacgccguuguaugaagcccguaauuuuaacugacggggaggaaagagugauccuggcaggaccuaugccgguuacacacaguuccgcugcccagcggaggggucgcauuggccgaaaucccaaaaacgagaaugaucaguacaucuacaugggggaaccccuugagaacgacgaagauugcgcacacuggaaggaggccaagaugcugcucgacaauauaaacaccccugagggaauuauccccagcauguucgaaccagagagagaaaaaguggaugcuauugacggcgaguaucgguugaggggugaagcccgcaagaccuuugucgaucugaugagaagaggggaccucccuguguggcuggcguacaaaguugcagccgagggcaucaauuaugcugaucggcguugguguuucgacggaauaaagaacaaccagauccuugaggaaaauguggaggucgaaauuuggacuaaagagggcgagcgcaagaagcuaaaaccccgauggcuggaugccagaaucuacucugacccauuggcuuuaaaggaauuuaaagaguucgcagccgggaggaagucacugacacucaaccugauuaccgaaaugggacggcuuccuacauucaugacucagaaaacgcgcgaugcucuggacaaucucgccguguugcauaccgcagaggcggguggcagagccuauaaccacgcucuguccgaacuaccggagacacuggagacucuccuucuguuaaccuugcuggccacaguaaccgggggaaucuuucucuuccugaugaguggcagggguauagggaagaugacucuuggcaugugcugcauuaucacggcaagcauccugcucugguacgcucagauucagccccauuggaucgccgcaucgauaauuuuggaauuuuuccugaucguguuacuaauuccagagccugaaaagcagcggaccccacaagacaaucagcugacauauguugucaucgccauacucacugugguggcugcgaccauggccaacgagaugggauuucuugagaaaacuaagaaagaucugggcuuggggucuaucgcaacccagcagccagaauccaauauucuggacaucgaucuccgaccugcuagcgccuggacucuguacgccgucgcaacaacguucguuacccccaugcuuagacacucaauugagaacaguucugugaauguaucccucacugcuaucgccaaccaagcgacagugcugaugggauuggguaagggcuggccgcugagcaaaauggacauuggggucccauuacuagcuaucggauguuacucacaggugaauccuauaacccugaccgccgcacuccuuagucugguugcccacuaugcuauuaucggccccgguuugcaggcaaaggccacacgcgaagcgcagaagagggcugccgcagggaucaugaaaaacccaacuguggauggcauuacggucauagaccuggaucccaucccuuacgacccgaaguuugagaaacaacucggacagguaaugcugcuuauuuuaugcgugacccagguucugaugaugcggacaacuugggcccucugugaggcuuugacccuggccacaggccccaucagcacccuaugggaggggaauccaggacguuucuggaacacuacgauugcaguguccauggcuaauaucuuuagaggcucuuaucuggccggugcggggcuccuuuucagcauaaugaagaacacaaccaauacuaggcgcggaaccggcaacaucggugaaacacugggcgagaaauggaagucccgguugaacgcccuggggaaaucagaguuucaaacuuacaagaagucuggcauucaggaagucgaucgaacccucgcaaaagagggcaucaagagaggggaaacagaccaucacgcugugaguaggggaucggccaaacugcgcugguucgucgagcggaauauggugacgccugagggcaagguuguggauuuagguugcgggagaggaggcuggagcuauuacugugguggccuuaaaaacguacgugaagugaaggggcugaccaagggaggccccgggcaugaggaaccuauuccaauguccacuuauggauggaaucucgucaggcuacagucuggcguugacguguuuuucauaccaccugagaaaugcgauacacuguugugugacauaggugaaucaagcccaaaccccaccgucgaggcagggcggacucugcgcgugcucaaucuuguagagaacuggcugaauaacaauacacaguucugcauuaagguguugaacccguacaugccuuccguuaucgagaaaauggaggcucugcaacgaaaguacggaggcgcccucgugagaaauccauuaaguaggaacucuacccacgaaauguauugggucagcaaugccucaggcaacaucguguccagugucaauaugauuagccggaugcugauaaaccgcuuuacgaugagacauaaaaaggcgaccuacgagcccgacguggaucuugggucuggaacaaggaacaucgguauugaauccgagaucccuaaucuggacauuaucggcaagcgaauagagaaaaucaagcaggaacacgagacuucauggcacuaugaucaggaccauccauacaaaaccugggcuuaucacgggagcuacgaaacaaagcagacuggaucggcaucuaguaugguuaacggcguagugcggcuacucaccaaacccugggauguccugccgacagugacccaaauggccaugacugacacgacaccuuucggucagcagcguguuuuuaaggagaagguggauaccagaacucaggaacccaaagaggggaccaagaaauugaugaagauuacagcugaguggcuguggaaagaacucggaaagaaaaagacgccacgcauguguaccagggaggaguucacucggaaggucagauccaaugccgcacuuggcgccaucuuuacagacgagaacaaauggaaaagcgcucgcgaggcgguggaagauucaagguucugggagcugguagacaaagaacgaaauuuacaucuggagggcaagugcgaaaccuguguguauaacaugauggggaaacgggagaagaaguugggagaguuugguaaagccaagggcuccagagcaauuugguacauguggcucggggcuagguuccuggaauuugaggcccuaggauuccuuaaugaagaucacugguuuucucgcgagaacagccugaguggcguugaaggugaggggcuccacaaacugggauacaucuugcgugacgucuccaagaaagagggcggcgcaauguaugccgacgauacugcugggugggacacacggauuacccuggaagaucucaagaaugaggaaauggugacaaaccauauggagggagaacacaagaaacuugccgaggcgauauucaagcugacuuaccaaaauaaaguggucagaguucagaggccuacaccccgcgguacggugauggacaucauuagccgacgggaucagagaggcucugggcaaguaggaaccuauggcuuaaacacauuuacuaauauggaggcacagcugaucaggcagauggaaggugaggggguguucaagaacauccagcauuugaccgccacagaagaggucgcugugcaaaauuggcucgcccgcguuggaagagagcggcugucaaggauggcaauuaguggcgacgauugcguggucaaaccacuagacgaucguuucgcuaacgcccuuacugcucugaacgacaugggcaagauacgaaaggauauccagcagugggaacccuccaaaggguggaaugacuggacccaggugccuuuuugcagccaccauuuccacgagcucauuaugaaggauggacgcguacugguugugccauguagaaaccaagacgaauugaucggucgggccaggauuucucagggcgcaggguggucguuacgcgagacggcgugccugggaaaaucauacgcccagauguggagccucauguauuuucacagacgggaccuuaggcuggcugccaaugcaaucuguuccgcugucccgagucauugggugcccacaucucgaaccacuuggagcauacacgccaagcaugaauggaugacaaccgaggauaugcuaacuguguggaaccgugucuggaucagagagaauccuuggauggaagacaaaaccccaguugaguccugggaagagauucccuaccugggcaagcgcgaagaucaguggugcgguucacucaucggguugacaagucgggcaacgugggccaagaacauucaagcggcuaucaaucaggugaggucucugauaggaaacgaggaguauaccgacuacaugccuagcaugaaaagauuccgccgggaagaggaagaggccggcguacuuugguga

SEQ ID NO: 14436 - RNA, 9876 nt, Artificial Sequence
  derived and/or modified CDS sequence (opt3) from DENV-2__FJ639706__SS-prME
agcgccggaaugaucauuaugcugauacccaccgugauggcuuuccaccucaccacuagaaacggggagccucauaugaucgucgguauucaagaaaagggaaaaucccuucuguuuaagacggaggacggaguuaauaugugcaccuugauggcaauggauuuaggggaacugugugaggacacaaucacuuacaaaugcccacuacucaggcaaaacgaaccggaggauauugacuguuggugcaauucuaccucaacaugggugaccuauggaacuuguacaaccacgggcgagcaccggcgcgaaaagcgaaguguagcccuggugccccaugucgguauggggcuugagacucguaccgaaacauggaugagcuccgagggagcguggaaacacgcucagagaaucgagacuuggauacugaggcauccuggcuucaccaucauggccgcaauuuuggccuacacaaucggcaccacgcacuuucagcgggcucucauuuucauccugcugacugcaguggccccaucuaugacaaugcgcugcauagggauuucgaacagagauuuuguugaaggagugucagguggcagcugggucgacaucgugcucgagcacgggaguuguguuaccacuauggcuaagaauaagcccacauuagauuucgaacugauuaaaaccgaggccaagcagccugcgacgcuuaggaaauauugcaucgaagcaaaguugaccaacacaacuaccgagucccgguguccaacacaaggagagcccucucugaaagaagaacaggacaagcgcuuuguuugcaagcauagcaugguggaucgaggcugggguaauggguguggacuauucggcaaaggcgggaucgucacuugcgccauguuuaccugcaagaaaaacauggaaggaaagauugugcagccugagaaucucgaauacacaauaguggucaccccacacuccggugaggagcaugcuguuggcaacgacacugggaaacacggaaaggaaaucaaagugacgccgcagucaaguauuacagaggccgaacugaccggcuaugguacuguaaccauggaguguagccccagaacagggcuugauuucaaugaaauggugcuguugcaaauggagaacaaggcauggcucguccacaggcagugguuucuggacuuaccucugccauggcuccccggcgcugauaagcagggaucuaauuggauccagaaagagacccuugugacuuucaagaacccucaugccaaaaagcaagacguugugguccugggcucccaggaaggggcgaugcacacagccuugacgggagcaaccgagauacagaugucaagcgguaaucuacuguuuacuggccaucucaaaugccggcugcguauggacaaacuucaacugaaggggaugaguuacucuauguguacaggaaaauucaaggugguaaaagaaauugcugagacccagcacggcacaaucguuauccgcgugcaguaugagggugauggguccccaugcaagauucccuucgaaaucauggacuuggagaaaagauacguccucggcaggcugauuacugugaacccgauagucaccgaaaaggauagcccugugaacaucgaggccgaacccccauuuggagacucguacauuaucaucggcguugagccugggcaguuaaagcugaauugguucaaaaagggaucuuccauuggucaaauguuugagacgaccaugcggggcgcuaaacgaauggccauacuaggggauacagcaugggacuucggaucacucggcgguguguuuacaaguaucgggaaggcccugcaucagguauucggcgcuauuuauggagcggcauuuagcggcgucuccuggaccaugaaaauccuuauuggggugaucauaacauggaucggaaugaacucucgcagcacuucauugaguguuucccuggugcucgucggcauugugacccuguaccuugguguaauggugcaggccgauagcggguguguugucucuuggaagaauaaggaacugaaaugcggaucaggcaucuucauuacggacaacgugcacacauggaccgagcaguauaaguuucaacccgaaaguccaagcaaauuggcuuccgccauccagaaggcacaggaggaagguauauguggcauuagaucugugacuaggcucgagaaucugauguggaaacagaucacacccgaguuaaaccacauucuggccgaaaaugaggucaagcuaaccaucaugacuggggauauaaaaggaaucaugcaagcuggcaagcggucgcuccgcccucagccaaccgaacugaaguacagcuggaaaacaugggggaaggccaaaaugcuuuccacggagucacauaaccagaccuucuugauugacggaccggaaacugcagagugccccaauacaaacagagcguggaauagucuggagguugaagauuauggcuuugguguguucaccacaaacaucuggcucaagcugaaagagaagcaggacgcuuuuugugacucuaaguuaaugagcgccgcaauuaaagauaauagggccgugcacgcugacaugggguacuggaucgaauccgcccugaacgauacuuggaagauagagaaagcaucauucauugagguaaagaauugccauuggccuaaaagccacacccuuuggucuaacggagucuuggaauccgagaugaucaucccaaagaaccucgcuggccccgugagucaacacaauuaucguccugguuaccauacgcagauugccggcccauggcaccuggggaagcuagaaauggacuucgauuuuugugacggaacaaccguuaucgugacugaggauugcggcaaccgggggcccagccugcgaaccacaacugcgucuggaaaacucauuaccgaauggugcuguagauccugcacacugccgccucuuagguaccgcggcgaggacgguuguugguaugggauggagauacggccauugaaggaaaaagaggaaaaucuggucaacucauuagugacggccggacauggccagguugauaauuucagucucggugugcugggcauggcucuuuuucuggaggaaauguugagaaccaggguagggacuaagcacgcaauccuccuggucgccgugagcuucgugacacuaauuaccggaaacaugucguuuaaagaccugggccgcgucguugugaugguaggggcuacuaugacagaugacaucggaaugggcgugaccuaccucgcccugcuugcagcguucaagguccgacccacguuugccgcugguuugcuguuacggaagcucacuuccaaagagcugaugaugaccacaauugggaucgcccuucugucucaaagcaccauaccugagacuauccuagaacucacagaugcacuggcuuugggaaugauggugcugaagauuguucgugacauggagaaauaucaguuagccgugaccaucauggcaauucucugcguccccaaugccgugauccugcagaacgcuuggaagguuucauguacaauacuugcgguggucaguguauccccacuguugcucacuucuagccagcagaagaccgacuggauuccucuggcccuaacgaucaagggccugaaucccacagcaaucuuccuuaccacucucuccagaaccaacaaaaagaggucauggccacugaaugaagcuauuauggccgugggcaugguuagcauauuggccaguucucuguuaaagaacgauaucccgaugacagggccucucguggcuggaggucugcuuacugucugcuacgugcugaccggccgcuccgcagacuuggagcucgaacgggccacggauguaaaaugggaggaccaggcggagauuagcgggucgucacccauccugucuauuacaaucagugaagauggauccaugagcauaaagaaugaggaagaggagcagacccuaacuauccugauuagaacaggccuucucgugaucucuggucuguuuccagucagcauucccaucaccgcugccgcaugguauuugugggaaguuaaaaagcagagggccgggguguuaugggacgugccuuccccacccccuaugggaaaagcugagcuggaagauggcgcauaccgaauaaagcaaaagggcauucucggguauucacagaucggagccggugucuacaaagagggcacuuuccauacaauguggcacgugacccgcggggcgguucugaugcacaagggaaaacggaucgaaccgaguugggcugacguaaagaaagaucuuauuagcuacggcgguggguggaagcuggagggagaguggaaggaaggcgaggaagugcaggucuuggcccuagagccaggcaaaaaccccagagcagugcagacgaagccugggcuguuuaaaacuaauaccggaacaaucggugccguuucucucgacuucuccccaggcaccucagggagucccauaauugauaagaaaggaaagguggucggccuguaugguaacggggugguaacaaggagcggagcuuacgucuccgccaucgcacaaacugaaaagucuauugaggacaacccugagaucgaagaugacauauuucguaaacgccggcuuaccauuauggacuuacauccgggcgcuggcaagacgaaaagauaucugcccgccaucgugagggaggcgaucaagcgagggcuccggacauugauucuggccccaacucgcguuguggcagcugaaauggaggaagcccucagaggacugccuaucagguaccagacccccgcuauucgggcagagcacacaggucgagagauagucgaucuuaugugucaugccaccuucacuaugagacuguugucgccagugcgcguuccuaauuauaaccuaaucauuauggacgaagcccacuucaccgaucccgcuagcaucgcggcaaggggcuacaucucaacacguguggagaugggggaagccgcuggaauuuuuaugacggccacuccaccgggcucccgggacccuuucccccagaguaaugcaccaauaaucgaugaggagagagaaauucccgagaggucuuggaacagcggucaugaaugggucaccgacuuuaaagggaagacagugugguucguaccuuccaucaaggccggaaaugauauugcugcgugccugcgcaaaaacggcaagaaagugauccaacucucacgaaagaccuuugacucugaguauguuaaaacuagaacaaaugauugggacuucgucgugaccacggauauaagcgaaaugggcgccaacuuuaaggcagagcgggugaucgacccaaggcgcuguaugaaacccgucauuuuaacugacggggaggaacguguaauccuggcuggaccuaugccggugacacacaguuccgccgcacagagacgggguaggauuggccgcaauccaaagaacgagaaugaucaguacaucuacaugggggaaccccuugagaacgacgaagauugcgcccacuggaaggaggcuaaaaugcugcucgacaauauaaacaccccugagggaauuauccccagcauguucgaaccagagcgagaaaagguugaugccauugacggcgaguauagauugcggggugaagcgaggaaaaccuuuguggaucugaugcgcagaggggaccucccugucuggcuggcauacaagguggccgcugagggcaucaauuaugccgauaggcggugguguuucgacggaaucaaaaacaaccagauccuugaggaaaauguugagguggaaauuuggacuaaggagggcgagcguaagaaacuaaagccccgcuggcuggaugcucgaaucuacucugacccauuggcauuaaaagaauuuaaggaguucgccgcugggagaaaaucacugacacucaaccugauuaccgaaaugggaaggcuuccuacauucaugacucaaaagacgcgggaugcccuggacaaucucgcagucuugcauaccgcggaggccgguggccgcgcuuauaaccacgcccuguccgaacuaccggagacacuggagacucuccuucuguuaaccuugcuggcaacagugaccgggggaaucuuucucuuccugaugaguggcagagguauagggaagaugacucuuggcaugugcugcauuaucacggcuagcauccugcucugguacgcccagauucagccccauuggaucgcagccucgauaauuuuggaauuuuuccugaucguauuacuaauuccagagccugaaaaacagaggacaccccaagacaaucagcugacauaugugguuaucgcuauacucacugucguggcggccaccauggcaaacgagaugggauuucuugaaaagacuaaaaaggaucugggcuuggggucuaucgcuacccagcagccagaguccaauauucuggacaucgaucuccggccugccagcgccuggacucuguacgcaguggcuacaacguucgucacccccaugcuucgacacucaauugagaacaguucuguuaaugugucccucacugccaucgcgaaccaagcuacaguacugaugggauuggguaaaggcuggccgcugagcaagauggacauuggggugccauuacuagccaucggauguuacucacaggucaauccuauaacccugaccgcagcccuccuucuguugguggcucacuaugcaauuaucggccccggucugcaggccaaggcgacaagagaagcucagaaacgcgccgcagccgggaucaugaagaacccaacuguugauggcauuacggugauagaccucgaucccaucccuuacgacccgaaauuugagaagcaacugggacaggucaugcuuuuaauucugugcguaacccaggugcucaugaugaggacaacuugggcuuugugugaagcccugacccuagcaacaggccccaucaguacccugugggaggggaauccaggacgguucuggaacacuacgauugcuguuagcauggccaauaucuuucguggcuccuaucucgcgggugccgggcuucuguucucuauaaugaaaaacacaaccaauacuagaaggggaaccggcaacaucggugaaacauugggcgagaaguggaaaagccgccugaacgcacucgggaaguccgaguuucaaacuuacaagaaaucaggcauucaggaaguggaucggacccuggcuaaggagggcaucaaacgaggggaaacagaccaucacgccgucucuagaggaagugcaaaguuaaggugguucguggagcgcaauauggucacgccugagggcaaagugguugaucuugguugcgggcggggaggcuggucguauuacugugguggccugaagaacgugagagaaguaaaggggcucaccaaaggaggccccgggcaugaggaaccuauuccaaugagcacuuauggauggaaucuagugcgucugcaguccggcgucgacguauuuuucauacccccugagaagugcgauacauugcugugugacauaggugaaucuucaccaaaccccaccguggaggcugggaggacucuccggguccuuaaucugguggagaacugguugaauaacaauacacaguucugcauuaaaguacugaacccguacaugccuagcgugaucgaaaagauggaggcccuccaacgcaaauacggaggcgccuuaguucgaaauccacuguccagaaacaguacccacgaaauguauugggugucuaaugcgagcggcaacaucgucucauccgugaauaugauuaguaggaugcuuauaaaccgguuuacgaugcgccauaagaaggcuaccuacgagcccgacgucgaucuggggagcggaacaagaaacaucgguauugaaucugagaucccuaaucuagacauuaucggcaaaaggauagagaagaucaaacaggaacacgagacuuccuggcacuaugaucaggaccauccauacaagaccugggcauaucacgggucauacgaaacaaaacagacuggaagcgccucgucuauggugaacggcguuguacgacuccugaccaagcccugggauguguugccgacagucacccaaauggcuaugacugacacgacaccuuucggucagcagcggguguuuaaggagaaaguugauacccguacucaggaacccaaggaggggaccaaaaagcugaugaaaauuacagccgaguggcucuggaaggaacuuggcaaaaagaagacgccaagaauguguacccgcgaggaguucacuaggaaagugcggaguaaugcagcccugggcgcuaucuuuacagacgagaacaaguggaaauccgcgagagaggccgucgaagauagccgcuucugggaguuaguggacaaggaaaggaaucugcauuuggagggcaaaugcgaaaccuguguauauaacaugauggggaagcgagagaagaaacucggagaguuugguaaggcaaaaggcucacgggcuauuugguacauguggcugggggccagauuccuagaauuugaggcacuuggauuccugaaugaagaucacugguuuuccagggagaacucucucagcggcguggaaggugaggggcugcacaaguugggauacauccugcgcgacguuaguaaaaaggagggcggcgccauguaugcugacgauacugccgggugggacacacguauuacccucgaagaucuuaagaaugaggaaauggucacaaaccauauggagggagaacacaaaaagcuggcggaggcaauauucaaauuaacuuaccaaaauaagguggugcggguccagagaccuacccccagggguacgguuauggacaucauuucccgcaaagaucagcgaggcagcgggcaagugggaaccuauggccugaacacauuuacuaauauggaggcccaguugauccggcagauggaaggugaggggguauucaagaacauccagcaucucaccgcuacagaagagguggccguccaaaauuggcuggcaagagugggaagggagcgccuaucuagaauggcuauuucaggcgacgauugcguugugaagccacuugacgaucgguucgccaacgcucugacugcccucaacgacaugggcaaaauaaggaaggauauccagcagugggaacccaguaaaggguggaaugacuggacccaggucccuuuuugcucccaccauuuccacgagcugauuaugaaggauggacguguguugguaguuccaugucgaaaccaagacgaauuaaucggucgcgcaagaauuagccagggcgcgggguggucucugcgggagacggccugccucggaaaaucguacgcucagauguggucacuuauguauuuucacaggcgcgaccugagacuagccgcaaaugcuaucuguagcgccgugccgucccauuggguccccacaagucggaccacuuggucuauacacgcaaagcaugaauggaugacaaccgaggauaugcugacuguguggaacaggguguggauccgagagaauccuuggauggaagacaagaccccagucgagagcugggaagagauucccuaccucggcaaacgugaagaucaguggugcgguuccuugaucgggcugacaucaagagccacgugggcgaagaacauucaagcugccaucaaucagguucgcagucuuauaggaaacgaggaguauaccgacuacaugccuucuaugaaacgguucaggagagaagaggaagaggcaggcgugcugugguga

SEQ ID NO: 14437 - RNA, 9876 nt, Artificial Sequence
  derived and/or modified CDS sequence (opt3) from DENV-2__FJ639707__SS-prME
agcgcaggcaugaucauuaugcugauacccaccgugauggcuuuccaccucaccacuagaaacggggagccucauaugaucgucgguauucaagaaaagggaaaaucccuucuguuuaagacggaggacggcguuaauaugugcaccuugauggcaauggauuuaggggaacugugugaggacacaaucacuuacaaaugcccacuacucaggcaaaacgaaccggaggauauugacuguuggugcaauucuaccucaacaugggugaccuauggaacuuguacaaccacgggcgagcaccggcgcgaaaagcgaaguguagcacuggugccccaugucgguauggggcuugagacucguaccgaaacauggaugagcuccgagggagcguggaaacacgcucagagaaucgagacuuggauacugaggcauccuggcuucaccaucauggccgcaauuuuggccuacacaaucggcaccacgcacuuucagcgggugcucauuuucauccugcugacugcuguugcaccaucuaugacaaugcgcugcauagggauuucgaacagagauuuuguggaaggagucucagguggcagcuggguggacaucguacucgagcacgggaguuguguuaccacuauggccaagaauaagcccacauuagauuucgaacugauuaaaaccgaggcuaagcagccugccacgcuuaggaaauauugcaucgaagcgaaguugaccaacacaacuaccgagucccgguguccaacacaaggagagcccucucugaaagaagaacaggacaagcgcuuugugugcaagcauagcauggucgaucgaggcugggguaauggguguggacuauucggcaaaggcgggaucgugacuugcgcaauguuuaccugcaagaaaaacauggaaggaaagauugugcagccugagaaucucgaauacacaauagucguuaccccacacuccggugaggagcaugccgugggcaacgacacugggaaacacggaaaggaaaucaaaguaacgccgcagucaaguauuacagaggcugaacugaccggcuaugguacugugaccauggaguguagccccagaacagggcuugauuucaaugaaaugguccuguugcaaauggagaacaaggccuggcucgugcacaggcagugguuucuggacuuaccucugccauggcuccccggcgcagauaagcaggagucuaauuggauccagaaagaaacccuuguuacuuucaagaacccucaugcuaaaaagcaagacguggucgugcugggaucccaggagggcgccaugcacacagcguugacgggggccaccgaaauacagaugucaagcggaaaucuacuguuuacuggucaucucaaaugccggcugcguauggacaaacuucaacugaagggcaugaguuacucuauguguacagggaaauucaagguaguuaaagagauugcagagacccagcacggaacaaucgugauccgcguccaguaugaaggcgaugguuccccaugcaagauucccuucgagaucauggacuuggagaagagauacauucucgggaggcugauaacugugaacccgaucgucaccgagaaggauagcccugugaacauugaagcugagcccccauuuggcgacucguacaucaucauuggaguugagccuggccaguuaaagcugaauugguucaaaaaggggucuuccauaggacaaauguuugaaacgaccaugcggggugccaaacgaauggcuauccuaggcgauacagccugggacuucgggucacucggaggcguguuuacaaguauugguaaggcacugcaucagguauucggggccaucuauggcgcugcguuuagcggagucuccuggaccaugaaaauucuuaucggcgugauaaucacauggauugggaugaacucucgcagcacuucauugaguguuucccuggugcucgucggaaucgugacccuguaccuuggcguaauggugcaggcagauagcgguuguguugucucuuggaagaauaaggagcugaaaugcgggucaggaauuuucaucacggacaacgugcacacauggaccgaacaguauaaguuucaacccgagaguccaagcaaauuggccuccgcuauacagaaggcccaggaagagggcauuugugguaucagaucugugacuaggcucgagaaucugauguggaaacagauuacacccgaauuaaaccacauccuggcagagaaugaagucaagcuaaccauaaugacuggcgauaucaaagggauuaugcaagccggaaagcggucgcuccgcccucagccaaccgagcugaaguacagcuggaaaacauggggcaaggcuaaaaugcuuuccacggaaucauauaaccagaccuucuugaucgacgggccggagacuacagagugccccaauaccaacagagccuggaauagucuggaaguugaggauuacggauuuggcguguucacaacuaacauuuggcucaagcugaaagaaaagcaggacgcauuuugugacucuaaguuaaugagcgcggcuaucaaagauaauagggccgugcaugcagacauggguuauuggauagaguccgcccugaacgauaccuggaagauugagaaggcuucauucaucgaaguaaagaauugccacuggccuaaaagccauacgcuuuggucuaacggggucuuggaguccgaaaugaucauuccaaagaaccucgccggacccgugagucaacacaauuaccguccuggcuaccacacacagaucgcagguccauggcaucugggcaagcuagagauggacuucgauuuuugugacgggaccacuguuauugugaccgaagauugcggaaaccggggccccagccugcgaacaacuaccgcuucugggaaacucauaacagaguggugcuguagauccugcacgcugccgccucuuagguaucgcggagaggacggcuguugguacgguauggaaauccggccauugaaggagaaagaagagaaucuggucaacucauuagugaccgccgggcacggacagguugauaauuucagucucggcgugcuggguauggcgcuuuuucuggaagagauguugagaacuaggguaggcacaaagcaugccauucuccuggucgcugugagcuucaugacccuaaucacugggaacaugucguuuaaagaccugggacgcguggucguuauggugggcgcaacaauggccgaugacauugggaugggaguaaccuaucucgcucugcuugccgcauucaaggugcgacccacguuugcggccggcuugcuguuacggaagcucacuuccaaagagcugaugaugaccacaaucgguauaguccuucugucucaaagcaccaucccugaaacugugcuagagcucacagaugcucuggccuuggggaugaugguucugaagauugugcguaauauggaaaaauaccaguuagcagucaccaucauggcuauucucugcgugcccaacgccguuauccugcagaaugcauggaaggugucauguacaauacuugccgucguaaguguguccccacuguugcucacuucuagccagcagaaaaccgacuggauuccucuggcucuaacgaucaagggacugaaccccacagcgaucuuccuuaccacucucuccagaaccaauaaaaagaggucauggccacugaacgaggccauuauggcaguuggcauggugagcauauuggcuaguucucuguuaaagaaugacaucccgaugacaggcccucucgccgccgggggacugcuuacugucugcuaugugcugaccggucgcuccgcugauuuggaacucgagcgggcaacggacguaaaaugggaggaucaggccgaaauuagcggcucgucacccauccugucuauuacaaucagugaggacggguccaugagcauaaagaacgaagaggaggaacagacccuaacuauccugauuagaacaggacuucucgugaucucuggccuguuuccaauuagcauccccauaaccgcggcugccugguacuugugggaggucaaaaagcagagggccgguguuuuaugggaugugccuuccccacccccuauggggaaagccgaacuggaggacggagcuuaucgaauuaagcaaaagggcauccucggcuacucacagaucggggcaggaguguacaaagaagguacuuuccacacaauguggcaugucacccgcggcgccgugcugaugcacaaggggaaacggauugagccgaguugggcggauguuaagaaagaccuuaucagcuauggaggcgguuggaagcuggagggggaauggaaggagggagaagagguacagguguuggcucuagaaccaggcaaaaaucccagagccguccagacgaagccuggccuguuuaaaacuaacaccgggacaauaggagcagugucucucgauuucuccccagguaccucaggcagucccauuaucgacaagaaagggaagguugugggacuguacggcaacggugucgugacaaggagcggggccuauguauccgcuauugcccaaacugagaagucuaucgaggauaauccugaaauagaggacgauauuuuucguaaacgccggcuuaccaucauggacuuacacccgggagcaggcaagacgaaaagauaccugcccgcuaucgucagggaagccauuaagcgaggccuccggacauugauccuggcgccaacucgcgugguugccgcagagauggaagaggcucucagagggcugccuauuagguaucagacccccgccauacgggcugagcauacaggacgagaaaucguggaccuuaugugucacgcaaccuucacuaugagacuguugucgccaguccgcgugccuaacuacaaucuaauuaucauggaugaggcccauuucaccgaccccgccagcaucgcugcgagggguuauauuucaacacguguugaaaugggcgaggcagccgggauauuuaugacggcuacuccaccgggaucccgggauccuuucccccagaguaacgccccaaucauugacgaggaaagagagauccccgaaaggucuuggaauagcggccacgagugggugaccgauuuuaaagguaagacagucugguucgugccuuccauuaaggcagggaacgacaucgccgcuugccugcgcaaaaauggaaagaaaguaauacaacucucacgaaagaccuuugauucugaauacgcgaaaacuagaacaaacgacugggauuucgugguuaccacggacaucagcgagaugggcgccaauuuuaaggcagagcgggucauugauccaaggcgcuguaugaaacccgugaucuuaacugacggcgaagaacgugugauucuggcugggccuaugccggucacacauaguuccgccgcacagagacggggaaggaucggucgcaacccaaagaaugaaaacgaccaguacauauauaugggcgagccccuugaaaaugaugaggacugcgcccacuggaaggaggcuaaaaugcugcucgauaacauuaauaccccugaagggaucauucccagcauguucgagccagaacgagagaagguagacgccaucgauggagaauacagauugcggggcgaggcgaggaaaaccuuuguggaccugaugcgcagaggugaucucccuguuuggcuggcauauaagguggccgcugaggggauaaacuacgccgacaggcggugguguuucgauggcaucaaaaacaaucagauucuugaagagaacgucgaaguggagaucuggacuaaggagggagaacguaagaaacuaaagccccgcuggcuggacucucgaauuuauucagauccauuggcuuuaaaagaguuuaaggaguucgcagccggcagaaaaucccugacacucaaucugaucaccgagauggggaggcuuccuacauucaugacucaaaagacgcgggacgcucuggauaaccucgccguuuugcacaccgcagaagcgggaggucgcgccuacaaucaugcucugagugagcuaccggagacacuggaaacucuccuucuguuaaccuugcuggccacagugaccggcgggauauuucucuuccugaugagcggaagaggcauugguaagaugacucuugggaugugcugcaucaucacggcaucgauucugcucugguaugcucagauccagccccacuggauagccgcaucuauuaucuuggaguuuuuccugauugucuuacuaaucccagaaccugagaaacagaggacaccccaagacaaccagcugacauacgugguaauagccauccucacugugguugcugcgaccauggccaaugaaaugggcuuucuugagaagacuaagaaagaccugggauugggcuccauugcaacccagcagccagagagcaacauccuggauauugaccuccggccugcuucagccuggacucuguacgccgucgcaacaacguucgugacccccaugcuucgacauaguaucgaaaauucuuccgugaacgucagccucacugcuauugccaaucaagcgacaguucuggugggguugggaaaagguuggccgcugucaaaaauggauaucggcguaccauuacuagcuauaggguguuauagucaggugaacccuauuacccugaccgccgcacuccuucuguuggucgcccacuacgcuaucaucggacccggccugcaggcaaaggccacaagagaggcgcagaaacgcgcugccgcagguauuaugaagaauccaacuguggacgggauaacgguuaucgaucucgaccccauuccuuaugauccgaaauuugaaaagcaacugggccaggugaugcuuuuaauccugugcgucacccagguacucaugaugaggacaacuugggccuugugugaggcucugacccuagccacaggacccauuagcacccugugggaaggcaacccagggcgguucuggaauacuacgaucgcaguguccauggcuaacauauuucguggaucuuaccucgccggcgcgggucuucuguucagcaucaugaaaaauacaaccaacacuagaagggggaccggaaacauuggcgagacauugggugagaaguggaaaucccgccugaaugcccucggcaagucagaauuucaaaucuauaagaaaucugggauucaggagguugaccggacucuggcaaaggaaggaaucaaacgaggcgagaccgaucaccaugcugugaguagagggucggccaaguuaaggugguucgucgagcgcaacauggugacaccugaaggaaaagucguggaccuuggcugcgguagagggggauggagcuacuauuguggcggucugaagaauguuagagaggugaagggccucacgaaagggggacccggccacgaggaaccuauaccaauguccaccuacggguggaaccuaguacgucugcagucuggaguggaugucuuuuucauucccccugaaaagugcgacacuuugcugugugauaucggcgagucaagcccaaaucccacaguugaggcagguaggacccuccgggugcuuaaccuggucgaaaauugguugaacaauaacacucaguucugcaucaaagugcugaauccguacaugccuuccguaauugagaagauggaagcucuccaacgcaaauaugggggagccuuagugcgaaacccacugaguagaaauucuacacaugagauguacuggguuagcaacgccucaggcaauauaguguccagugucaacaugaucagcaggaugcuuauuaaccgguuuaccaugcgccacaagaaggcgacguaugaacccgacguggaccugggcucugggaccagaaauaucggaauugaguccgaggucccuaaccuagauaucauagguaaaaggaucgaaaagauuaaacaggagcaugaaacaucauggcacuacgaccaggaucacccauauaagacuugggcuuaccauggcagcuaugagaccaaacagacagggucggcaucuaguauggugaauggaguuguacgacuccugacuaagcccugggacguguugccgaccgucacacaaauggccaugaccgauacuacgccuuucggccagcagcggguguuuaaggaaaaaguugacacacguacccaggagcccaaggaggguacuaaaaagcugaugaaaaucaccgcugaauggcucuggaaggagcuugggaaaaagaagacaccaagaauguguacgcgcgaagaguucaccaggaaagugcgguccaacgccgcacugggagccauuuuuacugaugagaauaaguggaaaagcgcuagagaagcggucgaggacucacgcuucugggaauuaguggauaaggagaggaaccugcacuuggaaggcaaaugcgagacauguguauacaauaugaugggcaagcgagagaagaaacucggggaauuuggaaaggccaaagguucccgggcaaucugguacauguggcugggcgcuagauuccuagaguuugaagcccuuggguuccugaacgaggaccauugguuuucuagggaaaauagccucaguggaguggagggcgagggucugcacaaguugggguauauucugcgcgauguuuccaaaaaggaaggaggcgcaauguacgccgacgacaccgcuggcugggauacucguauaacacucgaggaccuuaagaacgaagagauggucaccaaucacauggaaggggagcauaaaaagcuggccgaggcgaucuucaaauuaacauaucaaaacaagguggugcggguccagagaccuacucccaggggaaccguuauggauauuaucagccgccgagaccagcgggguucuggccaaguggggacguacggacugaauaccuuuacaaacauggaagcacaguugaucagacagauggagggcgaagguguauucaaaaauauucagcaccucacugugaccgaggaggucgccgugcaaaacuggcuggcuaggguugggcgcgaaagacuaucacggauggccauaaguggagaugacugcguggucaagccacuugaugacagguucgcaaacgcucugacagcccucaaugauaugggcaagauccguaaagacauucagcagugggagcccuccaagggcuggaacgauuggacucaggugccuuuuugcagccaucacuuccaugaacugaucaugaaagacgggcgaguauugguugugccaugucgcaaucaagaugaguuaauuggacgggcucggaucucucagggugccggcuggucgcugagggaaaccgcaugccucgggaagucauaugcgcagauguggagccuuauguacuuucaccgcagagaccugcggcuagccgcuaacgccauauguuccgcagucccgagucacugggugcccacgucuaggacaaccuggagcauccaugcuaaacacgaguggaugacuacagaggacaugcugaccguguggaaucgagucuggauucgugaaaacccuuggauggaggauaagacuccaguugaauccugggaggaaauccccuaucucggaaagagagaggaccaguggugcggcucauugauuggucugaccagucgcgccacaugggccaaaaauauccaagccgcgauaaaccaggugcggucucuuauugggaaugaggaauacacggauuacaugccuagcaugaagagguucagacgcgaggaagaggaagcuggaguacugugguga

SEQ ID NO: 14438 - RNA, 9876 nt, Artificial Sequence
  derived and/or modified CDS sequence (opt3) from DENV-2__FJ639708__SS-prME
agcgcaggcaugaucauuaugcugauacccaccgugauggcuuuccaccucacuacuagaaacggggagccucauaugaucgucgguauucaagaaaagggaaaaucccuucuguuuaagacggaggacggcguuaauaugugcaccuugauggcaauggauuuaggggaacugugugaggacacgaucacuuacaaaugcccacuacucaggcaaaacgaaccggaggauauugacuguuggugcaauucuaccucaacaugggugaccuauggaacuuguacaaccacgggcgagcaccggcgcgaaaagcgaaguguagcacuggugccccaugucgguauggggcuugagacucguaccgaaacauggaugagcuccgagggagcguggaaacacgcucagagaaucgagacuuggauacugaggcauccuggcuucaccaucauggccgcaauuuuggccuacacaaucggcaccacgcacuuucagcgggugcucauuuucauccugcugacugcuguugcaccaucuaugacaaugcgcugcauagggauuucgaacagagauuuuguggaaggagucucagguggcagcuggguggacaucguucucgagcacgggaguuguguuaccacuauggccaagaauaagcccacauuagauuucgaacugauuaaaaccgaggcuaagcagccugccacgcuuaggaaauauugcaucgaagcgaaguugaccaacacaacuaccgagucccgguguccaacacaaggagagcccucucugaaagaagaacaggacaagcgcuuugugugcaagcauagcauggucgaucgaggcugggguaauggguguggacuauucggcaaaggcgggaucgugacuugcgcaauguuuaccugcaagaaaaacauggaaggaaagauugugcagccugagaaucucgaauacacaauagucguuaccccacacuccggugaggagcaugccgugggcaacgacacugggaaacacggaaaggaaaucaaaguaacgccgcagucaaguauuacagaggcugaacugaccggcuaugguacugugaccauggaguguagccccagaacagggcuugauuucaaugaaaugguccuguugcaaauggagaacaaggccuggcucgugcacaggcagugguuucuggacuuaccucugccauggcuccccggcgcagauaagcaggagucuaauuggauccagaaagaaacccuuguuacuuucaagaacccucaugcuaaaaagcaagacguggucgugcugggaucccaggagggcgccaugcacacagcguugacgggggccaccgaaauacagaugucaagcggaaaucuacuguuuacuggucaucucaaaugccggcugcguauggacaaacuucaacugaagggcaugaguuacucuauguguacagggaaauucaagguaguuaaagagauugcagagacccagcacggaacaaucgugauccgcguccaguaugaaggcgaugguuccccaugcaagauucccuucgagaucauggacuuggagaagagauacauucucgggaggcugauaacugugaacccgaucgucaccgagaaggauagcccugugaacauugaagcugagcccccauuuggcgacucguacaucaucauuggaguugagccuggccaguuaaagcugaauugguucaaaaaggggucuuccauaggacaaauguuugaaacgaccaugcggggugccaaacgaauggcuauccuaggcgauacagccugggacuucgggucacucggaggcguguuuacaaguauugguaaggcacugcaucagguauucggggccaucuauggcgcugcguuuagcggagucuccuggaccaugaaaauucuuaucggcgugauaaucacauggauugggaugaacucucgcagcacuucauugaguguuucccuggugcucgucggaaucgugacccuguaccuuggcguaauggugcaggcagauagcgguuguguugucucuuggaagaauaaggagcugaaaugcgggucaggaauuuucaucacggacaacgugcacacauggaccgaacaguauaaguuucaacccgagaguccaagcaaauuggccuccgcuauacagaaggcccaggaagagggcauuugugguaucagaucugugacuaggcucgagaaucugauguggaaacagauuacacccgaauuaaaccacauccuggcagagaaugaagucaagcuaaccauaaugacuggcgauaucaaagggauuaugcaagccggaaagcggucgcuccgcccucagccaaccgagcugaaguacagcuggaaaacauggggcaaggcuaaaaugcuuuccacggaaucauauaaccagaccuucuugaucgacgggccggagacugccgagugccccaauacaaacagagcauggaauagucuggaaguugaggauuacggauuuggcguguucaccacaaacauuuggcucaagcugaaagaaaagcaggacgcguuuugugacucuaaguuaaugagcgcugccaucaaagauaauagggcagugcaugccgacauggguuauuggauagaguccgcucugaacgauacuuggaagauugagaaagccucauucaucgaaguaaagaauugccacuggccuaaaagccauacccuuuggucuaacggggucuuggaguccgaaaugaucauuccaaagaaccucgcaggacccgugagucaacacaauuaccguccuggcuaccacacgcagaucgcugguccauggcaucugggcaagcuagagauggacuucgauuuuugugacgggacaaccguuauugugacugaagauugcggaaaccggggccccagccugcgaaccacaacugccucugggaaacucauaaccgaguggugcuguagauccugcacacugccgccucuuagguaucgcggagaggacggcuguugguacgguauggaaauccggccauugaaggagaaagaagagaaucuggucaacucauuagugacggcggggcacggacagguugauaauuucagucucggcgugcuggguauggcccuuuuucuggaagagauguugagaaccaggguaggcacuaagcaugcuauucuccuggucgcagugagcuucaugacacuaaucaccgggaacaugucguuuaaagaccugggacgcguggucguuauggugggcgccacuauggcugaugacauugggaugggaguaacauaucucgcccugcuugcagcguucaaggugcgacccaccuuugccgcuggcuugcuguuacggaagcucacguccaaagagcugaugaugacuaccaucgguauaguccuucugucucaaagcacaaucccugaaaccgugcuagagcucacugaugcccuggcauuggggaugaugguucugaagauugugcguaauauggaaaaauaccaguuagcugucacaaucauggccauucucugcgugcccaacgcaguuauccugcagaaugccuggaaggugucauguaccauacuugcugucguaaguguguccccacuguugcucacaucuagccagcagaaaacugacuggauuccucuggcgcuaaccaucaagggacugaaccccacggccaucuuccuuacaacccucuccagaacuaauaaaaagaggucauggccacugaacgaggcaauuauggcuguuggcauggugagcauauuggccaguucucuguuaaagaaugacaucccgaugaccggcccucucgucgccgggggacugcuuacagugugcuauguacugacuggucgcuccgcugauuuggaacucgagcgggcaaccgacgugaaaugggaggaucaggccgaaauuagcggcucgucacccauccugucuauuacgaucagugaggacggguccaugagcauaaagaacgaagaggaggaacagacacuaaccauccugauuagaacuggacuucucgucaucucuggccuguuuccaauuagcauccccauaacagcggcugccugguacuugugggagguuaaaaagcagagggccgguguguuaugggaugugccuuccccacccccuauggggaaagccgaacuggaggacggagcuuaucgaauuaagcaaaagggcauccucggcuacucacagaucggggcaggagucuacaaagaagguaccuuccacacuauguggcaugugacacgcggcgccguucugaugcacaaggggaaacggauugagccgaguugggcggauguaaagaaagaccuuaucagcuauggaggcgguuggaagcuggagggggaauggaaggagggagaagaggugcaggucuuggcucuagaaccaggcaaaaaucccagagccgugcagaccaagccuggccuguuuaaaacgaacacugggaccauaggagcaguuucucucgauuucuccccagguacaucaggcagucccauuaucgacaagaaagggaagguggucggacuguacggcaacggugugguaaccaggagcggggccuaugucuccgcuauugcccaaacagagaagucuaucgaggauaauccugaaauagaggacgauauuuuucguaaacgccggcuuacuaucauggacuuacacccgggagcaggcaagaccaaaagauaccugcccgcuaucgugagggaagccauuaagcgaggccuccggacguugauccuggcgccaacacgcguuguggccgcagagauggaagaggcucucagagggcugccuauuagguaucagacucccgccauacgggcugagcauaccggacgagaaaucgucgaccuuaugugucacgcaacauucaccaugagacuguugucgccagugcgcguuccuaacuacaaucuaauuaucauggaugaggcccauuucacugaccccgccagcaucgcugcgagggguuauauuucaacccguguggaaaugggcgaggcagccgggauauuuaugacagcuacgccaccgggaucccgggauccuuucccccagaguaacgccccaaucauugacgaggaaagagagauccccgaaaggucuuggaauagcggccacgagugggucacugauuuuaaagguaagaccgugugguucguaccuuccauuaaggcagggaacgacaucgccgcuugccugcgcaaaaauggaaagaaagugauacaacucucacgaaagacauuugauucugaauacguuaaaaccagaacuaacgacugggauuucgucgugacaaccgacaucagcgagaugggcgcgaauuuuaaggccgagcgggugauugauccaaggcgcuguaugaaacccgucaucuuaacggacggcgaagaacguguaauucuggcagggccuaugccggugacucauaguuccgcugcccagagacggggaaggaucggucgcaacccaaagaaugaaaacgaccaguacauauauaugggcgagccccuugaaaaugaugaggacugcgcacacuggaaggaggccaaaaugcugcucgauaacauuaauacaccugaagggaucauucccagcauguucgagccagaacgagagaagguugacgcuaucgauggagaauacagauugcggggcgaggccaggaaaaccuuuguggaccugaugcgcagaggugaucucccugucuggcuggcguauaagguggcagccgaggggauaaacuacgcugacaggcggugguguuucgauggcaucaaaaacaaucagauucuugaagagaacguugaaguggagaucuggaccaaggagggagaacguaagaaacuaaagccccgcuggcuggacgcccgaauuuauucugauccauuggcuuuaaaagaguuuaaggaguucgcagccggcagaaaaucacugacucucaaucugaucacagagauggggaggcuuccuaccuucaugacacaaaagacucgggacgcucuggauaaccucgccgucuugcacacggcagaagcgggaggucgcgccuacaaucaugcucuguccgagcuaccggagacccuggaaacacuccuucuguuaacuuugcuggccaccgugacaggcgggauauuucucuuccugaugaguggaagaggcauugguaagaugacccuugggaugugcugcaucaucacugcaagcauucugcucugguaugcucagauccagccccacuggauagccgcaucgauuaucuuggaguuuuuccugauuguauuacuaaucccagaaccugagaaacagaggacgccccaagacaaccagcugaccuacgugguuauagccauccucacagucguggcugcgacuauggccaaugaaaugggcuuucuugagaagaccaaaaaggaccugggauugggcucuauugcaacacagcagccagaguccaacauccuggauauugaccuccggccugcuagcgccuggacccuguacgccguggcaacuacauucgucacgcccaugcuucgacauucaaucgaaaauaguucuguuaacgugucccucaccgcuauugccaaucaagcgacuguacugaugggguugggaaaagguuggccgcugagcaagauggauaucggcgugccauuacuagcuauaggguguuauucacaggucaacccuauuacacugaccgccgcacuccuucuguugguggcccacuacgcuaucaucggacccggccugcaggcaaaggccaccagagaggcgcagaaacgcgcugccgcagguauuaugaagaauccaacaguugacgggauaacugugaucgaucucgaccccauuccuuaugauccgaaauuugaaaagcaacugggccaggucaugcuuuuaauccugugcguaacacaggugcucaugaugaggaccacaugggccuugugugaggcucugacucuagccaccggacccauuaguacacugugggaaggcaacccagggcgguucuggaauaccacuaucgcaguuagcauggcuaacauauuucguggauccuaccucgccggcgcgggucuucuguucucuaucaugaaaaauacgacaaacaccagaagggggacuggaaacauuggcgagaccuugggugagaaguggaaaagccgccugaaugcccucggcaaguccgaauuucaaaucuauaagaaaucagggauucaggagguggaccggacacuggcaaaggaaggaaucaaacgaggcgagacugaucaccaugcugucucuagagggagugccaaguuaaggugguucguggagcgcaacauggucaccccugaaggaaaagugguugaccuuggcugcgguagagggggauggucguacuauuguggcggucugaagaaugugagagagguaaagggccucacaaaagggggacccggccacgaggaaccuauaccaaugagcacguacggguggaaccuagugcgucugcaguccggagucgauguauuuuucauucccccugaaaagugcgacaccuugcugugugauaucggcgagucuucaccaaaucccacuguggaggcagguaggacacuccggguccuuaaccugguggaaaauugguugaacaauaacacccaguucugcaucaaaguacugaauccguacaugccuagcgugauugagaagauggaagcucuccaacgcaaauaugggggagccuuaguucgaaacccacuguccagaaauaguacucaugagauguacugggugucuaacgccagcggcaauauagucucauccgugaacaugaucaguaggaugcuuauuaaccgguuuacaaugcgccacaagaaggcgaccuaugaacccgacgucgaccugggcagcgggacgagaaauaucggaauugagucugaggugccuaaccuagauaucauagguaaaaggaucgaaaagauuaaacaggagcaugaaaccuccuggcacuacgaccaggaucacccauauaagacaugggcuuaccauggcucauaugagacuaaacagaccgggagcgcaucgucuaugguuaauggaguagugcgacuccugacaaagcccugggacgucuugccgacugugacccaaauggccaugacagauaccacuccuuucggccagcagcggguuuuuaaggaaaaaguggacacgcguacacaggagcccaaggaggguaccaaaaagcugaugaaaaucacugcugaauggcucuggaaggagcuugggaaaaagaagaccccaagaauguguacacgcgaagaguucacgaggaaaguccggaguaacgccgcacugggagccauuuuuaccgaugagaauaaguggaaauccgcuagagaagcgguggaggacagccgcuucugggaauuaguagauaaggagaggaaccugcacuuggaaggcaaaugcgagacuuguguguacaauaugaugggcaagcgagagaagaaacucggggaauuuggaaaggccaaagguucacgggcaaucugguacauguggcugggcgcuagauuccuagaguuugaagcccuuggguuccugaacgaggaccauugguuuuccagggaaaauucucucagcggaguugagggcgagggucugcacaaguugggguauauucugcgcgaugucaguaaaaaggaaggaggcgcaauguacgccgacgacacagcuggcugggauacccguauaacucucgaggaccuuaagaacgaagagauggugacaaaucacauggaaggggagcauaaaaagcuggccgaggcgaucuucaaauuaaccuaucaaaacaaggugguccggguucagagaccuacacccaggggaacugugauggauauuaucucccgccgagaccagcgggguagcggccaaguagggaccuacggacugaauacguuuaccaacauggaagcacaguugaucagacagauggagggcgaagguguguucaaaaauauucagcaccucacagucacugaggagguggccguucaaaacuggcuggcuaggguggggcgcgaaagacuaucucggauggccauaucaggagaugacugcgucgugaagccacuugaugacagguucgcaaacgcucugaccgcccucaaugauaugggcaagauccguaaagacauucagcagugggagcccaguaagggcuggaacgauuggacacagguaccuuuuugcucccaucacuuccaugaacugaucaugaaagacgggcgaguuuugguggucccaugucgcaaucaagaugaguuaauuggacgggcucggaucagccagggugccggcuggucucugagggaaacugcaugccucgggaagucguaugcgcagauguggucacuuauguacuuucaccgcagagaccugcggcuagccgcuaacgccauauguagcgcagugccgucccacugggugcccaccaguaggacgacauggucuauccaugcuaaacacgaguggaugaccacugaggacaugcugacagucuggaaucgaguuuggauucgugaaaacccuuggauggaggauaagaccccaguggaaagcugggaggaaauccccuaucucggaaagagagaggaccaguggugcggcuccuugauuggucugacuucacgcgccaccugggccaaaaauauccaagccgcgauaaaccagguacggagucuuauugggaaugaggaauacacagauuacaugccuucuaugaagagguucagacgcgaggaagaggaagcuggagugcugugguga

SEQ ID NO: 14439 - RNA, 9876 nt, Artificial Sequence
  derived and/or modified CDS sequence (opt3) from DENV-2__FJ639709__SS-prME
agcgccggaaugaucauuaugcugauacccaccgugauggcuuuccaccucacgacuagaaacggggagccucauaugaucgucgggauucaagagaaggguaaaucccuucuguuuaagacggaggacggaguuaauaugugcaccuugauggcaauggauuuaggggaacugugugaggacacaaucacuuacaaaugcccacuacucaggcaaaacgaaccggaggauauugacuguuggugcaauucuaccucaacaugggugaccuauggaacuuguacaaccacgggcgagcaccggcgcgaaaagcgaaguguagcccuggugccccaugucgguauggggcuugagacucguaccgaaacauggaugagcuccgagggagcguggaaacacgcucagagaaucgagacuuggauacugaggcauccuggcuucaccaucauggccgcaauuuuggccuacacaaucggcaccacgcacuuucagcgggcucucauuuucauccugcugacugcaguggccccaucuaugacaaugcgcugcauagggauuucgaacagagauuuuguugaaggagugucagguggcagcugggucgacaucgugcucgagcacgggaguuguguaaccacuauggcuaagaauaagcccacauuagauuucgaacugauuaaaaccgaggccaagcagccugcgacgcuuaggaaauauugcaucgaagcaaaguugaccaacacaacuaccgagucccgguguccaacacaaggagagcccucucugaaagaggaacaggacaagcgcuuuguuugcaagcauagcaugguggaucgaggcugggguaauggguguggacuauucggcaaaggcgggaucgucacuugcgccauguuuaccugcaagaaaaacauggaaggaaagauugugcagccugagaaucucgaauacacaauaguggucaccccacacuccggugaggagcaugcuguuggcaacgacacugggaaacacggaaaggaaaucaaagugacgccgcagucaaguauuacagaggccgaacugaccggcuaugguacuguaaccauggaguguagccccagaacagggcuugauuucaaugaaauggugcuguugcaaauggagaacaaggcauggcucguccacaggcagugguuucuggacuuaccucugccauggcuccccggcgcugauaagcagggaucuaauuggauccagaaagagacccuugugacuuucaagaacccucaugccaaaaagcaagacguugugguccugggcucccaggaaggggcgaugcacacagccuugacgggagcaaccgagauacagaugucaagcgguaaucuacuguuuacuggccaucucaaaugccggcugcguauggacaaacuucaacugaaggggaugaguuacucuauguguacaggaaaauucaaggugguaaaagaaauugcugagacccagcacggcacaaucguuauccgcgugcaguaugagggugauggguccccaugcaagauucccuucgaaaucauggacuuggagaaaagauacguccucggcaggcugauuacugugaacccgauagucaccgaaaaggauagcccugugaacaucgaggccgaacccccauuuggagacucguacauuaucaucggcguugagccugggcaguuaaagcugaauugguucaaaaagggaucuuccauuggucaaauguuugagacgaccaugcggggcgcuaaacgaauggccauacuaggggauacagcaugggacuucggaucacucggcgguguguuuacaaguaucgggaaggcccugcaucagguauucggcgcuauuuauggagcggcauuuagcggcgucuccuggaccaugaaaauccuuauuggggugaucauaacauggaucggaaugaacucucgcagcacuucauugaguguuucccuggugcucgucggcauugugacccuguaccuugguguaauggugcaggccgauagcggguguguugucucuuggaagaauaaggaacugaaaugcggaucaggcaucuucauuacggacaacgugcacacauggaccgagcaguauaaguuucaacccgaaaguccaagcaaauuggcuuccgccauccagaaggcacaggaggaagguauauguggcauuagaucugugacuaggcucgagaaucugauguggaaacagaucacacccgaguuaaaccacauucuggccgaaaaugaggucaagcuaaccaucaugacuggggauauaaaaggaaucaugcaagcuggcaagcggucgcuccgcccucagccaaccgaacugaaguacagcuggaaaacaugggggaaggccaaaaugcuuuccacggagucacauaaccagaccuucuugauugacggaccggaaacugcagagugccccaauacaaacagagcguggaauagucuggagguugaagauuauggcuuugguguguucaccacaaacaucuggcucaagcugaaagagaagcaggacgcuuuuugugacucuaaguuaaugagcgccgcaauuaaagauaauagggccgugcacgcugacaugggguacuggaucgaauccgcccugaacgauacuuggaagauagagaaagcaucauucauugagguaaagaauugccauuggccuaaaagccacacccuuuggucuaacggagucuuggaauccgagaugaucaucccaaagaaccucgcuggccccgugagucaacacaauuaucguccugguuaccauacgcagauugccggcccauggcaccuggggaagcuagaaauggacuucgauuuuugugacggaacaaccguuaucgugacugaggauugcggcaaccgggggcccagccugcgaaccacaacugcgucuggaaaacucauuaccgaauggugcuguagauccugcacacugccgccucuuagguaccgcggcgaggacgguuguugguaugggauggagauacggccauugaaggaaaaagaggaaaaucuggucaacucauuagugacggccggacauggccagguugauaauuucagucucggugugcugggcauggcucuuuuucuggaggaaauguugagaaccaggguagggacuaagcacgcaauccuccuggucgccgugagcuucgugacacuaauuaccggaaacaugucguuuaaagaccugggccgcgucguugugaugguaggggcuacuaugacagaugacaucggaaugggcgugaccuaccucgcccugcuugcagcguucaagguccgacccacguuugccgcugguuugcuguuacggaagcucacuuccaaagagcugaugaugaccacaauugggaucgugcuucugucucaaaccacuauaccugagacaauccuagaacucaccgaugcccuggcauugggaaugaugguucugaagauugugcgugacauggagaaauaucaguuagcugucacaaucauggccauucucugcgugcccaaugcaguuauccugcagaacgccuggaaggugagcuguacuauacuugcugucguaucagugaguccacuguugcucaccuccucucagcagaagacggacuggauuccucuggcgcuaacaaucaagggccugaaucccaccgccaucuuccuuacuacccucagcagaacaaacaaaaagagguccuggccacugaaugaagcaauuauggcuguuggcauggugucaauauuggccagcagucuguuaaagaacgauaucccgaugacugggccucucgucgccggaggucugcuuaccgugugcuacguacugacgggccgcucugcugacuuggagcucgaacgggcaacagaugugaaaugggaggaccaggccgagauuuccgggagcucgcccauccugucaauuaccaucucugaagauggaaguauguccauaaagaaugaggaagaggagcagacucuaacaauccugauuagaaccggccuucucgucaucagcggucuguuuccaguuucuauucccaucacugcggcugccugguauuugugggaagugaaaaagcagagggcagggguguuaugggacgucccuagcccacccccuaugggaaaagccgagcuggaagauggcgcuuaccgaauaaagcaaaagggcauucucggguauucccagaucggagccgguguguacaaagagggcacauuccauaccauguggcacguuacgcgcggggcaguacugaugcacaagggaaaacggaucgaaccgucaugggcggacgugaagaaagaucuuauuaguuacggcgguggguggaagcuggagggagaguggaaggaaggcgaggaaguccagguguuggcucuagagccaggcaaaaaccccagagccguucagacuaagccugggcuguuuaaaaccaauacaggaaccaucggugcagugagccucgacuucucuccaggcacauccgggucacccauaauugauaagaaaggaaaggucgugggccuguaugguaacgggguagucacuaggaguggagccuacgugagcgcuaucgcccaaaccgaaaaguccauugaggacaacccugagaucgaagaugacauauuucguaaacgccggcuuacgauuauggacuuacauccgggcgcaggcaagacaaaaagauaucugcccgcuaucguuagggaggccaucaagcgagggcuccggacuuugauucuggcgccaacccgcguggucgccgcagaaauggaggaagcucucagaggacugccuaucagguaccagacacccgccauucgggcugagcacaccggucgagagauaguggaucuuaugugucaugcaacuuucaccaugagacuguugucuccaguucgcgugccuaauuauaaccuaaucauuauggacgaagcccacuucacagaucccgccucgaucgcugcgaggggcuacaucagcacgcgugucgagaugggggaagcagccggaauuuuuaugacugcuaccccaccgggcucacgggacccuuucccccaguccaaugccccaauaaucgaugaggagagagaaauucccgagaggaguuggaacucuggucaugaaugggugacagacuuuaaagggaagaccguaugguucgugccuagcaucaaggcaggaaaugauauugccgcuugccugcgcaaaaacggcaagaaaguuauccaacucucccgaaagacuuuugacucagaguaugucaaaacaagaaccaaugauugggacuucguggugacgacugauauaucugaaaugggcgcgaacuuuaaggccgagcgggucaucgacccaaggcgcuguaugaaacccguaauuuuaacagacggggaggaacgugugauccuggcaggaccuaugccgguuacccacagcagugcugcccagagacgggguaggauuggccgcaauccaaagaacgagaaugaucaguacaucuacaugggggaaccccuugagaacgacgaagauugcgcacacuggaaggaggccaaaaugcugcucgacaauauaaacaccccugagggaauuauccccuccauguucgaaccagagcgagaaaagguggaugcuauugacggcgaguauagauugcggggugaagccaggaaaacuuuugucgaucugaugcgcagaggggaccucccuguguggcuggcguacaagguugcagccgagggcaucaauuaugcugauaggcggugguguuucgacggaaucaaaaacaaccagauccuugaggaaaauguggaggucgaaauuuggacaaaggagggcgagcguaagaaacuaaagccccgcuggcuggaugcccgaaucuacagcgacccauuggcuuuaaaagaauuuaaggaguucgcagccgggagaaaaucucugacccucaaccugauuacagaaaugggaaggcuuccuacuuucaugacgcaaaagacccgggaugcucuggacaaucucgccguguugcauacagcagaggcggguggccgcgccuauaaccacgcucugucagaacuaccggagacucuggagacccuccuucuguuaacauugcuggccaccguaacugggggaaucuuucucuuccugauguccggcagagguauagggaagaugacgcuuggcaugugcugcauuaucaccgcaaguauccugcucuggaaugcucagauucagccccauuggaucgccgcaagcauaauuuuggaauuuuuccugaucguguuacuaauuccagagccugaaaaacagaggacaccccaagacaaccagcugacuuacguugucaucgccauacucaccgugguggcugcgacaauggccaaugagaugggauuucuugaaaagaccaaaaaggaucugggcuuggggucgaucgcaacucagcagccagagucuaacauucuggacaucgaucuccggccugcuuccgccuggacacuguaugccgucgcaacgaccuucguuacucccaugcuucgacacagcauugaaaauucaagugugaacguaucucucacagcuaucgccaaucaagcgaccgugcugaugggauuggguaaaggcuggccgcuguccaagauggacauuggggucccauuacuagcuaucggauguuacagccaggugaacccuauaacccugacagccgcacuccuucuguugguugcccacuacgcuauuaucggccccggucugcaggcaaaggccacuagagaagcgcagaaacgcgcugccgcagggaucaugaagaauccaacgguggauggcauuaccgucauagaccucgaucccaucccuuaugacccgaaauuugagaagcaacugggacagguaaugcuuuuaauucugugcgugacacagguucucaugaugaggacuaccugggccuugugugaagcucugacacuagccaccggccccaucucaacucugugggaggggaacccaggacgguucuggaauacgacaauugcagugaguauggcuaacaucuuucguggcagcuaccucgccggugcggggcuucuguucuccauaaugaaaaauaccacuaacaccagaaggggaacaggcaacaucggugaaacuuugggcgagaaguggaaaucucgccugaaugcccucggaaagagcgaguuucaaaccuauaagaaauccggcauucaggaagucgaucggacacuggcaaaggagggcaucaaacgaggggaaacggaccaucacgcugugucaagaggaucugccaaguuaaggugguucgucgagcgcaacauggugaccccugagggcaaaguuguggaucuugguugcgggcggggaggcuggaguuacuauugugguggccugaagaauguaagagaagugaaggggcucacuaaaggaggccccgggcaugaggaaccuauuccaaugucgacauacggauggaaccuaguccgucugcagagcggcguugacguguuuuucauacccccugagaagugcgauaccuugcugugugacauaggugaauccucuccaaaucccacugucgaggcagggaggacacuccgggugcuuaaccugguagagaauugguugaacaauaacacccaguucugcauuaaagugcugaauccguauaugccuucaguuaucgaaaagauggaggcucuccaacgcaaauacggaggcgccuuagugcgaaacccacugagcagaaauuccacgcacgaaauguacugggucaguaacgccucuggcaauaucgugagcucagucaacaugauuuccaggaugcuuauaaaccgguuuaccaugcgccauaagaaggcgacauaugagcccgacguggaucuggggaguggaacuagaaauaucgguauugaaagcgagaucccuaaccuagacauuaucggcaaaaggauagagaagaucaaacaggaacacgagaccucuuggcacuacgaucaggaccauccauauaagacaugggcuuaccacggguccuaugaaacuaaacagaccggaucagcaagcucgaugguuaauggcguagugcgacuccugacaaagcccugggaugucuugccgaccgugacucaaauggccaugacggacacaaccccuuucggucagcagcggguuuuuaaggagaaaguggauacucguacccaggaacccaaggaggggacuaaaaagcugaugaaaauuacggcugaguggcucuggaaggaacuuggcaaaaagaagaccccaagaauguguacucgcgaggaguucacaaggaaaguccggucuaacgccgcacugggcgccaucuuuaccgacgagaauaaguggaaaagugcuagagaggcgguggaagauucccgcuucugggaguuaguagacaaggaaaggaaccugcauuuggagggcaaaugcgaaacuuguguguacaauaugauggggaagcgagagaagaaacucggagaguuugguaaggccaaaggcagccgggcaauuugguauauguggcugggggcuagauuccuagaauuugaggcccuuggauuccugaacgaagaucacugguuuucaagggaaaauucccucucuggcguugaaggugaggggcugcacaaguugggauacauccugcgcgacgucagcaaaaaggagggcggcgcaauguacgccgacgauacagcugggugggacacccguauuacacucgaagaucuuaagaacgaggaaauggugacuaaucauauggagggagaacacaaaaagcuggccgaggcgauauucaaauuaaccuaucaaaacaaggugguccggguucagagaccuacgcccagggguaccgugauggacaucauuagucgccgagaucagcggggcuccgggcaaguaggaacauacggccugaauacuuuuaccaacauggaggcacaguugaucagacagauggaaggugaggggguguucaaaaauauccagcaucucacagccacugaagaggucgcugugcaaaacuggcuggccaggguuggacgcgagagacuaagccggauggcaauuucuggcgacgauugcguggucaagccacuugacgauagguucgcuaacgcccugaccgcucucaaugacaugggcaagauacguaaagauauccagcagugggaacccucaaagggguggaacgacuggacacaggugccuuuuugcagucaccauuuccacgagcugauuaugaaagauggacgaguauugguugugccaugucgcaaucaagacgaauuaaucgguagagcccggauuucccagggcgcaggguggagccugagggagacagcgugccucggaaagucuuaugcccagauguggucgcuuauguacuuucaccgcagagaccugcggcuagcugccaacgcaaucuguucagcugucccgagccauugggugcccaccuccaggacuacauggaguauacacgccaaacaugaauggaugaccacugaggauaugcugaccguguggaaucgagucuggauccgugagaacccuuggauggaagacaagacaccaguugagucuugggaagagauucccuaucucggcaagagagaagaucaguggugcgguagcuugaucgggcugacgucccgcgcaaccugggccaaaaauauucaagcggcuaucaaccaggugcggucacuuauaggaaaugaggaguacacugacuauaugccuaguaugaagagguucagacgcgaagaggaagaggccggcguacugugguga

SEQ ID NO: 14440 - RNA, 9876 nt, Artificial Sequence
  derived and/or modified CDS sequence (opt3) from DENV-2__FJ639710__SS-prME
agcgccggaaugaucauuaugcugauaccaaccgugauggcuuuccaccucacuacuagaaacggggagccucauaugaucgucggcauucaagaaaaggguaaaucccuucuguuuaagacggaggacggcguuaauaugugcaccuugauggcaauggauuuaggggaacugugugaggacacaaucacuuacaaaugcccacuacucaggcaaaacgaaccggaggauauugacuguuggugcaauucuaccucaacaugggugaccuauggaacuuguacaaccacgggcgagcaccggcgcgaaaagcgaaguguagcccuggugccccaugucgguauggggcuugagacucguaccgaaacauggaugagcuccgagggagcguggaaacacgcucagagaaucgagacuuggauacugaggcauccuggcuucaccaucauggccgcaauuuuggccuacacaaucggcaccacgcacuuucagcgggcucucauuuucauccugcugacugcaguggccccaucuaugacaaugcgcugcauagggauuucgaacagagauuuuguugaaggagugucagguggcagcugggucgacaucgugcucgagcacgggaguuguguaaccacuauggcuaagaauaagcccacauuagauuucgaacugauuaaaaccgaggccaagcagccugcgacgcuuaggaaauauugcaucgaagcaaaguugaccaacacaacuaccgagucccgguguccaacacaaggagagcccucucugaaagaggaacaggacaagcgcuuuguuugcaagcauagcaugguggaucgaggcugggguaauggguguggacuauucggcaaaggcgccaucgucacuugcgcuauguuuaccugcaagaaaaacauggaagggaagauugugcagccugagaaucucgaauacacaauaguggucaccccacacuccggagaggagcaugccguugguaacgacacuggcaaacacgggaaggaaaucaaagugacgccgcagucaaguauuacagaggcagaacugaccggauauggcacuguaaccauggaguguagccccagaacaggucuugauuucaaugaaauggugcuguugcaaauggagaacaaggcuuggcucguccacaggcagugguuucuggacuuaccucugccauggcuccccggggccgauaagcaggagucuaauuggauccagaaagaaacccuugugacuuucaagaacccucaugcgaaaaagcaagacguugugguccugggcucccaggagggagccaugcacacagcauugacgggcgcuaccgaaauacagaugucaagcgggaaucuacuguuuacuggacaucucaaaugccggcugcguauggacaaacuucaacugaaggguaugaguuacucuauguguacaggcaaauucaaggugguaaaagagauugccgagacccagcacgggacaaucguuauccgcgugcaguaugaaggagauggcuccccaugcaagauucccuucgagaucauggacuuggagaagcgguacguccucgguaggcugauuacugugaacccgauagucaccgagaaggauagcccugugaacaucgaagcugagcccccauuuggggacucguacauuaucaucggcguugagccuggacaguuaaagcugaauugguucaaaaagggaucuuccauugggcaaauguuugaaacgaccaugcggggagccaaacgaauggcaauacuaggugauacagccugggacuucggcucacucgggggaguguuuacaaguaucggcaaggcucugcaucagguauucggugcgauuuauggggcagccuuuagcggcgucuccuggaccaugaaaauccuuauuggagugaucauaacauggaucggcaugaacucucgcagcacuucauugaguguuucccugauucucguggggaucgucacccuguaccuuggagugaugguacaggcugauagcggcugugugguuucuuggaagaauaaggagcugaaaugcgguucagggauuuucaucacggacaacguccacacauggaccgaacaguauaaguuucaacccgagaguccaagcaaauuggccuccgcaauacagaaggcccaggaagagggaauuuguggcaucagaucugugacuaggcucgagaaucugauguggaaacagauuacacccgaauuaaaccacauccuggcugagaaugaagugaagcuaaccauaaugacuggugauaucaaaggcauuaugcaagccgggcggcgcucgcucagaccucagccaaccgagcugaaguacagcuggaagacauggggaaaagcaaagaugcuuuccacggaaucauauaaccagaccuucuugaucgacggcccggagacuacagagugccccaauaccaacagggcguggaauagucuggaagucgaggauuacggguuuggaguuuucacaacuaacauuuggcucaaacugaaggaaaaacaggacgcuuuuugugacucuaaguuaaugagcgccgcaaucaaggauaaucgugccgugcaugcugacaugggcuauuggauagaguccgcccugaacgauaccuggaaaauugagaaggcaucauucaucgaagugaaaaauugccacuggccuaagagccauacgcuuuggucuaacgguguauuggaguccgaaaugaucauucccaagaaccucgcugggcccgucagucaacacaauuaccggccuggauaccacacacagaucgccggcccauggcaucuggguaagcuagagauggacuucgauuuuugugacggcaccacugugauuguuaccgaagauugcgggaaccgaggacccagccugagaacaacuaccgcgucuggcaagcucauaacagaguggugcuguagguccugcacgcugccgccucuucgcuauagaggggaggacggauguugguacggcauggaaaucagaccauugaaagagaaggaagagaaucuggugaacucauuagucaccgccggucacggacagguggauaauuucagucucggaguucugggcauggcucuuuuucuggaagagauguugaggacucgcguggguacaaaacaugcaauucuccugguagccgucagcuucgugacccuaaucacuggcaacaugucguuuaaggaccuggggcgaguggucguuauggugggagcuacaauggccgaugacauuggcauggggguaaccuaucucgcacugcuugcggccuucaaagugcggcccacguuugcugccggauugcuguuacguaagcucacuuccaaggagcugaugaugaccacaaucggcauaguccuucugucucaaagcaccaucccugaaacuauucuagagcucacagaugcacuggcuuuggguaugauggugcugaaaaucguuagaaauauggaaaaguaccaguuagccgugaccauuauggcaauccucugcguccccaacgccgugauacugcagaaugcuuggaaaguuucauguacaauucuugcgguggucaguguauccccacuguugcucacuucuagccagcaaaagaccgacuggaucccucuggcccuaacgaucaaagggcugaaccccacagcaauuuuccuuaccacucucuccaggaccaauaagaaacgcucauggccacugaacgaggcuauaauggccgugggaaugguuagcaucuuggccaguucucuguuaaagaaugacauuccgaugacaggcccucucguggcuggcgggcugcuuacugucugcuaugugcugaccggacgguccgcagauuuggaacucgagagagccacggacguaaagugggaggaacaggcggagaucagcgguucgucacccauucugucuaucacaauaagugaagauggcuccaugagcaucaaaaacgaggaggaggagcagacccuaacuauucugaucaggacagggcuucucgugauuucuggacuguuuccaaucagcauacccauuaccgcugccgcaugguacuugugggaagucaagaaacagcgagccggcguuuuaugggacgugccuuccccacccccuauggguaaggcugagcuggaagauggggcauaucgcaucaaacaaaagggaauccucggcuacucacagauuggcgccgggguguacaaggagggaacuuuccacacaauguggcaugucacccggggugcggugcugaugcacaaaggcaagagaaucgagccgaguugggcugacguuaaaaaggaucuuauaagcuaugggggaggcuggaaacuggaaggugaguggaaggaaggggaggaaguacagguguuggcccuagagccaggaaagaaucccagggcaguccagacgaaaccuggccuguuuaagacuaacaccggcacaauuggggccgugucucucgacuucuccccaggaaccucagguagucccaucauugauaaaaagggcaaaguuguggggcuguacggaaacggcgucgugacacguagcggugcuuauguauccgccaucgcacaaacugagaagucuauagaagacaauccugagauugaagaugacaucuuucgcaagcggagacuuaccaucauggauuuacacccgggggcuggaaaaacgaagagguaccugcccgccauuguccgagaggcgaucaaacggggccuccgcacauugauucuggccccaacuagagugguugcagcugaaauggaggaggcccucaggggccugccuauacgguaucagacccccgcuauccgagcagaacauacagggagagagauuguggaccuuaugugucacgccaccuucacuaugcgccuguugucgccagucagggugccuaacuacaaucuaaucaucauggacgaagcccauuucaccgaucccgcuagcauugcggcacguggauauauaucaacacggguugagaugggugaggccgcuggcaucuuuaugacggccacuccaccgggguccagagacccuuucccccagaguaacgcaccaauuaucgaugaagagagggaaauucccgagcgcucuuggaauagcggacacgaauggaucaccgacuuuaagggcaaaacagugugguucgucccuuccauaaaggccgguaacgauaucgcugcgugccugcgaaagaaugggaaaaaggugauucaacucucaagaaaaaccuuugacucugaguacguaaagacucggacaaacgauugggacuucgugguuaccacggauaucagcgagaugggagccaauuuuaaagcagaaagggucauugacccacgccguuguaugaagcccgugaucuuaacugauggcgaggaaagagugauacuggcuggcccuaugccggucacacauaguuccgccgcacagcggagggggcgcauuggacgaaaccccaaaaaugagaacgaccaguacaucuauaugggugaaccccuugagaaugacgaggauugcgcccacuggaaggaagcuaagaugcugcucgacaacauuaauaccccugagggcaucauacccagcauguucgaaccagagagagaaaaaguagaugccaucgacggggaguaccgguugaggggagaggcgcgcaagaccuuuguggaucugaugagaaggggcgaccucccuguuuggcuggcauauaaaguggccgcugaagguauuaacuacgccgaucggcguugguguuucgacgggaucaagaacaaucagauucuugaggaaaacgucgagguggagaucuggacuaaagaaggcgagcgcaagaagcuaaaaccccgauggcuggaugcuagaauauauucugacccauuggcauuaaaggaauuuaaagaguucgccgcuggaaggaagucacugacacucaaucugauuaccgaaaugggccggcuuccuacauucaugacucagaaaacgcgcgaugcccuggacaaccucgcaguuuugcacaccgcggaggccgggggcagagcuuacaaucaugcccuguccgagcuaccggaaacacuggagacucuccuucuguuaaccuugcuggcaacagugaccgguggcaucuuucucuuccugaugagugggaggggaaucggcaagaugacucuugguaugugcugcauuaucacggcuagcauacugcucugguaugcccagauucagccccacuggaucgcagccucgauuaucuuggaauuuuuccugauagucuuacuaaucccagagccugaaaagcagcggaccccacaagauaaccagcugacauacgugguaauugcuauccucacugugguugcggccaccauggcaaaugagaugggguuucuugagaaaacaaagaaagaccugggcuugggaucuauugcuacccagcagccagaauccaacauccuggacauugaucuccgaccugccagcgccuggacucuguacgcagucgcuacaacguucaucacccccaugcuuagacauucaauagagaauaguucugugaacacuucccucacagccauugcgaaucaagcuaccgugcugaugggcuuggggaagggauggccgcugagcaaaauggacaucggugucccauuacuagccaucggcuguuauucacagguuaacccuauuacccugacagcagcccuccuucuguugguggcucacuacgcaauaaucgggcccggacugcaggccaaggcgacucgcgaagcucagaagagggccgcagccggcauuaugaaaaauccaacgguagaugguaucaccgugauugaccucgaucccaucccuuaugacccgaaguuugagaaacaacuggggcaggucaugcuuuuaauacugugcgugacacagguucucaugaugcggacuaccugggcuuugugugaagcccugacacuagcaaccggccccaucaguacucugugggagggaaacccaggccguuucuggaauacgacaauugcugugagcauggccaacaucuuuagaggguccuaccucgcgggagccggccuucuguucucuauuaugaagaauaccacuaacaccaggcgcgguacagggaacaucggagagacuuugggcgaaaaauggaaaagccggcugaaugcacucgguaaauccgaguuucaaauauauaagaagucaggcauucaggaagucgaucgaacccuggcuaaagaggggaucaagagaggagagacagaccaccaugccguaucuaggggcagugcaaaauuacgcugguucguggaacggaacaugguuacgccugaggggaagguggucgaucuuggaugcggcagagguggguggucguacuauuguggaggccugaaaaaugugaaggaagucaagggucucaccaaaggcgggcccggacacgaggaaccuaucccaaugagcacuuacggcuggaaccuagugcgucugcaguccgggguugacguguuuuucauucccccugagaagugcgauacauugcugugugacauaggagagucuucaccaaaucccaccguagaagcuggcaggacucuccgggugcuuaaccuggucgagaauugguugaacaauaacacacaguucugcaucaaaguucugaauccguacaugccuagcgugauugaaaagauggaggcccuccaacgcaaauaugguggggccuuaguccgaaacccacuguccagaaauaguacccaugaaauguacugggugucuaacgcgagcggaaauaucguaucauccgugaacaugauuaguaggaugcuuaucaaccgguuuacgaugcgccacaagaaggcuaccuaugagcccgauguugaccugggcagcggcacaagaaauauagggaucgagucugaagugccuaaccuagacauuaucggaaaaaggauugagaagaucaaacaggaacaugagacuuccuggcacuacgaucaggaccacccauauaagaccugggcauaccaugguucauaugaaacaaaacagacuggcagcgccucgucuauggucaauggggugguccgacuccugaccaagcccugggauguguugccgacaguuacccaaauggcuaugacugacacgacaccuuucggacagcagcggguauuuaaggagaaaguggauacccguacucaggagcccaaggaaggcaccaaaaagcugaugaaaauuacagccgaguggcucuggaaggaacuugguaaaaagaagacgccaagaauguguacccgcgaggaguucacuaggaaaguccggaguaacgcagcccugggggcuauauuuacagacgaaaauaaguggaaauccgcgagagaggccguggaagauagccgcuucugggaguuaguugacaaggaaaggaaccugcacuuggagggaaaaugcgagaccuguguguacaauaugaugggcaagcgagaaaagaaacucggcgaguuugggaaggcaaaaggaucacgggcuaucugguacauguggcugggugccagauuccuagaauuugaggcacuuggcuuccugaacgaagaucauugguuuuccagggaaaauucucucagcggggucgagggagaaggccugcacaaguuggguuauauucugcgcgacgugaguaaaaaggaaggcggggccauguacgcugaugacacugccgggugggacacacguaucacccucgaagaucuuaagaacgaggaaaugguaacaaaucacauggagggcgagcauaaaaagcuggcggaagcaaucuucaaauuaacuuaucaaaacaaggugguucggguccagagaccuacccccagggggacggugauggacauuauaucccgccgagaucagcggggaagcggucaagugggcaccuacgggcugaauacauuuacuaacauggaggcccaguugaucagacagauggaaggagagggcgucuucaaaaauauucagcaccucaccguuacagaggaaguggcuguacaaaacuggcuggccagggugggucgcgagagacuaucucggauggcaaucucaggggacgauugcgucgugaagccacuugacgauagguucgcuaacgcccugacugcucucaaugacaugggaaagauucguaaagauauccagcagugggaacccaguaagggcuggaacgacuggacccagguuccuuuuugcucccaucacuuccaugagcugauaaugaaagauggccgaguguuggucgugccaugucgcaaucaagacgaauuaaucgggagagcccggauuagccagggagcagguuggucucugagggagacggcgugccucggcaagucguaugcccagauguggucacuuaucuacuuucaccgcagagaucugcggcuagcugccaacgcaauuuguagcgcuguaccgucccacuggguucccacaaguaggaccacuuggucuauccaugccaaacacgaguggaugacaaccgaagacaugcugacuguguggaaucgagucuggauacgugagaacccuuggauggaagacaagaccccaguggagagcugggaagagauucccuaucucgggaagagagaggaucaguggugcggauccuugaucggccugacaucacgcgcaacgugggccaaaaauauucaagcggcuaucaaccaggugcggagucuuauagguaaugaagaguacaccgacuacaugccuucuaugaagagguucagacgcgaagaggaagaggccgggguccugugguga

SEQ ID NO: 14441 - RNA, 9876 nt, Artificial Sequence
  derived and/or modified CDS sequence (opt3) from DENV-2__GQ868623__SS-prME
agcgccggaaugaucauuaugcugauacccaccgugauggcuuuccaccucacaacuagaaacggggaaccucauaugaucgucgggauucaagaaaaggguaaaucccuucuguuuaagacggaagacggcguuaauaugugcaccuugauggcaauggauuuaggggaacugugugaggacacaaucacuuacaaaugcccacuacucaggcaaaacgaaccggaggauauugacuguuggugcaauucuaccucaacaugggugaccuauggaacuuguacaaccacgggcgagcaccggcgcgaaaagcgaaguguagcccuggugccccaugucgguauggggcuugagacucguaccgaaacauggaugagcuccgagggagcguggaaacacgcucagagaaucgagacuuggauacugaggcauccuggcuucaccaucauggccgcaauuuuggccuacacaaucggcaccacgcacuuucagcgggcucucauuuucauccugcugacugcaguggccccaucuaugacaaugcgcugcauagggauuucgaacagagauuuuguugaaggagugucagguggcagcugggucgacaucgugcucgagcacgggaguuguguaaccacuauggcuaagaauaagcccacauuagauuucgaacugauuaaaaccgaggccaagcagccugcgacgcuuaggaaauauugcaucgaagcaaaguugaccaacacaacuaccgagucccgguguccaacacaaggagagcccucucugaaagaagaacaggacaagcgcuuuguuugcaagcauagcaugguggaucgaggcugggguaauggguguggacuauucggcaaaggcgggaucgucacuugcgccauguuuaccugcaagaaaaacauggaaggaaagauugugcagccugagaaucucgaauacacaauaguggucaccccacacuccggugaggagcaugcuguuggcaacgacacugggaaacacggaaaggaaaucaaagugacgccgcagucaaguauuacagaggccgaacugaccggcuaugguacuguaaccauggaguguagccccagaacagggcuugauuucaaugaaauggugcuguugcaaauggagaacaaggcauggcucguccacaggcagugguuucuggacuuaccucugccauggcuccccggcgcugauaagcagggaucuaauuggauccagaaagagacccuugugacuuucaagaacccucaugccaaaaagcaagacguugugguccugggcucccaggaaggggcgaugcacacagccuugacgggagcaaccgagauacagaugucaagcgguaaucuacuguuuacuggccaucucaaaugccggcugcguauggacaaacuucaacugaaggggaugaguuacucuauguguacaggaaaauucaaggugguaaaagaaauugcugagacccagcacggcacaaucguuauccgcgugcaguaugagggugauggguccccaugcaagauucccuucgaaaucauggacuuggagaaaagauacguccucggcaggcugauuacugugaacccgauagucaccgaaaaggauagcccugugaacaucgaggccgaacccccauuuggagacucguacauuaucaucggcguugagccugggcaguuaaagcugaauugguucaaaaagggaucuuccauuggucaaauguuugagacgaccaugcggggcgcuaaacgaauggccauacuaggggauacagcaugggacuucggaucacucggcgguguguuuacaaguaucgggaaggcccugcaucagguauucggcgcuauuuauggagcggcauuuagcggcgucuccuggaccaugaaaauccuuauuggggugaucauaacauggaucggaaugaacucucgcagcacuucauugaguguuucccuggugcucgucggcauugugacccuguaccuugguguaauggugcaggccgauagcggguguguugucucuuggaagaauaaggaacugaaaugcggaucaggcaucuucauuacggacaacgugcacacauggaccgagcaguauaaguuucaacccgaaaguccaagcaaauuggcuuccgccauccagaaggcacaggaggaagguauauguggcauuagaucugugacuaggcucgagaaucugauguggaaacagaucacacccgaguuaaaccacauucuggccgaaaaugaggucaagcuaaccaucaugacuggggauauaaaaggaaucaugcaagcuggcaagcggucgcuccgcccucagccaaccgaacugaaguacagcuggaaaacaugggggaaggccaaaaugcuuuccacggagucacauaaccagaccuucuugauugacggaccggaaacugcagagugccccaauacaaacagagcguggaauagucuggagguugaagauuauggcuuugguguguucaccacaaacaucuggcucaagcugaaagagaagcaggacgcuuuuugugacucuaaguuaaugagcgccgcaauuaaagauaauagggccgugcacgcugacaugggguacuggaucgaauccgcccugaacgauacuuggaagauagagaaagcaucauucauugagguaaagaauugccauuggccuaaaagccacacccuuuggucuaacggagucuuggaauccgagaugaucaucccaaagaaccucgcuggccccgugagucaacacaauuaucguccugguuaccauacgcagauugccggcccauggcaccuggggaagcuagaaauggacuucgauuuuugugacggaacaaccguuaucgugacugaggauugcggcaaccgggggcccagccugcgaaccacaacugcgucuggaaaacucauuaccgaauggugcuguagauccugcacacugccgccucuuagguaccgcggcgaggacgguuguugguaugggauggagauacggccauugaaggaaaaagaggaaaaucuggucaacucauuagugacggccggacauggccagguugauaauuucagucucggugugcugggccuugcucuguuuuuggaggaaaugcucagaaccaggguagggacuaagcacgcaauccugcuagucgccgugagcuucgugacacugauuaccggaaacaugucggucaaagaccucggccgcguugugguaauggugggggcuacuaugacagaugacaucggaaugggcgucaccuaccuggcccuuuuggcagcguuuaaggugcgacccacguucgccgcuggucuguuacuccggaagcugacuuccaaagagcuuaugaugaccacaauugggaucguucugcuaucucaaagcaccauaccugagacuauccucgaacugacagaugccuuggcacugggaaugaugguguuaaagauuguccgugacauggagaaauaucagcucgcugugaccaucauggccauucugugcguucccaaugcagugauccuucagaacgccuggaaggucucauguacaauacuggcuguagugaguguuuccccauugcuccugacuucuagccagcagaagaccgacuggauuccucuagcgcugacgaucaagggccuuaaucccacagccaucuuucucaccacucuguccagaaccaacaaaaagaggucauggccauugaaugaagcaauuauggcugugggcauggucagcauacuggccaguucuuuacucaagaacgauaucccgaugacagggccucugguggccggaggucuucugacuguaugcuacguguugaccggccgcuccgcugaccucgagcuggaacgggcaacggaugucaaaugggaggaccaggccgagauuagcgggucgucacccauccuaucuauuacaaucagugaagauggauccaugagcauaaagaaugaggaagaggagcagacccugacuauccuuauuagaacaggccuccugguuaucucugguuuguucccagugagcauucccaucaccgcggcugccugguauuuaugggaagugaaaaagcagagggcagggguccugugggacgugccuuccccacccccuaugggaaaagccgagcucgaagauggcgcuuaccgaauaaagcaaaagggcauucugggguauucacagaucggagccgguguuuacaaagagggcacuuuucauacaauguggcacguaacccgcggggcagugcuuaugcacaagggaaaacggaucgaaccgaguugggcggacgucaagaaagaucugauuagcuacggcgguggguggaaguuggagggagaguggaaggaaggcgaggaagugcagguucuagcucuggagccaggcaaaaaccccagagccgugcagacgaagccuggacucuucaaaacuaauaccggaacaaucggugcagucucucuggacuuuuccccaggcaccucagggagucccauaauugauaagaaaggaaaggugguaggccuuuaugguaacggggucgugacaaggagcggagccuacguuuccgcuaucgcccaaacugaaaagucuauugaggacaacccugagaucgaagaugacauauuccguaaacgccgguuaaccauuauggaccugcauccgggcgcaggcaagacgaaaagauaucuccccgcuaucgugagggaggccaucaagcgaggguugcggacacugauucucgcgccaacucgcgucguggccgcagaaauggaggaagcucugagaggacuuccuaucagguaccagacccccgccauucgggcugagcacacaggucgagagauaguugaucugaugugucaugcaaccuuuacuaugagauugcuaucgccagugcgcgucccuaauuauaaccugaucauuauggacgaagcccacuucaccgaucccgccagcaucgcugcgaggggcuacaucucaacacguguggagaugggggaagcagccggaauuuucaugacggcuacuccaccgggcucccgggacccuuuuccccagaguaaugccccaauaaucgaugaggagagagaaauucccgagaggucuuggaacagcggucaugaauggguaaccgacuucaaagggaagacagugugguuuguuccuuccaucaaggcaggaaaugauauugccgcuugccuccgcaaaaacggcaagaaagucauccaauuaucacgaaagaccuucgacucugaguaugugaaaacuagaacaaaugauugggacuuuguggucaccacggauauaagcgaaaugggcgcgaacuucaaggccgagcggguaaucgacccaaggcgcuguaugaaacccgugauucugacugacggggaggaacguguuauccuugcaggaccuaugccggugacacacaguuccgcugcccagagacgggguaggauuggccgcaauccaaagaacgagaaugaucaguacaucuacaugggggaaccccuggagaacgacgaagauugcgcacacuggaaggaggccaaaaugcucuuggacaauauaaacaccccugagggaauuauccccagcauguuugaaccagagcgagaaaaggucgaugcuauugacggcgaguauagacugcggggugaagccaggaaaaccuucguggaucucaugcgcagaggggaccugccuguuuggcuugcguacaagguggcagccgagggcacuaauuaugcugauaggcggugguguuuugacggaaucaaaaacaaccagauacuagaggaaaaugucgagguggaaaucuggacaaaggagggcgagcguaagaaacugaagccccgcugguuggaugcccgaauuuacucugacccauuagcucugaaagaguucaaggaguuugcagccgggagaaaaucacucacccugaaccuuaucacagaaaugggaaggcugccuacuuucaugacgcaaaagacccgggaugcucucgacaauuuggccguacugcauacagcagaggcggguggccgcgccuauaaccacgcucuauccgaacugccggagacucucgagacccuucuguuauugacacugcucgccaccgugacugggggaauuuuccuguuucuuaugaguggcagagguaucgggaagaugacgcugggcaugugcugcauaauuaccgcaagcauccucuugugguacgcucagauccagccccauuggauugccgcaucgaucauacuggaguucuuuuuaauuguucuacugaucccagagccugaaaaacagaggacaccccaagacaaucagcucacuuaugucgugauugccauccuuaccguggucgcugcgacaauggccaacgagaugggauuccuggaaaagaccaaaaaggauuugggccuggggucuauagcaacucagcagccagaguccaauauccucgacauugaucugcggccugcuagcgccuggacacuuuacgccguugcaacgaccuuugugacucccaugcuccgacacucaaucgagaacaguucuguaaaugugucccugacagcuauugccaaccaagcgaccgucuugaugggacuggguaaaggcuggccguuaagcaagauggacaucggggugccacuacuggcuauuggauguuacucacagguuaauccuaucacccucacagccgcacuucuguugcugguggcccacuaugcuauaauuggccccggucuccaggcaaaggccacuagagaagcgcagaaacgcgcugccgcagggaucaugaagaacccaacggucgauggcaucaccguaauugaccuggaucccauaccuuacgacccgaaauucgagaagcaacuuggacaggugauguuacugauccucugcguuacacagguguugaugaugaggacuaccugggcccugugugaagcucuaacacuggccaccggccccauuaguacucucugggaggggaauccaggacgguuuuggaacacgacaaucgcagucagcauggcuaauauuuuccguggcuccuaucuugccggugcggggcuguuguuuucuaucaugaaaaacaccacuaauaccagaaggggaacaggcaacauaggugaaacucugggcgagaaguggaaaagccgccucaacgcccuggggaaguccgaguuccaaaccuacaagaaaucaggaauccaggaaguggaucggacauuagcaaaggagggcauuaaacgaggggaaacggaccaucacgcugucucuagaggaagugccaaacuuaggugguuuguggagcgcaauaugguuaccccugagggcaaagugguagaucuggguugcgggcggggaggcuggucguauuacugugguggccucaagaacgugagagaagucaaggggcuaacuaaaggaggccccgggcaugaggaaccuaucccaaugagcacauauggauggaaucugguucguuugcaguccggcguggacgucuucuuuauucccccugagaagugcgauacccugcucugugacaucggugaaucuucaccaaaccccacuguggaggcagggaggacacuucggguacugaauuugguggagaacuggcugaauaacaauacccaguucugcauaaaaguucucaacccguacaugccuagcgugauugaaaagauggaggcuuuacaacgcaaacacggaggcgcccugguccgaaauccacuuuccagaaacaguacgcaugaaauguacugggugucuaaugccagcggcaacaucgucucauccgugaauaugaucaguaggaugcugauuaaccgguucaccaugcgccacaagaaggcgacauaugagcccgacguugaucuagggagcggaacuagaaacauagguaucgaaucugagauuccuaaucucgacaucauuggcaaaaggaucgagaagauaaaacaggaacacgagaccuccuggcauuacgaucaggaccacccauauaagacaugggcuuaccaugggucauaugaaacuaaacagaccggaagcgcaucgucuaugguaaacggcgugguccgacuguugacaaagcccugggaugugcugccgaccguuacucaaauggccaugacggacacaaccccuuuuggucagcagcggguguucaaggagaaagucgauacucguacccaggaacccaaggaggggacuaagaagcucaugaaaaucacggcugaguggcuuuggaaggaacugggcaaaaagaagaccccaagaauguguacucgcgaggaauuuacaaggaaagugcggaguaaugccgcauuaggcgccauuuucaccgacgagaacaaguggaaauccgcuagagaggcgguagaagauagccgcuuuugggagcugguggacagggaacgaaauuugcaccucgagggcaagugcgaaacuuguguuuacaacaugauggggaaacgggagaagaagcugggagaguucgguaaagccaagggcucaagagcaaucugguauauguggcuaggggcuagguuucuugaguucgaggcccugggauuucucaaugaagaucacugguucucccgcgagaacucucugagcggcgucgaaggugagggguugcauaaacugggauacauucuccgugacgugaguaagaaagagggcggcgcaauguacgccgacgauacagcugggugggacacccggaucacacuugaagaucugaagaaugaggaaauggugacuaaccacauggagggagaacauaagaaauuagccgaggcgauuuuuaagcugaccuaucaaaauaaagucguuagagugcagaggccuacgccccgcgguaccguaauggacauaaucucccgacgggaucagagaggcagcgggcaagugggaacauacggcuugaacacuuucaccaauauggaggcacagcucauuaggcagauggaaggugagggggucuuuaagaacauccagcaccugacagccacugaagagguggcuguucaaaauuggcuagcccgcgugggaagagagcggcuuucuaggauggcaaucucaggcgacgauugcgucgugaaaccacuggacgaucguuucgcuaacgcccucaccgcucugaacgacaugggcaagauucgaaaggauauacagcagugggaacccaguaaaggguggaaugacuggacgcagguaccuuucugcucccaucacuuucacgaguugaucaugaaggauggacgcguuuuaguggucccauguagaaaccaagacgaacugauuggucgggccaggaucagccagggcgcaggguggucucuccgcgagacagcgugccuuggaaaaucguaugcccagauguggucacugauguacuuccauagacgggaccuaaggcuggcugccaaugcaauuuguagcgcugugccgucccacugggugcccaccagucgaacuacauggucuauccaugccaagcacgaauggaugaccacugaggauaugcucaccgucuggaaccguguuuggauaagagagaauccuuggauggaagacaaaacaccaguggagagcugggaagagauccccuauuugggcaagcgcgaagaucaguggugcgguucccugauugggcuuacgucacgggcaaccugggccaagaacauccaagcggcuauuaaucagguaaggagucugaucggaaacgaggaguacacugacuauaugccuucuaugaaaagauuucgccgggaagaggaagaggccggcgugcucugguga

SEQ ID NO: 14442 - RNA, 9876 nt, Artificial Sequence
  derived and/or modified CDS sequence (opt3) from DENV-2__GQ868624__SS-prME
agcgccggaaugaucauuaugcugauaccaaccgugauggcuuuccaccucacuacucggaacggggagccucauaugaucgucgguauucaagaaaagggaaaaucccuucuguuuaagacggaggacggcguuaauaugugcaccuugauggcaauggauuuaggggaacugugugaggacacgaucacuuacaaaugcccacuacucaggcaaaacgaaccggaggauauugacuguuggugcaauucuaccucaacaugggugaccuauggaacuuguacaaccacgggcgagcaccggcgcgaaaagcgaaguguagcccuggugccacaugucgguauggggcuugagacucguaccgaaacauggaugagcuccgagggagcguggaaacacgcucagagaaucgagacuuggauacugaggcauccuggcuucaccaucauggccgcaauuuuggccuacacaaucggcaccacgcacuuucagcgggugcucauuuucauccugcugacugcuguugcaccaucuaugacaaugcgcugcauagggauuucgaacagagauuuuguggaaggagucucagguggcagcuggguggacaucguacucgagcacgggaguuguguuaccacuauggccaagaauaagcccacauuagauuucgaacugauuaaaaccgaggcuaagcagccugccacgcuuaggaaauauugcaucgaagcgaaguugaccaacacaacuaccgagucccgguguccaacacaaggagagcccucucugaaagaggaacaggacaagcgcuuugugugcaagcauagcauggucgaucgaggcugggguaauggguguggacuauucggcaaaggcgggaucgugacuugcgcaauguuuaccugcaagaaaaacauggaaggaaagauugugcagccugagaaucucgaauacacaauagucguuaccccacacuccggugaggagcaugccgugggcaacgacacugggaaacacggaauggaaaucaagguaacgccgcagucaaguauuacagaggcugaacugaccggcuaugguacugugaccauggaguguagccccagaacagggcuugauuucaaugaaaugguccuguugcaaauggagaacaaagccuggcucgugcacaggcagugguuucuggacuuaccucugccauggcuccccggcgcagauaagcaggagucuaauuggauccagaaggaaacccuuguuacuuucaaaaacccucaugcuaagaaacaagacguggucgugcugggaucccaggagggcgccaugcacacagcguugacgggggccaccgaaauacagaugucaagcggaaaucuacuguuuacuggucaucucaagugccggcugcguauggacaaacuucaacugaagggcaugaguuacucuauguguacagggaaguucaaaguaguuaaggagauugcagagacccagcacggaacaaucgugauccgcguccaguaugaaggcgaugguuccccaugcaaaauucccuucgagaucauggacuuggaaaagagauacgugcucgggaggcugauuacugucaacccgauagugaccgagaaagauagcccuguuaacaucgaagcugagcccccauuuggcgacucguacauuaucaucggaguggagccuggccaguuaaagcugaauugguucaagaaagggucuuccauuggacaaauguuugaaacgaccaugcggggugccaagcgaauggcuauacuaggcgauacagccugggacuucgggucacucggaggcguauuuacaaguaucgguaaagcacugcaucaggucuucggggccauuuauggcgcugcguuuagcggaguguccuggaccaugaagauccuuauuggcguuaucauaacauggaucgggaugaacucucgcagcacuucauugagugugucccugguccucgugggaauuguaacccuguaccuuggcgugaugguucaggcagauagcgguugugucgugucuuggaaaaauaaggagcugaagugcgggucaggaaucuucauuacggacaacgugcacacauggaccgaacaguauaaauuucaacccgagaguccaagcaaguuggccuccgcuauccagaaagcccaggaagagggcauaugugguauuagaucugucacuaggcucgagaaucugauguggaagcagaucacacccgaauuaaaccacauucuggcagagaaugaaguuaaacuaaccaucaugacuggcgauauaaaggggaucaugcaagccggaaaacggucgcuccgcccucagccaaccgagcugaaguacagcuggaagacauggggcaaagcuaagaugcuuuccacggaaucauauaaccagaccuucuugauugacgggccggagacugccgagugccccaauacaaacagagcauggaauagucuggaaguggaggauuacggauuuggcguguucaccacaaacaucuggcucaaacugaaggaaaaacaggacgcguuuugugacucuaaguuaaugagcgcugccauuaaggauaauagggcaguacaugccgacauggguuauuggaucgaguccgcucugaacgauacuuggaaaauagagaaggccucauucauugaagucaaaaauugccacuggccuaagagccauacccuuuggucuaacgggguguuggaguccgaaaugaucauccccaagaaccucgcaggacccguuagucaacacaauuaccguccuggcuaccacacgcagauugcugguccauggcaucugggcaagcuagagauggacuucgauuuuugugacgggacaaccgugaucgucacugaagauugcggaaaccggggccccagccugcgaaccacaacugccucugggaagcucauuaccgaguggugcuguagauccugcacacugccgccucuuagguaucgcggagaggacggcuguugguacgguauggaaauacggccauugaaagagaaggaagagaaucuggugaacucauuaguuacggcggggcacggacagguggauaauuucagucucggcguacuggguauggcccuuuuucuggaagagauguugagaaccagggucggcacuaaacaugcuauccuccugguggcagugagcuucgucacacuaauuaccgggaacaugucguuuaaggaccugggacgcguugugguaauggugggcgccacuauggcugaugacaucgggaugggagucacauaucucgcccugcuugcagcguucaaagugcgacccaccuuugccgcuggcuugcuguuacggaagcucacguccaaggagcugaugaugacuaccauugguaucguucuucugucucaaagcacaauaccugaaaccgugcuagagcucacugaugcccuggcauuggggaugaugguccugaaaaucgugcguaauauggaaaaguaccaguuagcuguuacaauuauggccauccucugcgugcccaacgcagucauucugcagaaugccuggaaaguaucauguaccauccuugcugugguuaguguguccccacuguugcucacaucuagccagcaaaagacugacuggauaccucuggcgcuaaccauuaaaggacugaaccccacggccaucuuccuuacaacccucuccagaacuaauaagaaaaggucauggccacugaacgaggcaaucauggcugucggcauggugagcauuuuggccaguucucuguuaaagaaugacauaccgaugaccggcccucucguagccgggggacugcuuacagugugcuauguccugacuggucgcuccgcugauuuggaacucgagcgggcaaccgacguuaagugggaggaucaggccgaaaucagcggcucgucacccauucugucuaucacgauuagugaggacggguccaugagcaucaaaaacgaagaggaggaacagacacuaaccauacugaucagaacuggacuucucgugauuucuggccuguuuccaaucagcauucccaucacagcggcugccugguacuugugggaggugaagaaacagagggccggugucuuaugggaugugccuuccccacccccuauggggaaggccgaacuggaggacggagcuuaucgaauaaaacaaaagggcauucucggcuacucacagaucggggcaggaguuuacaaggaagguaccuuccacacuauguggcauguaacacgcggcgccgugcugaugcacaaagggaagcggaucgagccgaguugggcggaugucaaaaaggaccuuauuagcuauggaggcgguuggaaacuggagggggaauggaaggagggagaagaggugcagguuuuggcucuagaaccaggcaagaaucccagagccgugcagaccaaaccuggccuguuuaagacgaacacugggaccaucggagcagucucucucgauuucuccccagguacaucaggcagucccauaauugacaaaaaggggaaagugguaggacuguacggcaacggugucgugaccaggagcggggccuauguuuccgcuaucgcccaaacagagaagucuauugaggauaauccugaaaucgaggacgauauauuucguaagcgccggcuuacuauuauggacuuacacccgggagcaggcaaaaccaagagauaccugcccgcuaucgugagggaagccaucaaacgaggccuccggacguugauucuggcgccaacacgcgucguggccgcagagauggaagaggcucucagagggcugccuaucagguaucagacucccgccauucgggcugagcauaccggacgagaaauaguugaccuuaugugucacgcaacauucaccaugagacuguugucgccagugcgcgucccuaacuacaaucuaaucauuauggaugaggcccauuucacugaccccgccagcaucgcugcgagggguuauaucucaacccguguggaaaugggcgaggcagccgggauuuuuaugacagcuacgccaccgggaucccgggauccuuucccccagaguaacgccccaauaaucgacgaggaaagagagauucccgaaaggucuuggaauagcggccacgaguggguaacugauuuuaaggguaaaaccgugugguucguuccuuccaucaaggcagggaacgacauugccgcuugccugcgcaagaauggcaagaaggucauccaacucucacgaaaaacauuugauucugaauacgugaagaccagaacuaacgacugggauuucguggucacaaccgacauaagcgagaugggcgcgaauuuuaaagccgagcggguaaucgauccaaggcgcuguaugaagcccgugauuuuaacggacggcgaagaacguguuauccuggcagggccuaugccggugacucauaguuccgcugcccagagacggggaaggauuggucgcaaccccaaaaaugaaaacgaccaguacaucuauaugggcgagccccuugaaaaugaugaggacugcgcacacuggaaggaggccaagaugcugcucgauaacauaaauacaccugaagggauuauccccagcauguucgagccagaacgagagaaagucgacgcuauugauggagaauacagauugcggggcgaggccaggaagaccuuuguggaccugaugcgcagaggugaucucccuguuuggcuggcguauaaaguggcagccgaggggaucaacuacgcugacaggcggugguguuucgauggcauaaagaacaaucagauccuugaagagaacgucgaaguggagauuuggaccaaagagggagaacguaagaagcuaaaaccccgcuggcuggacgcccgaaucuauucugauccauuggcuuuaaaggaguuuaaagaguucgcagccggcagaaagucacugacucucaaucugauuacagagauggggaggcuuccuaccuucaugacacagaaaacucgggacgcucuggauaaccucgccguauugcacacggcagaagcgggaggucgcgccuacaaucaugcucuguccgagcuaccggagacccuggaaacacuccuucuguuaacuuugcuggccaccgugacaggcgggaucuuucucuuccugaugaguggaagaggcauagguaagaugacccuugggaugugcugcauuaucacugcaagcauccugcucugguaugcucagauucagccccacuggaucgccgcaucgauaauuuuggaguuuuuccugaucguuuuacuaauuccagaaccugagaagcagaggacgccccaagacaaccagcugaccuacgucgugaucgccauacucacaguggucgcugcgacuauggccaaugaaaugggcuuucuugagaaaaccaagaaagaccugggauugggcucuaucgcaacacagcagccagaguccaacauucuggauaucgaccuccggccugcuagcgccuggacccuguacgccguugcaacuacauucgugacgcccaugcuucgacauucaauugaaaauaguucuguaaacgugucccucaccgcuaucgccaaucaagcgacuguccugaugggguugggaaaggguuggccgcugagcaaaauggauauuggcgugccauuacuagcuaucggguguuauucacagguuaacccuauaacacugaccgccgcacuccuucuguugguggcccacuacgcuauuaucggacccggccugcaggcaaaggccaccagagaggcgcagaagcgcgcugccgcagguaucaugaaaaauccaacagucgacgggauuacuguaauagaucucgaccccaucccuuaugauccgaaguuugaaaaacaacugggccaggugaugcuuuuaauucugugcguuacacaggugcucaugaugaggaccacaugggccuugugugaggcucugacucuagccaccggacccaucaguacacugugggaaggcaacccagggcgguucuggaauaccacuauugcagucagcauggcuaacaucuuucguggauccuaccucgccggcgcgggucuucuguucucuauaaugaagaauacgacaaacaccagaagggggacuggaaacaucggcgagaccuugggugagaaauggaaaagccgccugaaugcccucggcaaauccgaauuucaaauuuauaagaagucagggauccaggagguggaccggacacuggcaaaagaaggaauuaagcgaggcgagacugaucaccaugcugucucuagagggagugccaaauuaaggugguucguggagcgcaacaugguuaccccugaaggaaaggugguagaccuuggcugcgguagagggggauggucguacuauuguggcggucugaaaaaugugagagaggucaagggccucacaaaagggggacccggccacgaggaaccuaucccaaugagcacguacggguggaaccuaguucgucugcaguccggaguggaugucuuuuucauacccccugaaaaaugcgacaccuugcugugugauauuggcgagucuucaccaaaucccacuguggaggcagguaggacacuccggguacuuaaccugguggaaaauugguugaacaauaacacccaguucugcaucaagguucugaauccguacaugccuagcgugaucgagaaaauggaagcucuccaacgcaaguaugggggagccuuaguccgaaacccacuguccagaaauaguacucaugagauguacugggugucuaacgccagcggcaauauugucucauccgugaacaugauaaguaggaugcuuaucaaccgguuuacaaugcgccacaaaaaggcgaccuaugaacccgacguugaccugggcagcgggacgagaaauauuggaaucgagucugagauuccuaaccuagauaucauagguaagaggaucgagaaaauuaaggaggaacaugagaccuccuggcacuacgaccaggaucacccauauaaaacaugggcuuaccauggcucauaugaaacuaagcagaccgggagcgcaucgucuaugguaaauggagugguccgacuccugacaaaacccugggacguguugccgacuguuacccagauggccaugacagauaccacuccuuucggccaacagcggguguuuaaggagaaggucgacacgcguacacaggagcccaaagaagguaccaagaaacugaugaagaucacugcugaguggcucuggaaagaacuugggaagaaaaagaccccaagaauguguacacgcgaggaguucacgaggaaggugcggaguaacgccgcacugggagccauuuuuaccgaugaaaauaaauggaaguccgcuagagaggcgguagaagacagccgcuucugggaguuaguggauaaagaaaggaaccugcacuuggagggcaagugcgagacuuguguuuacaauaugaugggcaaacgagaaaagaagcucggggaguuuggaaaagccaaggguucacgggcaaucugguacauguggcugggcgcuagauuccuagaauuugaggcccuuggguuccugaacgaagaccauugguuuuccagggaaaauucucucagcggagucgagggcgaaggucugcacaaauugggguauauucugcgcgaugugaguaagaaagagggaggcgcaauguacgccgacgacacagcuggcugggauacccguauaacucucgaagaccuuaagaacgaggaaauggugacaaaucacauggagggggagcauaagaaacuggccgaagcgaucuucaaguuaaccuaucagaacaaagucguucgggugcaaagaccuacacccaggggaacuguaauggauauuaucucccgccgagaccagcgggguagcggccagguggggaccuacggacugaauacguuuaccaacauggaggcacaauugaucagacagauggaaggcgagggugucuucaagaauauucagcaccucacagugacugaggaagccgcuguucagaacuggcuggccaggguggggcgcgagagacuaucucggauggcaauaucaggagaugacugcgucgugaaaccacuugaugacagguucgcuaacgcccugaccgcucucaaugauaugggcaagauccguaaggacauucaacagugggaacccaguaaaggcuggaacgauuggacacagguaccuuuuugcucccaucacuuccaugagcugaucaugaaggacgggcgaguuuugguggucccaugucgcaaucaggaugaauuaauugguagagcacggaucagccaaggagcaggcuggucucugagggagacugcgugccucgggaaaucguaugcccagauguggucacuuauguacuuucaccgcagagaccugcggcuagcugccaacgcaauauguagcgcugugccgucccacugggugcccaccaguaggacgacauggucuauccaugccaagcacgaguggaugaccacugaagacaugcugacagucuggaaucgaguuuggauucgugagaacccuuggauggaagauaaaaccccaguggagagcugggaagagauccccuaucucggaaagagagaggaccaguggugcggcuccuugauuggucugacuucacgcgcaaccugggccaagaauauccaggcggcuauaaaccaaguacggagucuuauugggaaugaagaguacacagauuacaugccuucuaugaaaagguucagacgcgaagaggaagaggccggagugcugugguga

SEQ ID NO: 14443 - RNA, 9876 nt, Artificial Sequence
  derived and/or modified CDS sequence (opt3) from DENV-2__FJ639717__SS-prME
agcgcaggaaugaucauuaugcugauccccaccgugauggcuuuccaccucaccacuagaaacggggagccucauaugaucgucggcauucaggaaaaggguaaaucccuucuguuuaagacggaggacggcguuaauaugugcaccuugauggcaauggauuuaggggaacugugugaggacacaaucacuuacaaaugcccacuacucaggcaaaacgaaccggaggauauugacuguuggugcaauucuaccucaacaugggugaccuauggaacuuguacaaccacgggcgagcaccggcgcgaaaagcgaaguguagcacuggugccccaugucgguauggggcuugagacucguaccgaaacauggaugagcuccgagggagcguggaaacacgcucagagaaucgagacuuggauacugaggcauccuggcuucaccaucauggccgcaauuuuggccuacacaaucggcaccacgcacuuucagcgggcucucauuuucauccugcugacugcaguggccccaucuaugacaaugcgcugcauagggauuucgaacagagauuuuguugaaggagugucagguggcagcugggucgacaucgugcucgagcacgggaguuguguaaccacuauggcuaagaauaagcccacauuagauuucgaacugauuaaaaccgaggccaagcagccugcgacgcuuaggaaauauugcaucgaagcaaaguugaccaacacaacuaccgagucccgguguccaacacaaggagagcccucucugaaagaggaacaggacaagcgcuuuguuugcaagcauagcaugguggaucgaggcugggguaauggguguggacuauucggcaaaggcgggaucgucacuugcgccauguuuaccugcaagaaaaacauggaaggaaagauugugcagccugagaaucucgaauacacaauaguggucaccccacacuccggugaggagcaugcuguuggcaacgacacugggaaacacggaaaggaaaucaaagugacgccgcagucaaguauuacagaggccgaacugaccggcuaugguacuguaaccauggaguguagccccagaacagggcuugauuucaaugaaauggugcuguugcaaauggagucuaaggcauggcucguccacaggcagugguuucuggacuuaccucugccauggcuccccggcgcugauaagcagggauccaacuggauccagaaagagacccuugugacuuucaagaauccucaugccaaaaagcaagacguugugguccugggcucacaggaaggggcgaugcacacagccuugacgggagcaaccgagauacagaugagcagugguaaccuacuguuuacuggccaucucaaaugccggcugcguauggacaaacuucaacugaaggggaugucuuacuccauguguacaggaaaauucaaggugguaaaagaaauugcugagacccagcacggcacaaucguuauccgcgugcaguaugagggugaugggagcccaugcaagauucccuucgaaaucauggacuuggagaaaagauacguccucggcaggcugauuacugugaauccgauagucaccgaaaaggauucgccugugaacaucgaggccgaacccccauuuggagacucuuacauuaucaucggcguugagccugggcaguuaaagcugaacugguucaaaaagggauccucaauuggucaaauguuugagacgaccaugcggggcgcuaaacgaauggccauacuaggggauacagcaugggacuucggaagucucggcgguguguuuacuagcaucgggaaggcccugcaucagguauucggcgcuauuuauggagcggcauuuuccggcgucucuuggaccaugaaaauccuuauuggggugaucauaacauggaucggaaugaauagccgcucaacaaguuuguccguuagccuggugcucgucggcauugugacccuguaccuugguguaauggugcaggccgauucuggguguguugucucauggaagaacaaggaacugaaaugcggaaguggcaucuucauuacggacaaugugcacacauggaccgagcaguauaaguuucaacccgaaagcccauccaaauuggcuucugccauccagaaggcacaggaggaagguauauguggcauuagaucggugacuaggcucgagaaccugauguggaaacagaucacacccgaguuaaaucacauucuggccgaaaacgaggucaagcuaaccaucaugacuggggauauaaaaggaaucaugcaagcuggcaagcggagccuccgcccucagccaaccgaacugaaguacuccuggaaaacaugggggaaggccaaaaugcuuucaacggagagucauaaucagaccuucuugauugacggaccggaaacugcagagugccccaacacaaauagagcguggaacucucuggagguugaagauuauggcuuugguguguucaccacaaauaucuggcucaagcugaaagagaagcaggacgcuuuuugugacagcaaguuaauguccgccgcaauuaaagauaacagggccgugcacgcugacaugggguacuggaucgaaucagcccugaaugauacuuggaagauagagaaagccagcuucauugagguaaagaacugccauuggccuaaaucucacacccuuugguccaauggagucuuggaaagugagaugaucaucccaaagaaccucgcuggccccgugagccaacacaacuaucguccugguuaccauacgcagacagccggcccauggcaccuggggaagcuagaaauggacuucgauuuuugugacggaaccacuguuauugugaccgaggauugcggcaaucgggggcccucucugcgaacaacuaccgcguccggaaaacucaucacagaauggugcuguagaucaugcacgcugccgccucuuagguaccgcggcgaggacgguuguugguaugggauggagauucggccauugaaggaaaaagaggaaaaccuggucaauaguuuagugaccgccggacauggccagguugauaacuucagccucggugugcugggcauggcucuuuuucuggaggaaauguugagaacuaggguagggacaaagcacgcaauacuccuggucgccgugucguucgugacccuaaucacuggaaauauguccuuuaaagaccugggccgcgucguugugaugguagggacaaccaugacggaugacauuggaaugggcgugacuuaccucgcucugcuugccgcauucaagguccgacccaccuuugcggccgguuugcuguuacggaagcucacaucuaaagagcugaugaugaccacuaucgggauugugcuucugagccaaucaacaaucccugagaccauacuagaacucacagaugcucuggccuugggaaugaugguucugaagaucgugcgugacauggagaaauaucaguuagcagucacuauuauggcuauccucugcgugcccaacgccguuauucugcagaaugcauggaaggugaguuguaccauccuugccgucguauccgugucuccacuguugcucacgagcucccagcaaaagacugacuggauaccucuggcucuaaccauuaagggccugaaccccacugcgaucuuccuuaccacacucucaagaacuaauaaaaagaggagcuggccacugaacgaagccaucauggcaguuggcauggugaguauuuuggcuucuucccuguuaaagaaugauauaccgaugaccgggccucucgucgccggaggucugcuuacggugugcuacguacugacaggccgcagcgccgacuuggagcucgaacgggcuaccgaugugaaaugggaggaccaggcagagaucucggggucaucucccauucugaguaucacuauuuccgaagauggaagcaugucuaucaagaacgaggaagaggagcagacacuaaccauacugaucagaacuggccuucucgucauuagcggucuguuuccaguuuccauccccauuacagccgcggcuugguauuugugggaagugaaaaagcagagggccgggguguuaugggacgucccuucaccacccccuaugggaaaagcagagcuggaagauggcgccuaccgaaucaagcaaaagggcauacucggguauagucagauuggagcugguguguacaaagagggcaccuuccauacgauguggcacguuacucgcggggcaguacugaugcacaagggaaaacggaucgaaccgagcugggccgacgugaagaaagaucuuaucucuuacggcgguggguggaagcuggagggagaguggaaggaaggcgaggaaguccagguguuggcgcuagagccaggcaaaaaucccagagcuguucagaccaagccugggcuguuuaaaacaaacaccggaacaauuggugccgugucccucgacuucucaccaggcacaagugggagccccaucauagauaagaaaggaaaggucgugggccuguaugguaaugggguagucaccagguccggagcauacgugucugccauugcucaaacggaaaagucgaucgaggacaacccugagauugaagaugacaucuuucguaaacgccggcuuacaauaauggacuuacauccgggcgccggcaagacuaaaagauaucugcccgcaauuguuagggaggcuaucaagcgagggcuccggaccuugauccuggccccaacacgcguggucgcggccgaaauggaggaagcacucagaggacugccuauuagguaccagacccccgcuauccgggccgagcacacuggucgagagauuguggaucuuaugugucaugcuaccuucacaaugagacuguugagcccaguucgcgugccuaacuauaaucuaauaaucauggacgaagcacacuucacggaucccgccucaauugccgcuaggggcuacaucuccacucgugucgagaugggggaagcggcaggaaucuuuaugaccgccacaccaccgggcagucgggacccuuucccccagucuaacgcuccaauuauagaugaggagagagaaauccccgagaggagcuggaauaccggucaugaaugggugacugacuuuaaagggaagacaguaugguucgugccuuccauuaaggccggaaacgauaucgcagccugccugcgcaaaaauggcaagaaaguuauucaacucucacgaaagaccuuugacucugaguaugucaaaacgagaacuaacgauugggacuucguggugacaaccgauaucagcgaaaugggcgcuaauuuuaaggcggagcgggucauagacccaaggcgcuguaugaaacccguaaucuuaaccgacggggaggaacgugugauucuggccggaccuaugccgguuacucacaguuccgcagcucagagacgggguaggaucggccgcaacccaaagaaugagaacgaucaguacauuuacaugggggaaccccuugagaaugacgaagauugcgcccacuggaaggaggcaaaaaugcugcucgacaacaucaauacaccugagggaauaauucccagcauguucgaaccagagcgagaaaagguggaugccaucgacggcgaguauagauugcggggugaagcuaggaaaaccuuugucgaucugaugcgcagaggggaccucccuguguggcuggccuacaagguugcggcagagggcauuaacuaugccgauaggcggugguguuucgacggaaucaaaaauaaccagauacuugaggaaaacguggaggucgaaaucuggacaaaggagggcgagcguaagaaacuaaagccccgcuggcuggaugcucgaauuuacucugacccauuggccuuaaaagaauuuaaggaguucgcugcagggagaaaaucacugacucucaaucugaucacggaaaugggaaggcuuccuaccuucaugacacaaaagacucgggaugcccuggacaaccucgcuguguugcauaccgccgaggcggguggacgcgcauauaaucacgcccuguccgaacuaccggagacacuggagacccuccuucuguuaacuuugcuggcuacgguaaccgggggaauuuuucucuuccugaugaguggcagagguaucgggaagaugacacuuggcaugugcugcauaauuacugccagcgugcugcucugguacgcacagauccagccccauuggaucgcugccucgauuaucuuggaauuuuuccugauaguuuuacuaauuccagagccugaaaaacagaggacaccccaagacaaccagcugacauaugucgugaucgcaauucucaccguggucgccgcuacuauggcgaaugagaugggauuucuugaaaagacuaaaaaggaucugggcuuggggucuaucgccacgcagcagccagaguccaacauacuggacaucgaucuccggccugcaagcgcuuggacccuguacgccguugccacuacauucgugacccccaugcuucgacacucaauugagaauaguucuguaaacgugucccucaccgcaaucgcuaaucaagccacaguccugaugggauuggguaaaggcuggccgcugagcaagauggacauuggggugccauuacuagcgaucggauguuacucacagguuaacccuauuacucugacggcugcccuccuucuguugguggcacacuaugccaucauaggccccggucugcaggcuaaggcaaccagagaagcccagaaacgcgcggcugccgggauuaugaagaauccaacagucgauggcaucacuguaaucgaccucgaucccauuccuuacgacccgaaauuugagaagcaacugggacaggugaugcuuuuaauacugugcguuacccaggugcucaugaugaggacaaccugggcauugugugaagcccugacucuagcuacgggccccaucaguacacugugggaggggaacccaggacgguucuggaauaccacuauugccgucagcauggcaaacaucuuucguggcuccuaucucgcuggugccgggcuucuguucucuauuaugaaaaauaccacaaacacuagaaggggaaccggcaauaucggugaaacauugggcgagaaguggaaaagccgccugaacgcgcucgggaaguccgaguuucaaacguacaagaaaucaggaauacaggaaguggaucggacccuggccaaggagggcaucaaacgaggggaaacugaccaucacgcagucucuagaggaagugcuaaguuaaggugguucguggagcgcaacaugguuacaccugagggcaaagugguagaucuugguugcgggcggggaggcuggucguauuacugugguggccugaagaaugugagagaagucaaggggcucaccaaaggaggccccgggcaugaggaaccuauuccaaugagcacuuauggauggaaccuaguucgucugcaguccggcguggacgucuuuuucauacccccugagaagugcgauacauugcugugugacauuggugaaucuucaccaaaucccaccguggaggccgggaggacgcuccggguacuuaaccugguggagaauugguugaacaauaacacccaguucugcaucaaaguucugaauccguacaugccuagcgugauagaaaagauggaggcacuccaacgcaaauacggaggcgcuuuaguccgaaacccacuguccagaaauaguacacacgaaauguauugggugucuaacgccagcggcaauauugucucauccgugaacaugaucaguaggaugcuuaucaaucgguuuacuaugcgccauaagaaggccaccuacgagcccgacguugaucuggggagcggaacaagaaacauugguauagaaucugagaucccuaaccuagacauuaucggcaaaaggauugagaagaucaaacaggaacacgagacuuccuggcacuaugaucaggaccauccauacaagaccugggcguaucacgggucauacgaaacaaaacagaccggaagcgcuucgucuaugguaaauggcgugguccgacuccugacuaagcccugggauguguugccgacgguuacacaaauggcaaugaccgacacuaccccuuucggucagcagcggguguuuaaggagaaagucgauacacguacgcaggaacccaaggaggggaccaaaaagcugaugaaaauaacugccgaguggcucuggaaggaacuuggcaaaaagaagacaccaagaauguguacccgcgaggaguucacuaggaaagugcggaguaacgcugcccugggcgcaaucuuuacagacgagaauaaguggaaauccgccagagaggcuguagaagauagccgcuucugggaguuaguggacaaggaaaggaaccugcauuuggagggcaaaugcgaaaccuguguuuauaauaugauggggaagcgagagaagaaacucggagaguuugguaaggcgaaaggcucacgggccauuugguacauguggcugggggcaagauuccuagaauuugaggcucuuggauuccugaacgaagaucacugguuuuccagggaaaauucucucagcggcgucgaaggugaggggcugcacaaguugggauacauccugcgcgacgugaguaaaaaggagggcggcgccauguaugcagacgauacagccgggugggacacucguauuacccucgaagaucuuaagaacgaggaaauggugacgaaucauauggagggagaacacaaaaagcuggcugaggccaucuucaaauuaaccuaccaaaacaaggucguucgggugcagagaccuacacccagggguacuguaauggacauuauaucccgccgagaucagcggggcagcgggcaagugggaaccuauggccugaauacauuuacuaacauggaggcgcaguugaucagacagauggaaggugagggggucuucaaaaauauucagcaucucaccgcaacggaagagguggccguucaaaacuggcuggcuagggugggacgcgagagacuaucucggauggccaucucaggcgacgauugcgucgugaagccacuugacgauagguucgcaaaugcucugacagcccucaacgacaugggcaagauccguaaagauauucagcagugggaacccaguaagggguggaacgacuggacccagguaccuuuuugcucccaccauuuccacgagcugauaaugaaagauggacgaguuuugguggucccaugucgcaaucaagacgaauuaaucgguagagcucggauuagccagggcgccggguggucucugagggagacugcaugccucggaaagucguacgcgcagauguggucacuuauguauuuucaccgcagagaccugcggcuagccgcuaacgccaucuguagcgcagugccgucccauugggugcccacaaguaggaccacuuggucuauucacgcuaaacaugaauggaugaccacagaggauaugcugacggucuggaaucgaguuuggauccgugagaacccuuggauggaagacaagaccccaguggagagcugggaagagauacccuaccucggcaagagagaagaucaguggugcgguuccuugaucgggcugacuucacgcgccacaugggccaaaaauauucaagccgcgaucaaccagguacggagucuuauuggaaaugaggaguauaccgacuacaugccuucuaugaagagguucagacgcgaagaggaagaggcuggcgugcugugguga

SEQ ID NO: 14444 - RNA, 9876 nt, Artificial Sequence
  derived and/or modified CDS sequence (opt3) from DENV-2__FJ639718__SS-prME
agcgccggcaugaucauuaugcugauacccaccgugauggcuuuccaccucacaacuagaaacggggagccucauaugaucgucggaauucaggaaaaggguaaaucccuucuguuuaagacggaggacggcguuaauaugugcaccuugauggcaauggauuuaggggaacugugugaggacacaaucacuuacaaaugcccacuacucaggcaaaacgaaccggaggauauugacuguuggugcaauucuaccucaacaugggugaccuauggaacuuguacaaccacgggcgagcaccggcgcgaaaagcgaaguguagcccuggugccccaugucgguauggggcuugagacucguaccgaaacauggaugagcuccgagggagcguggaaacacgcucagagaaucgagacuuggauacugaggcauccuggcuucaccaucauggccgcaauuuuggccuacacaaucggcaccacgcacuuucagcgggugcucauuuucauccugcugacugcuguugcaccaucuaugacaaugcgcugcauagggauuucgaacagagauuuuguggaaggagucucagguggcagcuggguggacaucguacucgagcacgggaguuguguuaccacuauggccaagaauaagcccacauuagauuucgaacugauuaaaaccgaggcuaagcagccugccacgcuuaggaaauauugcaucgaagcgaaguugaccaacacaacuaccgagucccgguguccaacacaaggagagcccucucugaaagaagagcaggacaagcgcuuugugugcaagcauagcauggucgaucgaggcugggguaauggguguggacuauucggcaaaggcgggaucgugacuugcgcaauguuuaccugcaagaaaaacauggaaggaaagauugugcagccugagaaucucgaauacacaauagucguuaccccacacuccggugaggagcaugccgugggcaacgacacugggaaacacggaauggaaaucaagguaacgccgcagucaaguauuacagaggcugaacugaccggcuaugguacugugaccauggaguguagccccagaacagggcuugauuucaaugaaaugguccuguugcaaauggagaacaaagccuggcucgugcacaggcagugguuucuggacuuaccucugccauggcuccccggcgcagauaagcaggagucuaauuggauccagaaggaaacccuuguuacuuucaaaaacccucaugcuaagaaacaagacguggucgugcugggaucccaggagggcgccaugcacacagcguugacgggggccaccgaaauacagaugucaagcggaaaucuacuguuuacuggucaucucaagugccggcugcguauggacaaacuucaacugaagggcaugaguuacucuauguguacagggaaguucaaaguaguuaaggagauugcagagacccagcacggaacaaucgugauccgcguccaguaugaaggcgaugguuccccaugcaaaauucccuucgagaucauggacuuggaaaagagauacgugcucgggaggcugauuacugucaacccgauagugaccgagaaagauagcccuguuaacaucgaagcugagcccccauuuggcgacucguacauuaucaucggaguggagccuggccaguuaaagcugaauugguucaagaaagggucuuccauuggacaaauguuugaaacgaccaugcggggugccaagcgaauggcuauacuaggcgauacagccugggacuucgggucacucggaggcguauuuacuaguaucgguaaagcacugcaucaggucuucggggccauuuauggcgcugcguuuagcggaguguccuggaccaugaagauccuuauuggcguuaucauaacauggaucgggaugaacucucgcagcacuucauugagugugucccugguccucgugggaauuguaacccuguaccuuggcgugaugguucaggcagauagcgguugugucgugucuuggaaaaauaaggagcugaagugcgggucaggaaucuucauuacggacaacgugcacacauggaccgaacaguauaaauuucaacccgagaguccaagcaaguuggccuccgcuauccagaaagcccaggaagagggcauaugugguauuagaucugucacuaggcucgagaaucugauguggaagcagaucacacccgaauuaaaccacauucuggcagagaaugaaguuaaacuaaccaucaugacuggcgauauaaaggggaucaugcaagccggaaaacggucgcuccgcccucagccaaccgagcugaaguacagcuggaagacauggggcaaagcuaagaugcuuuccacggaaucauauaaccagaccuucuugauugacgggccggagacugccgagugccccaauacaaacagagcauggaauagucuggaaguggaggauuacggauuuggcguguucaccacaaacaucuggcucaaacugaaggaaaaacaggacgcguuuugugacucuaaguuaaugagcgcugccauuaaggauaauagggcaguacaugccgacauggguuauuggaucgaguccgcucugaacgauacuuggaaaauagagaaggccucauucauugaagucaaaaauugccacuggccuaagagccauacccuuuggucuaacgggguguuggaguccgaaaugaucaucccaaaaaaccucgcaggacccguuagucaacacaauuaccguccuggcuaccacacgcagauugcugguccauggcaucugggcaagcuagagauggacuucgauuuuugugacgggacaaccgugaucgucacugaagauugcggaaaccggggccccagccugcgaaccacaacugccucugggaagcucauuaccgaguggugcuguagauccugcacacugccgccucuuagguaucgcggagaggacggcuguugguacgguauggaaauacggccauugaaagagaaggaagagaaucuggugaacucauuaguuacggcggggcacggacagguggauaauuucagucucggcguacuggguauggcccuuuuucuggaagagauguugagaaccagggucggcacuaaacaugcuauccuccugguggcagugagcuucgucacacuaauuaccgggaacaugucguuuaaggaccugggacgcguugugguaauggugggcgccacuauggcugaugacaucgggaugggagucacauaucucgcccugcuugcagcguucaaagugcgacccaccuuugccgcuggcuugcuguuacggaagcucacguccaaggagcugaugaugacuaccauugguaucguucuucugucucaaagcacaauaccugaaaccgugcuagagcucacugaugcccuggcauuggggaugaugguccugaaaaucgugcguaauauggaaaaguaccaguuagcuguuacaauuauggccauccucugcgugcccaacgcagucauucugcagaaugccuggaaaguaucauguaccauccuugcugugguuaguguguccccacuguugcucacaucuagccagcaaaagacugacuggauaccucuggcgcuaaccauuaaaggacugaaccccacggccaucuuccuuacaacccucuccagaacuaauaagaaaaggucauggccacugaacgaggcaaucauggcugucggcauggugagcauuuuggccaguucucuguuaaagaaugacauaccgaugaccggcccucucguagccgggggacugcuuacagugugcuauguccugacuggucgcuccgcugauuuggaacucgagaaggcaaccgacguuaaaugggaggaucaggccgaaaucagcggcucgucacccauucugucuaucacgauuagugaggacggguccaugagcaucaagaacgaagaggaggaacagacacuaaccauacugauccggacuggacuucucgugauuucuggccuguuuccaaucagcauucccaucacagcggcugccugguacuugugggaggugaaaaagcagagagcaggugucuuaugggaugugccuuccccacccccuauggggaaagccgaacuggaggacggagcuuauaggauaaagcaaaagggcauucucggcuacucacagaucggggcaggaguuuacaaagaagguaccuuccacacuauguggcauguaacacgaggcgccgugcugaugcacaaggggaaacgcaucgagccgaguugggcggaugucaagaaagaccuuauuagcuauggaggcgguuggaagcuggagggggaauggaaggagggagaagaggugcagguuuuggcucuagaaccaggcaaaaauccccgggccgugcagaccaagccuggccuguuuaaaacgaacacugggaccaucggagcagucucucucgauuucuccccagguacaucaggcagucccauaauugacaagaaagggaaggugguaggacuguacggcaacggugucgugaccagaagcggggccuauguuuccgcuaucgcccaaacagagaagucuauugaggauaauccugaaaucgaggacgauauauuuaggaaacgucgccuuacuauuauggacuuacacccgggagcaggcaagaccaaacgguaccugcccgcuaucgugagagaagccaucaagaggggccuccgaacguugauucuggcgccaacacgggucguggccgcagagauggaagaggcucuccgcgggcugccuaucagauaucagacucccgccauuagggcugagcauaccggacgggaaauaguugaccuuaugugucacgcaacauucaccaugcgacuguugucgccagugagagucccuaacuacaaucuaaucauuauggaugaggcccauuucacugaccccgccagcaucgcugcgcgcgguuauaucucaaccaggguggaaaugggcgaggcagccgggauuuuuaugacagcuacgccaccgggaucccgugauccuuucccccagaguaacgccccaauaaucgacgaggaacgggagauucccgaaagaucuuggaauagcggccacgaguggguaacugauuuuaaagguaagaccgugugguucguuccuuccaucaaggcagggaacgacauugccgcuugccugaggaaaaauggaaagaaagucauccaacucucacgcaagacauuugauucugaauacgugaaaacccgaacuaacgacugggauuucguggucacaaccgacauaagcgagaugggcgcgaauuuuaaggccgagagaguaaucgauccacggagguguaugaaacccgugauuuuaacggacggcgaagagcgcguuauccuggcagggccuaugccggugacucauaguuccgcugcccagcguagaggacggauugguaggaacccaaagaaugaaaacgaccaguacaucuauaugggcgagccccuugaaaaugaugaggacugcgcacacuggaaggaggccaaaaugcugcucgauaacauaaauacaccugaagggauuauccccagcauguucgagccagaacgcgagaaggucgacgcuauugauggagaauaccgauugagaggcgaggcccggaaaaccuuuguggaccugaugaggcgcggugaucucccuguuuggcuggcguauaagguggcagccgaggggaucaacuacgcugacagaaggugguguuucgauggcauaaaaaacaaucagauccuugaagagaacgucgaaguggagauuuggaccaaggagggagaacggaagaaacuaaagccccguuggcuggacgcccgcaucuauucugauccauuggcuuuaaaagaguuuaaggaauucgcagccggccgaaaaucacugacucucaaucugauuacagagauggggagacuuccuaccuucaugacacaaaagacuagggacgcucuggauaaccucgccguauugcacacggcagaagcgggaggucgggccuacaaucaugcucuguccgagcuaccggagacccuggaaacacuccuucuguuaacuuugcuggccaccgugacaggcgggaucuuucucuuccugaugaguggacgcggcauagguaagaugacccuugggaugugcugcauuaucacugcaagcauccugcucugguaugcucagauucagccccacuggaucgccgcaucgauaauuuuggaguuuuuccugaucguuuuacuaauuccagaaccugagaaacagagaacgccccaagacaaccagcugaccuacgucgugaucgccauacucacaguggucgcugcgacuauggccaaugaaaugggcuuucuugagaagaccaaaaaggaccugggauugggcucuaucgcaacacagcagccagaguccaacauucuggauaucgaccucaggccugcuagcgccuggacccuguacgccguugcaacuacauucgugacgcccaugcuucggcauucaauugaaaauaguucuguaaacgugucccucaccgcuaucgccaaucaagcgacuguccugaugggguugggaaaagguuggccgcugagcaagauggauauuggcgugccauuacuagcuaucggguguuauucacagguuaacccuauaacacugaccgccgcacuccuucuguugguggcccacuacgcuauuaucggacccggccugcaggcaaaggccacccgagaggcgcagaaaagagcugccgcagguaucaugaagaauccaacagucgacgggauuacuguaauagaucucgaccccaucccuuaugauccgaaauuugaaaagcaacugggccaggugaugcuuuuaauucugugcguuacgcaggugcucaugaugcgcaccacaugggccuugugugaggcucugacucuagccaccggacccaucaguacacugugggaaggcaacccagggagguucuggaauaccacuauugcagucagcauggcuaacaucuuucggggauccuaccucgccggcgcgggucuucuguucucuauaaugaaaaauacgacaaacacccguagagggacuggaaacaucggcgagaccuugggugagaaguggaaaagcaggcugaaugcccucggcaaguccgaauuucaaauuuauaagaaaucagggauccaggagguggaccgcacacuggcaaaggaaggaauuaaacggggcgagacugaucaccaugcugucucucgagggagugccaaguuaagaugguucguggagaggaacaugguuaccccugaaggaaaagugguagaccuuggcugcggucgcgggggauggucguacuauuguggcggucugaagaaugugcgggaggucaagggccucacaaaagggggacccggccacgaagagccuaucccaaugagcacguacggguggaaccuaguuagacugcaguccggaguggaugucuuuuucauacccccugaaaagugcgacaccuugcugugugauauuggcgagucuucaccaaaucccacuguggaggcaggucguacacucaggguacuuaaccugguggaaaauugguugaacaauaacacccaguucugcaucaaaguucugaauccguacaugccuagcgugaucgagaagauggaagcucuccaacggaaauaugggggagccuuaguccgcaacccacugucccgaaauaguacucaugagauguacugggugucuaacgccagcggcaauauugucucauccgugaacaugauaaguagaaugcuuaucaacagguuuacaaugcggcacaagaaggcgaccuaugaacccgacguugaccugggcagcgggacgcgcaauauuggaaucgagucugagauuccuaaccuagauaucauagguaaaagaaucgaaaagauuaaagaggaacaugagaccuccuggcacuacgaccaggaucacccauauaagacaugggcuuaccauggcucauaugaaacuaaacagaccgggagcgcaucgucuaugguaaauggaguggucaggcuccugacaaagcccugggacguguugccgacuguuacccagauggccaugacagauaccacuccuuucggccaacagcgaguguuuaaggagaaagucgacacgcggacacaggagcccaaggaagguaccaaaaagcugaugaaaaucacugcugaguggcucuggaaggaacuugggaaaaagaagaccccacguauguguacaagagaggaguucacgcgcaaagugaggaguaacgccgcacugggagccauuuuuaccgaugaaaauaaguggaaauccgcucgggaggcgguagaagacaacagauucugggaguuaguggauaaggaacgcaaucugcacuuggagggcaaaugcgagacuuguguuuacaacaugaugggcaagagggaaaagaaacucggggaguuuggaaaggccaaagguagccgagcaaucugguacauguggcugggcgcucgguuccuagaauuugaggcccuuggguuccugaaugaagaccauugguuuucaagagagaacucccucucuggagucgagggcgaaggucugcacaaguugggguauauucugagggaugugagcaaaaaggagggaggcgcaauguacgccgacgacacagcuggcugggauacccgcauaacucucgaagaccuuaagaaugaggaaauggugacaaaccacauggagggggagcauaaaaagcuggccgaagcgaucuucaaauuaaccuaucagaauaaggucguucgugugcaacggccuacacccagaggaacuguaauggauauuaucaguaggcgcgaccagcgagguuccggccagguggggaccuacggacugaacacguuuaccaauauggaggcacaauugauccggcagauggaaggcgagggugucuucaaaaacauucagcaccucacagugacugaggaagccgcuguucagaacuggcuggccagaguggggagggagcgccuaagcagaauggcaauaucuggagaugacugcgucgugaagccacuugaugaccgguucgcuaaugcccugaccgcucucaacgauaugggcaagaucaggaaagacauucaacagugggaacccucaaagggcuggaaugauuggacacagguaccuuuuugcagucaucacuuccaugagcugguuaugaaagacgggcguguguuggucgugccaugucgaaaccaggaugaauuaaucggacgcgccagaauuucccaaggugcaggcuggagccugcgggagacugcgugccucgggaagucuuaugcccagauguggucgcuuauguacuuucacaggcgcgaccugagacuagcugccaaugcaaucuguucagcugugccgagccacuggguccccaccucccggacgacauggaguauacaugccaaacacgaguggaugaccacugaagacaugcugacaguuuggaacaggguguggauccgagagaauccuuggauggaagauaagaccccaguagagucuugggaagagauucccuaucucggaaagcgugaggaccaguggugcggcagcuugaucggucugacuuccagagcaaccugggccaaaaacauucaggcggcuaucaaucaagugcgcucacuuauagggaacgaagaguacacagauuacaugccuaguaugaagcgguucaggagagaagaggaagaggccggaguccugugguga

SEQ ID NO: 14445 - RNA, 9876 nt, Artificial Sequence
  derived and/or modified CDS sequence (opt3) from DENV-2__GQ868625__SS-prME
agcgccggcaugaucauuaugcugauacccaccgugauggcuuuccaccucacaacuagaaacggggagccucauaugaucgucggaauucaggaaaaggguaaaucccuucuguuuaagacggaggacggcguuaauaugugcaccuugauggcaauggauuuaggggaacugugugaggacacaaucacuuacaaaugcccacuacucaggcaaaacgaaccggaggauauugacuguuggugcaauucuaccucaacaugggugaccuauggaacuuguacaaccacgggcgagcaccggcgcgaaaagcgaaguguagcccuggugccccaugucgguauggggcuugagacucguaccgaaacauggaugagcuccgagggagcguggaaacacgcucagagaaucgagacuuggauacugaggcauccuggcuucaccaucauggccgcaauuuuggccuacacaaucggcaccacgcacuuucagcgggugcucauuuucauccugcugacugcuguugcaccaucuaugacaaugcgcugcauagggauuucgaacagagauuuuguggaaggagucucagguggcagcuggguggacaucguacucgagcacgggaguuguguuaccacuauggccaagaauaagcccacauuagauuucgaacugauuaaaaccgaggcuaagcagccugccacgcuuaggaaauauugcaucgaagcgaaguugaccaacacaacuaccgagucccgguguccaacacaaggagagcccucucugaaagaagagcaggacaagcgcuuugugugcaagcauagcauggucgaucgaggcugggguaauggguguggacuauucggcaaaggcgggaucgugacuugcgcaauguuuaccugcaagaaaaacauggaaggaaagauugugcagccugagaaucucgaauacacaauagucguuaccccacacuccggugaggagcaugccgugggcaacgacacugggaaacacggaauggaaaucaagguaacgccgcagucaaguauuacagaggcugaacugaccggcuaugguacugugaccauggaguguagccccagaacagggcuugauuucaaugaaaugguccuguugcaaauggagaacaaagccuggcucgugcacaggcagugguuucuggacuuaccucugccauggcuccccggcgcagauaagcaggagucuaauuggauccagaaggaaacccuuguuacuuucaaaaacccucaugcuaagaaacaagacguggucgugcugggaucccaggagggcgccaugcacacagcguugacgggggccaccgaaauacagaugucaagcggaaaucuacuguuuacuggucaucucaagugccggcugcguauggacaaacuucaacugaagggcaugaguuacucuauguguacagggaaguucaaaguaguuaaggagauugcagagacccagcacggaacaaucgugauccgcguccaguaugaaggcgaugguuccccaugcaaaauucccuucgagaucauggacuuggaaaagagauacgugcucgggaggcugauuacugucaacccgauagugaccgagaaagauagcccuguuaacaucgaagcugagcccccauuuggcgacucguacauuaucaucggaguggagccuggccaguuaaagcugaauugguucaagaaagggucuuccauuggacggauguuugaaacgaccaugcgaggugccaagcgcauggcuauacuaggcgauacagccugggacuucgggucacucggaggcguauuuacuaguaucgguaaagcacugcaucaagucuucggggccauuuauggcgcugcguuuagcggaguguccuggaccaugaagauccuuauuggcguuaucauaacauggaucgggaugaacucuagaagcacuucauugagugugucccugguccucgugggaauuguaacccuguaccuuggcgugaugguucaggcagauagcgguugugucgugucuuggaaaaauaaggagcugaagugcgggucaggaaucuucauuacggacaacgugcacacauggaccgaacaguauaaauuucagcccgagaguccaagcaaguuggccuccgcuauccaaaaagcccaggaagagggcauaugugguauuaggucugucacucggcucgagaaucugauguggaagcagaucacacccgaauuaaaccacauucuggcagagaaugaaguuaaacuaaccaucaugacuggcgauauaaaggggaucaugcaggccggaaaacgcucgcucagaccucaaccaaccgagcugaaguacagcuggaagacauggggcaaagcuaagaugcuuuccacggaaucauauaaccagaccuucuugauugacgggccggagacugccgagugccccaauacaaacagggcauggaauagucuggaaguggaggauuacggauuuggcguguucaccacaaacaucuggcucaaacugaaggaaaaacaggacgcguuuugugacucuaaguuaaugagcgcugccauuaaggauaaucgugcaguacaugccgacauggguuauuggaucgaguccgcucugaacgauacuuggaaaauagagaaggccucauucauugaagucaaaaauugccacuggccuaagagccauacccuuuggucuaacgggguguuggaguccgaaaugaucaucccaaaaaaccucgcaggacccguuagucagcacaauuaccggccuggcuaccacacgcaaauugcugguccauggcaucugggcaagcuagagauggacuucgauuuuugugacgggacaaccgugaucgucacugaagauugcggaaaccgaggccccagccugagaaccacaacugccucugggaagcucauuaccgaguggugcuguagguccugcacacugccgccucuucgcuaucggggagaggacggcuguugguacgguauggaaauaagaccauugaaagagaaggaagagaaucuggugaacucauuaguuacggcggggcacggacagguggauaauuucagucucggcguacuggguauggcccuuuuucuggaagagauguugaggacccgcgucggcacuaaacaugcuauccuccugguggcagugagcuucgucacacuaauuaccgggaacaugucguuuaaggaccugggacgaguugugguaauggugggcgccacuauggcugaugacaucgggaugggagucacauaucucgcccugcuugcagcguucaaagugcggcccaccuuugccgcuggcuugcuguuacguaagcucacguccaaggagcugaugaugacuaccauugguaucguucuucugucucagagcacaauaccugaaaccgugcuagagcucacugaugcccuggcauuggggaugaugguccugaaaaucgugagaaauauggaaaaguaccaauuagcuguuacaauuauggccauccucugcgugcccaacgcagucauucugcagaaugccuggaaaguaucauguaccauccuugcugugguuaguguguccccacuguugcucacaucuagccagcagaagacugacuggauaccucuggcgcuaaccauuaaaggacugaaccccacggccaucuuccuuacaacccucuccaggacuaauaagaaacgcucauggccacugaacgaggcaaucauggcugucggcauggugagcauuuuggccaguucucuguuaaagaaugacauaccgaugaccggcccucucguagccgggggacugcuuacagugugcuauguccugacuggucgguccgcugauuuggaacucgagagagcaaccgacguuaagugggaggaucaagccgaaaucagcggcucgucacccauucugucuaucacgauuagugaggacggguccaugagcaucaaaaacgaagaggaggaacagacacuaaccauacugaucaggacuggacuucucgugauuucuggccuguuuccaaucagcauucccaucacagcggcugccugguacuugugggaggugaagaaacagcgagcaggugucuuaugggaugugccuuccccacccccuauggggaaggccgaacuggaggacggagcuuaucgcauaaaacagaagggcauucucggcuacucacaaaucggggcaggaguuuacaaggaagguaccuuccacacuauguggcauguaacacggggcgccgugcugaugcacaaagggaagagaaucgagccgaguugggcggaugucaaaaaggaccuuauuagcuauggaggcgguuggaaacuggagggggaauggaaggagggagaagaggugcagguuuuggcucuagaaccaggcaagaaucccagggccgugcagaccaaaccuggccuguuuaagacgaacacugggaccaucggagcagucucucucgauuucuccccagguacaucaggcagucccauaauugacaaaaaggggaaagugguaggacuguacggcaacggugucgugacccguagcggggccuauguuuccgcuaucgcccagacagagaagucuauugaggauaauccugaaaucgaggacgauauauuucgcaagcggagacuuacuauuauggacuuacacccgggagcaggcaaaaccaagagguaccugcccgcuaucgugcgagaagccaucaaacggggccuccgcacguugauucuggcgccaacaagagucguggccgcagagauggaagaggcucucagggggcugccuauccgguaucaaacucccgccauucgagcugagcauaccggaagagaaauaguugaccuuaugugucacgcaacauucaccaugcgccuguugucgccagugagggucccuaacuacaaucuaaucauuauggaugaggcccauuucacugaccccgccagcaucgcugcgcgugguuauaucucaacccggguggaaaugggcgaggcagccgggauuuuuaugacagcuacgccaccgggauccagagauccuuucccccagaguaacgccccaauaaucgacgaggaaagggagauucccgaacgcucuuggaauagcggccacgaguggguaacugauuuuaaggguaaaaccgugugguucguuccuuccaucaaggcagggaacgacauugccgcuugccugcgaaagaauggaaaaaaggucauccagcucucaagaaaaacauuugauucugaauacgugaagacccggacuaacgacugggauuucguggucacaaccgacauaagcgagaugggcgcgaauuuuaaagccgagaggguaaucgauccacgccguuguaugaagcccgugauuuuaacggacggcgaagagagaguuauccuggcagggccuaugccggugacucauaguuccgcugcccaacggaggggacgcauuggucgaaacccaaaaaaugaaaacgaccaguacaucuauaugggcgagccccuugaaaaugaugaggacugcgcacacuggaaggaggccaagaugcugcucgauaacauaaauacaccugaagggauuauccccagcauguucgagccagaaagagagaaagucgacgcuauugauggagaauaccgguugaggggcgaggcccgcaagaccuuuguggaccugaugagaaggggugaucucccuguuuggcuggcguauaaaguggcagccgaggggaucaacuacgcugaccggcguugguguuucgauggcauaaagaacaaucagauccuugaagagaacgucgaaguggagauuuggaccaaagagggagaacgcaagaagcuaaaaccccgauggcuggacgccagaaucuauucugauccauuggcuuuaaaggaguuuaaagaauucgcagccggcaggaagucacugacucucaaucugauuacagagauggggcggcuuccuaccuucaugacacagaaaacucgcgacgcucuggauaaccucgccguauugcacacggcagaagcgggagguagagccuacaaucaugcucuguccgagcuaccggagacccuggaaacacuccuucuguuaacuuugcuggccaccgugacaggcgggaucuuucucuuccugaugaguggaaggggcauagguaagaugacccuugggaugugcugcauuaucacugcaagcauccugcucugguaugcucaaauucagccccacuggaucgccgcaucgauaauuuuggaguuuuuccugaucguuuuacuaauuccagaaccugagaagcagcggacgccccaggacaaccaacugaccuacgucgugaucgccauacucacaguggucgcugcgacuauggccaaugaaaugggcuuucuugagaaaaccaagaaagaccugggauugggcucuaucgcaacacagcagccagaguccaacauucuggauaucgaccuccgaccugcuagcgccuggacccuguacgccguugcaacuacauucgugacgcccaugcuuagacauucaauugaaaauaguucuguaaacgugucccucaccgcuaucgccaaucaggcgacuguccugaugggguugggaaaggguuggccgcugagcaaaauggauauuggcgugccauuacuagcuaucggguguuauucacaaguuaacccuauaacacugaccgccgcacuccuucuguugguggcccacuacgcuauuaucggacccggccugcaggcaaaggccacccgcgaggcgcagaagagggcugccgcagguaucaugaaaaauccaacagucgacgggauuacuguaauagaucucgaccccaucccuuaugauccgaaguuugaaaaacagcugggccaagugaugcuuuuaauucugugcguuacgcaggugcucaugaugcggaccacaugggccuugugugaggcucugacucuagccaccggacccaucaguacacugugggaaggcaacccagggcguuucuggaauaccacuauugcagucagcauggcuaacaucuuuagaggauccuaccucgccggcgcgggucuucuguucucuauaaugaagaauacgacaaacaccaggcgcgggacuggaaacaucggcgagaccuugggugagaaauggaagagccggcugaaugcccucggcaaauccgaauuucagauuuauaagaagucagggauccaagagguggaccgaacacuggcaaaagaaggaauuaagagaggcgagacugaucaccaugcugucucuagggggagugccaaauuacgcugguucguggagcggaacaugguuaccccugaaggaaaggugguagaccuuggcugcgguagagggggauggucguacuauuguggcggucugaaaaaugugcgugaggucaagggccucacaaaggggggacccggccacgaagagccuaucccaaugagcacguacggguggaaccuaguuaggcugcaguccggaguggaugucuuuuucauacccccugaaaaaugcgacaccuugcugugugauauuggcgagucuucaccaaaucccacuguggaggcaggucggacacuccgcguacuuaaccugguggaaaauugguugaacaauaacacccaguucugcaucaagguucugaauccguacaugccuagcgugaucgagaaaauggaagcucuccagcgaaaguaugggggagccuuagucagaaacccacuguccaggaauaguacucaugagauguacugggugucuaacgccagcggcaauauugucucauccgugaacaugauaagucggaugcuuaucaaccgcuuuacaaugagacacaaaaaggcgaccuaugaacccgacguugaccugggcagcgggacgaggaauauuggaaucgagucugagauuccuaaccuagauaucauagguaagcgaaucgaaaaaauuaaggaggaacaugagaccuccuggcacuacgaccaagaucacccauauaaaacaugggcuuaccauggcucauaugaaacuaagcagaccgggagcgcaucgucuaugguaaauggagugguccggcuccugacaaaacccugggacguguugccgacuguuacccagauggccaugacagauaccacuccuuucggccagcaacguguguuuaaggagaaggucgacacgagaacacaggagcccaaagaagguaccaagaaacugaugaagaucacugcugaguggcucuggaaagaacuugggaagaaaaagaccccacgcauguguacaagggaggaguucacgcggaaggugagaaguaacgccgcacugggagccauuuuuaccgaugaaaauaaauggaaguccgcucgcgaggcgguagaagacagcagguucugggaguuaguggauaaagaacgaaaccugcacuuggagggcaagugcgagacuuguguuuacaauaugaugggcaaacgggaaaagaagcucggggaguuuggaaaagccaaggguucaagagcaaucugguacauguggcugggcgcuagguuccuagaauuugaggcccuuggguuccugaacgaagaccauugguuuucccgcgagaauucucucagcggagucgagggcgaaggucugcacaaauugggguauauucugcgugaugugaguaagaaagagggaggcgcaauguacgccgacgacacagcuggcugggauacccggauaacucucgaagaccuuaagaacgaggaaauggugacaaaucacauggagggggagcauaagaaacuggccgaagcgaucuucaaguuaaccuaucagaacaaagucguuagagugcagaggccuacaccccgcggaacuguaauggauauuaucucccgacgggaccaaagagguagcggccagguggggaccuacggacugaauacguuuaccaacauggaggcacaguugaucaggcaaauggaaggcgagggugucuucaagaauauucagcaccucacagugacugaggaagccgcuguucagaacuggcuggcccgcguggggagagagcggcuaucuaggauggcaauaucaggagaugacugcgucgugaaaccacuugaugaccguuucgcuaacgcccugaccgcucucaaugauaugggcaagauccgaaaggacauucagcaaugggaacccaguaaaggcuggaacgauuggacacagguaccuuuuugcucccaucacuuccaugagcugguuaugaaggacgggcgcguguuggucgugccauguagaaaucaggaugaauuaaucggacgggccaggauuagccagggugcaggcuggucucugcgcgagacugcgugccucgggaaaucguaugcccaaauguggucacuuauguacuuucacagacgggaccugaggcuagcugccaacgcaaucuguagcgcugugccgucccacuggguccccaccagucgaacgacauggucuauacaugccaagcacgaguggaugaccacugaagacaugcugacaguuuggaaucguguguggaucagagagaacccuuggauggaagauaaaaccccaguagagagcugggaagagauucccuaucucggaaagcgcgaggaccaguggugcggcuccuugaucggucugacuucacgggcaaccugggccaagaauauucaggcggcuaucaaccaggugaggagucuuauagggaaugaagaguacacagauuacaugccuucuaugaaaagauuccgccgggaagaggaagaggccggaguccugugguga

SEQ ID NO: 14446 - RNA, 9876 nt, Artificial Sequence
  derived and/or modified CDS sequence (opt3) from DENV-2__KF955401__SS-prME
agcgccggaaugaucauuaugcugauaccaaccgugauggcuuuccaccucacuacuagaaauggggagccucauaugaucgucgggauucaagaaaaggguaaaucccuucuguuuaagacggaggacggaguuaauaugugcaccuugauggcaauggauuuaggggaacugugugaggacacaaucacuuacaaaugcccacuacucaggcaaaacgaaccggaggauauugacuguuggugcaauucuaccucaacaugggugaccuauggaacuuguacaaccacgggcgagcaccggcgcgaaaagcgaaguguagcccuggugccacaugucgguauggggcuugagacucguaccgaaacauggaugagcuccgagggagcguggaaacacgcucagagaaucgagacuuggauacugaggcauccuggcuucaccaucauggccgcaauuuuggccuacacaaucggcaccacgcacuuucagcgggugcucauuuucauccugcugacugcuguugcaccaucuaugacaaugcgcugcauagggauuucgaacagagauuuuguggaaggagucucagguggcagcuggguggacaucguacucgagcacgggaguuguguuaccacuauggccaagaauaagcccacauuagauuucgaacugauuaaaaccgaggcuaagcagccugccacgcuuaggaaauauugcaucgaagcgaaguugaccaacacaacuaccgagucccgguguccaacacaaggagagcccucucugaaagaagaacaggacaagcgcuuugugugcaagcauagcauggucgaucgaggcugggguaauggguguggacuauucggcaaaggcgggaucgugacuugcgcaauguuuaccugcaagaaaaacauggaaggaaagauugugcagccugagaaucucgaauacacaauagucguuaccccacacuccggugaggagcaugccgugggcaacgacacugggaaacacggaauggaaaucaagguaacgccgcagucaaguauuacagaggcugaacugaccggcuaugguacugugaccauggaguguagccccagaacagggcuugauuucaaugaaaugguccuguugcaaauggagaacaaagccuggcucgugcacaggcagugguuucuggacuuaccucugccauggcuccccggcgcagauaagcaggagucuaauuggauccagaaggaaacccuuguuacuuucaaaaacccucaugcuaagaaacaagacguggucgugcugggaucccaggagggcgccaugcacacagcguugacgggggccaccgaaauacagaugucaagcggaaaucuacuguuuacuggucaucucaagugccggcugcguauggacaaacuucaacugaagggcaugaguuacucuauguguacagggaaguucaaaguaguuaaggagauugcagagacccagcacggaacaaucgugauccgcguccaguaugaaggcgaugguuccccaugcaaaauucccuucgagaucauggacuuggaaaagagauacgugcucgggaggcugauuacugucaacccgauagugaccgagaaagauagcccuguuaacaucgaagcugagcccccauuuggcgacucguacauuaucaucggaguggagccuggccaguuaaagcugaauugguucaagaaagggucuuccauuggacaaauguuugaaacgaccaugcggggugccaagcgaauggcuauacuaggcgauacagccugggacuucgggucacucggaggcguauuuacaaguaucgguaaagcacugcaucaggucuucggggccauuuauggcguggcuuuuagcggaguuuccuggaccaugaagauccuuauuggcgugaucauaacauggaucgggaugaacucucgcagcacuucauugagugucucccuggugcucguaggaauugugacccuguaccuuggcguuaugguccaggcggauagcgguuguguggugucuuggaaaaauaaggagcugaagugcgggucaggaaucuucauuacggacaacguccacacauggaccgaacaguauaaauuucaacccgagaguccaagcaaguuggcauccgccauccagaaagcucaggaagagggcauaugugguauuagaucuguuacuaggcucgagaaucugauguggaagcagaucacacccgaauuaaaccacauucuggccgagaaugaagugaaacuaaccaucaugacuggcgauauaaaggggaucaugcaagcaggaaaacggucgcuccgcccucagccaaccgagcugaaguacagcuggaagacauggggcaaagccaagaugcuuuucacggaauccuauaaccagaccuuuuugauugacgggccggagacugcugagugccccaauacaaacagagccuggaacucacuggaaguggaggauuacggauucggcguauuuaccacaaacaucuggcucaaacugaaggaaaaacaggacgcauucugugacaguaaguuaaugucugcggcuauuaaggauaauagggccguccaugcagacauggguuauuggaucgagagcgcccugaacgauacuuggaaaauagagaaggcuuccuucauugaagugaaaaauugccacuggccuaagucacauacccuuuggagcaacgggguuuuggagucugaaaugaucauccccaagaaucucgccggacccgugucccaacacaauuaccguccuggcuaccacacgcagauugcagguccauggcaucugggcaagcuagagauggacuuugauuucugugacgggacaaccgucaucgugacugaagauugcggaaaccggggccccagucugcgaaccacaacugcuagcgggaagcucauuaccgaguggugcuguagaucuugcacacugccgccucuuagguaucgcggagaggacggcuguugguacgguauggaaauacggccauugaaagagaaggaagagaaucugguuaacuccuuagugacggccgggcacggacagguagauaauuuuucacucggcguccuggguauggcgcuuuuccuggaagagauguugagaaccagggugggcacuaaacaugccauccuccugguggcugucaguuuuguuacacuaauuaccgggaacaugagcuucaaggaccugggacgcgugguagugauggucggcgcaacuauggccgaugacaucgggaugggagugacauaucucgcucugcuugccgcauuuaaaguucgacccaccuucgcggccggcuugcuguuacggaagcucacgucgaaggagcugaugaugacuaccauugguaucgugcuucugucccaaucuacaauaccugaaaccguccuagagcucacugaugcucuggccuuggggaugauggugcugaaaaucguucguaauauggaaaaguaccaguuagcagugacaauuauggcuauccucugcguccccaacgccguaauucugcagaaugcauggaaagugagcuguaccauccuugccguugugucagucaguccacuguugcucacauccucucagcaaaagacugacuggauaccucuggcucuaaccauuaaaggacugaaccccacggcgaucuuucuuacaacccucagcagaacuaauaagaaaagguccuggccacugaacgaggccaucauggcagugggcaugguaucaauuuuggcuagcagucuguuaaagaaugacauaccgaugaccggcccucucguggccgggggacugcuuacagucugcuauguucugacuggucgcucugccgauuuggaacucgagcgggcuaccgacgugaagugggaggaucaggcagaaaucuccggcagcucgcccauucugucaaucacgauuucugaggacgggaguauguccaucaaaaacgaagaggaggaacagacacuaaccauacugaucagaacuggacuucucgugauuagcggccuguucccaaucucuauucccaucacagccgcggcuugguacuugugggaggucaagaaacagagggccgguguguuaugggauguuccuagcccacccccuauggggaaggcagaacuggaggacggagccuaucgaauaaaacaaaagggcauucucggcuacucccagaucggggcuggaguauacaaggaagguaccuuucacacuauguggcaugugacacgcggcgcaguccugaugcacaaagggaagcggaucgagccgucaugggccgaugugaaaaaggaccuuauuaguuauggaggcgguuggaaacuggagggggaauggaaggagggagaagagguucagguguuggcgcuagaaccaggcaagaaucccagagcuguccagaccaaaccuggccuguucaagacgaacacugggaccaucggagccgugagccucgauuuuucuccagguacauccggcucacccauaauugacaaaaaggggaaaguagucggacuguacggcaacggugugguuaccaggaguggggcauaugugagcgccaucgcucaaacagagaaguccauugaggauaauccugaaaucgaggacgauauauuccguaagcgccggcuuacuauuauggacuuacacccgggagccggcaaaaccaagagauaccugcccgcaaucgucagggaagcuaucaaacgaggccuccggacguugauucuggccccaacacgcgugguugcggccgagauggaagaggcacucagagggcugccuaucagguaucagacucccgcuauucgggccgagcauaccggacgagaaauaguggaccuuaugugucacgcuacauucaccaugagacuguugucuccaguccgcgugccuaacuacaaucuaaucauuauggaugaggcacauuuuacugaccccgccucgaucgccgcuagggguuauaucagcacccguguagaaaugggcgaggcggcagggauuuucaugacagccacgccaccgggaucacgggauccuuuuccccaguccaacgcuccaauaaucgacgaggaaagagagauucccgaaaggaguuggaacucuggccacgagugggugacugauuucaaggguaaaaccguuugguuugucccuagcaucaaggccgggaacgacauugcagccugccugcgcaagaauggcaaaaaggugauccaacucucccgaaaaacauucgauucagaauacgugaagaccagaacuaacgacugggauuuugucguaacaaccgacauaucugagaugggcgcuaauuucaaagcggagcgggugaucgauccaaggcgcuguaugaagcccguuauuuuaacggacggcgaagaacgugugauccuggccgggccuaugccggucacucauagcagugcagcucagagacggggaaggauuggucgcaaccccaaaaaugaaaacgaccaguacaucuauaugggcgagccccuugaaaaugaugaggacugcgcccacuggaaggaggcaaagaugcugcucgauaacauaaauacaccugaagggauuauccccuccauguuugagccagaacgagagaaaguggacgccauugauggagaauacagauugcggggcgaggcuaggaagaccuucguugaccugaugcgcagaggugaucucccuguguggcuggccuauaaagucgcggcagaggggaucaacuacgccgacaggcggugguguuuugauggcauaaagaacaaucagauccuugaagagaacguggaaguagagauuuggaccaaagagggagaacguaagaagcuaaaaccccgcuggcuggacgcucgaaucuauagcgauccauuggccuuaaaggaguucaaagaguucgcugcaggcagaaagucucugacucucaaucugauuacagagauggggaggcuuccuaccuuuaugacacagaaaacucgggacgcccuggauaaccucgcuguguugcacacggccgaagcaggaggucgcgcguacaaucaugcccugucagagcuaccggagacccuggaaacacuccuucuguuaacuuugcuggcuaccguuacaggcgggaucuuccucuuucugauguccggaagaggcauagguaagaugacccuugggaugugcugcauuaucacugccaguauccugcucugguaugcacagauucagccccacuggaucgcugccagcauaauuuuggaguucuuucugaucgucuuacuaauuccagaaccugagaagcagaggacgccccaagacaaccagcugaccuacguggugaucgcaauacucacagucguugccgcuacuauggcgaaugaaaugggcuuccuugagaaaaccaagaaagaccugggauugggcucgaucgccacacagcagccagagucuaacauucuggauaucgaccuccggccugcauccgcuuggacccuguacgccguggccacuacauuuguaacgcccaugcuucgacauagcauugaaaauucaagugugaacgucucucucaccgcaaucgcuaaucaagccacugugcugaugggguugggaaaggguuggccgcuguccaaaauggauauuggcguuccauuacuagcgaucggguguuauagccaggugaacccuauaacacugaccgcugcccuccuucuguuggucgcacacuacgccauuaucggacccggccugcaggcuaaggcaaccagagaggcccagaagcgcgcggcugccgguaucaugaaaaauccaacaguagacgggauuacugugauagaucucgaccccaucccuuaugauccgaaguucgaaaaacaacugggccagguuaugcuuuuaauucugugcgugacgcagguccucaugaugaggaccacaugggcauugugugaggcccugacucuagcuaccggacccaucucaacacugugggaaggcaacccagggcgguuuuggaauaccacuauugccgugaguauggcaaacaucuuccguggaagcuaccucgcuggcgccggucuucuguuuuccauaaugaagaauacgacaaacaccagaagggggacuggaaacaucggcgagaccuugggugagaaauggaagucucgccugaaugcgcucggcaaaagcgaguuccaaauuuauaagaaguccgggauccaggaggucgaccggacacuggccaaagaaggaauuaagcgaggcgagacugaucaccaugcagugucaagagggucugcuaaauuaaggugguuuguugagcgcaacauggugaccccugaaggaaagguaguggaccuuggcugcggucggggaggauggaguuacuauuguggcggucugaaaaaugucagagagguuaagggccucacaaaagggggacccggccacgaagaaccuaucccaaugucgacguacggguggaaccuagugcgucugcagagcggagucgauguguucuucauacccccugaaaaaugcgacaccuugcugugugauauuggcgaguccucuccaaaucccacuguagaggccgguaggacacuccgggugcuuaaccugguugaaaauugguugaacaauaacacccaguuuugcaucaaggugcugaauccguacaugccuucagucaucgagaaaauggaagcacuccaacgcaaguaugggggagcuuuagugcgaaacccacugagcagaaauuccacucaugagauguacugggucaguaacgccucuggcaauauugugagcucaguuaacaugauauccaggaugcuuaucaaccgguucacaaugcgccacaaaaaggccaccuaugaacccgacguagaccugggcagugggacgagaaauauuggaaucgagagcgagaccccuaaccuagauauuaucgguaagaggauagagaaaaucaaggaggaacaugagacaucuuggcacuacgaccaggaucacccauauaaaacuugggcguaccauggcuccuaugaaaccaagcagacagggucagcuagcucgauggugaauggagucgugcgacuccugacuaaacccugggacguuuugccgaccgugacacagauggcaaugaccgauacuacgccuuuuggccaacagcgggucuucaaggagaagguggacacacguacccaggagcccaaagaagguacuaagaaacugaugaagauuaccgccgaguggcucuggaaagaacuugggaagaaaaagacaccaagaauguguacgcgcgaggaguuuaccaggaagguacggucuaacgcugcccugggagcaaucuucacugaugaaaauaaauggaagagugccagagaggcuguggaagacucccgcuuuugggaguuaguugauaaagaaaggaaccugcacuuggagggcaagugcgagacaugugucuacaauaugaugggcaaacgagaaaagaagcucggggaguucggaaaagcgaaggguagccgggccauuugguacauguggcugggcgcaagauuucuagaguucgaggcucuuggguuucugaacgaagaccauugguucucaagggaaaauucccucucuggaguggagggcgaaggucugcacaaauugggguauauccugcgcgaugugagcaagaaagagggaggcgccauguacgcagacgacaccgccggcugggauacucguauuacacucgaagaccuuaagaacgaggaaauggucaccaaucacauggagggggagcauaagaaacuggcugaagccauauuuaaguuaacauaucagaacaaaguugugcggguacaaagaccuacucccaggggaaccgugauggauaucauuagucgccgagaccagcgggguuccggccaggucgggacguacggacugaauaccuucacaaacauggaggcgcaauugaucagacagauggaaggcgaggguguguucaagaauauccagcaccucacuguuaccgaggaagcagccgugcagaacuggcuggcuagggucgggcgcgagagacuaagccggauggccauuucuggagaugacugcgugguaaaaccacuugaugacagguuugcaaacgcucugacagcccucaaugauaugggcaagauacguaaggacauccaacagugggaacccucaaaaggcuggaacgauuggacucagguuccuuucugcagucaucacuuucaugagcugauuaugaaggacgggcgaguguuggucgugccaugucgcaaucaggaugaauuaaucggcagagcucggauuucccaaggugccggcuggagccugagggagaccgcaugccucgggaaaucuuaugcgcagauguggucgcuuauguacuuccaccgcagagaccugcggcuagccgcuaacgccaucuguucagcagugccgagccacuggguccccacguccaggacaaccuggaguauacaugcuaagcacgaguggaugacuacagaagacaugcugaccguuuggaaucgaguguggauccgugagaacccuuggauggaagauaaaacuccaguagagucuugggaagagauucccuaucucggaaagagagaggaccaguggugcggcagcuugaucggucugaccucccgcgccacaugggcaaagaauauucaggccgcgaucaaccaagugcggucacuuauagggaaugaagaguacacggauuacaugccuaguaugaaaagguuuagacgcgaagaggaagaggcuggaguccugugguga

SEQ ID NO: 14447 - RNA, 9876 nt, Artificial Sequence
  derived and/or modified CDS sequence (opt3) from DENV-2__JF730047__SS-prME
agcgcaggaaugaucauuaugcugauacccaccgugauggcuuuccaccucacuacuagaaacggggagccucauaugaucgucggcauucaggaaaaggguaaaucccuucuguuuaagacggaggacggcguuaauaugugcaccuugauggcaauggauuuaggggaacugugugaggacaccaucacuuacaaaugcccacuacucaggcaaaacgaaccggaggauauugacuguuggugcaauucuaccucaacaugggugaccuauggaacuuguacaaccacgggcgagcaccggcgcgaaaagcgaaguguagcccuggugccccaugucgguauggggcuugagacucguaccgaaacauggaugagcuccgagggagcguggaaacacgcucagagaaucgagacuuggauacugaggcauccuggcuucaccaucauggccgcaauuuuggccuacacaaucggcaccacgcacuuucagcgggcucucauuuucauccugcugacugcaguggccccaucuaugacaaugcgcugcauagggauuucgaacagagauuuuguugaaggagugucagguggcagcugggucgacaucgugcucgagcacgggaguuguguaaccacuauggcuaagaauaagcccacauuagauuucgaacugauuaaaaccgaggccaagcagccugcgacgcuuaggaaauauugcaucgaagcaaaguugaccaacacaacuaccgagucccgguguccaacacaaggagagcccucucugaaagaggaacaggacaagcgcuuuguuugcaagcauagcaugguggaucgaggcugggguaauggguguggacuauucggcaaaggcgggaucgucacuugcgccauguuuaccugcaagaaaaacauggaaggaaagauugugcagccugagaaucucgaauacacaauaguggucaccccacacuccggugaggagcaugcuguuggcaacgacacugggaaacacggaaaggaaaucaaagugacgccgcagucaaguauuacagaggccgaacugaccggcuaugguacuguaaccauggaguguagccccagaacagggcuugauuucaaugaaauggugcuguugcaaauggagucuaaggcauggcucguccacaggcagugguuucuggacuuaccucugccauggcuccccggcgcugauaagcagggauccaacuggauccagaaagagacccuugugacuuucaagaauccucaugccaaaaagcaagacguugugguccugggcucacaggaaggggcgaugcacacagccuugacgggagcaaccgagauacagaugagcagugguaaccuacuguuuacuggccaucucaaaugccggcugcguauggacaaacuucaacugaaggggaugucuuacuccauguguacaggaaaauucaaggugguaaaagaaauugcugagacccagcacggcacaaucguuauccgcgugcaguaugagggugaugggagcccaugcaagauucccuucgaaaucauggacuuggagaaaagauacguccucggcaggcugauuacugugaauccgauagucaccgaaaaggauucgccugugaacaucgaggccgaacccccauuuggagacucuuacauuaucaucggcguugagccugggcaguuaaagcugaacugguucaaaaagggauccucaauuggucaaauguuugagacgaccaugcggggcgcuaaacgaauggccauacuaggggauacagcaugggacuucggaagucucggcgguguguuuacuagcaucgggaaggcccugcaucagguauucggcgcuauuuauggagcggcauuuuccggcgucucuuggaccaugaaaauccuuauuggggugaucauaacauggaucggaaugaauagccgcucaacaaguuuguccguuagccuggugcucgucggcauugugacccuguaccuugguguaauggugcaggccgauucuggguguguugucucauggaagaacaaggaacugaaaugcggaaguggcaucuucauuacggacaaugugcacacauggaccgagcaguauaaguuucaacccgaaagcccauccaaauuggcuucugccauccagaaggcacaggaggaagguauauguggcauuagaucggugacuaggcucgagaaccugauguggaaacagaucacacccgaguuaaaucacauucuggccgaaaacgaggucaagcuaaccaucaugacuggggauauaaaaggaaucaugcaagcuggcaagcggagccuccgcccucagccaaccgaacugaaguacuccuggaaaacaugggggaaggccaaaaugcuuucaacggagagucauaaucagaccuucuugauugacggaccggaaacugcagagugccccaacacaaauagagcguggaacucucuggagguugaagauuauggcuuugguguguucaccacaaauaucuggcucaagcugaaagagaagcaggacgcuuuuugugacagcaaguuaauguccgccgcaauuaaagauaacagggccgugcacgcugacaugggguacuggaucgaaucagcccugaaugauacuuggaagauagagaaagccagcuucauugagguaaagaacugccauuggccuaaaucucacacccuuugguccaauggagucuuggaaagugagaugaucaucccaaagaaccucgcuggccccgugagccaacacaacuaucguccugguuaccauacgcagacagccggcccauggcaccuggggaagcuagaaauggacuucgauuuuugugacggaaccacuguuauugugaccgaggauugcggcaaucgggggcccucucugcgaacaacuaccgcguccggaaaacucaucacagaauggugcuguagaucaugcacgcugccgccucuuagguaccgcggcgaggacgguuguugguaugggauggagauucggccauugaaggaaaaagaggaaaaccuggucaauaguuuagugaccgccggacauggccagguugauaacuucagccucggugugcugggcauggcucuuuuucuggaggaaauguugagaacuaggguagggacaaagcacgcaauacuccuggucgccgugucguucgugacccuaaucacuggaaauauguccuuuaaagaccugggccgcgucguugugaugguagggacaaccaugacggaugacauuggaaugggcgugacuuaccucgcucugcuugccgcauucaagguccgacccaccuuugcggccgguuugcuguuacggaagcucacaucuaaagagcugaugaugaccacuaucgggauugugcuucugagccaaucaacaaucccugagaccauacuagaacucacagaugcucuggccuugggaaugaugguucugaagaucgugcgugacauggagaaauaucaguuagcagucacuauuauggcuauccucugcgugcccaacgccguuauucugcagaaugcauggaaggugaguuguaccauccuugccgucguauccgugucuccacuguugcucacgagcucccagcaaaagacugacuggauaccucuggcucuaaccauuaagggccugaaccccacugcgaucuuccuuaccacacucucaagaacuaauaaaaagaggagcuggccacugaacgaagccaucauggcaguuggcauggugaguauuuuggcuucuucccuguuaaagaaugauauaccgaugaccgggccucucgucgccggaggucugcuuacggugugcuacguacugacaggccgcagcgccgacuuggagcucgaacgggcuaccgaugugaaaugggaggaccaggcagagaucucggggucaucucccauucugaguaucacuauuuccgaagauggaagcaugucuaucaagaacgaggaagaggagcagacacuaaccauacugaucagaacuggccuucucgucauuagcggucuguuuccaguuuccauccccauuacagccgcggcuugguauuugugggaagugaaaaagcagagggccgggguguuaugggacgucccuucaccacccccuaugggaaaagcagagcuggaagauggcgccuaccgaaucaagcaaaagggcauacucggguauagucagauuggagcugguguguacaaagagggcaccuuccauacgauguggcacguuacucgcggggcaguacugaugcacaagggaaaacggaucgaaccgagcugggccgacgugaagaaagaucuuaucucuuacggcgguggguggaagcuggagggagaguggaaggaaggcgaggaaguccagguguuggcgcuagagccaggcaaaaaucccagagcuguucagaccaagccugggcuguuuaaaacaaacaccggaacaauuggugccgugucccucgacuucucaccaggcacaagugggagccccaucauagauaagaaaggaaaggucgugggccuguaugguaaugggguagucaccagguccggagcauacgugucugccauugcucaaacggaaaagucgaucgaggacaacccugagauugaagaugacaucuuucguaaacgccggcuuacaauaauggacuuacauccgggcgccggcaagacuaaaagauaucugcccgcaauuguuagggaggcuaucaagcgagggcuccggaccuugauccuggccccaacacgcguggucgcggccgaaauggaggaagcacucagaggacugccuauuagguaccagacccccgcuauccgggccgagcacacuggucgagagauuguggaucuuaugugucaugcuaccuucacaaugagacuguugagcccaguucgcgugccuaacuauaaucuaauaaucauggacgaagcacacuucacggaucccgccucaauugccgcuaggggcuacaucuccacucgugucgagaugggggaagcggcaggaaucuuuaugaccgccacaccaccgggcagucgggacccuuucccccagucuaacgcuccaauuauagaugaggagagagaaauccccgagaggagcuggaauaccggucaugaaugggugacugacuuuaaagggaagacaguaugguucgugccuuccauuaaggccggaaacgauaucgcagccugccugcgcaaaaauggcaagaaaguuauucaacucucacgaaagaccuuugacucugaguaugucaaaacgagaacuaacgauugggacuucguggugacaaccgauaucagcgaaaugggcgcuaauuuuaaggcggagcgggucauagacccaaggcgcuguaugaaacccguaaucuuaaccgacggggaggaacgugugauucuggccggaccuaugccgguuacucacaguuccgcagcucagagacgggguaggaucggccgcaacccaaagaaugagaacgaucaguacauuuacaugggggaaccccuugagaaugacgaagauugcgcccacuggaaggaggcaaaaaugcugcucgacaacaucaauacaccugagggaauaauucccagcauguucgaaccagagcgagaaaagguggaugccaucgacggcgaguauagauugcggggugaagcuaggaaaaccuuugucgaucugaugcgcagaggggaccucccuguguggcuggccuacaagguugcggcagagggcauuaacuaugccgauaggcggugguguuucgacggaaucaaaaauaaccagauacuugaggaaaacguggaggucgaaaucuggacaaaggagggcgagcguaagaaacuaaagccccgcuggcuggaugcucgaauuuacucugacccauuggccuuaaaagaauuuaaggaguucgcugcagggagaaaaucacugacucucaaucugaucacggaaaugggaaggcuuccuaccuucaugacacaaaagacucgggaugcccuggacaaccucgcuguguugcauaccgccgaggcggguggacgcgcauauaaucacgcccuguccgaacuaccggagacacuggagacccuccuucuguuaacuuugcuggcuacgguaaccgggggaauuuuucucuuccugaugaguggcagagguaucgggaagaugacacuuggcaugugcugcauaauuacugccagcauccugcucugguacgcacagauccagccccauuggauugcugccucgaucauauuggaauuuuuccugauuguguuacuaaucccagagccugaaaaacagaggacaccccaagacaaccagcugacauauguugucauugcaauccucaccgugguggccgcuacuauggcgaaugagaugggauuucuugaaaagacuaaaaaggaucugggcuuggggucuauagccacgcagcagccagaguccaacauccuggacauugaucuccggccugcaagcgcuuggacccuguacgccgucgccacuacauucguuacccccaugcuucgacacucaaucgagaauaguucugugaacguaucccucaccgcaauugcuaaucaagccacagugcugaugggauuggguaaaggcuggccgcugagcaagauggacaucggggucccauuacuagcgauuggauguuacucacaggugaacccuaucacucugacggcugcccuccuucuguugguugcacacuaugccauaauuggccccggucugcaggcuaaggcaaccagagaagcccagaaacgcgcggcugccgggaucaugaagaauccaacaguggauggcaucacugucauugaccucgaucccauaccuuacgacccgaaauuugagaagcaacugggacagguaaugcuuuuaauccugugcgugacccagguucucaugaugaggacaaccugggcauugugugaagcccugacucuagcuacgggccccauuaguacacugugggaggggaacccaggacgguucuggaauaccacuaucgccgugagcauggcaaacauuuuucguggcuccuaucucgcuggugccgggcuucuguucucuaucaugaaaaauaccacaaacacuagaaggggaaccggcaauauaggugaaacauugggcgagaaguggaaaagccgccugaacgcgcucgggaaguccgaguuucaaacguacaagaaaucaggaauccaggaagucgaucggacccuggccaaggagggcauuaaacgaggggaaacugaccaucacgcagugucuagaggaagugcuaaguuaaggugguucgucgagcgcaacauggugacaccugagggcaaaguuguggaucuugguugcgggcggggaggcuggucguauuacugugguggccugaagaauguaagagaagugaaggggcucaccaaaggaggccccgggcaugaggaaccuaucccaaugagcacuuauggauggaaccuaguccgucugcaguccggcguugacguguuuuucauucccccugagaagugcgauacauugcugugugacaucggugaaucuucaccaaaucccaccgucgaggccgggaggacgcuccgggugcuuaaccugguagagaauugguugaacaauaacacccaguucugcauaaaagugcugaauccguacaugccuagcguuauugaaaagauggaggcacuccaacgcaaauacggaggcgcuuuagugcgaaacccacuguccagaaauaguacacacgaaauguauugggucucuaacgccagcggcaauaucgugucauccgucaacaugaucaguaggaugcuuauuaaucgguuuacuaugcgccauaagaaggccaccuacgagcccgacguggaucuggggagcggaacaagaaacauagguaucgaaucugagauuccuaaccuagacaucauuggcaaaaggaucgagaagauaaaacaggaacacgagacuuccuggcacuaugaucaggaccauccauacaagaccugggcguaucacgggucauacgaaacaaaacagaccggaagcgcuucgucuaugguuaauggcguagugcgacuccugacuaagcccugggaugucuugccgacggugacacaaauggcaaugaccgacacuaccccuuucggucagcagcggguuuuuaaggagaaaguggauacacguacgcaggaacccaaggaggggaccaaaaagcugaugaaaaucacugccgaguggcucuggaaggaacuuggcaaaaagaagacaccaagaauguguacccgcgaggaguucauuaggaaaguccggaguaacgcugcccugggcgcaaucuuuacugacgagaauaaguggaaauccgccagagaggcuguggaagauagccgcuucugggaguuaguagacaaggaaaggaaccugcauuuggagggcaaaugcgaaacauguguguauaauaugauggggaagcgagagaagaaacucggagaguuugguaaggcgaaaggcucacgggccauuugguacauguggcugggggcaagauuccuagaauuugaggcucuuggauuccugaacgaagaucacugguuuuccagggaaaauucucucagcggcguugaaggugaggggcugcacaaguugggauacauccugcgcgacgucaguaaaaaggagggcggcgccauguaugcagacgauaccgccgggugggacacacguauuacucucgaagaucuuaagaacgaggaaauggugaccaaucauauggagggagaacacaaaaagcuggcugaggccauauucaaauuaacguaccaaaacaaggugguccggguucagagaccuacccccagggguacagugauggacaucauuucccgccgagaucagcggggcagcgggcaaguaggaacuuauggccugaauaccuuuacaaacauggaggcgcaguugaucagacagauggaaggugaggggguguucaaaaauauccagcaucucacugcaaccgaagaggucgccgugaagaacuggcuggcuaggguuggacgcgagagacuaucucggauggccauuucaggcgacgauugcguggucaagccacuugacgauagguucgcaaaugcucugacggcccucaacgacaugggcaaaauacguaaggauauccaacagugggaacccaguaaaggguggaacgacuggacacaggugccuuuuugcucccaccauuuccacgagcugauuaugaaggauggacgaguauugguugugccaugucgcaaucaggacgaauuaaucgguagagcucggauuagccaaggcgccggguggucucugagggagaccgcaugccucggaaaaucguacgcgcagauguggucacuuauguauuuucaccgcagagaccugcggcuagccgcuaacgccaucuguagcgcagucccgucccauugggugcccacaaguaggacaaccuggucuauacacgcuaagcaugaauggaugacuaccgaggauaugcugacaguguggaaucgagucuggauccgugagaacccuuggauggaagacaagacgccaguugagagcugggaagagauucccuaccucggcaaaagagaagaucaguggugcgguuccuugaucgggcugaccucacgcgccacuugggcaaagaauauucaggccgcgaucaaccaagugcggagucuuauaggaaaugaggaguauacagacuacaugccuucuaugaaaagguucagacgcgaagaggaagaggcuggcguacugugguga

SEQ ID NO: 14448 - RNA, 9876 nt, Artificial Sequence
  derived and/or modified CDS sequence (opt3) from DENV-2__JF730048__SS-prME
agcgcaggaaugaucauuaugcugauacccaccgugauggcuuuccaccucacuacuagaaacggggagccucauaugaucgucggcauucaggaaaaggguaaaucccuucuguuuaagacggaggacggcguuaauaugugcaccuugauggcaauggauuuaggggaacugugugaggacacaaucacuuacaaaugcccacuacucaggcaaaacgaaccggaggauauugacuguuggugcaauucuaccucaacaugggugaccuauggaacuuguacaaccacgggcgagcaccggcgcgaaaagcgaaguguagcccuggugccccaugucgguauggggcuugagacucguaccgaaacauggaugagcuccgagggagcguggaaacacgcucagagaaucgagacuuggauacugaggcauccuggcuucaccaucauggccgcaauuuuggccuacacaaucggcaccacgcacuuucagcgggcucucauuuucauccugcugacugcaguggccccaucuaugacaaugcgcugcauagggauuucgaacagagauuuuguugaaggagugucagguggcagcugggucgacaucgugcucgagcacgggaguuguguaaccacuauggcuaagaauaagcccacauuagauuucgaacugauuaaaaccgaggccaagcagccugcgacgcuuaggaaauauugcaucgaagcaaaguugaccaacacaacuaccgagucccgguguccaacacaaggagagcccucucugaaagaggaacaggacaagcgcuuuguuugcaagcauagcaugguggaucgaggcugggguaauggguguggacuauucggcaaaggcgggaucgucacuugcgccauguuuaccugcaagaaaaacauggaaggaaagauugugcagccugagaaucucgaauacacaauaguggucaccccacacuccggugaggagcaugcuguuggcaacgacacugggaaacacggaaaggaaaucaaagugacgccgcagucaaguauuacagaggccgaacugaccggcuaugguacuguaaccauggaguguagccccagaacagggcuugauuucaaugaaauggugcuguugcaaauggagucuaaggcauggcucguccacaggcagugguuucuggacuuaccucugccauggcuccccggcgcugauaagcagggauccaacuggauccagaaagagacccuugugacuuucaagaauccucaugccaaaaagcaagacguugugguccugggcucacaggaaggggcgaugcacacagccuugacgggagcaaccgagauacagaugagcagugguaaccuacuguuuacuggccaucucaaaugccggcugcguauggacaaacuucaacugaaggggaugucuuacuccauguguacaggaaaauucaaggugguaaaagaaauugcugagacccagcacggcacaaucguuauccgcgugcaguaugagggugaugggagcccaugcaagauucccuucgaaaucauggacuuggagaaaagauacguccucggcaggcugauuacugugaauccgauagucaccgaaaaggauucgccugugaacaucgaggccgaacccccauuuggagacucuuacauuaucaucggcguugagccugggcaguuaaagcugaacugguucaaaaagggauccucaauuggucaaauguuugagacgaccaugcggggcgcuaaacgaauggccauacuaggggauacagcaugggacuucggaagucucggcgguguguuuacuagcaucgggaaggcccugcaucagguauucggcgcuauuuauggagcggcauuuuccggcgucucuuggaccaugaaaauccuuauuggggugaucauaacauggaucggaaugaauagccgcucaacaaguuuguccguuagccuggugcucgucggcauugugacccuguaccuugguguaauggugcaggccgauucuggguguguugucucauggaagaacaaggaacugaaaugcggaaguggcaucuucauuacggacaaugugcacacauggaccgagcaguauaaguuucaacccgaaagcccauccaaauuggcuucugccauccagaaggcacaggaggaagguauauguggcauuagaucggugacuaggcucgagaaccugauguggaaacagaucacacccgaguuaaaucacauucuggccgaaaacgaggucaagcuaaccaucaugacuggggauauaaaaggaaucaugcaagcuggcaagcggagccuccgcccucagccaaccgaacugaaguacuccuggaaaacaugggggaaggccaaaaugcuuucaacggagagucauaaucagaccuucuugauugacggaccggaaacugcagagugccccaacacaaauagagcguggaacucucuggagguugaagauuauggcuuugguguguucaccacaaauaucuggcucaagcugaaagagaagcaggacgcuuuuugugacagcaaguuaauguccgccgcaauuaaagauaacagggccgugcacgcugacaugggguacuggaucgaaucagcccugaaugauacuuggaagauagagaaagccagcuucauugagguaaagaacugccauuggccuaaaucucacacccuuugguccaauggagucuuggaaagugagaugaucaucccaaagaaccucgcuggccccgugagccaacacaacuaucguccugguuaccauacgcagacagccggcccauggcaccuggggaagcuagaaauggacuucgauuuuugugacggaaccacuguuauugugaccgaggauugcggcaaucgggggcccucucugcgaacaacuaccgcguccggaaaacucaucacagaauggugcuguagaucaugcacgcugccgccucuuagguaccgcggcgaggacgguuguugguaugggauggagauucggccauugaaggaaaaagaggaaaaccuggucaauaguuuagugaccgccggacauggccagguugauaacuucagccucggugugcugggcauggcucuuuuucuggaggaaauguugagaacuaggguagggacaaagcacgcaauacuccuggucgccgugucguucgugacccuaaucacuggaaauauguccuuuaaagaccugggccgcgucguugugaugguagggacaaccaugacggaugacauuggaaugggcgugacuuaccucgcucugcuugccgcauucaagguccgacccaccuuugcggccgguuugcuguuacggaagcucacaucuaaagagcugaugaugaccacuaucgggauugugcuucugagccaaucaacaaucccugagaccauacuagaacucacagaugcucuggccuugggaaugaugguucugaagaucgugcgugacauggagaaauaucaguuagcagucacuauuauggcuauccucugcgugcccaacgccguuauucugcagaaugcauggaaggugaguuguaccauccuugccgucguauccgugucuccacuguugcucacgagcucccagcaaaagacugacuggauaccucuggcucuaaccauuaagggccugaaccccacugcgaucuuccuuaccacacucucaagaacuaauaaaaagaggagcuggccacugaacgaagccaucauggcaguuggcauggugaguauuuuggcuucuucccuguuaaagaaugauauaccgaugaccgggccucucgucgccggaggucugcuuacggugugcuacguacugacaggccgcagcgccgacuuggagcucgaacgggcuaccgaugugaaaugggaggaccaggcagagaucucggggucaucucccauucugaguaucacuauuuccgaagauggaagcaugucuaucaagaacgaggaagaggagcagacacuaaccauacugaucagaacuggccuucucgucauuagcggucuguuuccaguuuccauccccauuacagccgcggcuugguauuugugggaagugaaaaagcagagggccgggguguuaugggacgucccuucaccacccccuaugggaaaagcagagcuggaagauggcgccuaccgaaucaagcaaaagggcauacucggguauagucagauuggagcugguguguacaaagagggcaccuuccauacgauguggcacguuacucgcggggcaguacugaugcacaagggaaaacggaucgaaccgagcugggccgacgugaagaaagaucuuaucucuuacggcgguggguggaagcuggagggagaguggaaggaaggcgaggaaguccagguguuggcgcuagagccaggcaaaaaucccagagcuguucagaccaagccugggcuguuuaaaacaaacaccggaacaauuggugccgugucccucgacuucucaccaggcacaagugggagccccaucauagauaagaaaggaaaggucgugggccuguaugguaaugggguagucaccagguccggagcauacgugucugccauugcucaaacggaaaagucgaucgaggacaacccugagauugaagaugacaucuuucguaaacgccggcuuacaauaauggacuuacauccgggcgccggcaagacuaaaagauaucugcccgcaauuguuagggaggcuaucaagcgagggcuccggaccuugauccuggccccaacacgcguggucgcggccgaaauggaggaagcacucagaggacugccuauuagguaccagacccccgcuauccgggccgagcacacuggucgagagauuguggaucuuaugugucaugcuaccuucacaaugagacuguugagcccaguucgcgugccuaacuauaaucuaauaaucauggacgaagcacacuucacggaucccgccucaauugccgcuaggggcuacaucuccacucgugucgagaugggggaagcggcaggaaucuuuaugaccgccacaccaccgggcagucgggacucuuucccucagagcaacgcucccauuauagaugaggagagagaaaucccagagagguccuggaauaccggucaugaaugggugacugacuuuaaagggaagacaguaugguucgugcccucaauuaaggccggaaacgauaucgcagccugccugcgcaaaaauggcaagaaaguuauucaacucucucgaaagaccuuugacagcgaguaugucaaaacgagaacuaacgauugggacuucguggugacaaccgauaucagugaaaugggcgcuaauuuuaaggcggagcgggucauagacccuaggcgcuguaugaaaccaguaaucuuaaccgacggggaggaacgugugauucuggccggacccaugccuguuacucacuccagcgcagcucagagacgggguaggaucggccgcaacccgaagaaugagaacgaucaguacauuuacaugggggaaccacuugagaaugacgaagauugcgcccacuggaaggaggcaaaaaugcugcucgacaacaucaauacacccgagggaauaauuccuucuauguucgaacccgagcgagaaaagguggaugccaucgacggcgaguauagauugcggggugaagcuaggaaaaccuuugucgaucugaugcgcagaggggaccucccaguguggcuggccuacaagguugcggcagagggcauuaacuaugccgauaggcggugguguuucgacggaaucaaaaauaaccagauacuugaggaaaacguggaggucgaaaucuggacaaaggagggcgagcguaagaaacuaaagccucgcuggcuggaugcucgaauuuacucagaccccuuggccuuaaaagaauuuaaggaguucgcugcagggagaaaaucccugacucucaaucugaucacggaaaugggaaggcuuccaaccuucaugacacaaaagacucgggaugcccuggacaaccucgcuguguugcauaccgccgaggcggguggacgcgcauauaaucacgcccugagugaacuaccugagacacuggagacccuccuucuguuaacuuugcuggcuacgguaaccgggggaauuuuucucuuccugaugagcggcagagguaucgggaagaugacacuuggcaugugcugcauaauuacugccucgauccugcucugguacgcacagauccagccgcauuggauugcugccucuaucauauuggaauuuuuccugauuguguuacuaauccccgagccagaaaaacagaggaccccucaagacaaccagcugacauauguugucauugcaauccucaccgugguggccgcuacuauggcgaaugagaugggauuucuugaaaagacuaaaaaggaucugggcuugggguccauagccacgcagcagcccgagagcaacauccuggacauugaucuccggccagcaucagcuuggacccuguacgccgucgccacuacauucguuaccccuaugcuucgacacaguaucgaaaauucuuccgugaacguaagccucaccgcaauugcuaaucaagccacagugcugaugggauuggguaaaggcuggccccugucaaagauggacaucggggucccguuacuagcgauuggauguuacagucaggugaacccaaucacucugacggcugcccuccuucuguugguugcacacuaugccauaauuggcccuggucugcaggcuaaggcaaccagagaagcccagaaacgcgcggcugccgggaucaugaagaaucccacaguggauggcaucacugucauugaccucgauccaauacccuacgacccuaaauuugagaagcaacugggacagguaaugcuuuuaauccugugcgugacccagguucucaugaugaggacaaccugggcauugugugaagcccugacucuagcuacgggcccgauuagcacacugugggaggggaaccccggacgguucuggaauaccacuaucgccguguccauggcaaacauuuuucguggcucuuaucucgcuggugccgggcuucuguucagcaucaugaaaaauaccacaaacacuagaaggggaaccggcaauauaggugaaacauugggcgagaaguggaaaucccgccugaacgcgcucgggaagucagaguuucaaacguacaagaaaucuggaauccaggaagucgaucggacccuggccaaggagggcauuaaacgaggggaaacugaccaucacgcagugaguagaggaucggcuaaguuaaggugguucgucgagcgcaacauggugacaccagagggcaaaguuguggaucuugguugcgggcggggaggcuggagcuauuacugugguggccugaagaauguaagagaagugaaggggcucaccaaaggaggcccugggcaugaggaacccaucccuauguccacuuauggauggaaccuaguccgucugcagucuggcguugacguguuuuucauuccacccgagaagugcgauacauugcugugugacaucggugaaucaagcccuaauccaaccgucgaggccgggaggacgcuccgggugcuuaaccugguagagaauugguugaacaauaacacccaguucugcauaaaagugcugaaucccuacaugccguccguuauugaaaagauggaggcacuccaacgcaaauacggaggcgcuuuagugcgaaacccucugaguagaaauucuacacacgaaauguauugggucagcaacgccucaggcaauaucguguccagugucaacaugaucagcaggaugcuuauuaaucgguuuacuaugcgccauaagaaggccaccuacgagccagacguggaucuggggucuggaacaagaaacauagguaucgaauccgagauucccaaccuagacaucauuggcaaaaggaucgagaagauaaaacaggaacacgagacuucauggcacuaugaucaggaccauccuuacaagaccugggcguaucacgggagcuacgaaacaaaacagaccggaucggcuucuaguaugguuaauggcguagugcgacuccugacuaagccaugggaugucuugcccacggugacacaaauggcaaugaccgacacuaccccguucggucagcagcggguuuuuaaggagaaaguggauacacguacgcaggaaccuaaggaggggaccaaaaagcugaugaaaaucacugccgaguggcucuggaaggaacuuggcaaaaagaagacacccagaauguguacccgcgaggaguucacuaggaaaguccgguccaacgcugcccugggcgcaauuuuuacagacgagaauaaguggaaaagcgccagagaggcuguggaagauucacgcuucugggaguuaguagacaaggaaaggaaccugcauuuggagggcaaaugcgaaaccuguguguauaauaugauggggaagcgagagaagaaacucggagaguuugguaaggcgaaaggcucccgggccaucugguacauguggcugggggcaagauuccuagaauuugaggcucuuggauuccugaacgaagaucacugguuuucuagggagaauagccucaguggcguugaaggugaggggcugcacaaguugggauacauucugcgcgacgucuccaaaaaggagggcggcgccauguaugcagacgauacagccgggugggacacucguaucacccucgaagaucuuaagaacgaggaaauggugacgaaucauauggagggagaacacaaaaagcuggcugaggccauuuucaaauuaaccuaccaaaacaaggugguccggguucagagaccaacaccuagggguacugugauggacauaaucagccgccgagaucagcggggcucugggcaaguaggaaccuauggccugaauacauuuacuaacauggaggcgcaguugauuagacagauggaaggugaggggguguucaaaaauauccagcaucucaccgcaacggaagaggucgccgugaagaacuggcuggcuaggguuggacgcgagagacuaucacggauggccaucaguggcgacgauugcguggucaagccccuugacgauagguucgcaaaugcucugacagcccucaacgacaugggcaaaauucguaaggauauacaacagugggaaccauccaaaggguggaacgacuggacccaggugcccuuuugcagccaccauuuccacgagcugaucaugaaggauggacgaguauugguugugccuugucgcaaucaggacgaauuaauugguagagcucggaucucucaaggcgccggguggucgcugagggagacugcaugccucggaaaaucauacgcgcagauguggagccuuauguauuuucaccgcagagaccugcggcuagccgcuaacgccauuuguuccgcagucccaagucauugggugccgacaucuaggaccacuuggagcauccacgcuaagcaugaauggaugaccacagaggauaugcugacgguguggaaucgagucuggauacgugagaaccccuggauggaagacaagaccccuguugaguccugggaagagaucccauaccucggcaaaagagaagaucaguggugcgguucauugauugggcugacaagucgcgccacaugggcaaagaauauccaggccgcgauuaaccaagugcggucucuuaucggaaaugaggaguauaccgacuacaugcccagcaugaaaagguucagacgcgaagaggaagaggcuggcguacugugguga

SEQ ID NO: 14449 - RNA, 9876 nt, Artificial Sequence
  derived and/or modified CDS sequence (opt3) from DENV-2__KF955402__SS-prME
agcgccggaaugaucauuaugcugauaccaaccgugauggcuuuccaccucacuacucggaacggggagccucauaugaucgucgguauucaagaaaagggaaaaucccuucuguuuaagacggaggacggcguuaauaugugcaccuugauggcaauggauuuaggggaacugugugaggacacgaucacuuacaaaugcccacuacucaggcaaaacgaaccggaggauauugacuguuggugcaauucuaccucaacaugggugaccuauggaacuuguacaaccacgggcgagcaccggcgcgaaaagcgaaguguagcccuggugccacaugucgguauggggcuugagacucguaccgaaacauggaugagcuccgagggagcguggaaacacgcucagagaaucgagacuuggauacugaggcauccuggcuucaccaucauggccgcaauuuuggccuacacaaucggcaccacgcacuuucagcgggugcucauuuucauccugcugacugcuguugcaccaucuaugacaaugcgcugcauagggauuucgaacagaguguuugucgaaggagugucagguggcagcuggguagauaucguucucgagcacgggaguugugugaccacuauggccaagaauaagcccacauuagacuucgaacugauuaaaaccgaggcuaagcagccugccacgcuuaggaaauauugcaucgaagcgaaguugaccaacacaacuaccgagucccgguguccaacacaaggagagcccucucugaaagaggaacaggauaagcgcuuugucugcaagcauagcaugguggaccgaggcugggguaauggguguggacuauucggcaaaggcgggaucgugacuugcgcaauguuuaccugcaagaaaaacauggaaggaaagauuguccagccugagaaucucgaauacacaauaguugugaccccacacuccggugaggagcaugccguaggcaacgauacugggaaacacggaauggaaaucaaggugacgccgcagucaaguauuacagaggcugaacugaccggcuaugguacugucaccauggaguguagccccagaacagggcuugacuucaaugaaauggugcuguugcaaauggagaacaaagccuggcucguucacaggcagugguuucuggauuuaccucugccauggcuccccggcgcagacaagcaggagucuaauuggauccagaaggaaacccuugugacuuucaaaaacccucaugcuaagaaacaagaugucgugguacugggaucccaggagggcgccaugcacacagcguugacgggggccaccgaaauacagaugucaagcggaaaucuacuguuuacuggucaucucaagugccggcugcguauggacaaacuucaacugaagggcaugaguuacucuauguguacagggaaguucaaaguugugaaggagauugcagagacccagcacggaacaaucgucauccgcgugcaguaugaaggcgacgguuccccaugcaaaauucccuucgagaucauggauuuggaaaagagauacguccucgggaggcugauuacugugaacccgauaguuaccgagaaagacagcccugugaacaucgaagcugagcccccauuuggcgauucguacauuaucaucggaguagagccuggccaguuaaagcugaauugguucaagaaagggucuuccauuggacaaauguuugaaacgaccaugcggggugccaagcgaauggcuauacuaggcgacacagccugggauuucgggucacucggaggcgucuuuacaaguaucgguaaagcacugcaucagguguucggggccauuuauggcguugcuuuuagcggaguguccuggaccaugaagauccuuauuggcgucaucauaacauggaucgggaugaacucucgcagcacuucauugagugugucccugguacucgugggaauuguuacccuguaccuuggcgucauggugcaggcggacagcgguuguguggucucuuggaaaaauaaggagcugaagugcgggucaggaaucuucauuacggauaacguucacacauggaccgaacaguauaaauuucaacccgagaguccaagcaaguuggcauccgccauccagaaagcucaggaagagggcauaugugguauuagaucugugacuaggcucgagaaucugauguggaagcagaucacacccgaauuaaaccacauucuggccgagaaugaagugaaacuaaccaucaugacuggcgacauaaaggggaucaugcaagcaggaaaacggucgcuccgcccucagccaaccgagcugaaguacagcuggaagacauggggcaaagccaagaugcuuuccacggaaucauauaaccagaccuucuugauugaugggccggagacugcugagugccccaauacaaacagagccuggaauagucuggaaguagaggacuacggauuuggcgucuucaccacaaacaucuggcucaaacugaaggaaaaacaggaugcauuuugugacucuaaguuaaugagcgcggcuauuaaggacaauagggccgugcaugcagauauggguuauuggaucgaguccgcccugaacgacacuuggaaaauagagaaggcuucauucauugaaguuaaaaauugccacuggccuaagagccauacccuuuggucuaacgggguguuggaguccgaaaugaucauccccaagaaccucgccggacccgucagucaacacaauuaccguccuggcuaccacacgcagauugcagguccauggcaucugggcaagcuagagauggauuucgacuuuugugaugggacaaccgugaucguuacugaagacugcggaaaccggggccccagccugcgaaccacaacugcuucugggaagcucauuaccgaguggugcuguagauccugcacacugccgccucuuagguaucgcggagaggauggcuguugguacgguauggaaauacggccauugaaagagaaggaagagaaucuggugaacucauuaguaacggccgggcacggacaggucgacaauuucagucucggcgugcuggguauggcgcuuuuucuggaagagauguugagaaccagggugggcacuaaacaugccauccuccuggucgcuguuagcuucgugacacuaauuaccgggaacaugucguuuaaggaucugggacgcguaguggucauggugggcgcaacuauggccgacgauaucgggaugggaguuacauaucucgcucugcuugccgcauucaaagugcgacccaccuuugcggccggcuugcuguuacggaagcucacguccaaggagcugaugaugacuaccauugguaucguccuucugucucaaagcacaauaccugaaaccgugcuagagcucacugacgcucuggccuuggggaugaugguucugaaaaucgugcguaauauggaaaaguaccaguuagcagucacaauuauggcuauccucugcguacccaacgccgugauucugcagaaugcauggaaaguuucauguaccauccuugccguggucaguguguccccacuguugcucacaucuagccagcaaaagacugauuggauaccucuggcucuaaccauuaaaggacugaaccccacggcgaucuuccuuacaacccucuccagaacuaauaagaaaaggucauggccacugaacgaggccaucauggcaguaggcauggugagcauuuuggcuaguucucuguuaaagaaugacauaccgaugaccggcccucucgucgccgggggacugcuuacaguuugcuaugugcugacuggucgcuccgccgacuuggaacucgagcgggcuaccgaugugaagugggaggaccaggcagaaaucagcggcucgucacccauucugucuaucacgauuagugaggauggguccaugagcaucaaaaacgaagaggaggaacagacacuaaccauacugaucagaacuggacuucucgucauuucuggccuguuuccaaucagcauucccaucacagccgcggcuugguacuugugggaggugaagaaacagagggccgguguuuuaugggacguaccuuccccacccccuauggggaaggcagaacuggaggauggagccuaucgaauaaaacaaaagggcauucucggcuacucacagaucggggcuggaguguacaaggaagguaccuuccacacuauguggcaugucacacgcggcgcagugcugaugcacaaagggaagcggaucgagccgaguugggccgacguuaaaaaggaucuuauuagcuauggaggcgguuggaaacuggagggggaauggaaggagggagaagaggugcaggucuuggcgcuagaaccaggcaagaaucccagagcugugcagaccaaaccuggccuguuuaagacgaacacugggaccaucggagccguaucucucgacuucuccccagguacaucaggcagucccauaauugauaaaaaggggaaagucgugggacuguacggcaacgguguugugaccaggagcggggcauaugucuccgccaucgcucaaacagagaagucuauugaggacaauccugaaaucgaggaugacauauuucguaagcgccggcuuacuauuauggauuuacacccgggagccggcaaaaccaagagauaccugcccgcaaucgugagggaagcuaucaaacgaggccuccggacguugauucuggccccaacacgcguuguggcggccgagauggaagaggcacucagagggcugccuaucagguaucagacucccgcuauucgggccgagcauaccggacgagaaauagucgaccuuaugugucacgcuacauucaccaugagacuguugucgccagugcgcguaccuaacuacaaucuaaucauuauggacgaggcacauuucacugaucccgccagcaucgccgcuagggguuauaucucaacccguguggaaaugggcgaggcggcagggauuuuuaugacagccacgccaccgggaucccgggacccuuucccccagaguaacgcuccaauaaucgaugaggaaagagagauucccgaaaggucuuggaauagcggccacgaguggguuacugacuuuaaggguaaaaccgucugguucgugccuuccaucaaggccgggaacgauauugcagccugccugcgcaagaauggcaagaaggugauccaacucucacgaaaaacauuugacucugaauacgucaagaccagaacuaacgauugggacuucguagugacaaccgauauaagcgagaugggcgcuaauuuuaaagcggagcggguuaucgacccaaggcgcuguaugaagcccgugauuuuaacggauggcgaagaacgugucauccuggccgggccuaugccggugacucauaguuccgcagcucagagacggggaaggauuggucgcaaccccaaaaaugaaaacgaccaguacaucuauaugggcgagccccuugaaaaugacgaggauugcgcccacuggaaggaggcaaagaugcugcucgacaacauaaauacaccugaagggauuauccccagcauguucgagccagaacgagagaaaguugaugccauugacggagaauacagauugcggggcgaggcuaggaagaccuuuguggaucugaugcgcagaggugaccucccugucuggcuggccuauaaaguggcggcagaggggaucaacuacgccgauaggcggugguguuucgacggcauaaagaacaaucagauccuugaagagaacguagaaguggagauuuggaccaaagagggagaacguaagaagcuaaaaccccgcuggcuggaugcucgaaucuauucugacccauuggccuuaaaggaguuuaaagaguucgcugcaggcagaaagucacugacucucaaucugauuacagagauggggaggcuuccuaccuucaugacacagaaaacucgggaugcccuggacaaccucgcuguuuugcacacggccgaagcaggaggucgcgcguacaaucaugcccuguccgagcuaccggagacccuggaaacacuccuucuguuaacuuugcuggcuaccgucacaggcgggaucuuucucuuccugaugaguggaagaggcauagguaagaugacccuugggaugugcugcauuaucacugccagcauccugcucugguaugcacagauucagccccacuggaucgcugccucgauaauuuuggaguuuuuccugaucguguuacuaauuccagaaccugagaagcagaggacgccccaagauaaccagcugaccuacguggucaucgcaauacucacaguuguggccgcuacuauggcgaaugaaaugggcuuucuugagaaaaccaagaaagaccugggauugggcucuaucgccacacagcagccagaguccaacauucuggacaucgaucuccggccugcaagcgcuuggacccuguacgccguagccacuacauucgugacgcccaugcuucgacauucaauugaaaauaguucugucaacgugucccucaccgcaaucgcuaaucaagccacuguucugaugggguugggaaaggguuggccgcugagcaaaauggacauuggcgugccauuacuagcgaucggguguuauucacaggucaacccuauaacacugaccgcugcccuccuucuguugguagcacacuacgccauuaucggacccggccugcaggcuaaggcaaccagagaggcccagaagcgcgcggcugccgguaucaugaaaaauccaacaguggaugggauuacuguuauagaccucgaucccaucccuuaugacccgaaguuugaaaaacaacugggccaggugaugcuuuuaauucugugcgucacacaggugcucaugaugaggaccacaugggcauugugugaggcccugacucuagcuaccggacccaucaguacacugugggaaggcaacccagggcgguucuggaauaccacuauugccgucagcauggcaaacaucuuucguggauccuaccucgcuggcgccggucuucuguucucuauaaugaagaauacgacaaacaccagaagggggacuggaaacaucggcgagaccuugggugagaaauggaaaagccgccugaaugcgcucggcaaauccgaauuucaaauuuauaagaagucagggauccaggagguggaucggacacuggccaaagaaggaauuaagcgaggcgagacugaccaccaugcaguuucuagagggagugcuaaauuaaggugguucguggagcgcaacaugguaaccccugaaggaaagguggucgaucuuggcugcgguagagggggauggucguacuauuguggcggucugaaaaauguuagagaggugaagggccucacaaaagggggacccggccacgaggaaccuaucccaaugagcacguacggguggaaccuaguccgucugcaguccggaguggacguauuuuucauacccccugaaaaaugcgauaccuugcugugugacauuggcgagucuucaccaaaucccacuguggaggccgguaggacacuccggguucuuaaccugguggaaaauugguugaacaauaacacccaguucugcaucaagguccugaauccguacaugccuagcgugaucgagaaaauggaagcacuccaacgcaaguaugggggagcuuuaguccgaaacccacuguccagaaauaguacucaugagauguacugggugucuaacgccagcggcaauauuguuucauccguaaacaugauaaguaggaugcuuaucaaccgguuuacaaugcgccacaaaaaggccaccuaugaacccgauguggaccugggcagcgggacgagaaauauuggaaucgagucugagaccccuaaccuagacauuaucgguaagaggauagagaaaaucaaggaggaacaugagacauccuggcacuacgaucaggaccacccauauaaaacuugggcguaccauggcucauaugaaaccaagcagacagggagcgcuucgucuauggucaauggagugguucgacuccugacuaaacccugggauguguugccgaccgucacacagauggcaaugaccgacacuacgccuuucggccaacagcggguguuuaaggagaagguagauacacguacccaggagcccaaagaagguacuaagaaacugaugaagauuaccgccgaguggcucuggaaagaacuugggaagaaaaagacaccaagaauguguacgcgcgaggaguucaccaggaaggugcggaguaacgcugcccugggagcaaucuuuacugacgaaaauaaauggaaguccgccagagaggcuguugaagauagccgcuucugggaguuagucgacaaagaaaggaaccugcacuuggagggcaagugcgagacauguguguacaauaugaugggcaaacgagaaaagaagcucggggaguuuggaaaagcgaaggguucacgggccauuugguacauguggcugggcgcaagauuccuagaauuugaggcucuuggguuccugaacgaagaucauugguuuuccagggaaaauucucucagcggaguggagggcgaaggucugcacaaauugggguauauccugcgcgacgucaguaagaaagagggaggcgccauguacgcagaugacaccgccggcugggacacucguauuacacucgaagaucuuaagaacgaggaaaugguuaccaaucacauggagggggagcauaagaaacuggcugaagccauauucaaguuaacauaucagaacaaagugguacgggugcaaagaccuacucccaggggaaccgucauggacaucauuucccgccgagaucagcgggguagcggccagguggggacguacggacugaauaccuuuacaaacauggaggcgcaauugaucagacagauggaaggcgaggguguuuucaagaauauccagcaccucacugugaccgaggaagcagccguccagaacuggcuggcuaggguggggcgcgagagacuaucucggauggccauuucaggagacgauugcguaguuaaaccacuugacgauagguucgcaaacgcucugacagcccucaaugacaugggcaagauacguaaggauauccaacagugggaacccaguaaaggcuggaacgacuggacucaggugccuuuuugcucccaucacuuccaugagcugauuaugaaggaugggcgagucuugguggugccaugucgcaaucaggacgaauuaaucgguagagcucggauuagccaaggagccggcuggucucugagggagaccgcaugccucgggaaaucguaugcgcagauguggucacuuauguacuuucaccgcagagaucugcggcuagccgcuaacgccaucuguagcgcagucccgucccacuggguucccacgaguaggacaaccuggucuauacaugcuaagcacgaguggaugacuacagaagacaugcugaccguguggaaucgaguauggauccgugagaacccuuggauggaagacaaaacuccaguggagagcugggaagagauucccuaucucggaaagagagaggaucaguggugcggcuccuugaucggucugaccucacgcgccacaugggcaaagaauauucaggccgcgaucaaccaaguccggagucuuauagggaaugaagaguacacggacuacaugccuucuaugaaaagguucagacgcgaagaggaagaggcuggagugcugugguga

SEQ ID NO: 14450 - RNA, 9876 nt, Artificial Sequence
  derived and/or modified CDS sequence (opt3) from DENV-2__FJ898460__SS-prME
accgccggcgugaucgucaugcugauucccacagcuauagcauuccaccucacuacgagaaacggggagccucauaugaucguuggaaggcaggaaaaggguaaaagccuucuguuuaagaccgaggacggcgugaauaugugcacauugauggccauugauuuaggggaacugugugaggacacuaucaccuacaaaugcccacuacuccggcaaaacgaaccggaggauauugacuguuggugcaauuccacaucuaccuggguaacuuauggaacauguaccacgacuggcgagcaccgccgagaaaagcguucaguggcgcuggucccccauguggguauggggcuugagaccagaacagaaacuuggaugaguagcgagggagcuuggaaacacguucagaggaucgagaccuggauacugcggcauccuggcuucacaaucauggccgcaauuuuggccuacaccaucggcacgacucacuuucagcgcgcucucauuuucauccugcugacagcaguggccccauccaugaccaugagaugcauagggauuucuaacagggauuuugucgaaggagugucggguggcucauggguagacaucguucucgagcacgggagcugugugacuacaauggcuaagaauaagcccaccuuagauuucgaacugauuaaaacggaggccaagcagccugcgacccuucggaaauauugcaucgaagcaaaguugacaaacacuaccacagagagucgcuguccaacucaaggagagcccucccugaaugaagagcaggacaaacgauuuaucugcaagcauucuauggucgauagaggcugggguaacggguguggacuauucggcaagggcgggauugugaccugcgccauguuuacaugcaaaaagaauauggaaggaaaagugguccagccugagaaccucgaauacaccauaguuaucacuccacacagcggugaggagcaugcugugggcaaugacacggggaagcacggaaaagaaauuaagaucacaccgcaguccucaauaaccgaggccgaacugacuggcuaugguaccguaacaauggaguguagucccaggaccgggcuugauuucaacgaaauggugcuguugcaaauggaggacaaagcauggcucguccaccggcagugguuucuggauuuaccucugccauggcuccccggcgcugacacucagggaagcaauuggauucagaaggagacacuugugacguucaagaacccucaugccaaaaagcaagacguugugguccugggcucucaggaaggggcgaugcacaccgccuugacuggagcaacagagauccagauguccucagguaaucuacuguuuaccggccaucucaaaugccgucugcgcauggauaagcuucaacugaaagggaugagcuacaguauguguacaggaaaguucaagaucgugaaagaaauugcugagacucagcacggcaccaucguaauuagaguucaguaugagggugacgggucuccaugcaagauacccuucgaaaucacggauuuggagaaaaggcaugugcucggccggcugauuaccgucaacccgaucgugacagaaaaggacuccccugucaacaucgaggccgaacccccauuuggagauagcuacauuauaaucggcguggagccugggcaguuaaaacugaauugguucaagaagggaucgucuauuggucaaauguuugagacuaccaugcgaggcgcuaaacgcauggccauccuaggggacacagcaugggauuucggaucccucggcgguguuuuuacuucaauugggaaggcccugcaccagguguucggcgcuaucuacggagcggcauuuaacggcguaaguuggaccaugaaaauacuuaucggggucauuaucacguggauuggaaugaauagcagauccacaucuuugagcgugucacugguucucgugggcgucgugacccuguaucuuggugccaugguacaggcugacagugggugugugguuuccuggaagaacaaagaacugaagugcggaagcggcaucuucauaacugauaauguccacacauggaccgagcaguacaaguuucaacccgaaucuccaucaaaauuggccagugcaauucagaaggcccaugaggaagguaucuguggcauuaggagcgugacucggcucgagaaccugauguggaaacagaucacccccgaguuaaaucacauacuguccgaaaacgaggugaagcuaacaaucaugacgggggacauuaaaggaaucaugcaggcuggcaagcgcucucucagaccucaaccaaccgaacugaaauauucguggaagacuugggggaaggccaaaaugcuuagcacagagucccauaaucagaccuucuugauugauggaccggaaacagcagagugccccaacacuaauagggcguggaacucacuggaggucgaagacuacggcuuugguguuuucaguaccaauaucuggcucaagcugcgugagaaacaggacguguuuugugauucuaaguuaaugagcgcugccauaaaagacaaccgggcagugcacgccgauaugggguauuggauugaauccgcucugaaugacacguggaagauggagaaggccucauucaucgagguaaaaagcugccacuggccuaagucucauacacuuugguccaacggagucuuggaaagugagaugaucauuccaaaaagcuucgcaggccccgugucucagcacaacuaccgaccugguuaucauacccaaacugcuggcccauggcaccucgggaagcuggaaauggauuuugacuucugugagggaaccacaguuguggucacugaagauugcggcaauagagggcccucccuaaggaccacaacggccucaggaaaacugaucaccgaguggugcugucgcaguugcacucucccgccucugcgguacagaggcgaggacgguuguugguacgggauggaaauuaggccacuuaaggagaaggaagagaacuuggugaauagccugguuacagcgggacauggccagauagauaacuuuucguuaggugugcucggcauggcccuguuccuugaagagaugcugcgcacccgaguagggacuaaacacgcuaucuugcucgucgcaguguccuuugugacacugauuaccggaaauaugucuuuccgggaccuaggccgugucaugguuauggugggggccacgaugacugaugacaucggaaugggcguaaccuaucuggcucuccuggccgcauuuaaggugagacccacauucgcggccggucuuuugcugaggaaauuaaccagcaaggagcucaugauggcuacuauugggaucgcccugcuuucacagaguacaaugccugaaaccauacuggagcuaacagaugcacucgcucugggaaugauggucuugaaaaucgugcgcaacauggaaaaguaccaacuggccguuacuauuauggcaaucuccugcgugcccaaugccgucauuuuacagaacgcuuggaaggugucuuguaccauccucgcggccguuagcguguccccacugcuucugacgucaagccagcagaaagcagacuggauaccuuuggcucucacaauuaagggccugaaucccaccgccaucuuucuaacuacccugagucggacaucuaaaaagagauccuggccacuuaacgaggccaucauggcugucggcaugguaagcauucucgcaucgucacuguugaaaaaugacauaccgaugacugggccucugguggccggagguuuacucaccguuugcuaugugcugacgggcaggucugcggaucuugaacuggagcgagcugccgacgucaagugggaggaucaagcagaaaucaguggguccagccccauuuugucuaucacaauuagcgaggacggauccaugucaaucaaaaacgaagaggaggaacagacccucacuauacugauccgcacaggccuacuggugauuagugguguauucccagugagcauccccauuaccgccgcugcaugguaccuuugggaggucaagaagcagcgggccgggguucucugggaugugccuucuccacccccugugggaaaagcggaacuggaggacggcgcuuauagaaucaagcagaggggcauauugggguacucccaaauuggagccggugucuauaaagaaggcacuuuucacacaauguggcaugugacccguggggcaguuuuaaugcaccgcggaaagcggaucgagccgucaugggccgauguaaaaaaggaccugaucaguuacggcgguggguggaagcucgagggagaauggaaagagggcgaagaggugcagguccuggcucuugaaccaggcaagaaucccagagccgugcagacgaaaccugggauuuucaagacuaacaccggaacaaucggugcaguuagccuggauuuuuccccaggcaccucugggucgcccauaguggacaggaaaggaaaggucgugggcuuguacgguaaugggguagucacacgaagcggagcuuaugugucagccauugcgcagacugagaaguccaucgaggauaacccugaaauugaggacgauaucuuccggaaaaagcgccuaaccauaauggaccugcauccgggcgccggcaaaacgaagagauaccuccccgcaauuguuagggaagcuaucaaacgggggcugcgaacacuuaucuuagccccaacuagaguggucgcugcagagauggaagaggcccugcgcggacucccuauuagguaucaaacccccgccauccgugcugagcacacaggucgggaaauuguggacuugaugugucaugcgaccuucacuaugagacugcucaguccaguuagggugccuaacuacaaucugauaaucauggaugaggcacacuuuaccgaccccgccucuauugcugcccgcggcuauaucagcacacgagucgaaaugggggaggcagccggaaucuucaugacggcuacuccaccgggcuccagagauccuuuuccccagucaaacgcgccaauuauggacgaggaacgggagauacccgaaaggucuuggaauagcggucacgagugggugaccgauuucaaggggaagacaguaugguuugugccuaguaucaaagccggaaacgacauugcagcuugccuucgcaagaauggcaaaaagguuauccagcugucccguaaaaccuucgauagcgaauacgucaagacuagagccaacgacugggauuuuguggugacaaccgacauuucugagaugggcgcaaauuucaaggccgagcgggucaucgauccaaggcgcuguaugaaacccguaauauugacggacggggaagagcgagugauccuagcuggaccuaugccgguuacucauucauccgccgcgcaaagacgggguaggauuggccgcaacccaaagaaugaaaacgaccaguauaucuacaugggggagccccuggaaaaugaugaggacugcgcacacuggaaagaggccaagaugcucuuagauaacauuaauacaccugaaggaaucauacccaguauguuugagccagaaagagagaaaguggacgcuauugauggcgaauacaggcugcggggugaggcccguaagaccuucgucgaccuuaugcgccgaggggaucugccuguguggcucgcuuauaaaguugcagccgagggcaucaacuacgcugacagaaagugguguuuugauggaauuaagaauaaccagaucuuggaagagaacguggaagucgagauauggaccaaagagggcgaaaggaagaaacugaagccccgguggcucgacgcccgcaucuauagcgauccacuggcacuuaaagaguucaaggaauucgcggccgggagaaagucgcuaacucugaauuugauuacagagaugggaagguuaccuaccuuuaugacacagaaagcucggaacgcccuggacaaucucgcagugcugcauacugcugaagccgguggccgagcauacaaccacgcccuuucugagcugccggagacgcucgaaaccuugcugcuacugacacuccuugcuacuguaaccgggggaaucuuccuguuuuuaauguccggcaaggguauugggaaaaugacauugggcaugugcugcaucauaaccgcgagcauucugcucugguaugcccaaauccagccccacuggaucgcagcuucaauuauccuggaguucuuucuuauagugcugcucauuccagaaccugagaagcagagaacuccccaggauaaucaauugacguacguugucaucgccauucugaccgugguggccgcaacaauggcuaacgaaaugggauucuuagagaaaacuaagaaggaccuaggccuggggaguaucaccacacaggagucugaauccaauauacucgacaucgaucuucgcccagccagcgcguggacccuguaugcugucgccacuacauuuguuacgccuauguugaggcauucaauugagaacaguagcgugaauguaucccugaccgcaaucgccaaccaggcuacugugcucaugggacuggguaaaggcuggccccuuucuaagauggacauuggggucccgcuccuggcaaucggauguuacagccaggugaauccaauuacauugaccgccgcgcuguuacuacugguugcucacuacgccaucauaggcccuggucuccaagcaaaagccacccgggaagcucagaagcgugccgcagcugggauuaugaaaaaccccacaguggauggcaucacugucaucgaccuugagccaauucccuaugauccuaaguucgaaaagcagcugggacagguaauguugcugauacucugcgugacgcaaguucugaugaugagaaccacaugggcccuuugugaggcguuaacucuggccaccggcccgaucuccacacucugggaggggaaucccggaagguuuuggaacaccacuauugcagugucaauggcuaauaucuuccgcggcucuuacuuggccggugcagggcugcuauuuaguauuaugaaaaacacgacaaauacccggcgaggaacuggcaacaucggugaaacccugggcgagaaguggaaaucgagacucaacgcucuugggaagagcgaauuccagauauauaaaaaguccggaauccaggaggucgacaggacacuggccaaagagggcauuaagcgcggggaaacugaucaucacgccgugucucggggaucagcgaaguugagaugguuugucgagcguaauauggugaccccagaaggcaaaguuguggaccuggguugcgggaggggaggcuggagcuacuauugugguggccucaagaacguacgggaggugaaagggcugacaaagggaggcccugggcaugaagagcccgucccuauguccacguacggauggaauuuaguucgccuucaaaguggcguggaugucuucuucaccccacccgagaaaugcgacacucugcucugugauaucggugaaucuagcccuaacccaacaauugaggcugggcgaacccuaagagugcugaauuugguagaaaacuggcugaauaacaauacucaguuuugcaucaaggugcucaaccccuauaugccgucaguuauagagaagauggaaacacuucagaggaaauacggaggcgcacuggugcggaauccuuugucccgcaacaguacccacgagauguacugggucagcaaugccacgggcaacauugugucuuccgucaauaugaucucaagaaugcugaucaacagguucaccaugaagcacaaaaaggcuacauaugagccagacguggaucucgggagcggaacucgaaacauugguauagaaucggagacccccaauuuagacaucauuggcaaacggaucgaaaagauuaagcaggagcaugaaacaucuuggcacuacgaccaagaucauccuuauaaaacuugggccuaccacgggaguuaugagaccaagcagacaggauccgcaagcucaaugguuaacggcguagugcgucugcuuaccaaaccaugggacgucgugcccaugguuacucagauggccaugacggauacaaccccguuuggucagcaaagaguguucaaggagaaagucgacacucgcacccaggaaccuaaggaggggacaaagaaacugaugaagaucacggcugaauggcuauggaaagagcucggaaagaaaaagacccccaggauguguacucgggaggaauuuacaaaaaaggugagauccaaugcggcccugggcgcaauauucaccgaugagaacaaguggaaaucugcucgcgaagccguagaggacggcagguuuugggaauugguggaucgagagcggaaucugcaccucgaggggaagugcgaaacuuguguuuacaacaugaugggaaaaagagagaagaaacuuggugaauucggcaaggcaaaggggagcagggccaucugguauauguggcugggagcucgcuuuuuagaguucgaagcccugggcuuuuugaaugaggaccauugguucagucgugguaacucccucagcggggucgagggagaaggccugcaccggcuaggcuacauucuuagagagguggggaaaaaggaaggaggugcgauguacgcagaugacacagccggcugggauaccaggaucacacuggaggaccucaaaaaugaagagauggugacuaaccauaugaagggggagcacaaaaagcuggcugaagccauuuuuaaguugaccuaucagaauaaagucguucgcgugcagcgaccaacgccucggggaaccguaauggacaucauuucuagaagggaucaacgcggcucaggucagguggggacauacggacugaacacuuucaccaauauggaggcacagcucauaagacaaauggaaggcgagggcaucuucaagaguauucagcaucuuacagcuacugaggaaaucgccguccagaacuggcuggcucggguggggagggagcguuuaucccgaauggccaucagcggagacgauugcguugugaaacccauugacgaucgcuuugcaucugcgcugaccgccuugaaugacauggguaaggucagaaaagauauacagcaaugggaaccaucgcggggcuggaacgacuggacgcaggugcccuucugcucacaccacuuucaugagcucguaaugaaggaugggaggguucugguggucccuugucgcaaccaggacgaacuaaucggaagagcucggauuagccagggcgccgguuggucccuuaaggagacagcaugccuggggaaaaguuaugcucaaauguggacccucauguacuuccacaggcgagaucugcguuuggccgcaaaugccaucuguucugcggugccaagccauugggugccgacuuccagaacaaccuggucaauucacgcuaagcacgaguggaugacuaccgaagacauguuagccgucuggaaccgcguuuggauccaggagaaucccuggauggaagauaaaacaccuguggagaguugggaagagguaccauaucugggaaagcgggaggaccaguggugcggcucucucauaggccuuacgagcagggcaaccugggccaaaaacauccagacugcuauuaaucaagugagaucccugaucgggaacgaagaguacacagacuauaugcccucaaugaagcgcuuucggagggaagaggaagaggccggaguccuaugguga

SEQ ID NO: 14451 - RNA, 9876 nt, Artificial Sequence
  derived and/or modified CDS sequence (opt3) from DENV-2__FJ882602__SS-prME
accgccggcaugaucauuaugcugauacccacagcuauggcauuccaccucacuacgagaaacggggagccucauaugaucgugagcaggcaggaaaagggaaagucccuucuguuuaagaccgaggacggugucaauaugugcacauugauggccauggauuuaggcgaacugugugaggacacuauuaccuacaacugcccacuacuccggcaaaaugaaccggaggauaucgacuguuggugcaacucuacaucaaccuggguuacuuaugggacauguaccgcgacgggagagcaccgccgagaaaagcguaguguggcucuggugccccaugugggcaugggucuugagacuagaaccgaaacauggaugagcuccgagggggccuggaagcacgcacagaggauugagacuuggauccugcggcauccuggauucaccauaauggccgcuaucuuggcauacacaauuggcaccacguauuuucagcgcguccucaucuucauucugcugacugccguggcuccaucuaugacaaugagaugcaucggcauaucgaauagggauuuuguugaaggggugucaggagguagcugggucgacauugugcucgagcacggcaguuguguaaccacuauggccaagaacaagcccacauuagauuucgaacugaucaagaccgaggcgaaacagccugcaacgcuucggaaguacugcauugaagccaaauugaccaauacaacuaccgcuucccgcuguccaacacaaggggagcccucucugaacgaggaacaggacaagcgauuuguuugcaaacacagcaugguggauagaggauggggcaaugguugugggcuauucggaaagggcggcaucgucacuugcgccauguuuaccugcaagaaaaacauggaggggaagaucgugcagccugaaaaucucgaguauacaauugugauaaccccacauuccggagaagagaacgcagucgguaaugacacuggcaaacacgggaaggagaucaaaguuacgccgcagucaaguauuacagaagcugagcugaccggauacggcacugugaccauggaauguagccccaggacaggucuugauuucaacgagaugguacuguugcaaauggaaaauaaggccuggcucgugcaucggcagugguuucuggacuuaccucugccauggcuccccggggcggauacccagggcucuaacuggauccagaaagagacucuugucacauucaagaacccucacgccaagaaacaagacgugguugugcugggaucccaggagggcgcaaugcacacggcuuugaccggggccacugaaauacagaugucaagcggaaaucuacuguuuacaggucaucucaagugccgucugcgcauggacaaacuucaacugaagggcaugaguuauucuauguguaccgggaaauucaaggucgugaaggagauugcugaaacacagcacggaacuaucguaaucagaguucaguacgagggcgaugguuccccaugcaaaauucccuucgagaucauggacuuggaaaagaggcaugugcucgggcggcugauuaccgucaacccgauagugacggagaaagauagcccugucaauaucgaagccgagcccccauuuggcgacucguacauuaucaucggaguggaaccuggccaguuaaagcugucuugguucaaaaagggguccucaauuggacaaauguuugagaccacaaugcgaggugcaaagcgcauggccauacuaggcgauacugcuugggacuucgggagucucggaggcguuuuuaccagcaucgguaaagcgcugcaccagguguucggggcaauuuauggcgccgcuuuuuccggaguaucuuggacaaugaagauccuuauuggcgucgugaucacuuggauagggaugaacagcagaucaaccaguuuguccguugcccuggugcucgucggagugguaacgcuguaccuuggcgugaugguucaggcagauagcgguugugucgugucuuggaaaaauaaggagcugaaaugcgggucaggaaucuucauuacagacaacgugcauaccuggacugaacaguauaaguuucaacccgagaguccaagcaaguuggccuccgcuauccagaaagcccacgaagagggcauuugugguaucaggucugucacacggcucgaaaaucugauguggaagcagauaacccccgaguuaaaccacauucugucggagaaugaaguuaaacuaacuaucaugaccggcgauauuaaggggaucaugcaggcaggaaaacgcagccucagaccucaaccaacagagcugaaguacuccuggaaaacguggggcaaggcgaagaugcuuucaaccgaaccgcauaaccagacuuucuugauagacgggcccgagacagcugaaugcccuaauaccaacagggccuggaauagucuggagguggaggauuauggauuuggcguguucacaacuaacaucuggcucaaacugaaggaacgucaggacguauuuugugacucuaaauuaaugagcgcagccauuaaggauaaucgggcuguccacgccgacauggguuacuggaucgaguccgcacugaacgauaccuggaaaauugaaaaggcuucauucaucgagguaaagagcugccauuggccaaaaucucacacgcuuugguccaacgggguuuuggagagugaaaugauaauucccaagaauuucgccggaccugugagccagcacaacuaucgaccaggcuaccauacacaaaccgcgggucccuggcaccucggcaaacuggagauggacuuugauuucugugaagggacuaccgucgugguuacagaggacugcggaaauagaggcccgucucuaaggacuaccacagccuccgggaagcugaucacggaauggugcugucgcucaugcacccucccuccacugcgguacagaggagaugacggcuguugguaugguauggagaucaggccccuuaaagagaaggaagagaacuuggugaauagucugguaacugcuggguacggacagauugauaacuuuagcuuaggcguccucgguauggcacuguuccuugaagagaugcugcgcacacgagugggcaccaagcaugccguguugcucgucgcuguuucguuuaugacucugaucacagggaauauguccuuccgggaccuaggacgugugguagugauggucggcgccgcaaugaccgaugacauugggaugggagugacguaucuggcgcuccuggccgcuuuuaaaguuagaccuacuuucgccgcaggccuuuugcugaggaaguuaaccucuaaagaacucaugaugacaaccauagguaucgugcugcuuagccagucaacuauucccgagacaauccuggagcuaaccgaugcucucgcccuggggaugaugauuuugaagaucguccgcaacauggaaaaauaccaacuggcagugacaauaauggccaucuuaugcguuccaaaugcugugauucuccagaacgcguggaaggucaguuguacuauccuggccguaguguccguuucuccucuucuguugaccagcucccagcagaaggcagacuggauuccccucgcucugacgaucaaaggacuaaauccaacagccauauuucugaccacucuuucacggaccaacaagaaaagaagcuggccgcucaaugaggccauuauggcugugggcauggucaguauccuggcaucuuccuugcugaagaacgacaucccuaugacaggccccuuaguggccgggggacuccugacuguaugcuaugugcuuaccgguaggagcgcggaucuggaauuggagcgagcugccgacguccgcugggaagaucaagcagagauuucgggcucaucuccaauacucaguaucacgauuuccgaggacgggagcaugucuaucaaaaaugaagaggaggaacagacacugaccauucuaauccggacuggacugcuuguuauaagcggccucuuccccguguccaucccuauuacagccgcugcaugguaccugugggaggugaagaaacagagagccggugucuugugggaugugccaucacccccuccgguugggaaggcggaauuagaggacggagcuuauaggaucaagcagaaaggcauucugggcuacagucaaaucggggccggaguauacaaggaagguaccuuucacacuauguggcaugugacacguggcgcaguccucaugcacaaagggaagcgcauagagccaagcugggccgaugugcggaaagaccugauuucuuauggaggcgguuggaaacuugaaggggaguggaaggagggagaagagguucaggugcuggcuuuggaacccggcaaaaacccuagagccguccagaccaagccaggccuauucaaaacgaacacugggaccaucggagcagugucccuggauuuuucacccgguacaaguggcagcccuaucguagacaagaaagggaaggucgugggacucuacggcaaugguguugugaccagguccgggacauaugucucugcuauugcccagacugagaagucgaucgaagauaacccggagauagaggacgauauuuuccgaaaacggcgccugaccaucauggaccuucaccccggagcgggcaagacgaaaagauacuuaccagccauugugagggaagcaaucaagcggggccugcgaacacucauauuggcuccuacuagaguuguggccgcugagauggaagaggcacugcgcgggcuccccauuagguaucaaaccccagccauccgugccgaacauacaggacgggagaucgucgaccugaugugucacgcuaccuucacuaugagacuucugagcccugugaggguacccaauuacaacuugauuaucauggaugaggcgcauuuuaccgacccagcaucaauugccgcucgcgguuauauauccacacgaguggaaaugggcgaggccgcagggaucuucaugacggccacuccgccuggaaguagagaucccuuuccacagucuaaugcucccauuauggacgaggaacgggagaucccugaaaggagcuggaacuccggccacgaguggguuaccgauuucaaagguaagacagucugguuugugccaucaaucaaggcggggaaugacauugccgcaugccuacgcaaaaacggaaagaaagugauacagcugucucguaagaccuucgauagcgaauacaucaaaacuagaacaaaugacugggauuuugucguaaccacggacauuagugagaugggcgcuaacuucaaggccgaacgggugaucgaucccaggcgcuguaugaagccuguuauucucacugacggcgaggagcgagugaucuuagcagggccgaugccagucacacauuccagcgccgcucaaagacggggaaggauaggucgcaaucccaaaaacgaaaaugaccaguacaucuauaugggcgagccucuggaaaacgaugaggacugcgcccacuggaaggaagcgaaaaugcuucuggauaauauuaacacccccgaggggaucauuccaucuauguuugagccugaaagagagaagguggacgcaaucgauggagaauacaggcuccggggcgaggcccguaaaaccuucguugacuugaugcgccgaggugaucugcccguguggcucgcuuauagagucgccgcugaagggauaaacuacgcagacaggcggugguguuuugauggcauuaagaauaaccagauccuggaggagaauguggaaguagagauuuggacuaaagaaggagagcgcaagaaacuuaaaccaagauggcuagacgccaggaucuauucagauccucuggcuuugaaggaguucaaagaguucgccgcaggccggaaguccuuaacacugaaccucauaaccgagauggggcgacugccgacauuuaugacucagaaagcgagaaaugcccuugacaaccuggcugugcuccacacggccgaagcaggaggucgcgcuuacaaucaugccuugagugagcugcccgaaacccuagagacacugcuccuucugacuuuauuggcaaccguuacaggcgggaucuuccuguuucucaugagcggaaagggcauugguaagaugacccuggggaugugcugcaucauuacugccucgauccuucugugguaugcucaaauacagccacacuggauugcggccucuaucauccucgaguucuuuuugauuguccuguuaaucccugaacccgagaaacagaggacgccacaggauaaccaacuaaccuacguggugauagcaauucugacagucguugcugccacuauggccaaugaaaugggcuuccucgagaagaccaaaaaggaccuuggacugggcuccaucgcaacacagcagccugaaagcaacauuuuggacaucgaucugcggcccgcuucagccuggacccucuacgcgguggcuacuacauuuauaacgccgaugcugcgucauaguaucgaaaauucuuccguaaacgugagccuuaccgccauugcaaaucaggccacuguccucauggggcugggaaaagguuggccauugucaaagauggacaucggcgugccucuguuagcuauuggguguuauagucaaguuaaccccaucacacuaaccgcagcccugcuccuucugguggcgcacuacgcuauuaucggaccaggcuugcaggccaaggcaaccagagaggcccagaaaagggcugccgcagguauaaugaagaaucccacagucgaugggauuacuguaaucgaccuggauccuaucccguaugaccccaaauucgaaaagcagcucggccaagugaugcugcuuguuuuaugcgugacgcagguccugaugaugcgcaccacaugggcucucugugaggccuugacucuggcgaccggaccaauuagcacacuaugggaaggcaacccugggcgguuuuggaauaccacuauagccguguccauggcaaacaucuuccgaggaucuuaccuggcuggcgccggucuccuuuuuagcauuaugaaaaacacgacaaauaccagaagggggacuggaaacaccggcgagacacugggugaaaaguggaagaaucgcuugaacgcacugggcaaauccgaguuccagaucuauaagaaaucagggauucaagaggucgaucggacucucgcuaaggaaggaaucaaaagaggcgagaccgaccaccaugccgugucucgugggagugccaagcugaggugguuuguugaacggaauuuagugacacccgagggaaaaguaguggaucuuggcugcggucgcgggggauggucguacuauuguggcggucugaagaacguccgagagguuaagggccucacgaaagggggaccuggccacgaggaaccaauacccaugagcaccuacggguggaaucuagugagacugcaguccggagucgacguguucuucacuccuccagaaaagugcgauacauugcugugugacaucggcgagucuucacccaacccgaccguagaagcggguaggacucuccgggugcuuaaucugguugagaacugguugaauaacaauacacaguuuugcauuaaagugcugaacccuuacaugccaagcgucaucgagaagauggaagcucuccagcgcaaauaugggggagcauuagugagaaauccccuguccaggaacaguacccaugagauguacugggucucuaacgccagcggcaauauugugucauccguuaacaugaucagucgaaugcuuauaaaucgguucacgaugcgucacaagaaggcuaccuaugaaccugauguagaccugggcagcgggacaagaaacauuggaaucgagucugaaacuccaaaucuagacaucauugguaaacgcauagagaagaucaaacaagagcaugaaaccuccuggcacuacgaucaggaccaccccuauaagacaugggccuaccauggcucauaugagacuaaacagaccgggagcgcaucgucuauggugaacggagucgugaggcuccugacaaagccgugggauguuauuccuauggugacccagauggccaugacugacacgacacccuuuggccaacagcgggucuucaaggaaaaaguggauaccagaacucaggagccaaaggaagguaccaaaaaguugaugaaaaucacagcugaguggcuguggaaggagcucgggaagaaaaagacgccucgcauguguaccagggaagaguuuacucgaaaaguacggaguaaugcggcccuuggagcaauuuucacagacgaaaacaaguggaaauccgcuagagaggccguggaggauagcagguuuugggaacugguugacaaggagcgcaauuuacaccuggaaggcaaaugcgagaccugugucuacaacaugaugggcaagcgugaaaagaaauugggggaguucggaaaggcaaaagguucacgggccaucugguacauguggcucggcgcuagauuucuggaguucgaagcccuaggguuucuuaaugaggaucauugguucuccagggaaaacucucugagcggaguggagggcgaaggucuccacaagcugggguauauauugcgcgacgugaguaaaaaggagggaggcgcgauguacgcagaugacacugccggcugggacacacgaaucacccuggaggaucucaagaaugaagagauggucacaaaccacauggaaggggagcauaagaaacuugcugaagccauuuuuaaacugacuuaucagaauaaaguugugcggguacaaagacccaccccaaggggaacggugauggacaucauuucccgcagagaucagcgggguagcggccaggucgggaccuacggauuaaacacauucacuaacaugggcgcacaacugaucaggcagauggagggugaggaaguguucaaagggauucagcacuugaccgcuacagaggaaauagccguucagaauuggcucgcucgugugggacgagagcgccugucuagaauggccaucucaggcgacgauugcgucgugaagccccuagacgaucgguuugcaagugcgcuuacugcccugaacgacaugggcaagguaaggaaagauauucaacagugggagccuucccgcggguggaaugacuggacccagguuccauucugcagccaucacuuucaugaacucaucaugaaggauggaagagugcuggucgugccgugucggaaccaggacgaguugaucgguagggcucgaauuucucaaggcgccggguggucguuacgugaaacggcaugccugggaaaaucauaugcucagauguggagccucauguacuuccacagacgcgaucuucggcuggccgcaaaugccauauguuccgcggugcccagucacugggucccuacaucuaggaccacuuggagcauccaugcuagacacgaguggaugacaaccgaagacaugcuaacuguuuggaaccgcguguggauucaggagaauccauggauggaggacaagacccccguagaauccugggaggaaaucccuuaucugggcaaacgggaggaucaguggugcgguucacucauuggguugacaaguagggccacgugggcaaagaacauccaaaccgccauaaaucaggugcgaucucugaucggaaacgaagaguacacugacuacaugccaagcaugaagagauuucggagggaggaagaggaagcuggcguccuuugguga

SEQ ID NO: 14452 - RNA, 9876 nt, Artificial Sequence
  derived and/or modified CDS sequence (opt3) from DENV-2__GQ252676__SS-prME
accgccggagugaucauuaugcugauacccacagcuauggcauuccaccucacuacgagaaacggggagccucauaugaucgucagcaagcaggaaaagggaaagucccuucuguuuaagaccgaggaagguguuaauaugugcacauugauggccauggacuuaggcgagcugugugaagauacuauuaccuacaacugcccacugcucaggcaaaaugagccggaggacaucgauuguuggugcaacucuacaucaaccugggugacuuaugggacauguaccgcgacgggagaacaccggcgcgagaagcgaaguguugcucuggugccccaugucggcaugggucuugaaacucguaccgagacauggaugagcuccgagggggccuggaaacacgcacagcggauugaaacuuggauccugaggcauccuggauucaccauaauggccgcuaucuuggcauacacaauuggcaccacguauuuucagcgggugcucaucuucauucugcugacugccguugcuccaucuaugacaaugcgcugcaucggcauaucgaauagagacuuuguggagggggucucaggagguagcuggguggauauugugcucgaacacggcaguuguguuaccacuauggccaagaacaagcccacauuagacuucgagcugaucaaaaccgaagcgaagcagccugcaacgcuuaggaaauacugcauugaggccaaguugaccaauacaacuaccgcuucccgguguccaacacaaggggagcccucucugaacgaagaacaggauaaacgcuuugugugcaagcacagcauggucgaccgaggauggggcaaugguugugggcuauucggaaagggcggcaucgugacuugcgccauguuuaccugcaaaaagaacauggaagggaaaaucgugcagccugagaaucucgaauauacaauugucguuaccccacauuccggagaggagaacgcaguggguaaugauacuggcaagcacgggaaagaaauaaagguaacgccgcagucaaguaucacagaggcugaacugaccggauacggcacugugaccauggaguguagccccagaacaggucuugacuucaacgaaaugguccuguugcaaauggagaauaaagccuggcucgugcauaggcagugguuucuggauuuaccucugccauggcuccccggggcggacauucagggcucuaacuggauccagaaggagacccuuguuacuuucaagaacccucacgccaaaaagcaagauguggucgugcugggaucccaggaaggcgcaaugcacacagcuuugacgggggccaccgagauacagaugucaagcggaaaucuacuguuuacuggucaucucaaaugccggcugcguauggacaaacuucaacugaaaggcaugaguuauucuauguguacagggaaguucaagguaguuaaagaaauugcugagacccagcacggaacaaucgugguccgcgugcaguacgagggcgacgguuccccaugcaagauccccuucgaaauuauggauuuggagaaaagacauguccucgggaggcugaucacugugaacccgauuguuaccgaaaaggacagcccugugaauauagaggccgaacccccauuuggcgauucguacaucauuaucggaguagagccuggccaguuaaaacugucuugguucaagaagggguccucaaucggacaaauguuugagacgaccaugcggggugcaaaacgaauggccauucuaggcgacacagcuugggauuucgggagucucggaggcgucuuuacuagcauagguaaggcgcugcaccagguguucggggcaaucuauggcgccgcuuuuuccggaguuucuuggaccaugaaaauucuuaucggcguggucauuacauggaucgggaugaacagccgcucaaccagcuuguccgugagccugguacucgugggaguugucacacuguaccuuggcgugauggugcaggccgacucugguugugucguuucauggaagaauaaagaacugaagugcgggaguggaauauucaucacggauaacgugcauacauggaccgagcaguauaaguuucaacccgaaagcccauccaaauuggcaucugccauucagaaggcucacgaggaaggcaucugugguauuagaucggugacuaggcucgagaaucugauguggaaacagaucacacccgaguuaaaccacauacugagcgaaaaugagguaaagcuauccauuaugaccggcgacaucaaagggauuaugcaggccggaaagcggucacuccgcccucaaccaacugaacugaaauacaguuggaagaccuggggcaaggcaaaaaugcuuucuacagagccgcauaaccagacguucuugaucgaugggcccgaaaccgcggagugcccuaauacuaacagagcuuggaauagccuggaggucgaagacuauggauuuggcguguucacaaccaacauauggcucaagcugaaagagaggcaggauguauuuugugacuccaaguuaaugucagccgcaaucaaagacaaucgugccgugcacgcugauauggguuacuggauugaaagcgcccugaacgacacauggaagaucgagaaggcaucuuucauugaggucaaauccugccauuggccaaagagucacacucuuuggagcaacgggguguuggaaucugagaugaucauacccaaaaauuucgcuggaccuguuucccagcacaacuaucggccaggcuaccauacccaaacggccggucccuggcaccucggcaagcuggaaauggauuuugacuucugugaggggacaaccgugguagucacugaagauugcggaaaucgaggcccgucacuaagaaccacaacugcgagugggaaacugauuaccgaguggugcuguaggagcugcacacucccuccacugcgcuaccggggagaggacggcuguugguaugguauggaaaucagaccccuuaaggagaaggaagagaacuugguaaauucgcuggugacggccgggcauggacagaucgauaacuuuuccuuaggcguccucgguauggcucuguuccuugaagagaugcugaggacccgcguuggcacuaaacacgcaguguugcucguagccgugucuuuuaugacacugauuaccgggaauaugagcuuccgagaccuaggacgggucauggugaugguuggcgcugccaugacugaugacaucgggaugggagugacauaccuggcacuccuggcggccuuuaagguccguccuaccuucgcugccggccuuuugcugagaaaauuaacgucaaaggagcucaugaugacuaccauugguauagugcugcuuagucaguccacaauccccgaaaccauucuggagcuaacugaugcacucgcucuggggaugaugaucuugaaaauuguuaggaacauggaaaaguaucaacuggccgugacaaucauggcaauauuaugcgucccaaaugccguaauccuccagaacgcuuggaaggugucuuguaccauucuggcggccguuagcguguccccucuucuguugacaucaagccagcagaaagcagacuggaucccccucgcucugacuauuaagggacuaaauccaaccgccaucuuucugacgacacuuagucgcaccaacaaaaagcggucuuggccgcucaaugaggccauaauggcugucggcaugguguccauucuggcaagcucguugcugaaaaacgauaucccuaugacuggccccuuaguagccgggggacuccugaccgugugcuacguccuuacagguagaucagcggaccuggaauuggagagggcugccgacguucgaugggaggaucaagcagaaaucucuggcaguuccccaauucucagcauaacuaucucugaggacgggagcauguccauuaagaaugaagaggaggaacagacccugacgauccuaauucgcacaggacugcuugugaucucaggccucuuccccgugaguauaccuaucaccgccgcugcaugguaucugugggaggucaaaaagcagcgggccgguguguugugggauguuccaagucccccuccgguagggaaggcggaauuagaggacggagcuuacagaauuaaacagaagggcauccugggcuauucucaaauuggggccggaguguacaaagaagguacuuuucauacaauguggcacgucaccaggggcgcagugcucaugcacaaggggaaacguaucgagccauccugggccgauguucgcaaggaccugauaucauacggaggcgguuggaaacuugagggggaauggaaagagggagaagaggugcagguccuggcuuuggaacccggcaagaacccucgggccgugcagacuaaaccaggccuauucaagacaaacaccgggacgauuggagcaguaagucuggauuuuagccccgguacuuccggcucuccuaucgucgacaaaaaggggaaggugguuggacucuauggcaaugguguggucaccagaucggggacauacgugagcgcuaucgcccagaccgagaaaucaauugaggauaacccggaaaucgaggacgauauauucaggaagaaacgacugacaauuauggaccuucaucccggagcgggcaagacuaaacgguauuuaccagccaucguucgcgaagcaauuaagagaggccugaggacccucaucuuggcuccuacgcggguggucgccgcugagauggaagaggcacugcgagggcuccccauaagauaccaaacaccagccauucgcgccgagcacacuggaagggaaaucguggaucugaugugucaugcuaccuucacaaugcgucuucuguccccuguacgggugcccaauuauaacuugaucauuauggacgaggcgcacuuuaccgacccagcaaguaucgccgcuagagguuacauuucuacuaggguugaaaugggcgaggccgcagggauauucaugaccgccacaccgccuggaagccgcgaucccuuuccacaguccaaugcucccaucauggacgaggaacgagagauuccugaaagaucauggaacucuggccaugagugggucacggauuucaaggguaaaacugugugguuugugccaagcaucaaggcggggaaugacaucgccgcaugccuacggaaaaacggaaagaaagucauucagcugaguaggaagaccuucgauuccgaauauauaaagacacgcaccaaugacugggauuuuguagugacuacagacaucagcgagaugggcgcuaacuucaaagccgagcguguuauugaucccagacgguguaugaagccugugauccucaccgacggcgaagagagggucauuuuagcagggccgaugccagugacgcacucuucagccgcucaacgccgaggaagaaucggucggaaucccaaaaacgaaaaugaucaguacauauacaugggcgagccucuggaaaacgacgaggacugcgcccacuggaaggaggcgaaaaugcuucuggauaauaucaacacucccgaagggauuaucccauccauguuugagccugaaagggagaagguugacgcaauugauggagaauaucgccucagaggcgaggccaggaaaacauucguggacuugaugcggcguggugaucugcccgucuggcucgcuuaccgcguggccgcugaggggaucaacuaugcagaccgaagaugguguuuugauggcauaaagaauaaccagauucuggaagagaauguagaaguggagaucuggaccaaggagggagaaaggaagaaacuuaaaccacgguggcuagacgcccgcauuuacagugauccucuggcuuugaaagaguucaaagaguucgccgcaggcagaaagagcuuaacccugaaccucaucacugagauggggaggcugccgacauuuaugacccagaaggcgcggaaugcccuugacaaccuggcuguucuccauacagccgaagcaggaggucgagcuuauaaucacgccuugucggagcugcccgagacucuagaaacgcugcuccuucugaccuuauuggcaacagucacuggcgggauauuccuguuucucaugucuggaaaaggcaucgguaagaugacccuggggaugugcugcauuaucacagccuccauucuucugugguacgcucaaauccagccacauuggauagcggccagcauuauccucgaguucuuuuugaucgugcuguuaauuccugaacccgagaaacagagaaccccacaggauaaccaacuaacuuauguggucaucgcaauacugacgguuguggcugccaccauggccaaugaaaugggcuuccucgagaagacuaagaaggacuuuggacuuggcucaauugcaacucagcagccugagaguaacauccuggauauugacuugcgccccgcuucugccuggacccuguacgcgguagcuacaaccuucaucacuccgaugcucaggcacuccauagaaaauagcucagugaacgucagucugacagccaucgcaaaucaggccacggugcuuauggggcucggaaaggguuggccacugagcaaaauggacauuggcguuccuuugcuggcuaucggguguuacucccaagugaaccccauuaccuuaacugcagcccuacugcuccuugucgcgcacuaugcuaucauuggaccaggccugcaggccaaggcaacacgggaggcccagaaacgugcugccgcagguaucaugaagaaucccaccguagaugggauaaccgugauugacuuggauccuaucccguacgaccccaaauuugaaaagcagcugggccaaguuaugcuccuggugcuuugcgucacacagguguuaaugaugagaacuacgugggcucugugugaggcccucaccuuggcgacaggaccaaucucuacucugugggaaggcaacccugggagguucuggaauaccacaauugccgucagcauggcaaacauauuucgcggauccuaucuagcuggcgccggucuacucuucucaaucaugaagaacaccacuaauacgcggcgagggacaggaaacaccggcgagacucuuggugagaaauggaagaauagacugaacucuuugggcaaaagugaauuucagauuuacaagaggucggggauccaagagguggaucgcacccuggcaaaagaaggaauuaagcggggcgagacagaccaucacgcuguuagcagaggguccgccaaacuccguugguucguggagaggaaucugguaacucccgaaggaaagguggucgauuuaggcugcgguagagggggauggucuuauuacuguggcggucuuaagaacguucgcgaggugaaaggccugaccaaagggggaccuggccaugaagaaccaauccccaugucaacauauggguggaaucucguccgacuacagagcggaguggacguauucuuuacgccuccagaaaaaugcgauacccuguugugugacauaggcgaguccagucccaacccgacuguggaggccgguagaacacugaggguucucaaucuuguggaaaacuggcugaauaacaauacccaguucugcaucaaggucuugaacccuuacaugccaucugugauugagaaaauggaaacucugcagcggaaguacgggggagcgcucguccgcaaucccuuaagcagaaacucaacacacgagauguauuggguguccaacgcuaguggcaauaucguuagcucuguaaacaugauuuccaggaugcugaucaaucgauuuaccaugcggcauaagaaagcaacguacgaaccugauguggaccuuggcucagggacccguaacauaggaauugagagcgagacaccaaaucuggauaucaucgguaagagaauugagaagauaaagcaagagcacgaaacuucguggcacuaugaccaggaccaucccuacaaaaccugggccuaucacggcucuuacgagacaaagcagacugggagugcuuccagcauggucaacggagugguucgccuacucaccaagccgugggaugugaucccuauggucacacagauggccaugaccgacacuacgcccuucggccaacagaggguguuuaaagaaaagguagauacacggacccaggagccaaaagaggguacuaagaaacugaugaagauuaccgcagaaugguuguggaaggagcuggggaaaaagaaaacaccuagaauguguacgcgcgaagaguucgccaggaaggugcgaucaaaugcugcgcucggagccaucuuuaccgacgagaacaaauggaaguccgcacgggaagcuguugaggauucuagauucugggaacuugucgacaaagagaggaaucugcauuuagaaggcaagugcgagacuuguguguauaacaugaugggcaagcgcgagaaaaagauuggggaauuuggaaaagccaaggguagccgugcaaucugguacauguggcugggcgcccgguucuuggaguuugaagcucucggguuccugaaugaggaucacugguuuaguagagaaaacucccuaagcggaguggagggcgagggucuucacaaacugggguacauacucagggaagucucuaagaaggagggaggcgccauguaugcggacgauacagcaggcugggacacccgcaucacucuggaagauuugaaaaaugaggaaaugguuacaaaccauauggagggggagcacaagaaacuggccgaagcuauuuucaagcucaccuaccagaauaaagugguacgagugcaacggcccacaccaagaggaacugucauggacaucauuucaaggcgcgaccagagagguaguggccagguggggaccuauggacuuaacacguucaccaacaugggcgcccaacugauccggcagauggagggugaagggguuuuuaagggcauucagcauuuaacagcaacugaggagguggcuguccaggauuggcuggccagggugggccgugaacgauugucccgcauggcuauaagcggcgacgauugcguaguuaagccccucgacgauagauucgccucugcacugaccgcgcuaaaugacauggggaaagugcggaaggauauccaacagugggagccuucgaggggauggaacgacuggacacaggucccauuuugcucacaccauuuccacgaacuuauuaugaaagauggucgcgugcugguggucccguguagaaaucaggacgagcucaucggccgggccaggaucagccaaggggcuggauggucccugcgagaaacugccugcuugggcaagaguuacgcacagauguggucuuuaauguauuuucaccguagagaucugcgccucgcugccaacgcaauuuguagcgccguucccucccauugggugccuaccucacggacgacauggaguauacacgcgaggcaugaguggaugaccacugaggacaugcuuacaguauggaauagaguguggauccaggaaaacccauggauggaggauaaaacccccgucgaaucuugggaggaaauuccuuaccuggguaagcgcgaggaccaguggugcgggagccuaaucggacugacuucccgggcuaccugggccaagaauauucaaacagcaaucaaccaggugaggucacucauaggcagcgaggaauauacggacuacaugccaucuaugaaacgauucagacgggaggaagaggaagccggcguuuugugguga

SEQ ID NO: 14453 - RNA, 9876 nt, Artificial Sequence
  derived and/or modified CDS sequence (opt3) from DENV-2__GQ252677__SS-prME
accgccggcgugaucauuaugcugauacccacagcuauggcauuccaccucacuacgagaaacggggagccucauaugaucgucagcaagcaggaaaagggaaagucccuucuguuuaaaaccgaggaagguguuaauaugugcacauugauggccauggacuuaggcgagcugugugaagauacuauuaccuacaacugcccacugcucagacaaaaugagccggaggacaucgauuguuggugcaacucuacaucaaccugggugacuuaugggacauguaccgcgacgggagaacaccggcgcgagaagcgaaguguugcucuggugccccaugucggcaugggucuugaaacucguaccgagacauggaugagcuccgagggggccuggaaacacgcacagcggauugaaacuuggauccugaggcauccuggauucaccauaauggccgcuaucuuggcauacacaauuggcaccacguauuuucagcgggugcucaucuucauucugcugacugccguugcuccaucuaugacaaugcgcugcaucggcauaucgaauagagacuuuguggagggggucucaggagguagcuggguggauauugugcucgaacacggcaguuguguuaccacuauggccaagaacaagcccacauuagacuucgagcugaucaaaaccgaagcgaagcagccugcaacgcuuaggaaauacugcauugaggccaaguugaccaauacaacuaccgcuucccgguguccaacacaaggggagcccucucugaacgaggaacaggauaaacgcuuugugugcaagcacagcauggucgaccgaggauggggcaaugguugugggcuauucggaaagggcggcaucgugacuugcgccauguuuaccugcaaaaagaacauggaagggaaaaucgugcagccugagaaucucgaauauacaauugucguuaccccacauuccggagaggagaacgcaguggguaaugauacuggcaagcacgggaaagaaauaaagguaacgccgcagucaaguaucacagaggcugaacugaccggauacggcacugugaccauggaguguagccccagaacaggucuugacuucaacgaaaugguccuguugcaaauggagaauaaagccuggcucgugcauaggcagugguuucuggauuuaccucugccauggcuccccggggcggacauucagggcucuaacuggauccagaaggagacccuuguuacuuucaagaacccucacgccaaaaagcaagauguggucgugcugggaucccaggaaggcgcaaugcacacagcuuugacgggggccaccgagauacagaugucaagcggaaaucuacuguuuacuggucaucucaaaugccggcugcguauggacaaacuucaacugaaaggcaugaguuauucuauguguacagggaaguucaagguaguuaaagaaauugcugagacccagcacggaacaaucgugguccgcgugcaguacgagggcgacgguuccccaugcaagauccccuucgaaauuauggauuuggagaaaagacauguccucgggaggcugaucacugugaacccgauuguuaccgaaaaggacagcccugugaauauagaggccgaacccccauuuggcgauucguacaucauuaucggaguagagccuggccaguuaaaacugucuugguucaagaagggguccucaaucggacaaauguuugagacgaccaugcggggugcaaaacgaauggccauucuaggcgacacagcuugggauuucgggagucucggaggcgucuuuacuagcauagguaaggcgcugcaccagguguucggggcaaucuauggcgccgcuuuuuccggaguuucuuggaccaugaaaauucuuaucggcguggucauuacauggaucgggaugaacagccgcucaaccagcuuguccgugagccugguacucgugggaguugucacacuguaccuuggcgugauggugcaggccgacucugguugugucguuucauggaagaauaaagaacugaagugcgggaguggaauauucaucacggauaacgugcauacauggaccgagcaguauaaguuucaacccgaaagcccauccaaauuggcaucugccauucagaaggcucacgaggaaggcaucugugguauuagaucggugacuaggcucgagaaucugauguggaaacagaucacacccgaguuaaaccacauacugagcgaaaaugagguaaagcuauccauuaugaccggcgacaucaaagggauuaugcaggccggaaagcggucacuccgcccucaaccaacugaacugaaauacaguuggaagaccuggggcaaggcaaaaaugcuuucuacagagccgcauaaccagacguucuugaucgaugggcccgaaaccgcggagugcccuaauacuaacagagcuuggaauagccuggaggucgaagacuauggauuuggcguguucacaaccaacauauggcucaagcugaaagagaggcaggauguauuuugugacuccaaguuaaugucagccgcaaucaaagacaaucgugccgugcacgcugauauggguuacuggauugaaagcgcccugaacgacacauggaagaucgagaaggcaucuuucauugaggucaaauccugccauuggccaaagagucacacucuuuggagcaacgggguguuggaaucugagaugaucauacccaaaaauuucgcuggaccuguuucccagcacaacuaucggccaggcuaccauacccaaacggccggucccuggcaccucggcaagcuggaaauggauuuugacuucugugaggggacaaccgugguagucacugaagauugcggaaaucgaggcccgucacuaagaaccacaacugcgagugggaaacugauuaccgaguggugcuguaggagcugcacacucccuccacugcgcuaccggggagaggacggcuguugguaugguauggaaaucagaccccuuaaggagaaggaagagaacuugguaaauucgcuggugacggccgggcauggacagaucgauaacuuuuccuuaggcguccucgguauggcucuguuccuugaagagaugcugaggacccgcguuggcacuaaacacgcaguguugcucguagccgugucuuuuaugacacugauuaccgggaauaugagcuuccgagaccuaggacgggucauggugaugguuggcgcugccaugacugaugacaucgggaugggagugacauaccuggcacuccuggcggccuuuaagguccguccuaccuucgcugccggccuuuugcugagaaaauuaacgucaaaggagcucaugaugacuaccauugguauagugcugcuuagucaguccacaauccccgaaaccauucuggagcuaacugaugcacucgcucuggggaugaugaucuugaaaauuguuaggaacauggaaaaguaucaacuggccgugacaaucauggcaauauuaugcgucccaaaugccguaauccuccagaacgcuuggaaggugucuuguaccauucuggcggccguuagcguguccccucuucuguugacaucaagccagcagaaagcagacuggaucccccucgcucugacuauuaagggacuaaauccaaccgccaucuuucugacgacacuuagucgcaccaacaaaaagcggucuuggccgcucaaugaggccauaauggcugucggcaugguguccauucuggcaagcucguugcugaaaaacgauaucccuaugacuggccccuuaguagccgggggacuccugaccgugugcuacguccuuacagguagaucagcggaccuggaauuggagagggcugccgacguucgaugggaggaucaagcagaaaucucuggcaguuccccaauucucagcauaacuaucucugaggacgggagcauguccauuaagaaugaagaggaggaacagacccugacgauccuaauucgcacaggacugcuugugaucucaggccucuuccccgugaguauaccuaucaccgccgcugcaugguaucugugggaggucaaaaagcagcgggccgguguguugugggauguuccaagucccccuccgguagggaaggcggaauuagaggacggagcuuacagaauuaaacagaagggcauccugggcuauucucaaauuggggccggaguguacaaagaagguacuuuucauacaauguggcacgucaccaggggcgcagugcucaugcacaaggggaaacguaucgagccauccugggccgauguucgcaaggaccugauaucauacggaggcgguuggaaacuugagggggaauggaaagagggagaagaggugcagguccuggcuuuggaacccggcaagaacccucgggccgugcagacuaaaccaggccuauucaagacaaacaccgggacgauuggagcaguaagucuggauuuuagccccgguacuuccggcucuccuaucgucgacaaaaaggggaaggugguuggacucuauggcaaugguguggucaccagaucggggacauacgugagcgcuaucgcccagaccgagaaaucaauugaggauaacccggaaaucgaggacgauauauucaggaagaaacgacugacaauuauggaccuucaucccggagcgggcaagacuaaacgguauuuaccagccaucguucgcgaagcaauuaagagaggccugaggacccucaucuuggcuccuacgcggguggucgccgcugagauggaagaggcacugcgagggcuccccauaagauaccaaacaccagccauucgcgccgagcacacuggaagggaaaucguggaucugaugugucaugcuaccuucacaaugcgucuucuguccccuguacgggugcccaauuauaacuugaucauuauggacgaggcgcacuuuaccgacccagcaaguaucgccgcuagagguuacauuucuacuaggguugaaaugggcgaggccgcagggauauucaugaccgccacaccgccuggaagccgcgaucccuuuccacaguccaaugcucccaucauggacgaggaacgagagauuccugaaagaucauggaacucuggccaugagugggucacggauuucaaggguaaaacugugugguuugugccaagcaucaaggcggggaaugacaucgccgcaugccuacggaaaaacggaaagaaagucauucagcugaguaggaagaccuucgauuccgaauauauaaagacacgcaccaaugacugggauuuuguagugacuacagacaucagcgagaugggcgcuaacuucaaagccgagcguguuauugaucccagacgguguaugaagccugugauccucaccgacggcgaagagagggucauuuuagcagggccgaugccagugacgcacucuucagccgcucaacgccgaggaagaaucggucggaaucccaaaaacgaaaaugaucaguacauauacaugggcgagccucuggaaaacgacgaggacugcgcccacuggaaggaggcgaaaaugcuucuggauaauaucaacacucccgaagggauuaucccauccauguuugagccugaaagggagaagguugacgcaauugauggagaauaucgccucagaggcgaggccaggaaaacauucguggacuugaugcggcguggugaucugcccgucuggcucgcuuaccgcguggccgcugaggggaucaacuaugcagaccgaagaugguguuuugauggcauaaagaauaaccagauucuggaagagaauguagaaguggagaucuggaccaaggagggagaaaggaagaaacuuaaaccacgguggcuagacgcccgcauuuacagugauccucuggcuuugaaagaguucaaagaguucgccgcaggcagaaagagcuuaacccugaaccucaucacugagauggggaggcugccgacauuuaugacccagaaggcgcggaaugcccuugacaaccuggcuguucuccauacagccgaagcaggaggucgagcuuauaaucacgccuugucggagcugcccgagacucuagaaacgcugcuccuucugaccuuauuggcaacagucacuggcgggauauuccuguuucucaugucuggaaaaggcaucgguaagaugacccuggggaugugcugcauuaucacagccuccauucuucugugguacgcucaaauccagccacauuggauagcggccagcauuauccucgaguucuuuuugaucgugcuguuaauuccugaacccgagaaacagagaaccccacaggauaaccaacuaacuuauguggucaucgcaauacugacgguuguggcugccaccauggccaaugaaaugggcuuccucgagaagacuaagaaggacuuuggacuuggcucaauugcaacucagcagccugagaguaacauccuggauauugacuugcgccccgcuucugccuggacccuguacgcgguagcuacaaccuucaucacuccgaugcucaggcacuccauagaaaauagcucagugaacgucagucugacagccaucgcaaaucaggccacggugcuuauggggcucggaaaggguuggccacugagcaaaauggacauuggcguuccuuugcuggcuaucggguguuacucccaagugaaccccauuaccuuaacugcagcccuacugcuccuugucgcgcacuaugcuaucauuggaccaggccugcaggccaaggcaacacgggaggcccagaaacgugcugccgcagguaucaugaagaaucccaccguagaugggauaaccgugauugacuuggauccuaucccguacgaccccaaauuugaaaagcagcugggccaaguuaugcuccuggugcuuugcgucacacagguguuaaugaugagaacuacgugggcucugugugaggcccucaccuuggcgacaggaccaaucucuacucugugggaaggcaacccugggagguucuggaauaccacaauugccgucagcauggcaaacauauuucgcggauccuaucuagcuggcgccggucuacucuucucaaucaugaagaacaccacuaauacgcggcgagggacaggaaacaccggcgagacucuuggugagaaauggaagaauagacugaacucuuugggcaaaagugaauuucagauuuacaagaggucggggauccaagagguggaucgcacccuggcaaaagaaggaauuaagcggggcgagacagaccaucacgcuguuagcagaggguccgccaaacuccguugguucguggagaggaaucugguaacucccgaaggaaagguggucgauuuaggcugcgguagagggggauggucuuauuacuguggcggucuuaagaacguucgcgaggugaaaggccugaccaaagggggaccuggccaugaagaaccaauccccaugucaacauauggguggaaucucguccgacuacagagcggaguggacguauucuuuacgccuccagaaaaaugcgauacccuguugugugacauaggcgaguccagucccaacccgacuguggaggccgguagaacacugaggguucucaaucuuguggaaaacuggcugaauaacaauacccaguucugcaucaaggucuugaacccuuacaugccaucugugauugagaaaauggaaacucugcagcggaaguacgggggagcgcucguccgcaaucccuuaagcagaaacucaacacacgagauguauuggguguccaacgcuaguggcaauaucguuagcucuguaaacaugauuuccaggaugcugaucaaucgauuuaccaugcggcauaagaaagcaacguacgaaccugauguggaccuuggcucagggacccguaacauaggaauugagagcgagacaccaaaucuggauaucaucgguaagagaauugagaagauaaagcaagagcacgaaacuucguggcacuaugaccaggaccaucccuacaaaaccugggccuaucacggcucuuacgagacaaagcagacugggagugcuuccagcauggucaacggagugguucgccuacucaccaagccgugggaugugaucccuauggucacacagauggccaugaccgacacuacgcccuucggccaacagaggguguuuaaagaaaagguagauacacggacccaggagccaaaagaggguacuaagaaacugaugaagauuaccgcagaaugguuguggaaggagcugaggaagaagaaaacaccucgcauguguacgagggaagaguucgcccgaaaggugcggucaaaugcugcgcucggggccaucuuuaccgacgagaacaaauggaaguccgcaagagaagcuguugaggauucuagguucugggaacuugucgacaaagagcgcaaucugcauuuagaaggaaagugcgagacuuguguguauaacaugaugggcaagcgugagaaaaagauuggcgaauuugggaaagccaagggaagccgggcaaucugguacauguggcugggugccagauucuuggaguuugaagcucucggcuuccugaaugaggaucacugguuuaguagggaaaacucccuaagcgggguggagggagagggccuucacaaacuggguuacauacuccgcgaagucucuaagaaggaagggggagccauguaugcggacgauacagcaggcugggacacccgaaucacucuggaagauuugaaaaaugaggaaaugguuacaaaccauauggagggcgagcacaagaaacuggccgaagcuauuuucaagcucaccuaccagaauaaagugguacgggugcaaagacccacaccaagggggacugucauggacaucauuucacgcagagaccagcggggaaguggucaggugggcaccuaugggcuuaacacguucaccaacaugggagcccaacugaucaggcagauggagggcgaagguguuuuuaaggggauucagcauuuaacagcaacugaggagguggcuguccaggauuggcuggcccgugugggacgagaacgcuuguccagaauggcuauaagcggcgacgauugcguaguuaagccccucgacgaucgguucgccucugcacugaccgcgcuaaaugacaugggcaaagugaggaaggauauccaacagugggagccuucgcgcggguggaacgacuggacacaggucccauuuugcucacaccauuuccacgaacuuauuaugaaagauggaagagugcugguggucccgugucggaaucaggacgagcucaucgguagggcccgaaucagccaaggcgcuggguggucccugcgugaaacugccugcuugggaaagaguuacgcacagauguggucuuuaauguauuuucacagacgcgaucugcggcucgcugccaacgcaauuuguagcgccguucccucccauugggugccuaccucaaggacgacauggaguauacacgcgagacaugaguggaugaccacugaggacaugcuuacaguauggaaucgcguguggauccaggaaaacccauggauggaggauaaaacccccgucgaaucuugggaggaaauuccuuaccugggcaagcgggaggaccaguggugcgguagccuaaucgggcugacuuccagggcuaccugggccaagaauauucaaacagcaaucaaccaggugcgaucacucauaggaagcgaggaauauacggacuacaugccaucuaugaaaagauuccggagggaggaagaggaagccggcguuuugugguga

SEQ ID NO: 14454 - RNA, 9876 nt, Artificial Sequence
  derived and/or modified CDS sequence (opt3) from DENV-2__FJ898438__SS-prME
accgugggaguaaucguuaugcugauuccaacagccauggcuuuccaccucacuacgagaaacggggagccucauaugauagugggaaggcaggaaaaggguaaaagccuucuguuuaagaccgaggacggcguaaauaugugcacauugauggcaaucgauuuaggggaacugugugaggacacuauuaccuacaaaugcccacuucuccggcaaaacgaaccggaggauaucgacuguuggugcaauuccacaucuaccugggugacuuauggaacauguucaaccacgggcgagcaccgccgagaaaagcguagugucgcccuggugccccauguugguauggggcuugagacuagaaccgaaacauggaugagcuccgagggagcguggaaacacgugcagaggauugagacuuggauccugcggcauccuggcuucaccauaauggcugccaucuuggcauacacaauuggcaccacgcacuuucagcgcgcccucaucuucauucugcugacugcugucgcaccaucuaugacaaugagaugcaucgggauaucgaacagggauuuuguggaaggaguaucagguggcagcuggguugacauugugcucgagcacgggaguugugucaccacuauggccaagaauaagcccacauuagauuucgaacugaucaaaaccgaggcuaagcagccugccacgcuucggaaauauugcauugaagcgaaguugaccaacacaacuaccgagucccgcuguccaacacaaggagagcccucucugaaugaagaacaggacaaacgauuuaucugcaagcauagcaugguggauagaggcugggguaacggguguggacuauucggcaagggcgggaucgugacuugcgcaauguuuaccugcaaaaagaauauggaaggaaaagucguucagccugagaacuucgaauacacaauugugauaaccccacacuccggugaggagcaugccguaggcaaugacacugggaagcacggaaaagaaaucaagauuacgccgcagucaaguaucacagaggcugaacucaccggcuaugguacugugaccauggaguguagccccaggacagggcuggauuuuaacgaaaugguccuucugcaaauggaggacaaagccugguuggugcaccggcagugguuccucgaucugccuuuaccauggcugcccggcgcagacacccagggaucuaauuggauacagaaggagacucucguuacauuuaagaacccucaugcuaaaaagcaagacguggucgugcuuggcucccaggaaggggccaugcacacggcgcugaccggagccacugagauucagaugucaagcgguaauuugcuauucacaggccaucugaaaugccgucuccgcauggauaagcugcaacuuaaagggaugaguuacucuauguguaccggaaaguucaagaucguaaaagaaaucgcagagacacagcacggcacuauuguuaucagagugcaguaugagggugacggguccccaugcaagauucccuuugaaauaaccgaucuggagaaaaggcaugucuugggccggcucaucacggugaacccgauugucaccgaaaaggacagcccugugaacaucgaggcugaacccccauucggagauucguacaucauuauaggcguugagccugggcagcugaaauuaaauugguuuaagaagggaucuuccaucggucaaauguucgagacaacuaugcgaggcgccaaacgcauggcuauucugggggacaccgccugggauuuuggaucacuaggcgguguguucacaaguaucgggaaggcacuccaccagguauuuggcgccauuuacggagcugcguucagcggcgucuccuggacuaugaaaauccugauaggggugaucauuaccuggaucggaaugaacucuagaagcacgucacuuaguguuuccuuggugcuggucggcgugguaacacucuaucugggugcaauggugcaggccgacagcggguguguugucucuuggaagaauaaagaacuuaagugcggaucaggcauuuuuaucaccgauaacgugcacacuuggacagagcaguacaaguuccaacccgaaaguccaagcaaacuggcuuccgccauacagaaggcacaugaggaagguauuuguggcaucaggucugugacccgguuggagaaucucauguggaaacagauuacucccgagcugaaccacaucuuaucggaaaaugaggucaagcugaccauaaugacaggggacaucaaaggaauuaugcaggccggcaagcgcagccuaagaccucaaccaacggaacucaaauauuccuggaagaccugggggaaggcuaaaaugcugucaacugagagucauaaccagacauuucuuaucgauggaccggaaaccgccgagugccccaauucuaacagggcauggaauagcuuggagguugaagacuacggcuucgguguguuuacaacuaacauuuggcugaagcuccgugagaaacaggacguguucugugauuccaagcugaugucagcggcuaucaaagacaaucgggccguacacgcagauaugggguauuggauagaaagcgccuuaaacgacaccuggaagauggagaaggcuucuuucauugaggucaaauccugccacuggccuaagagucauacgcuguggagcaauggagugcuugaaucugagaugaucauccccaagaacuuugccggccccguuucccagcacaacuaccgaccugguuaucauacacaaaccgcaggcccauggcacuuggggaagcucgaaauggauuucgacuuuugugagggaacuaccguggucgugacagaagauugcggcaauagagggcccucacugaggacuaccacagcuaguggaaaacuaauuacggaguggugcugucgcagcugcacccugccgccucuccgguacagaggcgaggacgguuguugguacgggauggaaaucaggccacugaaggagaaggaagagaaccuuguuaauucguuggugacugccggacauggccagauugauaacuucucccuggguguauuaggcauggcgcucuuucuggaagagaugcuucgcacacgaauagggaccaaacacgccauccuguuggucgcugcaucuuucgugacucucauuacaggaaauaugagcuuucgggaccugggccgugugauggucaugguuggggccaccaugacggaugacaucggaaugggcgugacuuaucuagcucugcucgccgcauucaagguaagacccaccuuugcggccggucugcuuuugaggaaacugacaucaaaggaguuaaugauggcuaccauugggaucgcccuccugagucaguccacuauaccugaaacaauccuugagcugaccgaugcacuagcucucggaaugauggugcugaaaauuguccgcaacauggaaaaguaccaauuggccgugacaaucauggcaauuucuugcguucccaaugccgugauccugcagaacgcuuggaaggucagcuguacuauauuagcggccguguccguuucaccacuccugcuuaccagcagucagcagaaagcagacuggauuccucuggcuuugacgaucaagggccucaaucccacagccaucuuccugaccacucuaucucggaccuccaaaaagagaagcuggccacugaacgaggccgugauggcugucggcaugguaucgauucuugcaucaucucuccugaaaaaugacauaccgaugacagggccuuugguggccggaggucuguuaacuguuugcuaugugcucaccggcaggagugcggaucuggaacuugagcgagcugccgacgucaagugggaggaucaagcagaaaucuccgggagcucucccauucugagcaucacgauuuccgaggacggaucaaugaguaucaaaaacgaagaggaggaacagacauugaccauacucauccgcacuggccugcuagugauuagcgguguauuuccagugucuauccccauuacagccgcugcaugguaccugugggaggucaagaagcagcgggccgggguucuuugggaugugccuuccccacccccugugggaaaagcggaacucgaggacggcgcuuauagaaucaagcagaggggcauacugggguacucacaaauuggagccggugucuauaaagaaggcaccuuccacacuauguggcaugugacacguggggcaguuuugaugcaccgcggaaagcggaucgagccgaguugggccgaugucaaaaaggacuuaaucagcuacggcgguggguggaagcuggagggagaauggaaagagggcgaagaggugcagguccucgcucuggaaccaggcaagaaucccagagccgugcagaccaaaccugggauuuuuaagacgaacacuggaaccaucggugcaguuucccuugauuucucuccaggcacaucggggagccccauaguggacaggaaaggaaaggucgugggccuguacgguaaugggguagucacccgaucaggagcuuauguguccgccauugcgcagacagagaagaguaucgaggauaacccugaaauugaggacgauaucuuccggaaaaagcgcuugacuauaauggaccuacauccgggcgccggcaaaaccaagagauaccugcccgcaauuguuagggaagcuaucaaacgggggcuccgaacgcugauccuugccccaacaagaguggucgcugcagagauggaagaggccuuacgcggacugccuauuagguaucaaacucccgccaucaagaccgagcacacaggucgugaaauuguggaccucaugugucaugcuaccuuuacuaugcgguugcugucuccaguuagagugccuaacuacaaucucauaaucauggaugaggcgcacuucaccgaccccgcaagcauugccgcuaggggcuauaucuccacacgcgucgaaaugggggaggccgcaggaaucuuuaugacggccacuccaccgggcucacgagauccuuucccccagucuaacgcuccaauuauggacgaggaaagagagauacccgaacggagcuggaauaguggucacgagugggugaccgauuuuaaggggaaaacaguaugguucgugccuuccaucaaggcgggaaacgacauugccgcaugccugaggaaaaauggcaagaaaguuauccagcuuagccgcaagaccuuugauucugaauacgucaagacucgugcuaacgacugggauuucguggugacaaccgacauuucagagaugggcgccaauuuuaaagcagagagagucaucgauccacggagguguaugaagcccguaauacugacggacggggaagaacgcgugaucuuggccggaccuaugccgguuacucauuccagugcugcccaacgaagaggucggauuggcaggaaccccaaaaaugaaaacgaccaguauaucuacaugggggagccccuagaaaaugaugaggacugcgcgcacuggaaggaggcaaaaaugcugcucgauaacauuaauacaccugaaggaaucauacccagcauguucgagccagaacgcgagaagguggacgccauugauggcgaauacagauuaaggggugaggcucggaaaaccuuugucgaccugaugcgucgcggggaucuuccuguguggcuggccuauaagguugcugcagagggcaucaacuacgccgaccgaaagugguguuucgauggaauuaaaaauaaccagauccucgaagagaacauggaaguggagauauggaccaaggagggcgaaaggaaaaaguugaaacccagguggcuggacgcucggaucuauucggauccacucgcccugaaggaguucaaggaauuugcagcggggcgcaaaucucuuacucuaaaucugauuacagagaugggaagauugccuaccuucaugacacagaaggccaggaacgcuuuagacaaucuggccguccuccauacugcagaagcugguggccgggccuacaaccacgcacuguccgagcuuccggagacgcuggaaacccucuugcugcuaacacugcucgccacugugaccgggggaaucuuucuuuuccugaugagcggcaaagguauugggaagaugacauuaggcaugugcugcaucauaaccgcuucaauuuugcugugguaugcgcaaauccagccccacuggaucgccgcaaguauuauccucgaguuuuuccugauaguacuucugauuccagaaccugagaaacagcgaacuccccaggauaaucaacucacguacgugguuaucgcuauuuugaccgucguggccgccacaauggcaaacgaaaugggauuucuggagaagacuaagaaagacuuaggccuagggucuaucaccacacaggaguccgaaagcaauauacuggacaucgaucucagaccagcuucagccuggacccuuuaugcgguggcuacuacauucgucacgccuaugcugcgccauaguauugagaacagcuccguuaaugugucuuugaccgccaucgcaaaccaggccacuguacugaugggacucgguaagggcuggccccugagcaaaauggacauuggggugccgcuucucgcuaucggauguuacucccaggucaauccaauuacacugaccgcagccuugcugcuauuaguggcgcacuacgcuaucauaggcccuggucugcaagccaaggcaaccagggaagcccagaaacgggcugccgcagggauuaugaagaaccccacaguugauggcaucacugugaucgaccucgagccaauucccuaugauccuaaguuugaaaaacagcuuggacaggucaugcuguugauacugugcguaacgcaagugcucaugaugcguaccacaugggcucugugugaggcccuuacuuuagcgaccggcccgaucucaacacugugggaggggaaucccggaagauucuggaacaccacuauugccguuucuauggcaaauaucuuuaggggcaguuaccucgcuggugccggguugcuguucucgauuaugaagaacacgacaaauacccgccggggaacuggcaacaucggugaaacccuaggcgagaaauggaaaagccgacugaacgcacucgggaaauccgaauuucagauauauaagaaaucuggaauccaggagguggacagaacacuugcuaaggagggcauuaagagaggggaaacugaucaucacgccgucucacgcggaagcgccaaacugcggugguucguggagagaaauauggucaccccagaaggcaaggugguugacuuggguugcgggcguggaggcugguccuacuauugugguggccugaaaaacgugagggagguaaaggggcucacaaaaggaggcccugggcaugaggaaccaaucccuaugaguacguacggauggaaucuggugcgguuacaaucuggcgucgauguuuucuuuaccccacccgagaagugcgacacucuucugugugauauuggugaaagcucaccuaacccaacaaucgaggcggggcgcacccuccgagugcuaaaucuggucgaaaacugguugaauaacaauacucaguucugcauaaaggugcugaaccccuauaugccguccguaauugagaaaauggaaacacuccagagaaaguacggaggcgcucuugugaggaauccucugagucggaacagcacccacgagauguacuggguuucuaaugcaacgggcaacaucguguccucagucaauaugaucagccgcauguugauuaacagauuuaccaugaaacacaagaaagccacauaugagccagacguggaucuggggucgggaacuaggaacauagguaucgaaucugagauucccaaucucgacaucauuggcaagcgaaucgaaaagauaaaacaggagcaugaaaccaguuggcacuacgaccaagaucauccuuauaagacaugggcuuaccacggguccuaugagacuaaacagaccggaagcgccucauccauggucaacggcgugguucgguuacugacaaagccaugggacguagugcccauggucacccagauggcaaugacugauacgacaccguucggucagcaacguguguuuaaagagaagguugacaccagaacucaggaaccuaaggaggggaccaaaaagcuaaugaaaaucacagccgaauggcuguggaaggagcuaggcaaaaagaaaacgccccgcauguguaccagggaggaguucacucggaaggugagaucuaaugcugcgcucggcgccauuuuuacagaugagaacaaguggaaaagcgcacgcgaagcugucgaggacggcagguucugggaacugguggaucgagagcggaauuugcaccuggaggggaagugcgaaaccuguguauacaacaugaugggaaaaagagagaagaaacucggugaauuuggcaaggccaaggggaguagggcaaucugguauauguggcuuggagcccgcuuccuggaguuugaggcuuuaggcuuccugaaugaggaccauugguuuucccgugguaacagcuugucugggguggagggagaaggccuccaccggcugggcuacauucuaagagauguugggaaaaaggagggaggugccauguacgcggacgauacugcaggcugggacacaaggaucacccuugaagaccugaaaaaugaggaaauggucacaaaccauaugaagggggagcacaaaaagcucgccgaggcuauuuucaagcugacuuaucagaauaaaguggugcgcguccagcgaccaaccccucggggaacgguuauggauauaaucucaagaagggaccaacgcggcaguggucagguggggaccuacggauugaacacauucacuaauauggaagcccagcugauuagacaaauggagggcgaaggcaucuuuaaguccauccagcaucucaccgcaacagaggagauugcuguacagaacuggcuugcccggguggggagggaacgucugagccgaauggcuauaucuggagaugacugcgucgugaaacccaucgaugaccgcuucgccucggcauuaacugcgcugaaugauauggguaagguuagaaaagacauucagcaaugggagccaucacggggcuggaacgauuggacccaggugcccuuuugcagccaccacuuccaugaauuggucaugaaggacgggagggugcucguaguuccuugucgcaaccaggaugagcugaucggcagagcacggauuucccagggagcugguuggagucuaaaggaaacggccugccuugggaaaucuuaugcacaaauguggacacugauguacuuucacaggcgagaccuccgucuggcugccaaugcaaucuguagcgccgugccaucccauugggucccgaccucaagaacuacauggaguauacacgcgaagcacgaguggaugaccacugaggauauguuggcuguguggaaccgcguguggauccaggaaaaucccuggauggaggacaaaaccccugucgaaucuugggaggaaguuccauauuuaggaaagcgggaggaccaguggugcggcagccugauuggccucacauccagggccacgugggccaaaaacauccagaccgccauuaaucaagugagaucacuuaucgggaacgaggaauacacugauuauaugcccagcaugaagcgcuuccggagggaggaagaggaagcuggaguacugugguga

SEQ ID NO: 14455 - RNA, 9876 nt, Artificial Sequence
  derived and/or modified CDS sequence (opt3) from DENV-2__GQ199893__SS-prME
accgccggagugaucgucaugcugauucccacggcuauggcauuccaccucacuacgcggaauggggagccucauaugauaguuggaaggcaggaaaaggguaaaagccuucuguuuaagaccgaggacggcgugaauaugugcacauugauggccaucgauuuaggggaacugugugaggacacuauuaccuacaaaugcccacuacuccggcaaaacgaaccggaggauaucgacuguuggugcaauuccacaucuaccuggguaacuuauggaacauguaccacgacuggcgagcaccgccgagaaaagcguucaguggcgcuggucccccauguggguauggggcuugagaccagaacagaaacuuggaugaguagcgagggagcuuggaaacacguucagaggauugagaccuggauccugcggcauccuggcuucacaauaauggccgcaaucuuggccuacaccauuggcacgacucacuuucagaaggcucucaucuucauucugcugacagcaguggccccauccaugaccaugcgcugcaucgggauaucuaacagagauuuugucgaaggagugucggguggcucauggguugacauuguucucgagcacgggagcugugugacuacaauggcuaagaauaaacccaccuuagauuucgaacugaucaagacggaggccaaacagccugcgacccuuaggaaguauugcauugaagcaaaauugacaaacacuaccacagagagucgguguccaacucaaggagagcccucccugaaugaggaacaggacaagcgcuuuaucugcaagcauucuauggucgaucgaggcugggguaacggguguggacuauucggcaaaggcgggaucgugaccugcgccauguuuacaugcaagaaaaauauggaaggaaaggugguccagccugagaaccucgaauacaccauuguuauaacuccacacagcggugaggagcaugcugugggcaaugacacggggaaacacggaaaggaaaucaaaauuacaccgcaguccucaaucaccgaggccgaacugacuggcuaugguaccguaacaauggaguguagucccagaaccgggcuugauuucaacgaaauggugcuguugcaaauggaggacaaggcauggcucguccacaggcagugguuucuggauuuaccucugccauggcuccccggcgcugacacucagggaagcaauuggauacagaaggagacacuugugacguucaaaaacccucaugccaagaaacaagacguugugguccugggcucucaggaaggggcgaugcacaccgccuugacuggagcaacagagauucagauguccucagguaaucuacuguuuaccggccaucucaagugccggcugcguauggauaaacuucaacugaaggggaugagcuacaguauguguacaggaaaguucaaaaucgugaaggaaaucgcugagacucagcacggcaccauuguaauccgcguucaguaugagggugacgggucuccaugcaaaauucccuucgaaauaacggauuuggagaagagacaugugcucggcaggcugaucaccgucaacccgauugugacagaaaaagacuccccugucaacaucgaggccgaacccccauuuggagauagcuacaucauuauaggcguggagccugggcaguuaaagcugaauugguucaagaaaggaucgucuaucggucaaauguuugagacuaccaugcggggcgcuaagcgaauggccauucuaggggacacagcaugggauuucggaucccucggcgguguuuuuacuucaaucgggaaagcccugcaccagguguucggcgcuauuuacggagcggcauuuaguggcguaagcuggaccaugaagauccuuauaggggucaucauuacguggaucggaaugaacucccgcucuacuagcuugucagugagucugguucucgugggcgucgugacccuguaucuuggugccaugguacaggcugacuccgggugugugguuagcuggaaaaauaaggaacugaagugcggaucuggcauuuucaucacugauaacguccacacauggaccgagcaguacaaauuucaacccgaaucaccaaguaaguuggccagcgcaauacagaaagcccaugaggaagguauuuguggcaucagauccgugacuaggcucgagaaucugauguggaagcagauuacccccgaguuaaaccacauccugucugaaaaugaggugaaacuaacaauaaugacgggggacaucaagggaauuaugcaggcuggcaaacggucgcuccgcccucaaccaaccgaacugaaguauagcuggaagacuugggggaaagccaagaugcuuuccacagagucacauaaccagaccuucuugaucgauggaccggaaacagcagagugccccaauacuaacagagcguggaauagucuggaggucgaagacuacggcuuugguguuuucaccacgaacauuuggcucaaacugagggagaagcaggacguguuuugugauucuaaauuaaugagcgcugccaucaaggacaaucgugcagugcacgccgauaugggguauuggauagaauccgcucugaacgacacauggaagauggagaaagccucauucauugagguaaagagcugccacuggccuaaaucucauacccuuugguccaauggagucuuggaaagugagaugaucaucccaaagaacuucgcaggccccgugagccagcacaacuaccggccugguuaucauacucaaaccgcuggcccauggcaccucgggaaacuggaaauggauuuugaccuaugugagggaacaacuguuguggucaccgaagauugcggcaaucgagggcccucucugagaacaacgaccgccuccggaaagcucauuacugaguggugcuguaggucaugcacacugccgccucuucgcuaccggggcgaggacgguuguugguacgggauggaaaucagaccauugaaggagaaagaagagaaccuggugaauaguuuaguuaccgcgggacauggccagauugauaacuucagccucggugugcugggcauggcccuuuuucuggaagagauguugaggacucgcauagggacaaagcacgcuauccuccugguagcagucucguucgugacccuaauuacgggaaauauguccuuucgagaccugggccgggugauggucaugguuggggccacuaugaccgaugacaucggaaugggcgugacauaucucgcucugcuugccgcauucaaaguacgucccaccuuugcggccgguuugcuguuaagaaagcucacuucuaaagagcugaugauggcuacaauugggaucgcccuucugagccagucaaccauaccugaaacaauccuagagcucacugaugcacuggcuuugggaaugauggugcugaagauugucaggaacauggaaaaguaccaauuagccgugaccaucauggcaauuaguugcguucccaaugccgugauccuccagaacgcuuggaaagucuccuguacgauacuggcggccgugucuguuagcccacuucuguugacauccucacagcagaaggcagacuggauuccucucgcucugaccaucaaaggccuaaaucccacugccaucuuccugaccacacuuagccgcacaaguaagaaacggucuuggccacucaacgaggccauuauggcugugggcauggucuccauacuggcaagcucguugcugaagaaugacaucccgaugaccgggccuuuaguagccggaggucuccugacggugugcuauguucuuacaggcagaucagcggaucuggaauuggagagggcugccgacgugaaaugggaggaucaagcagaaauuucugggaguucccccauccucagcauuaccaucucugaggacggaagcauguccauaaagaacgaagaggaggaacagacucugacaauccuaauucgaaccggccugcuugucaucucagguguguuuccaguaaguauucccaucacugccgcugcaugguaccucugggaggugaagaaacagcgcgccgggguccugugggauguuccuagcccacccccuguggaaaaggcggaguuggaagacggagcuuaucggauaaaacagagaggcauuuuaggcuacucucaaaucggggccggaguguauaaggaggguacauuccacaccauguggcaugucacgaggggcgcagugcugaugcaccgugggaaacgcaucgagccguccugggccgauguuaagaaggaccucauuucauacggaggcgguuggaaacuggaaggggaguggaaggaaggagaggaaguacaggugcuugcucuggagccaggcaaaaauccccgggccguccagacuaagccuggcaucuuuaaaaccaacacagggaccauaggagcagugaguuuggauuucagcccagguacauccggcucucccauuguugacagaaaggggaagguggucggacuauacggcaauggugugguaacuaggucgggggcuuaugucagcgccaucgcgcagaccgagaaaucaauugaagauaacccugagaucgaagacgauauauuucgaaagaaacggcugacgauuauggaccuccauccgggagccggcaagacaaaacgcuaccugcccgcaaucgugagagaggcuaucaagaggggccuucggacuuuaauucuggccccaacccgaguuguggcugcagaaauggaggaggcccucagaggguugccuauccgcuaucaaacacccgccauuaagaccgaacacacuggaagggagauagucgaccugaugugucaugcuaccuucacaaugcgucuccuguccccagugcggguuccuaacuacaaucuuaucauuauggaugaagcgcacuucacggaccccgcaaguaucgccgcuagagguuauaucucuacuaggguggagaugggcgaggccgcagggauuuuuaugaccgccacaccaccgggaagccgcgauccuuucccccaguccaacgcuccaauaauggacgaagaacgagaaauccccgagagaucauggaacucuggccacgaaugggucaccgauuuuaaagguaagacugugugguucguaccuagcauuaaagcggggaacgacaucgccgcaugccugcggaagaauggcaagaaggugauucaguugaguaggaagacauuugauuccgaguacguuaaaacccgcgcuaacgacugggauuucgucgugacgacugacaucagcgagaugggcgccaauuuuaaggcagaacgugugauagauccaagacgguguaugaaacccgucauccuaacagacggcgaggaaaggguaauucuggccgggccuaugccggugacccauucuucagcugcccaacgccgaggaagaaucggucggaacccaaagaaugagaacgaccaguauauuuacaugggcgaaccccucgagaaugaugaggacugcgcgcacuggaaagaagcaaagauguuacuggauaacaucaauaccccugaggggauaauucccuccauguucgaaccagagagggaaaaaguugacgccaucgauggagaguaccgccuuagaggcgaggcuaggaagacuuuuguggaccugaugcggcguggugaucucccugucugguuggccuauaagguggcugcagaagggauuaacuacgccgaccgcaaaugguguuucgauggcaucaagaauaaccagauacuggaggaaaacaucgagguugagauuuggacaaaagaaggagagcgaaagaaacucaagcccagauggcuggacgcuaggaucuauagugauccacuugcccuaaaggaauuuaaagaguucgcagcgggcagaaagagccugaccuugaauuuaauuacagaaauggggcgccugccuacuuucaugacgcagaaagccagaaacgcucucgacaaucuggccgugcuucauaccgcagaggcuggagguagggccuacaaccacgcacugucggagcucccggaaacauuggagacucugcuacugcucacccuucuggccacagucaccggcgggaucuuuuuauucuugaugucuggaaagggcauagguaaaaugacucuggggaugugcugcauuaucacggcuuccauccuccugugguaugcgcaaauucagccccacuggaucgccgcaagcauaauucuugaauuuuuccugaucgugcucuugauuccagagccugaaaagcagcggacaccccaggauaaucaacugacauacguagugaucgcuauauuaacuguugucgccgccaccauggcaaacgagaugggcuuucuagagaagaccaaaaaggaccugggacucggcucaaucaccacucaggaaagugagucuaauauucuugacaucgaucugcgaccagcuuccgccuggacauuguaugcgguggcuacgaccuucgugacuccuaugcugagacauagcauugaaaacucaagugucaauguuagccucacagccaucgcaaaccaggccaccgugcugauggggcuuggaaaagguuggccccucuccaagauggacauuggcguaccgcuguuggcuaucggguguuacucucaggugaauccaauaacccugacagcagccuuacuacugcucgucgcgcacuacgcuauuaucggaccuggccuucaagccaaagcaacucgcgaggcccagaagagggcugccgcagguaucaugaagaaccccacgguggaugggauuaccguuauagaccuggaaccaauccccuaugauccuaaauuugagaagcaguugggccaggugaugcugcucauucugugcgucacacaaguacuuaugaugcggacuaccugggcuuuaugugaggcccugacacucgcgaccggaccgaucagcacuuugugggaaggcaaucccgggcguuucuggaacacgacaauugccguguccauggcaaauaucuuuagaggaucauaccuggcuggcgccggucuacuguucucuauaaugaaaaacaccacuaauaccaggcgcgggacaggaaacaucggcgagacucucggugaaaaguggaaaagucggcuuaacgcacugggcaagucggaguuucagguuuauaaaaagagcgggauucaggagguggaccgaaccuuggcuaaggaaggaaucaaaagaggcgagacagaucaucacgccgucuccagggggucugccaagcugcgcugguucguggaacggaauauggucacgccagagggaaaagugguugaccucggcugcgguagagggggauggucauacuauuguggcggucugaagaacgugcgugaaguaaaaggcuuaaccaaagggggaccuggccaugaggagcccauuccuaugagcacuuacggguggaaucuugugaggcugcaauccggagucgauguauuuuucacaccacccgaaaagugcgacacccuccuaugugauaucggcgagaguucuccuaacccaacuauagaagcgggucggacacugcgcguguugaaucuggucgagaacuggcucaauaacaauacccaguucugcauuaaagugcuuaaccccuauaugccgagcguaaucgaaaagauggaggcucugcagcgaaaauacgggggagcauuggugagaaauccucugucaaggaacuccacgcacgagauguacuggguuaguaaugccaccggcaacaucgugagcucugucaauaugauuucccggaugcucauaaaccgcuuuacaaugaagcacaaaaaggcuacuuaugaaccagacguggauuuaggcucagggaccagaaacaucggaauugagagcgaaauccccaaucuggacauuaucgguaagaggauagagaaaaucaagcaggaacaugagacaucguggcacuacgaccaagaucauccuuauaaaacuugggccuaccacggcucuuaugagaccaagcagacagggagugcauccagcauggucaacggagugguucgacuucugaccaaaccaugggacguagugcccauggucacucagauggccaugacggauacaaccccguucggccagcaacggguguuuaaggaaaagguugacacucguacccaggagccuaaagaagguacaaagaaacuaaugaagauuacggcugaguggcucuggaaagagcuggggaagaaaaagacccccagaauguguacucgcgaagaguucacaaggaaggugcggucaaaugcggccuugggagcaaucuuuaccgaugaaaacaaauggaaguccgcuagagaggccgucgaagacggccgcuucugggagcugguggauagggagcgaaaucuccaccuugaaggcaaaugcgagacuuguguauacaacaugauggggaagcgggagaaaaagcugggagaguuugguaaggcaaaaggcucuagagccauuugguauaugugguuaggggcuagguuccuggaauuugaggccuugggauuccucaaugaggaccauugguuuagccgcggcaacagucuguccgguguggaaggggagggacuacaccgucuuggcuacauccugcgggauguuggcaagaaagaagggggagcgauguacgcagacgauacagccgguugggacaccagaauuacacucgaggaccugaagaaugaagagauggucacuaaccauaugaaaggcgagcacaagaaguuggcugaagccauauucaaacugaccuaucagaauaagguggugaggguccagcgcccaacgccucgagggaccguuauggauaucauuagccggagagaccaaaggggaucuggccagguggguacauacgggcucaacacuuuuaccaauauggaggcacagcuuauccgccaaauggaaggagagggcaucuucaaaucaauucagcaucugacagcuacugaggaaauagccguacagaacugguuagcuagagugggccgggagaggcugagucguauggccaucuccggggaugacugcgucgugaagcccauugaugaccgauucgcaagcgcguugaccgcccucaaugauaugggaaaaguucgcaaggacauccagcaaugggaaccaucuagagguuggaacgauuggacacaggugcccuuuugcucgcaccacuuccaugagcuggucaugaaggacggccgggugcuaguaguuccuuguaggaaccaggaugaacuuauugggcgcgcuagaaucucacagggagccggcuggagccugaaagagacagcaugccucgguaaguccuaugcucaaauguggacccugauguacuuucaccggagggacuugcgauuagccgcaaaugccauauguagugcggugccaccgcauuggguccccacuucucguacaaccuggagcauccacgcuaaacacgaguggaugacuaccgaagauaugcuggccguguggaacagaguguggauucaggagaauccuuggauggaagacaagacaccagucgaguccugggaagagguucccuaucucgggaaacgcgaggaccaguggugcggaucacuuaucggccugacgagucgggcaaccugggccaagaacauucagacugcuaucaaucaagugaggucucuaauaggcaacgaagaguacacagauuauaugccuagcaugaagagauuccgccgggaagaggaagaggccgggguacugugguga

SEQ ID NO: 14456 - RNA, 9876 nt, Artificial Sequence
  derived and/or modified CDS sequence (opt3) from DENV-2__GQ199894__SS-prME
accgccggagugaucgucaugcugauucccacagcuauggcauuccaccucacuacgaggaacggggagccucauaugauaguuggaaggcaggaaaaggguaaaagccuucuguuuaagaccgaggacggcgugaauaugugcacauugauggccaucgauuuaggggaacugugugaggacacuauuaccuacaaaugcccacuacuccggcaaaacgaaccggaggauaucgacuguuggugcaauuccacaucuaccuggguaacuuauggaacauguaccacgacuggcgagcaccgccgagaaaagcguucaguggcgcuggucccccauguggguauggggcuugagacccggacagaaacuuggaugaguagcgagggagcuuggaaacacguucagaggauugagaccuggauccugcggcauccuggcuucacaauaauggccgcaaucuuggccuacaccauuggcacgacucacuuucagaaggcucucaucuucauucugcugacagcaguggccccauccaugaccaugcgcugcaucgggauaucuaacagagauuuugucgaaggagugucggguggcucauggguagacauuguucucgagcacgggagcugugugacuacaauggcuaagaauaaacccaccuuagauuucgaacugaucaagacggaggccaaacagccugcgacccuuaggaaguauugcauugaagcaaaauugacaaacacuaccacagagagucgguguccaacucaaggagagcccucccugaaugaggaacaggacaagcgcuuuaucugcaagcauucuauggucgaucgaggcugggguaacggguguggacuauucggcaaaggcgggaucgugaccugcgccauguuuacaugcaagaaaaauauggaaggaaaggugguccagccugagaaccucgaauacaccauuguuauaacuccacacagcggugaggagcaugcugugggcaaugacacggggaaacacggaaaggaaaucaaaauuacaccgcaguccucaaucaccgaggccgaacugacuggcuaugguaccguaacaauggaguguagucccagaaccgggcuugauuucaacgaaauggugcuguugcaaauggaggacaaggcauggcucguccacaggcagugguuucuggauuuaccucugccauggcuccccggcgcugacacucagggaagcaauuggauacagaaggagacacuugugacguucaaaaacccucaugccaagaaacaagacguugugguccugggcucucaggaaggggcgaugcacaccgccuugacuggagcaacagagauucagauguccucagguaaucuacuguuuaccggccaucucaagugccggcugcguauggauaaacuucaacugaaggggaugagcuacaguauguguacaggaaaguucaaaaucgugaaggaaaucgcugagacucagcacggcaccauuguaauccgcguucaguaugagggugacgggucuccaugcaaaauucccuucgaaauaacggauuuggagaagagacaugugcucggcaggcugaucaccgucaacccgauugugacagaaaaagacuccccugucaacaucgaggccgaacccccauuuggagauagcuacaucauuauaggcguggagccugggcaguuaaagcugaauugguucaagaaaggaucgucuaucggucaaauguuugagacuaccaugcggggcgcuaagcgaauggccauucuaggggacacagcaugggauuucggaucccucggcgguguuuuuacuucaaucgggaaagcccugcaccagguguucggcgcuauuuacggagcggcauuuaguggcguaagcuggaccaugaagauccuuauaggggucaucauuacguggaucggaaugaacucccgcucuacuagcuugucagugagucugguucucgugggcgucgugacccuguaucuuggugccaugguacaggcugacuccgggugugugguuagcuggaaaaauaaggaacugaagugcggaucuggcauuuucaucacugauaacguccacacauggaccgagcaguacaaauuucaacccgaaucaccaaguaaguuggccagcgcaauacagaaagcccaugaggaagguauuuguggcaucagauccgugacuaggcucgagaaucugauguggaagcagauuacccccgaguuaaaccacauccugucugaaaaugaggugaaacuaacaauaaugacgggggacaucaagggaauuaugcaggcuggcaaacggucgcuccgcccucaaccaaccgaacugaaguauagcuggaagacuugggggaaagccaagaugcuuuccacagagucacauaaccagaccuucuugaucgauggaccggaaacagcagagugccccaauacuaacagagcguggaauagucuggaggucgaagacuacggcuuugguguuuucaccacgaacauuuggcucaaacugagggagaagcaggacguguuuugugauucuaaauuaaugagcgcugccaucaaggacaaucgugcagugcacgccgauaugggguauuggauagaauccgcucugaacgacacauggaagauggagaaagccucauucauugagguaaagagcugccacuggccuaaaucucauacccuuugguccaauggagucuuggaaagugagaugaucaucccaaagcacuucgcaggccccgugagccagcauaacuaccggccugguuaucacacucaaaccgcuggcccauggcaucucgggaaacuggaaauggauuuugaccuaugugagggaacaacuguuguggucaccgaagauugcggcaaccgagggcccucucugagaacaacgaccgccuccggaaagcucauuacugaguggugcuguaggucaugcacacugccgccucuucgcuaccggggcgaggacgguuguugguacgggauggaaaucagaccauugaaggagaaagaagagaaucuggugaacaguuuaguuaccgcgggacacggccagauugauaauuucagccucggugugcugggcauggcccuuuuucuggaagagauguugaggacucgcauagggacaaagcacgcuauccuccugguagcagccucguucgucacccuaauuacgggaaacauguccuuucgagaccugggccgggugauggugauggucggggcuacuaugaccgaugacaucggaaugggcguuacauaucucgcccugcuugcagcguucaaagugcgucccaccuuugccgcugguuugcuguuaagaaagcucacuucuaaagagcugaugauggccacaauugggaucgcacuucugagccagucaaccauaccugaaacaauccuagagcucacugaugcucuggccuugggaaugaugguacugaagauugugaggaauauggaaaaguaccaauuagcagucaccaucauggccauuaguugcgugcccaacgcuguuauccuccagaaugcguggaaaguguccuguacgauacuggccgcagucucugugagcccacuucuguugacauccucacagcagaaggcugacuggauuccucucgcccugaccaucaaaggccuaaaccccacugccaucuuccugaccacacuuagccgcacaaguaagaaacggucuuggccacucaaugaggcuauuauggcaguuggcaugguguccauacuggccagcucguugcugaagaacgacaucccgaugaccgggccuuuagucgcgggaggucuccugacgguaugcuaugugcuuacaggcagaucagcugaucuggaauuggagagggccgcagacguuaaaugggaggaucaagccgaaauuucugggaguucccccauccucagcauuaccaucucugaggacggaagcauguccauaaagaaugaagaggaggaacagacucugacaauccuaauucgaaccggccugcuugugaucucaggugucuuuccagugaguauucccaucacugcugcagccugguaccucugggagguaaagaaacagcgcgcgggggugcugugggaugucccuagcccacccccuguugaaaaggcugaguuggaagacggagccuaucggauaaaacagagaggcauuuuaggcuacucucaaaucggggcaggaguguauaaggaggguacauuccauaccauguggcacgugacgaggggcgccguccugaugcaucgugggaaacgcaucgagccguccugggcugaugugaagaaggaccucauuucauacggaggcgguuggaaacuggaaggggaguggaaggaaggagaggaaguucagguacuugcccuggagccaggcaaaaacccccgggcagugcagacuaagccuggcaucuuuaaaaccaauacagggaccauaggagcugucaguuuggauuucagcccagguacauccggcucucccauuguggacagaaaggggaagguugugggacuauacggcaacggugucgugacuaggucgggggccuauguaagcgcgaucgcccagaccgagaaaucaauugaagauaauccugagaucgaagacgauauauuucgaaagaaacggcugacgauuauggaccuccacccgggagcaggcaagacaaaacgcuaccugcccgcuaucgucagagaggccaucaagaggggccuucggacuuuaauucuggcuccaacccgagugguugcagccgaaauggaggaggcccucagaggguugccuauccgcuaucaaacacccgcuauuaagaccgaacauacuggaagggagauaguggaccugaugugucacgcgaccuucacaaugcgucuccuguccccaguccgggugccuaacuacaaccuuaucauuauggaugaagcacacuucacggaccccgccaguaucgcugccagagguuauaucucuacuaggguugagaugggcgaggcagccgggauuuuuaugaccgcuacaccaccgggaagccgcgauccuuucccccaguccaaugcgccaauaauggacgaagaacgagaaauccccgagagaucauggaacucuggccaugaaugggugaccgauuuuaaagguaagacugucugguucgugccuagcauuaaagccgggaaugacaucgcagcuugccugcggaagaacggcaagaagguaauucaguugaguaggaagacauuugauuccgaguacgugaaaacccgcgccaaugacugggauuucguugucacgacugacaucagcgagaugggcgcaaacuuuaaggccgaacgugugauagauccaagacgguguaugaaacccgugauccuaacagacggcgaggaaagggucauucuggcugggccuaugccgguaacccacucuucagccgcgcaacgccgaggaagaaucggucggaauccaaagaacgagaaugaccaguauauuuacaugggcgaaccccucgagaacgaugaggacugcgcacauuggaaagaagccaagauguuacuggauaauaucaacaccccugaggggauaauucccuccauguucgaaccagagagggaaaaaguggacgcuaucgauggagaguaccgccuuagaggcgaggccaggaagacuuuuguugaccugaugcggcguggugaucucccugugugguuggcuuauaaggucgcagccgaagggauuaauuacgcugaccgcaaaugguguuucgauggcaucaagaacaaucagauacuggaggaaaacaucgagguggagauuuggacaaaagaaggagagcgaaagaaacucaagcccagauggcuggacgccaggaucuauagugauccacuugcacuaaaggaauuuaaagaguucgcggccggcagaaagagccugaccuugaacuuaauuacagaaauggggcgccugccuacuuucaugacgcagaaagcuagaaaugcccucgacaaccuggcaguucuucacaccgcugaggccggagguagggcauacaaucacgcccugucggagcucccggaaacauuggagacucugcuacugcucacccuucuggcuacagugaccggcgggaucuuuuuauucuugaugucuggaaagggcauagguaaaaugacucuggggaugugcugcauuaucacggcguccauccuccugugguaugcccaaauucagccccauuggaucgcagcuagcauaauucuugaauuuuuccugaucguccucuugauuccagagccugaaaagcagcggacaccccaggauaaccaacugacauacgugguaaucgccauauuaacugugguugccgcaaccauggcuaaugagaugggcuuucuagagaagaccaaaaaggaccugggacucggcucaaucaccacucaggaaagugagucuaacauucuugacaucgaucugcgaccagccuccgcguggacauuguaugcugucgccacgaccuucgugacuccuaugcugagacacagcauugaaaauucaagugugaacgucagccucacagcaaucgccaaucaggcuaccguucugauggggcuuggaaaagguuggccccucuccaagauggacauuggcgugccgcuguuggcaaucggguguuacucucagguaaacccaauaacccugacagccgcguuacuacugcucguggcucauuacgccauuaucggaccuggccuucaagcaaaagccacucgcgaggcucagaagagggccgcagcugguaucaugaagaaucccacggucgaugggauuaccgugauagaccuggaaccaauccccuaugauccuaaauuugagaagcaguugggccagguuaugcugcucauucugugcgugacacaaguccuuaugaugcggacuaccugggccuuaugugaggcgcugacacucgccaccggaccgaucagcacuuugugggaaggcaaccccgggcguuucuggaauacgacaauugcaguauccauggcuaacaucuuuagaggaucauaccuggccggcgcaggucuacuguucucuauaaugaaaaauaccacuaacaccaggcgcgggacaggaaauaucggcgagacucucggugaaaaguggaaaagucggcuuaacgcucugggcaagucggaguuucagguguauaaaaagagcgggauucaggagguugaccgaaccuuggccaaggaaggaaucaaaagaggcgagacagaucaccaugccguguccagggggucugcgaagcugcgcugguucgucgaacggaacauggugacgccagagggaaaagucguggaccucggcugcgguagagggggauggucauacuauuguggcggucugaagaauguucgugaagugaaaggcuuaaccaaagggggaccuggccacgaggagcccauuccuaugagcacuuacggguggaaccuuguaaggcugcaauccggaguggaugucuuuuucacaccacccgaaaagugcgacacccuccuaugugauaucggcgagaguucuccuaauccaacuauagaagcuggucggacacugcgcguuuugaaccugguggagaauuggcucaacaauaacacccaguucugcauuaaaguccuuaaucccuauaugccgagcgugaucgaaaagauggaggcacugcagcgaaaauacgggggagccuugguaagaaacccucugucaagaaauuccacgcacgagauguacugggugaguaacgcuaccggcaauaucguuagcucugugaacaugauuucccggaugcucauaaaucgcuuuacaaugaagcauaaaaaggccacuuaugaaccagacgucgauuuaggcucagggaccagaaacaucggaauugagagcgaaauccccaaccuggacauuaucgguaagaggauagagaaaaucaagcaggaacacgagacaucguggcauuacgaccaagaucacccuuauaaaacuugggcauaccacggcucuuaugagaccaagcagacagggagugccuccagcauggugaauggagucgugcgacuucugaccaaaccaugggacguuguacccauggugacucagauggcuaugacggauacaaccccguucggccagcaacgggucuuuaaggaaaagguggacacucguacccaggagccuaaagaagguacaaagaaacuaaugaagauuacggcggaguggcucuggaaagagcuggggaagaaaaagacccccagaauguguacucgcgaagaguucacaaggaagguucggucaaacgccgcauugggagcuaucuuuaccgaugaaaauaaauggaaguccgccagagaggcaguggaagacggccgcuucugggagcuggucgauagggagcgaaaccuccaucuugaaggcaaaugcgagacuuguguguacaauaugauggggaagcgggagaaaaagcugggagaguuugguaaggccaaaggcucuagagcuauuugguauaugugguuaggggccagguuccuggaauuugaggcguugggauuccucaacgaggaccacugguuuagccgcggcaauagucuguccgguguagaaggggagggacuacaucgucuuggcuacauccugcgggaugugggcaagaaagaagggggagcaauguacgccgacgauacagcugguugggacaccagaauuacacucgaggaccugaagaacgaagagaugguuacuaaucacaugaaaggcgagcauaagaaguuggccgaagcaauauucaaacugaccuaucagaacaaggucgugagggugcagcgcccaacgccucgagggaccgucauggauaucauuagccggagagaccaaaggggaucuggccagguugguacauacgggcucaauacuuuuaccaacauggaggcucagcuuauccgccaaauggaaggagagggcaucuucaaaucaauucagcaccugacagccacugaggaaauagcugugcagaauugguuagccagaguaggccgggagaggcugagucguauggcaaucuccggggaugacugcguggucaagcccauugaugaccgauucgcgagcgccuugaccgcucucaacgauaugggaaaagugcgcaaggacauccagcaaugggaaccaucuagagguuggaaugauuggacgcagguucccuuuugcucgcaccauuuccacgagcuggugaugaaggacggccggguccuagugguaccuuguaggaaccaggaugaacuuauugggcgcgccagaaucucacagggagcaggcuggagccugaaagagacagcuugccucgguaaguccuaugcccaaauguggacccugauguacuuucaucggagggacuugcgauuagcagccaacgcgauauguagugcuguuccaccgcacugggugcccacuucucguacaaccuggagcauccacgccaaacaugaguggaugacuaccgaagauaugcuggcagucuggaauagaguguggauucaggagaacccuuggauggaagacaagacaccaguggaguccugggaagagguccccuaucucgggaaacgcgaggaccaguggugcggaucacuuaucggccugacgagucgggccaccugggcuaagaauauucagacugccaucaaccaaguuaggucucuaauaggcaaugaagaguacacagauuauaugccuagcaugaagagauuccgccgggaagaggaagaggcaggggugcugugguga

SEQ ID NO: 14457 - RNA, 9876 nt, Artificial Sequence
  derived and/or modified CDS sequence (opt3) from DENV-2__FJ898439__SS-prME
accgccggcgugaucguaaugcugauucccacagcuauggcauuccaccucacuacgagaaacggggaaccucauaugauaguuggaagacaggaaaaggguaaaagccuucuguuuaagaccgaggacggcgugaauaugugcacauugauggccaucgauuuaggggaacugugugaggacacuauuaccuacaaaugcccacuacuccggcaaaacgaaccggaggauaucgacuguuggugcaauuccacaucuaccuggguaacuuauggaacauguucaaccacgggcgagcaccgccgagaaaagcguaguguggcgcuggucccccauguggguauggggcuugagacuagaaccgaaacauggaugagcuccgagggagcuuggaaacacguucagaggauugagacuuggauccugcggcauccuggcuucaccauuauggccgcaaucuuggccuacacaauuggcaccacgcacuuucagcgcgcucucaucuucauucugcugacugcaguggccccaucuaugacaaugagaugcaucgggauaucgaacagggauuuugucgaaggagugucagguggcagcuggguagacauuguucucgagcacgggaguugugugaccacuauggcuaagaauaagcccacauuagauuucgaacugaucaaaaccgaggccaagcagccugcgacgcuucggaaauauugcauugaagcaaaguugaccaacacaacuaccgagucccgcuguccaacacaaggagagcccucucugaaugaagaacaggacaaacgauuuaucugcaagcauagcauggucgauagaggcugggguaacggguguggacuauucggcaagggcgggaucgugacuugcgccauguuuaccugcaaaaagaauauggaaggaaaagugguccagccugagaaccucgaauacacaauuguuauaaccccacacuccggugaggagcaugcugugggcaaugacacugggaagcacggaaaagaaaucaagauuacgccgcagucaaguaucacagaggccgaacugaccggcuaugguacuguaaccauggaguguagccccaggacagggcuugauuucaacgaaauggugcuguugcaaauggaggacaaagcauggcucguccaccggcagugguuucuggauuuaccucugccauggcuccccggcgcugacacccagggaucuaauuggauacagaaggagacucuugugacauucaagaacccucaugccaaaaagcaagacguugugguccugggcucccaggaaggggcgaugcacacggccuugaccggagcaacugagauucagaugucaagcgguaaucuacuguuuacaggccaucucaaaugccgucugcgcauggauaaacuucaacugaaagggaugaguuacucuauguguaccggaaaguucaagaucgugaaagaaaucgcugagacacagcacggcacuauuguaaucagaguucaguaugagggugacggguccccaugcaagauucccuucgaaauaaccgauuuggagaaaaggcaugugcucggccggcugaucacggucaacccgauugugaccggaaaggacagcccugucaacaucgaagccgagcccccauuuggcgauucguacaucauuauagggguggaaccuggacaguuaaaacugaauugguucaagaaggguucuuccaucggccaaauguuugagacaacuaugcgaggggcuaaacgcauggccauucuaggagacaccgcaugggauuucggcucacucggugggguuuuuacaaguaucggcaaggcccugcaccagguguucggagcuauuuacggcgcggcauuuagcgggguauccuggacuaugaaaauccuuauaggagucaucauuaccuggaucggcaugaacucuagaagcacgucauugagugugucccugguucucgugggugucgugacacuguaucuuggggccaugguacaggcugacagcggaugugugguuucuuggaagaauaaagagcugaagugcggcucagguauuuucaucaccgauaacguccacacuuggacagaacaguacaaguuucaacccgagaguccaagcaaauuggccuccgcaauacagaaggcccaugaagagggcauuugugggaucaggucugugacccggcucgaaaaucugauguggaaacagauuacucccgaguuaaaccacauccugucggagaaugaagugaagcuaaccauaaugacaggagacaucaaaggcauuaugcaggcugggaagcgcagccucagaccucaaccaacggagcugaaauauuccuggaagaccuggggaaaggccaaaaugcuuucaacugaaagucauaaccagacauucuugaucgauggcccggagaccgcagaaugccccaauacaaacagggcguggaacucucuggaggucgaggacuacgguuuugggguuuucacuaccaacauuuggcucaagcugcgugaaaaacaggacguguuuugugauagcaaguuaauguccgcugccaucaaagacaaucgggcagugcacgccgauaugggauauuggauagagucagcucugaacgacacguggaagauggaaaaggccagcuucauugagguaaaaucuugccacuggccuaagucccauacacuuuggaguaauggcgucuuggagagcgaaaugaucauccccaagaauuucgcaggucccgugucucagcacaacuaccgaccuggcuaucauacccaaacugcugggccauggcaccucggaaagcuggagauggauuuugaccuaugugaaggcaccacaguuguggucacugaggauugcgggaauagaggacccucccugaggaccacaacggccucaggcaaacucauuaccgaauggugcugucgcaguugcacucugccgccucuucgguacagaggugaggacggguguugguacggaauggagaucaggccauugaaggaaaaggaggaaaaccuggugaauagcuuaguuacagcgggccauggucagguggauaacuucucgcucggcguacuggggauggcccuuuuucuggaggaaauguugcgcacccgaauuggaacuaaacacgcuauacuccuggucgcagccuccuucgugacacuaaucaccggcaauaugucuuuucgggaccuggggcgugugauggucaugguuggagcuacgaugacugaugacauuggcaugggugugaccuaucucgcccugcuugcagcguucaagguaagacccacauuugccgcuggguugcuguuaaggaaacucaccagcaaggagcugaugauggccacuaucggaauugcacuucugucacagaguacaaucccugagaccauacuagaacucacagaugcucuggccuugggcaugauggugcugaaaaucguccgcaacauggagaaguaccaauuagcagugacuauuauggccaucuccugcguucccaaugcugugauucuccagaacgcguggaaggucucuuguaccauccuggccgcagugagcguuuccccacuucuguugacgucaagccagcagaaagcugacuggauaccucucgcccugacaauuaagggccuaaaucccaccgccaucuuccugacuacccuuagucggacaucuaaaaagagauccuggccacucaacgaagcugugauggcagucgggaugguaagcauccuggccucgucauugcugaaaaaugacauuccgaugacuggaccuuuaguggcggguggccuccugaccguuugcuaugugcuuacggggaggucugcugaucuggaguuggaacgagccgcagacgucaagugggaggaucaagccgagauaaguggauccagccccauccucucuauuacaaucagcgaagacggcuccaugucaauuaaaaacgaggaagaggagcagacccugacuauccuaauacgcacaggucugcuugugaucagugggguauuuccagugagcauucccaucaccgcugcagccugguaccucugggaagucaagaagcagcgggcgggaguucugugggaugugccuucuccacccccuguggagaaagcugaauuggaggacggcgccuauagaauuaagcagaggggcaucuuaggguacucccaaauaggagccggugucuauaaagaaggcacuuuccacacaauguggcaugugacccguggggcaguucugaugcaccgcggaaagcggauugagccgucaugggcugaugucaaaaaggaccucaucaguuacggcgguggguggaagcuggagggagaauggaaagagggcgaagaggugcagguccuugcccuggaaccaggcaagaaucccagagcagugcagacgaaaccugggaucuuuaagacuaacaccggaacaauuggugcuguuagcuuggauuucuccccaggcaccucugggucgcccaucguggacaggaaaggaaaggucgugggccuauacgguaaugggguagucacacgaagcggagccuaugugucagcgauagcccagacugagaaguccauugaggauaacccugaaaucgaggacgauauuuuucggaaaaagcgccugaccaucauggaccuccauccgggcgcaggcaaaacgaagagauaccugcccgcuauaguuagggaagccauuaaacgggggcuucgaacauuaauccuggcuccaacuagaguggucgcagccgagauggaagaggcccuccgcggauugccuaucagguaucaaacccccgcuauuaagacagagcacaccggucgugaaaucguggaccugaugugucaugcgacuuucaccaugcggcuccugaguccaguuagagugccuaacuacaaucuuauuauaauggaugaggcacacuucacagaccccgccucuaucgcugccaggggcuauauuagcacgcgcgucgaaaugggggaggcagccggaaucuuuaugacugcuaccccaccgggcucccgagauccuuucccccagucaaacgcgccaaucauggacgaggaaagagagauucccgaacggucuuggaauagcggucacgagugggugacagauuuuaaggggaaaaccguaugguucgugccuaguauaaaggccggaaacgacaucgcagcuugccugaggaaaaauggcaagaaaguuauucaguugucccgcaagacuuuugauagcgaauacgucaagacacgugccaacgacugggauuucguggugaccacggacaucucugagaugggcgcaaauuuuaaagccgagagagucauugauccacggagguguaugaagcccguaauccuaacugacggggaagaacgcgugauacuggcuggaccuaugccgguuacacauucauccgccgcgcaacgaagaggucggaucggcaggaaccccaaaaaugaaaacgaccaguauauuuacaugggggagccccucgaaaaugaugaggacugcgcacacuggaaggaggccaaaauguuacuggauaacaucaauaccccugaaggaauuauccccaguauguucgagccagaacgcgagaagguggacgcuauagauggcgaauacagacuuaggggugaggcccggaaaaccuuugucgaccugaugcgucgcggggaucucccugugugguuggcuuauaagguugcagccgagggcauuaacuacgcugaccgaaagugguguuucgauggaaucaaaaauaaccagauucuggaagagaacauggaaguggagaucuggacuaaggagggcgaaaggaaaaagcucaaacccagguggcuggacgcccggauauauagcgauccacuugcacuaaaggaguuuaaggaguucgcggccgggcgcaaaucgcugacauugaauuuaaucaccgagaugggaagacugccuacauucaugacucagaaggcuaggaacgcccucgacaaucuggcaguccuucauacggcugaaaccgguggcaaagccuacaaccacgcacugucugagcucccggagacauuggaaacucugcuacugcucacccuucuggccacagugaccgggggaauauuuuuauucuugauguccggcaaggguaucgggaaaaugacucugggcaugugcugcauuaucacggcuagcauacuccugugguaugcgcaaauucagccccacuggaucgccgcaucaaucauucuugaguuuuuccugaucguacucuugauaccagaaccugagaagcagcggacaccacaggauaaucaacugacauacgugguuauugcuaucuuaacugucguggccgccaccauggcaaacgaaaugggauuucuagagaagaccaaaaaggaccugggcuucgggaguauuaccacucaggagucugaauccaauauccucgacauagaucuucgaccagcuagcgccuggacacuguaugcgguggcuacgaccuuugucacuccuauguugagacauucaaucgagaacaguagcguuaaugugucccugacagccauugcaaaccaggccaccguacucaugggacuggguaaaggcuggccccuuucuaagauggacaucggggugccgcuccuggcuauuggauguuacagccaggucaauccaaucaccuugacagcagcccuguuacuacugguggcgcacuacgcuauuguuggcccuggucuccaagccaaagcaacucgcgaagcccagaagagggcugccgcagggaucaugaagaaccccacgguggauggcauaaccgucauugaccuugagccaauccccuaugauccuaaauucgaaaagcagcugggacagguaauguugcugauccucugcgugacacaaguucugaugaugcggacuaccugggcucuuugugaggccuuaacacuggcgaccggcccgauuuccacucucugggaggggaaucccggacguuuuuggaacacgacaauagccgugucaauggcaaauaucuucagaggcucuuacuuggcuggugccgggcugcuauuuaguauuaugaaaaacaccacuaauaccaggcgcggaacaggcaacaucggugaaacucugggcgagaaguggaaaucgcggcucaacgcacuuggaaagagcgaguuccagauuuauaaaaaguccggaauccaggaggucgaccgaacccuggcuaaggagggcauaaaaagaggggaaacagaucaucacgccgugucuaggggaucagccaaguugcgcugguuugucgagcggaauauggugacgccagaaggcaaaguuguggaccuggguugcgggagaggaggcuggagcuacuauugugguggccucaagaacguacgugaggugaaagggcugaccaagggaggcccugggcaugaagaaccaaucccuauguccacuuacggauggaauuuagucaggcuucaaaguggcguugauguguucuucacaccacccgagaagugcgacacccugcucugugauauuggugaaucuagcccuaacccaacuaucgaggcggggcggacacuacgcguccugaauuugguggaaaacuggcugaauaacaauacccaguuuugcauuaaaguacucaaccccuauaugccgucagugaucgagaagauggaaacgcuucagcgaaaauacggaggcgcucugguuagaaauccuuuguccaggaacaguacccacgagauguacugggugagcaaugcaacaggcaacauagucucuuccgugaauaugauuucacggaugcugaucaaccgcuucacuaugaagcacaaaaaggccaccuaugagccagacgucgaucucgggagcggaacaagaaacaucgguauugaaucggagauacccaauuuagacaucauuggcaagaggaucgagaaaauuaagcaggagcaugaaacuucuuggcacuacgaccaagaucauccuuauaaaaccugggcuuaccacgggaguuaugagacaaagcagaccggauccgccagcucaauggugaacggcguuguacgacugcuuacuaaaccaugggacgugguccccauggugacgcagauggcaaugacagauaccacuccguuuggucagcaacggguuuucaaggagaagguggacacccguacacaggaaccuaaagaggggacgaagaaacugaugaagaucaccgccgaauggcuauggaaagagcucggaaagagaaaaacuccccgcauguguacaagggaggaauuuacccggaaggucagauccaaugcugcgcugggcgccauauucacugaugagaacaaguggaaaucugcacgcgaagcuguggaggacggcagguuuugggaauugguagaucgagagcggaaucugcaccucgaggggaagugcgaaacauguguguacaacaugaugggaaaaagagagaagaaacuuggugaguucggcaaggccaaggggagcagggcaaucugguauauguggcugggagcccgcuuuuuagaguucgaagcucugggcuuuuugaaugaggaccauugguucagucgugguaacucccucagcgggguugagggagaaggccugcaccggcuaggcuacauucuuagagaugucgggaaaaaggagggaggugccauguacgcggacgauaccgcaggcugggacacaaggaucacucuggaagaccucaaaaaugaggaaauggugaccaaccauaugaagggggagcacaaaaagcuggccgaggcuauuuuuaaguugacguaucagaauaaagugguccgcguucagcgaccaaccccucggggaacagugauggauaucauuucuagaagggaccaacgcggcucaggucagguagggacuuacggacugaacaccuucacaaauauggaagcccagcucauaagacaaauggagggcgaaggcaucuucaagaguauucagcaucuuacugcaaccgaggagguggcuguccagaacuggcuggcccggguggggagggaacguuuaucccgaauggcuaucagcggagaugacugcguugugaaacccaucgaugaccgcuuugccucugcacugacggcguugaaugauauggguaaggucagaaaagacauucagcaaugggagccaucgcggggcuggaacgauuggacacaggugcccuucugcucacaccacuuucaugaacucguaaugaaggacgggaggguucugguggucccuugucgcaaccaggaugagcuaauagggagagcacggaucagccagggcgcugguuggucccuuaaggaaaccgccugccuggggaaaaguuaugcacaaauguggacucucauguacuuccacaggcgagaccugcguuuggcugccaaugcaauuuguucugccgugccaagccauugggugccgacauccagaaccacuuggucaauccacgcgaagcacgaguggaugaccacagaggauauguuagcugucuggaaccgcguuuggauucaggaaaaucccuggauggaggacaaaacgccuguggaaaguugggaggaaguaccauaucugggaaagcgggaggaccaguggugcggcucucucaucggccuuaccagcagggccacuugggccaaaaacauacagacagccaucaaucaagugagaucccugauugggaacgaggaauacaccgauuauaugcccucaaugaagcgcuuucggagggaggaagaggaagcuggaguccuaugguga

SEQ ID NO: 14458 - RNA, 9876 nt, Artificial Sequence
  derived and/or modified CDS sequence (opt3) from DENV-2__GQ868588__SS-prME
accgccggcaugaucauuaugcugauacccacagugauggcuuuccaccucacuacgagaaauggggagccucauaugaucgucuccaggcaggaaaagggaaaaucccuucuguuuaagaccaaagacgguacaaauaugugcacuuugauggcauuagaucugggcgagcuaugugaagacaccauuacauacaagugcccauuccucaaacaaaacgagccggaagauaucgacuguuggugcaauucuaccucaacuuggguuacauaugggaccuguacgacuaccggagagcaccggcgcgagaagcgaaguguggcccugguaccccaugugggcaugggucuugaaacacguacugagaccuggaugagcuccgaaggggcguggaagcacgcucagagaauugagacauggauccugaggcauccuggauuuaccauaauggccgcaaucuuggccuacacgauuggcacuacacacuuccagcggguccucaucuuuauucugcugaccgcuaucgcaccaucuauggccaugcgcugcauaggcauuucgaacagagauuucguggaggggguuucaggagguagcuggguggacaucguccucgaacacggcaguugugugacuacaauggcuaaaaauaagcccaccuuagauuuugagcugauuaaaacggaagccaagcagccugcgacccuuaggaaauauugcaucgaggcaaaguugacaaacacuaccacagacucccgguguccaacucaaggggaacccacccugaaugaggagcaggauaagcgcuucguaugcaaacauucuaugguugaccgaggauggggcaacgguugugggcuauuuggaaagggcggcaucgugacaugcgccauguucacaugcaaaaagaauauggaagggaaaauuguccagccugagaaccucgaauacacuguggugauaacgccacacagcggagaggaacaugcugucgguaaugauacaggcaagcacgggaaagagguuaagaucaccccgcaguccucaauuacugaggccgaacugaccggauauggcacagugaccauggaguguagucccagaacuggucuugacuuuaacgaaaugguacuguugcaaauggaggauaaggcauggcucgugcacaggcagugguuccuggacuuaccucugccauggcuccccggggcugacacacagggcagcaauuggauccagaaagaaacgcuugucaccuuuaagaacccucaugccaaaaagcaagaugugguugugcugggaucucaggagggcgcgaugcacacugccuugacaggggcaaccgagauacagauguccucaggaaaucuacuguucacaggucaucucaaaugccggcugcguauggacaaacuucaacugaagggcaugagcuacaguauguguacugggaaauucaagauugucaaagaaaucgcugagacccagcacggaacgaucgugauucgcguacaguaugaaggcgaugguucuccaugcaagauccccuuugagauuauggacuuggagaaaagacauguucucgggaggcugauaaccgugaacccgaucgucacagaaaaggauuccccugugaacauugaggccgaacccccauucggcgacagcuacaucaucauuggagucgagccuggccaguuaaagcuggauugguuucggaaagggucgucuauaggacaaauguucgaaacuaccaugcgaggugcuaagcgcauggccauccuaggcgacacagcaugggauuuugggucccucggaggcguguucacuucaauugguaaagcccugcaccagguuuuuggggcuaucuacggcgcggcauucaguggagugagcuggaccaugaagauucuuaucggcguaauaaucacguggauugggaugaacuccagaucuacaucauugucagucagucuggugcucguuggaaucgugacccuguaucuuggcgucauggugcaggccgacuccgguuguguagugagcuggaaaaacaaggagcugaagugcgggucuggaauuuuuguuacugauaauguccacacauggaccgagcaguacaaauuccaacccgaaucaccaaguaaguuggcuagcgccauccagaaagcacaugaggaaggcauaugugguauuagguccgugacucggcucgagaaccugauguggaagcagaucaccucugaauuaaaucacauucugucggagaacgaggugaaacuaacaaucaugacgggcgacauaaaggggaucaugcaggucggaaaacgcagccucagaccccaaccuaccgaacugagguauuccuggaagacuuggggcaaggccaaaaugcuuucaacagaguugcauaaucagaccuuucugauugacgggccagaaacagcugagugcccgaacacuaaucgugccuggaacagucucgaaguugaggauuacggauucggcguguuuaccacgaauaucuggcugcgguuacgagagaagcaggacguguucugugauucuaaacugaugagcgcagcgauuaaggacaacagagcuguacacgccgauauggguuauuggaucgaauccgcacuuaaugacacauggaaaauagagaaggccucauucauugaagucaagagcugccacuggcccaaaucucauaccuugugguccaacggggugcucgagagugagaugguuaucccuaagaauuuugcuggaccagugagccagcacaacaacaggcccggcuaccauacucaaaccgccgguccuuggcaccugggcaaacuagaaauggauuucgacuuuugugaggggacaacugucgugguuaccgaagagugcggaaaucgcggcccaucucugcggacaacgaccgcauccgggaagcucaucacugaauggugcuguagaucaugcacacugcccccgcuuagguaucgcggagaggauggcuguugguacgguauggagauucgaccuuugaaagaaaaggaggaaaaccuggugaguagcuuaguaaccgcugggcauggacagaucgacaauuucucgcucggcauucuggguauggcccuuuuucuggaggaaauguugcggacucgugucggcacaaagcacgcgauacuccugguggccguguccuucgucacccuaaucacggggaacaugucuuuuagagaucugggaaggguuauggugaugguaggcgcuacuaugaccgacgauauugggaugggagugacauaccucgcacugcuugccgcuuucaaaguccgcccaaccuuugccgcaggcuugcuguuacggaagcucacuagcaaagagcugaugaugacaaccaucgguauugugcuucugucacagaguuccauccccgagacaauacuagaacucacugacgcgcuggccuuggggaugaugguucugaagauggugagaaauauggagaaauaucaauuagcugucaccaucauggccauucucugcgugccuaacgcaguuauccugcagaaugcuuggaaggugucuuguacgauucuugccgucguaagcgugagcccccuguugcucacaucaagccagcagaaggcagacuggaucccacuggcccuaaccauaaaaggacugaacccuacugcuauuuuccuuaccacacucaguaggacuucuaagaaacgauccuggccccugaaugaagcgaucauggccguuggcauggugagcaucuuggcaucgucacuguuaaagaacgauauuccaaugaccggcccgcucgucgcugggggacugcuuacggugugcuacguacugacaggucgcucugccgacuuggagcucgaacgggccaccgaugugaaaugggacgaucaagcugagauaaguggcuccagcccuauccugucuauuacuaucagcgaggacggguccaugucaauuaagaaugaagaggaggaacagacacuaaccauccugauaagaacuggacuucucgucaucaguggccuguuucccguuagcauuccaaucacagcagccgcgugguauuugugggaggugaaaaagcagagggcugguguguuaugggauauucccucuccuccacccgucgggaaggccgaacuggaggacggagcauaccguaucaaacagaagggcauacucggcuauucccaaauuggggccggaguguacaaagaagguaccuuccacacgauguggcauguuacucgcggcgcuguacugaugcacaaggggaaacggaucgagccuucaugggcagaugugaagaaggaccuuaucaguuauggaggcgguuggaaacuggaaggggaguggaaggagggagaagagguccagguguuggcccuagaaccgggcaaaaacccaagagcgguucagaccaagcccggccuguuuaggacaaauaccgggacaauuggagcugugagccucgauuucuccccugguacuucuggcucgccaaucgucgacaaaaaggggaaggugguaggacuguacggcaacggugucgugacccgaagcggggccuacguuucagcaauagcccagacggagaaauccauugaagauaaucccgagaucgaggacgacauuuuccggaagcgcagacuuacaaucauggauuuacauccuggagcuggcaaaacuaagaaauaucugccggccauagugagggaagcaauuaagcggggccuccgaaccuugauccuggcucccacaagagucguggccgcggagauggaagaggcccuccgcgggcugccaaucagguaccaaaccccugcaauucgugcugaacacacuggacgggagaucguugaccuuaugugucaugccaccuuuacaaugagacuguugagucccauuagggugccaaacuauaaccuaauaaucauggaugaggcucacuucacggacccugcaucuauugccgcccgcgguuacaucagcacucgagucgaaaugggcgaggcugcggggaucuuuaugaccgcaacacccccaggauccagagauccguucccucagucaaaugcccccauuauggacgaggaacgggagauaccagaaaggucuuggaacagcggccacgagugggugaccgauuuuaaggguaaaacuguaugguucgugcccaguaucaagacagggaaugacauugcugccugccugcgcaaaaacggaaagcguguuauccagcucuccagaaaaaccuuugauagcgaauaugucaagacgcggacuaaugacugggauuucguggugacaaccgacauuucugagaugggcgcaaacuuuaaggccgaaagggucaucgacccucgccgauguaugaaaccaguaauauuaaccgauggcgaggagagagugauccuggcugggcccaugccuguuacucauucauccgcggcccaacggaggggacgcauugguagaaauccgaggaacgaaaaugaccaguacaucuauaugggcgagccacuugaaaacgaugaggacugcgcacacuggaaggaagcuaaaaugcugcucgauaauauuaacacacccgaggggaucauaccuaguauguucgagcccgaacgggagaagguggacgccauugauggagaauaccguuugcgcggcgaggcacgaaaaaccuuugucgaccugaugagaaggggugaucucccaguguggcuggccuacaagguugcuagcgaagggaucaauuaugccgaccggcgcugguguuucgauggcacaagaaacaaucagauucuugaggagaacguggaagucgagaucuggacuaaagaaggagagaggaagaagcuaaaaccucgguggcuggacgcgcgaauauacucggaucccuuggcauuaaaggaguucaaagaauuugccgcuggcagaaagucucugacgcucaaccugaucaccgagauggggcgccuuccaacauucaugacucagaaagccagggacgcucuggacaaucucgcaguguugcauaccgccgaagcuggagguaaggccuauaaccacgcacuguccgagcuaccugaaacacuggagacccuccuucuguuaacuuugcuggcgacgguaaccggcgggauuuuucucuuccugaugagcggacggggcaucgguaagaugacacuugggaugugcugcauuaucacugccucaauacugcucugguacgcucaaauucagccgcacuggaucgccgcaaguaucauuuuggaguuuuuccugaucguguuacuaauacccgaaccagagaaacagcguaccccucaggauaaucaacugacauauguuauuaucgcuauucucaccgucguggccgcaacuauggccaacgaaaugggcuuucuugagaagaccaagaaggaccugggauugggccauaucgcuacgcagcagcccgaaucuaauauacuggauaucgaccucagaccagcguccgccuggacccuguacgcaguggcuacuacauucauuaccccuaugcuuaggcacagcaucgagaacucaagugucaauguuagccucaccgccauugccaaccaggcaacagugcugaugggguugggaaaagguuggccccuguccaagauggauaucggcguaccguuacuagcuauuggguguuauucucaagugaauccaaucacucugacggccgcgcuccuucuguuggucgcucauuacgccauaauuggaccuggccugcaggcaaaggccacccgcgaggcucagaaacgggcagccgcggguaucaugaagaaccccacaguggacgggaucacuguuauugaucucgacccaauacccuacgauccuaaauuugaaaagcagcugggccaagugaugcuuuuaguccugugcguaacccaggugcucaugaugcgaacaaccugggcuuugugugaggcccugacucuagcaacgggaccgguuagcacacugugggaaggcaaucccgggagauucuggaacaccacuaucgccguguccauggcuaauauuuuuaggggaucauaucucgccggcgcaggucuucuguucucuaucaugaaaaacaccacaaguacucgccgggggaccggaaauauuggcgagacauugggugaaaaguggaagucgagacugaacgcucucggcaaaagcgaguuucagaucuacaagaaauccgggauacaagaggucgaccguacgcuggccaaggaaggaaucaaaaggggcgagaccgaucaccaugcggugucucgggggucagccaaguuacgcugguucgucgaacgaaaucuugugacuccagagggaaaaguuguggaccugggcugcgguagagggggauggagcuauuacuguggcggucucaagaacguaagggaggugaagggccuaacaaaagggggaccuggccacgaggaacccauuccuauguccaccuauggguggaaccugguccgguugcagaguggaguugauguguucuuugucccacccgaaaagugcgacacucugcucugugacaucggcgagucuagcccuaauccaacaguggaagcaggucgcacccuuagaguacugaacuugguggagaauuggcugaacaauaacacgcaguucugcguuaaagugcucaaucccuacaugccgucagucauugagaggauggaaaccuuacagcgaaaguaugggggagcucuggugcggaacccucuuucccguaauaguacacacgagauguacugggucagcaacgccucuggcaauaucguguccucaguuaacaugauaagcagaaugcugauuaaucgcuuuacuaugaggcauaaaaaggcaaccuacgaaccagauguagaccuaggcucggggacacggaacaucggaaucgagucugaaacucccaaucucgauauuauagguaagagaaucgagaaaauuaagcaagagcacgaagcuaguuggcauuaugaccaggaucacccuuacaaaaccugggccuaucacggcuccuacgagacaaagcagaccgggagcgccucauccauggugaacggagucgugcgccuguugacuaaaccaugggacguugugcccauggucacgcagauggcgaugacagauaccacuccguucggccaacagaggguguuuaaggaaaagguagacacccgaacacaggagccuaaagaagguacgaagaaacugaugaagaucaccgcugaguggcucuggaaagagcuugggaagaagaaaacuccccggauguguacaagagaagaguucaccaagaaagugaggucuaacgcagcccugggagcuauuuuuacugaugaaaauaaguggaaaagcgcccgcgaggcaguugaggacaaccguuucugggaauuagucgauaaggagcggaaucugcauuuggaaggcaaaugcgagacauguaucuauaacaugaugggcaagagagaaaagaaacucggggaguuuggaaaggccaaagguaguagggcuauaugguacauguggcugggcgcgcgcuuccuagaguuugaagcccuuggguuccugaaugaggaccacugguuuucccgagaaaacagccucucuggaguggagggcgaaggucugcauaaguugggguauauccugcgggaggugagcaagaaggagggaggcgcaauguacgcugacgauaccgccggcugggacacaagaauuacuaucgaagaucucaagaaugaggaaaugauuaccaaccacauggcaggggagcauaagaaacuugccgaagcuaucuucaaacugacguaccagaauaaagucguuagggugcaacgcccaaccccuagaggaacaguaauggacauuauaagucggagggaucagcgugguuccggccagguggggacuuauggauuaaacaccuucacaaauauggaggcccaacugauccgacagauggagggcgaagguauuuuuaaaagcauccagcacuugacugcgucugaggaaaucgcaguccaggacuggcucgugcgcguugggagagagcggcugucgaggauggccauuucaggagaugacugcguggucaagccccuagaugaccgcuucgcuagagcccuuaccgcacugaacgauaugggcaaggugcggaaagacauacaacagugggagccaagcaggggcuggaaugauuggacgcagguacccuuuugcucccaccauuuccacgaacucaucaugaaggacgggcguauucugguugugccuuguagaaaccaggacgaguugaucggacgagcucgcauuagucaaggugccggcuggucuuuacgggaaacagcuugccuggggaaaagcuacgcccagauguggucccucauguauuuucauaggagagaucuucgccuggcagcgaaugccaucuguucagcugucccaagucacugggugccgaccucucggacuacauggagcauacacgccucccaugaguggaugaccacugaagacaugcuaaccguguggaacagggucuggauccuggagaaccccuggauggaggauaagacaccuguugaaucaugggaggaaauuccauaccucggaaaacgagaggaccaguggugcggcagcuugaucggucugacgucuagagcaaccugggcuaagaauauucagacugccaucaaccaagugcggucccuuauagggaaugaagaguauacagauuacaugcccaguaugaagagguuccgccgugaggaagaggaagcaggaguacugugguga

SEQ ID NO: 14459 - RNA, 9876 nt, Artificial Sequence
  derived and/or modified CDS sequence (opt3) from DENV-2__GQ868590__SS-prME
accgcaggaaugaucauuaugcugauacccacugugauggcuuuccaccucacuacgagaaauggggagccucauaugaucgucagcaggcaggaaaagggaaaaucccuucuguuuaagaccaaagacgguacaaauaugugcacuuugauggcaauggauuuaggcgagcugugugaagacaccauuacauacaagugcccauucuuaaaacagaaugagccggaagauaucgacuguuggugcaauucuaccucaacuuggguuacauaugggaccuguacgacuaccggagagcaccggcgcgagaagcgaaguguggcacucguaccccaugugggcaugggucuggaaacacguacugagaccuggaugagcuccgaaggggcguggaagcacgcucagagaauugagacauggauccuuaggcauccuggauuuaccauaauggccgcaauccuggccuacacgauuggcacuacacacuuccagcgggucuugaucuuuauucuccugaccgcuaucgcaccaucuaugacuaugcgcugcauaggcauuucgaacagagauuucguggaggggguuucaggagguagcuggguggacaucguccuggaacacggcaguugugugacaaccauggccaaaaauaagcccacgcucgauuuugaguuaauuaaaaccgaagcuaagcagccugccacacugaggaaauauugcaucgaggcgaaacuuacuaacaccacaacugacucccgguguccaacccaaggggaacccacauugaaugaggagcaggauaagcgcuucguaugcaaacauucuaugguugaccgaggauggggcaacgguugugggcuguuuggaaagggcggcaucgugaccugcgcaauguucacuugcaaaaagaauauggaagggaaaauuguccagccugagaaccuagaauacacgguggugauaacaccacacagcggagaggaacaugccgucgguaaugauaccggcaagcacgggaaagagguuaagaucacuccgcaguccucaauuaccgaggcugaacucacaggauauggcaccgugacuauggaguguagucccagaacaggucuggacuuuaacgaaaugguacuucugcaaauggaggauaaggccugguuggugcacaggcagugguuccucgaccugccuuuaccauggcugcccggggcagacacgcagggcagcaauuggauccagaaagaaacccucgucacuuuuaagaacccucaugcuaaaaagcaagaugugguugugcuuggaucucaggagggcgccaugcacacagcgcugaccggggccacagagauacagauguccucaggaaauuugcuauucacuggucaucugaaaugccggcuccguauggacaagcugcaacuuaagggcaugagcuacaguauguguaccgggaaauucaagauugucaaagaaaucgcagagacgcagcacggaaccaucgugauucgcguacaguaugaaggcgaugguucuccaugcaagauccccuuugagauuauggaccuggagaaaagacauguuuuggggaggcucauaacagugaacccgaucgucacugaaaaggauuccccugugaacauugaggcugaacccccauucggcgacagcuacaucaucauuggagucgagccuggccagcugaaguuagauugguuuaaaaaggggucgucuauaggacaaauguucgaaaccacaaugcggggugccaaacgaauggcuauccugggcgacacugccugggauuuugggucccuaggaggcauguucaccucaauugguaaggcacuccaccagguguuuggggccaucuacggcgcugcguucaguggaguuagcuggacgaugaaaauucugaucggcgugauaaucacauggauugggaugaacucccgcucuaccagccuuucaguaaguuugguccuggugggaaucguuacucucuaucugggcgugaugguccaggcagacuccgguugugugguaagcuggaagaacaaggagcuuaaaugcgggucuggaauuuuugugacagauaauguucacaccuggacugagcaguacaaguuccaacccgaaucaccaaguaaacuggccagcgcuauccagaaggcccaugaggaaggcauaugugguauuagauccgucaccagguuggagaaccucauguggaaacagaucacacccgaacugaaucacauuuuaucugagaacgaggugaagcugacgaucaugaccggcgacacuaaagggauaaugcaagugggaaagcggucgcuacgcccucaaccaacagaacucagauauagcuggaagaccuggggcaaagcaaagaugcugccgacagagcuucauaaucagacauuuuugaucgacgggcccgaaaccgccgagugcccuaacacgaauagggcuuggaacucccuggaagucgaggauuacggauucggcguuuuuacaaccaauauuuggcuccgucugcgggagaaacaggacguguucugugauucaaaguuaaugagugccgcaaucaaagacaaccgagcggugcacgcugauauggguuauuggauugaaucugcccugaaugacacuuggaagaucgagaaggccagcuucauagaaguaaaauccugccacuggccaaagucacauacccuuuggagcaacggggucuuggagucugagauggugauucccaaaaaucucgccggaccuguuucccagcacaacaacagaccaggcuaccauacacaaacugcuggucccuggcaccugggcaagcuagaaauggauuuuaauuucugugaggggaccacaguggucgugacggaagagugcggaaacaggggcccgagucugcgcaccacuacagccagcgggaaacucaucaccgaauggugcugucggucuugcacucugccuccacuuagauauaggggagaggacggcuguugguacgguauggagauccgccccuugaaggaaaaggaggaaaaucugguuuccucauuagugacagcagggcauggacagauugauaacuuuagucucggcauccuggguauggcucuuuuccuggaggaaauguugcgaacccggguaggcacgaaacacgccauucuccuggucgcggugagcuuugugacucuaauaaccgggaauaugucguuccgugaccugggaagagucaugguuauggugggcgccacaaugaccgaugacaucgggaugggaguaacuuaccucgcucugcuugcagccuauaaggugaggccuacauuugcugccggcuugcuguuacgcaaacucaccuccaaggagcugaugaugacaacuauugguaucguccuucugucucagagcucaauucccgagaccauccuagaacucacggaugcacuggcguuggggaugauggugcugaaaaugguucggaacauggagaaguaccaauuagccgugacaauaauggcuauccucugcgucccaaaugccgugauucugcagaacgcauggaagguuaguuguaccauccuugcuguggucuccguaucuccucuguugcucacuagcucccagcagaaagccgacuggauuccccuggcacuaaccaucaagggacugaauccaacagccauauuccuuacuacccucucaagaacgagcaaaaagaggaguuggccgcugaacgaagcuauuauggcggugggcaugguuucuaucuuggccuccagccugcuaaagaaugacaucccuaugacaggcccccucguggcagggggacugcuuaccgucugcuaugugcugacuggucgaucggcugauuuggagcucgaaaaggccacagacguaaaaugggaugaccaagccgagauuucaggcucuaguccaauacuguccaucaccauuagcgaggaugggucuaugagcaucaagaacgaagaggaggaacagacucuaacaauucugauccgcaccggacuucucgugauauccggccuguuucccgucucaaucccuauuacggcugcagccugguacuugugggagguuaagaaacagcgggcggguguguuaugggacgugccaagucccccuccggucgggaaggcugaacuggaggauggagccuauagaaucaaacagaagggcauucucggcuacagccaaaucggggcaggaguguauaaagaagguacuuuccacaccauguggcauguuacaaggggcgccguacugaugcacaaggggaagcguauagagccaucuugggcugacgugaaaaaggaucuuauuuccuacggaggcgguuggaaacuggaaggggaguggaaggagggagaagagguccagguguuggcacuagaacccggcaaaaauccucgcgccguucagaccaagccaggccuguuucggacaaacacugggaccaucggagcggugucacucgacuucagucccgguacgagcggcuccccuaucgucgauaagaaagggaaggugguaggacuguacggcaauggugucgugacaagaucuggggcuuauguuucggccauugcacagacugagaaaagcaucgaagacaacccggagauagaggaugacauuuuuaggaagcgacggcuuaccaucauggacuuacaucccggagccggcaaaacaaagaaguaccugccagcuauugugcgcgaagccaucaaaagaggccucaggaccuugauacuggcaccuacucgggucguggcugccgagauggaagaggcgcuccgagggcugcccauuagauaucaaaccccagccauccgcgcagaacacacaggaagggagaucguugaucuuaugugucaugcuacguucacuaugcgucuguugucaccuauucgggugcccaacuacaaucuaaucauuauggacgaggcccacuucaccgauccagcuuccauagcagccagagguuauaucaguacaagggucgaaaugggcgaggccgcugggauuuuuaugaccgcgacuccgccuggaucucgcgaccccuucccacagagcaacgcacccaucauggaugaggaacgagagaucccugaaagauccuggaacucaggccacgagugggugacagacuuuaaggguaaaaccguaugguucgugccaucuauuaagacggggaacgauauagccgcuugccugcggaaaaauggaaagaggguuauccagcucagccgcaagacuuuugacagugaauacgucaaaacacguaccaacgauugggacuucguggugaccacugauauuuccgagaugggcgccaauuuuaaggcagaaagagucaucgacccccggagguguaugaaaccuguaauuuuaacagacggcgaggagcgcgugauccuggccgggccgaugccaguuacccauagcucugcugcgcaacgaagaggacggauagguaggaacccccgcaaugaaaacgaucaguauaucuacaugggcgagccucuugaaaaugacgaggauugcgcccacuggaaggaagcaaaaaugcugcucgacaacauuaauacacccgaggggaucauuccaucaauguucggaccugagagagaaaagguggaugcuaucgacggcgaguacagguugcggggugaagcccguaaaacuuuugucgagcugaugcgccgaggggaucuccccguguggcuggcauauaagguugccuccgaaggcauaaacuacgcugacagaaggugguguuucgauggaacgcggaauaaccagauucuugaggagaacguggaagucgagaucuggaccaaggaaggcgagcgcaaaaagcuaaaaccaagauggcuggacgccaggauuuauagugauccuuuggcguuaaaggaguuuaaagaguucgcagccgggcggaaaagccugacacucaaucugaucacugagaugggacgacuuccgaccuucaugacacagaaggcuagagacgcccuggauaaccucgcuguguugcauaccgcagaagccgguggcaaggcuuacaaucacgcccugucggagcuacccgaaacucuggagacgcuccuucuguuaaccuugcuggcaacaguaacugggggaauauuucucuuccugaugucuggccgcgguaucgggaagaugacccuuggcaugugcugcauuaucacagcguccauucugcucugguaugcccaaauccagccacacuggauagcugccagcauuaucuuggaguuuuuccugaucguguuacuaauuccugaacccgagaaacagaggaccccacaggacaaccaacugacuuacguuaucauagcaauucucacagucguggcugccacgauggcaaaugaaaugggauuucuugagaagaccaaaaaggaccugggcuuggggcauaucgccacucagcagccugaaucaaacauucuggauaucgaccuccggcccgcuagugcguggacacuguaugccguggcaaccaccuucauaacaccgaugcuucgucacucuaucgaaaauuccagcgucaacguuucacucacugcuauugccaaucaggccacggugcugaugggauuggguaagggcuggccacugaguaaaauggauaucgggguaccuuuacuagcaauuggauguuacagccaagugaaccccaucacccugacagcugcccuccuucuguuggucgcgcauuacgcuauuaucggcccaggucugcaggccaaggcaacuagagaggcccagaaaagggcugcagccgggauaaugaagaaucccaccguggacggcauuacaguuaucgaucucgacccuaucccguaugaucccaaauuugaaaagcagcugggacaagugaugcuuuuaguccugugcguaacccaggugcucaugaugcgcacuacgugggcguugugugaggcucugacacuagccaccggcccaguuuccacucugugggaagggaacccuggacgguucuggaauaccacaauugcagugucuauggccaacauauuucgaggcagcuaccucgcuggugccgggcuucuguucuccaucaugaagaauacuaccucaacaagaaggggaacgggcaacauuggugagaccuugggcgaaaaauggaagucucgccugaaugcacucgggaaaagugaguuucagaucuauaagaaaucgggcauucaagaggucgaccggacucuggcuaaggaaggaaucaaaagaggggagacagaucaccaugccgugagccguggauccgcgaaguuaaggugguucgucgaacggaaccuugugacccccgagggcaagguuguggaccuggguugcgggcgcggaggcuggucuuacuauugugguggccucaaaaacguacgagaggugaaggggcuaacuaaaggaggcccugggcacgaggaaccaauacccaugucaacauacggauggaaucuggucagauugcagagcggcguugauguguuuuucaucccuccagaaaagugcgacacccugcucugugauauuggugaguccagucccaacccgacggucgaagccgggaggacccuucgggugcugaauuugguagagucuuggcugaacaauaacacacaguucugcgugaaaguucucaauccuuauaugccaagcgugaucgagcgcauggaaacuuuacagagaaaguacggaggcgcacuggucaggaacccccuuucacgaaauuccacccacgagauguacugggugaguaacgcuagcggcaaugucgugucuuccguuaacaugauuucacggaugcugaucaaucguuuuacaaugagacauaagaaagccacuuaugaaccugacguagaccuagggagcggaacccgcaacauagguauugagucggaaacaccaaaucucgauaucaucggcaagaggauugagaaaauaaagcaagagcacgaagcaucuuggcauuacgaccaggaucaccccuauaaaaccugggcuuaccacgggaguuaugagacuaagcagacgggauccgccagcucaauggugaacggcgucgugcggcuguugacaaagccgugggacguugugccuauggucacccagauggccaugacugauaccacacccuucggucaacagagaguguuuaaagaaaagguagacacgcgcacccaggagccaaaagaagggacuaagaaacugaugaagaucacagcggaguggcucuggaaggagcuuggcaagaagaaaaccccuaggauguguacucgagaagaguucacaaagaaagugcgguccaacgcugcacugggcgccauuuuuaccgaugaaaauaaguggaaaucugcuagagaggccguugaggacaacagguucugggaauuagucgauaaggagcgcaaucugcauuuggaaggcaagugcgagacauguguguacaacaugauggggaaacgugaaaagaaacucggagaguuugguaaggcaaaaggcagccgggccaucugguauauguggcugggggcuagauuccuagaguuugaagcgcuuggauuccugaaugaggaccacugguuuaguagggaaaacucccucagcggcguggagggugaagggcugcauaaguugggauacauucugcgcgaggucucuaagaaagagggcggcgccauguacgcagaugacacugcugggugggacacccgaaucacgauagaagaucucaagaaugaggaaaugaucaccaaccacauggccggagagcauaagaaacuugcagaagccauuuucaaacugacauaucagaauaaaguugugcggguacaaagacccacuccaaucgguaccgugauggacauuaucucaaggcgcgaucagagaggcagugggcaggucggaacauacggcuuaaacacuuuuaccaauauggaggcucaacugauucggcagauggagggugaagggauauucaaguccauccagcacuugacggccagcgaggaaauugcggugcaggacuggcucguuagggugggacgugagcgacugucucgcauggcaaucucgggcgaugacugcgucgugaaaccccuagaugacagauucgcccgggcucuuacagcccugaacgauaugggcaagguaaggaaagacauccaacagugggagccuucacgcggguggaaugauuggacccagguuccauuuugcagccaccauuuccacgaacucauuaugaaggacggaagaacucugguggucccgugucggaaccaggaugaguugauagguagggcacgaaucucccaaggcgcuggguggaguuuacgugaaacagccugccugggaaaaucuuaugcucagauguggagccucauguacuuucauagacgcgaccuucggcuggccgcaaaugcgauuuguuccgccgugcccucacacugggugccuaccaguaggacuaccuggucuauccacgcuagccaugaguggaugacaacggaagacaugcuaaccgucuggaacagaguuuggauucuggagaacccauggauggaggauaagacucccguggaauccugggaggaaaucccuuaucucggcaagcgcgaggaccaguggugcgguucauugauagggcugacaagccgggccaccugggccaaaaauauccagacugcuauuaaccaaguaaggucucuuaucggaaaugaagaguacacagauuauaugccauccaugaagcgauucagacgggaggaagaggaagccggcgugcugugguga

SEQ ID NO: 14460 - RNA, 9876 nt, Artificial Sequence
  derived and/or modified CDS sequence (opt3) from DENV-2__GQ868497__SS-prME
accgcaagcgugaucguaaugcugauuccaacaguuauggcuuuccaccucacuacgcguaacggcgaaccucauaugauaguggggagacaggaaaagggaaaaucccuucuguuuaagaccgaagacggugugaauaugugcacauugauggcaaucgauuuaggcgaacugugugaagacacuauuaccuacaaaugcccacuacuccggcaaaacgaaccggaggauaucgacuguuggugcaauucuacaucaaccugggugacuuaugggacauguaguaccacgggagagcaccgccgagaaaagcguagcgucgcccuggugccacauguuggcaugggucuugagacuagaaccgaaacauggauguccucugagggggcguggaaacacgugcagaggauugagacuuggauccugcggcauccuggauucaccauaauggcugccaucuuggcauacacaauuggcaccacgcacuuucagcgcgcccucaucuucauucugcugacugcugucgcaccaucgaugacaaugagaugcaucggcauaucaaacagggauuuuguggaagggguaagcggagguaguuggguugacauugugcucgagcacggcuccugugucaccacuauggccaagaauaagcccacauuagauuucgaacugaucaaaaccgaggcuaagcagccugccacgcuucggaaauauugcauugaagcgaaguugaccaacacaacuaccgagucucgcuguccaacacaaggggagcccagccugaaugaagaacaggacaaacgauuuaucugcaagcauuccaugguggauagaggauggggcaacgguugugggcuauucggaaagggcggcaucgugacuugcgcaauguuuaccugcaaaaagaauauggaagggaaagucaugcagccugagaaccucgaauacacaauuguuauaaccccacacucaggagaggagcaugccguggguaaugacacuggcaagcacgggaaagaaaucaagauuacgccgcagaguagcaucacagaggcugaacugaccggauauggcacuguaaccauggaguguucucccaggacaggucuugauuucaacgaaauggugcuguugcaaauggaggacaaagccuggcucguccaccggcagugguuucuggauuuaccucugccauggcuccccggggcagacacccagggcuccaauuggauacagaaggagacucuugugacauucaagaacccucaugcuaaaaagcaagacguugugguccugggaucacaggaaggcgccaugcacacggcguugaccggggccacugagauucagaugagcaguggaaaucuacuguuuacaggucaucucaaaugccgucugcgcauggauaaacuucaacugaaaggcaugucuuacuccauguguaccgggaaguucaagaucgugaaagaaaucgcagagacacagcacggaacuauuguaaucagaguucaguaugagggcgacgguagcccaugcaagauucccuucgaaauaaccgauuuggagaaaaggcaugugcucgggcggcugaucacggucaacccgauugugaccgaaaaggacucgccugucaacaucgaggcugaacccccauuuggcgauucuuacaucauuauaggaguggagccuggccaguuaaaacugaauugguucaagaagggguccucaaucggacaaauguuugagacaacuaugcgaggugccaaacgcauggcuauucuaggcgacaccgccugggauuucgggagucucggaggcguuuuuacaagcaucgguaaggcacugcaccagguguucggggccauuuacggcgcugcguuuuccggaguaucuuggacuaugaaaauccuuauaggcgucaucauuaccuggaucgggaugaacagcagaucaacgaguuuguccgugagccugguucucgugggagucgugacacuguaucuuggcgcaaugguacaggccgacucugguugugugguuucauggaagaauaaagaacugaagugcgggaguggaauuuucaucaccgauaacguccacacuuggacagagcaguacaaguuucaacccgaaagcccauccaaauuggcuucugccauacagaaggcacaugaggaaggcauuugugguaucaggucggugacccggcucgagaaucugauguggaaacagauuacucccgaguuaaaccacauccugagcgaaaaugaggugaagcuaaccauaaugacaggcgacaucaaagggauuaugcaggccggaaagcgcucccucagaccucaaccaacggaacugaaauauucauggaagaccuggggcaaggcuaaaaugcuuaguacugagucucauaaccagacauucuugaucgaugggccggaaaccgccgagugccccaauacaaacagggcauggaauagccuggaggucgaagacuacggauuuggcguuuucacuaccaacauuuggcucaagcugcgugagaaacaggacguguuuugugauuccaaguuaaugucagcggcuaucaaagacaaucgggccgugcacgcagauauggguuauuggauagaaagcgcccugaacgacacguggaagauggagaaggcuucuuucauugagguaaaauccugccacuggccuaagagucauacacuuuggagcaauggggucuuggaaucugagaugaucauccccaagaacuucgccggacccgugucccagcacaacuaccgaccuggcuaucauacccaaacugcagguccauggcaccucggcaagcuggaaauggauuuugacuucugugaggggaccacaguuguggucacugaagauugcggaaauagaggccccucacuaaggaccacaacggcuagugggaaacugauuaccgaguggugcugucgcagcugcacucucccgccucugcgguacagaggagaggacggcuguugguacgguauggaaaucaggccacuuaaggagaaggaagagaacuugguaaauucgcugguuacagccgggcauggacagauugauaacuuuuccuuaggcgugcucgguauggcgcuguuccuugaagagaugcugcgcacccgaauaggcacuaaacacgccaucuugcucguagcugcaucuuuugucacacugauuaccgggaauaugagcuuccgggaccuaggacgugugauggugauggucggcgccacgaugacugaugacaucgggaugggaguuaccuaucuggcucuccuggccgcauuuaaggugagacccacauucgcggccggccuuuugcugaggaaauuaaccucaaaggagcucaugauggcuacuauugguaucgcccugcuuagucaguccacaauaccugaaaccauccuggagcuaacagaugcacucgcucuggggaugaugguauugaaaauugugcgcaacauggaaaaguaccaacuggccgucacuaucauggcaauuucuugcgugcccaaugccguuaucuuacagaacgcuuggaaggugagcuguaccauacucgcggccgucuccgugucaccacugcuucugacgagcagucagcagaaagcagacuggauuccuuuggcucucacaaucaagggacugaaucccaccgccaucuuucuaacuacccugucucggacauccaaaaagagaagcuggccacuuaacgaggccguuauggcugugggcauggucucgauucucgcaucaucucuguugaaaaaugacauaccgaugacuggcccucugguagccgggggauuacucaccgugugcuauguucugacggguaggagugcggaucuugaacuggagcgagcugccgacgugaagugggaggaucaagcagaaaucuccggcagcucucccauuuugagcaucacaauuuccgaggacgggucaaugagugucaaaaacgaagaggaggaacagacccucacuauccugauacgcacaggacuacuggugaucagcggcguauucccagugucuauucccaucaccgccgcugcaugguaccuuugggaggucaagaagcagcgggccgguguucucugggaugugccuuccccacccccuguggaaaaagcggagcuggaagacggggcuuauagaauuaagcagaggggaaucuugggcuacucacaaauaggcgccggggucuauaaagagggaacuuuucacacaauguggcaugugacccguggugcaguuuuaaugcaccgcggcaagcggauugagccgaguugggccgaugucaagaaggaccugaucagcuacgggggaggcuggaagcucgaaggugaguggaaagaaggggaggaagugcagguccuggcucuugagccaggaaagaaucccagagccgugcagacgaaaccuggcaucuucaagacuaacaccggcacaauuggggcaguuucccuggauuuuucuccaggaaccucggguagccccaucguggacaggaaaggcaaggucgugggguuguacggaaauggcguagucacacgaucaggugcuuauguguccgccauagcgcagacugagaagaguauugaagauaacccugagaucgaagacgauauuuuccggaaaaagcgccuaaccaucauggaccugcauccgggggccggaaaaacgaagagauaccuccccgcaauaguuagggaggcuauuaaacggggccugcgaacacuuaucuuagccccaacuagaguggucgcugcagaaauggaggaggcccugcgcggccucccuaucagguaucaaacccccgccauuaagacagaacacaccgggcgugagaucguggacuugaugugucaugcuacuuucaccaugcggcugcucucuccaguuagagugccuaacuacaaucugauuauaauggaugaagcgcacuuuacagaccccgcaagcaucgccgcuaggggauauauuuccacgcgcgucgagaugggugaggccgcaggcaucuucaugacugccaccccaccggggucacgagauccuuuuccccagucuaacgcuccaaucauggacgaagagagagaaauucccgagcggagcuggaauaguggacacgaaugggugacagauuucaagggcaaaaccguaugguuugugccuuccauaaaggcggguaacgacaucgccgcaugccuuaggaaaaaugggaagaaaguuauucagcugagccgcaagacuuucgauucugaguacgucaagacacgugcuaacgacugggauuuuguggugaccacggacaucucagagaugggagccaauuucaaagcagaaagagucauugauccacggagguguaugaagcccguaaucuugacugacggcgaggaacgcgugauacuagccggcccuaugccgguuacacauuccagugcugcccaacgaagagggcggaucggaaggaaccccaaaaaugagaacgaccaguauauuuacaugggugaaccccuggagaaugaugaggacugcgcgcacuggaaggaagcaaaaaugcucuuagauaacaucaauaccccugagggcauuauccccagcauguuugaaccagagcgcgaaaagguggacgccauagauggggaguacagacugaggggagaggcucggaaaaccuucgucgaccuuaugcgucgcggcgaucugccuguguggcucgccuauaagguugcugcagaagguauuaacuacgccgaccgaaagugguguuuugaugggaucaaaaauaaccagauuuuggaggaaaacauggagguggagaucuggacuaaggaaggcgagaggaaaaagcugaaacccagguggcucgacgcucggauauauucggauccacuggcccuuaaggaguucaaggaguucgcagcgggacgcaaaucucuaacacugaauuugaucaccgaaaugggcagauuaccuacauuuaugacucagaaggccaggaacgcucuggacaaucucgccguccugcauacggcagaggcugggggacgggccuacaaccacgcacuuuccgagcugccggaaacccucgagacauugcugcuacugacucuccuugccaccgugacagguggcauuuuccuguuuuuaaugagcgggaaaggaaucggcaagaugaccuuggguaugugcugcauuaucacugcuucaauacugcucugguaugcgcaaauucagccccacuggaucgccgcaaguaucauucuggaguucuuucuuaucguacugcucauaccagagccugaaaaacagcgaacgccccaggauaaucaauugaccuacgugguuauugcuauccugacagucguggccgccacuauggcaaacgagaugggguucuuagagaagaccaagaaagaccuaggccugggaucuauuacaacccaggaauccgagagcaauauccucgacauagaucuuagaccagcuucagccuggacucuguaugcgguggcuacaacguuugucaccccuauguugcgccauaguaucgaaaacagcuccguuaaugugucucugacugccauugcaaaccaggccacaguacucaugggccuggggaagggauggccccuuagcaaaauggacaucggugugccgcuccuggcuauuggcuguuacucccaggucaauccaaucaccuugaccgcagcccuguuacuacugguggcgcacuacgcuauuaucgggccuggacuccaagccaaggcaacaagggaggcccagaaacgggcugccgcaggcauaaugaagaaccccacuguugaugguauuacggugaucgaccuugaaccaauccccuaugauccuaaguucgagaaacagcuggggcaggucauguugcugauucucugcguaacccaagugcugaugaugcguacaacuugggcucuuugugaggccuuaacccuggcgacaggcccgauaucaacccucugggaaggaaaucccggcagauuuuggaacacuacgaucgccguuucuauggcaaauauuuucagggggaguuacuuggcuggagccggccugcuauuuucgaucaugaagaacacaaccaauacucgccgggguaccgggaacauuggagagacacugggcgaaaaauggaaaagccgacucaacgcacuugguaaauccgaguuccagaucuauaagaaaucuggcauacaggagguggacagaacucuggcuaaggaagggaucaagaggggagagaccgaucaucacgccgucucacgcggcagcgccaaauugcggugguuuguggaaagaaauauggucacaccagaggggaaggugguugaccugggaugcggccguggugggugguccuacuauuguggaggccucaaagaugugagggaaguaaagggucugacgaaaggcgggccuggacaugaggagcccauuccuaugaguaccuacggcuggaacuuagugcggcuucaaucugggaucgacgucuucuucacuccacccgaaaagugcgauacacugcucugugacauuggagagagcucaccuaauccaaccaucgaagcgggccgcacucuacgaguucugaacuugguggagaauuggcugaacaauaacacacaguuuugcauaaagguccucaaucccuauaugccguccgugauugagaaaauggagacccuucagagaaaguacgguggggcucugguaaggaacccuuugagucggaauagcacgcacgagauguacugggugucuaacgcaaccggaaauaucguuuccucagugaacaugaucagccgcaugcugauuaauagauucacaaugaaacacaagaaagccacuuaugaaccagaugucgaccucggcucgggcaccaggaacauagggaucgagucugaaauucccaacuuagacaucauuggaaagcgaaucgagaagauaaaacgggaacaugagacaaguuggcacuacgaucaggaccauccuuauaagacuugggcuuaccacgguuccuaugagaccaaacaaacaggcagcgccucauccauggugaauggggucgugcgucugcuuaccaagccaugggauguuguacccauggugacucagauggcaaugacggacacaaccccguuuggacagcagagagucuucaaagaaaagguggauacucgcacccaagagccuaaggaaggcacgaaaaagcugaugaaaaucacagccgaguggcuauggaaggagcucgguaaaaagaaaacccccaggauguguacucgggaagaguuuacaagaaagguucgcucuaacgcugcgcugggggccauuuucaccgacgaaaauaaguggaaaagcgcaagggaggcuguggaagauggacgauuuugggaguuggucgaccgggagagaaaccugcaccucgaaggcaagugcgagacuuguguguacaauaugaugggcaaaagggaaaagaaacuuggggaguucggaaaggccaaggguagucgcgcaaucugguauauguggcugggcgccagauuuuuagaguucgaggcucugggguuuuugaacgaggaucauugguucucccggggaaauagccucucuggcguagaaggugaggggcugcacagacuaggauacauucuuagggacgugggcaaaaaggaaggcggggccauguacgcggaugacacagcaggaugggacacccgcaucacacuggaggaucucaaaaacgaagagaugguuacuaaucauaugaagggugagcacaaaaagcuggccgaagcuauuuuuaaguugaccuaucagaacaaagucgugcgagugcagcggccaacgccuagaggcaccgucauggacauaaucucaaggcgcgaucagagagggaguggacaaguuggcacauacggucugaauacuuucaccaacauggaggcccagcucauucggcagauggaaggggagggaaucuucaaguccauccaacaucuuacagcaacugaggaaauugcugugcagaauuggcuggccaggguaggccgugagcgauuaagccgcauggcuauaucuggcgacgauugcguggucaaacccaucgacgauagauuugccucggcacugaccgcguugaacgacauggggaaggugcggaaagauauucagcagugggaaccaucaaggggauggaaugacuggacgcaaguucccuucugcagccaccacuuucaugagcucgugaugaaggauggucgcguccuggugguaccuuguagaaaccaggacgaacuaaucggccgggccaggauuucccagggggcuggauggagucuuaaggagacagccugccugggcaaaucuuaugcacagauguggacccucauguacuuccaccgacgugaucugagauuggcugccaacgcaaucuguagcgccguuccaucccauugggugccgacuucacgcacaaccuggaguauacacgcgaagcacgaguggaugacuaccgaagacauguuagcugucuggaaucggguguggauccaagagaaccccuggauggaagacaaaacaccuguggagucuugggaagaggucccauaucuggguaagagggaggaucaguggugcgggagccucauuggacuuacguccagagccaccugggccaaaaauauccagacugccauuaaccagguucgcucacugaucggcaaugaagaguacacagacuauaugcccagcaugaagcgguuuaggaaggaagaggaagaggcuggcgugcuaugguga

SEQ ID NO: 14461 - RNA, 9876 nt, Artificial Sequence
  derived and/or modified CDS sequence (opt3) from DENV-2__GU131959__SS-prME
accgcaggcgugaucguaaugcugauuccaacaguuauggcuuuccaccucacuacgcggaacggggagccucauaugauagugggaaggcaggaaaaggguaaaagccuucuguuuaagaccgaggacggcguaaauaugugcacauugauggcaaucgauuuaggggaacugugugaggacacuauuaccuacaaaugcccacuacuccggcaaaacgaaccggaggauaucgacuguuggugcaauuccacaucuaccugggugacuuauggaacauguucaaccacgggcgagcaccgccgagaaaagcguagugucgcccuggugccccauguugguauggggcuugagacuagaaccgaaacauggaugagcuccgagggagcguggaaacacgugcagaggauugagacuuggauccugcggcauccuggcuucaccauaauggcugccaucuuggcauacacaauuggcaccacgcacuuucagcgcgcccucaucuucauucugcugacugcugucgcaccaucuaugacaaugagaugcaucgggauaucgaacagggauuuuguggaaggaguaucagguggcagcuggguugacauugugcucgagcacgggaguugugucaccacuauggccaagaauaagcccacauuagauuucgaacugaucaaaaccgaggcuaagcagccugccacgcuucggaaauauugcauugaagcgaaguugaccaacacaacuaccgagucccgcuguccaacacaaggagagcccucucugaaugaggaacaggacaaacgauuuaucugcaagcauagcaugguggauagaggcugggguaacggguguggacuauucggcaagggcgggaucgugacuugcgcaauguuuaccugcaaaaagaauauggaaggaaaagucguucagccugagaaccucgaauacacaauugugauaaccccacacuccggugaggagcaugccguaggcaaugacacugggaagcacggaaaagaaaucaagauuacgccgcagucaaguaucacagaggcugaacugaccggcuaugguacugugaccauggaguguagccccaggacagggcuugauuucaacgaaaugguccuguugcaaauggaggacaaagccuggcucgugcaccggcagugguuucuggauuuaccucugccauggcuccccggcgcagacacccagggaucuaauuggauacagaaggagacucuuguuacauucaagaacccucaugcuaaaaagcaagacguggucgugcugggcucccaggaaggggccaugcacacggcguugaccggagccacugagauucagaugucaagcgguaaucuacuguuuacaggccaucucaaaugccgucugcgcauggauaaacuucaacugaaagggaugaguuacucuauguguaccggaaaguucaagaucguaaaagaaaucgcagagacacagcacggcacuauuguuaucagagugcaguaugagggugacggguccccaugcaagauucccuucgaaauaaccgauuuggagaaaaggcauguccucggccggcugaucacggugaacccgauugucaccgaaaaggacagcccugugaacaucgaggcugaacccccauuuggagauucguacaucauuauaggcguugagccugggcaguuaaaacugaauugguucaagaagggaucuuccaucggucaaauguuugagacaacuaugcgaggcgccaaacgcauggcuauucuaggggacaccgccugggauuucggaucacucggcgguguguuuacaaguaucgggaaggcacugcaccagguauucggcgccauuuacggagcugcguuuagcggcgucuccuggacuaugaaaauccuuauaggggugaucauuaccuggaucggaaugaacacgagaucuacuagcuugucaguuagucuggugcucgucggcgugguaacccuguaucuuggugcaauggugcaggccgacuccggguguguugucagcuggaagaauaaagaacugaagugcggaucuggcauuuucaucacugauaacgugcacacauggaccgagcaguacaaguuucaacccgaaucaccaaguaaauuggcuagcgccauacagaaggcacaugaggaagguauuuguggcaucagguccgugacucggcucgagaaucugauguggaaacagauuacccccgaguuaaaccacauccugucugaaaaugaggucaagcuaacaauaaugacgggggacaucaaaggaauuaugcaggccggcaagcgcucgcucagaccucaaccaaccgaacugaaauauagcuggaagacuugggggaaggcuaaaaugcuuuccacagagucacauaaccagaccuucuugaucgauggaccggaaacagccgagugccccaauacuaacagggcauggaauagucuggagguugaagacuacggcuuugguguguucaccacgaacauuuggcucaagcugcgugagaaacaggacguguuuugugauucuaaguuaaugagcgcggcuaucaaagacaaucgggccguacacgcagauaugggguauuggauagaauccgcccugaacgagacauggaagauggagaaggcuucauucauugaagucaaaagcugcuacuggccuaagucucacacccuuugguccaauggaguguuggagagugaaaugaucauccccaagaauuucgccggccccguuagccagcauaacuaucgaccugguuaccacacucaaaccgcaggcccauggcaucucgggaagcuggagauggacuuugaucuaugugaaggaacaacuguggucgugaccgaggacugcggcaauagagggcccucucugaggacaacgaccgcuuccggaaaacucauuacugaguggugcugucgcucaugcacacugccgccucuucgguacagaggcgaagaugguuguugguaugggauggagaucaggccauugaaggaaaaggaggaaaaccugguuaauaguuuagugaccgccggacacggccagauugacaacuucagccucgguguacugggcauggcgcuuuuucuggaggagauguugcgcacucgaauagggacaaaacaugccauccuccuggucgcugcaucguucgugacccuaauuacgggaaauauguccuuucgggaucugggccgugugauggucaugguuggggccacuaugaccgacgauaucggaaugggcgugacauaccucgcucugcuugccgcauucaagguaagacccaccuuugcggccgguuugcuguuaaggaaacucacuucuaaggaacugaugauggcuacaauugggaucgcccuucugagccagucaaccauaccugagacaauccuagaacucacugacgcacuggcuuugggaaugauggugcugaaaauuguccgcaacauggagaaguaucaauuagccgugaccaucauggcaauuaguugcguucccaaugccgugauccuccagaacgcuuggaaggucuccuguacgauacuggcggccgugucuguuagcccacuucuguugacauccucacagcagaaagcagauuggauuccucucgcucugaccaucaagggccuaaaucccacugccaucuuccugaccacacuuagccggacaaguaaaaagagaucuuggccacucaacgaagccgugauggcugucggcaugguauccauucuggcaagcucguugcugaaaaaugacauaccgaugaccgggccuuuaguggccggaggucuccugacgguuugcuacgugcuuacaggcaggucagcggaccuggaguuggagcgagcugccgaugucaagugggaagaccaagcagagaucucugggaguucccccauucucagcaucaccauuucugaagauggaagcauguccaucaaaaacgaggaggaagaacagacucugacaauacuaauccgcaccggccugcuugugauuucagguguauuuccagugaguauccccauuacugccgcugcaugguaucucugggaagucaagaagcagcgggccgggguucugugggacgugccuagcccacccccuguggagaaagcggaauuggaggauggagcuuacagaaucaagcagaggggcauauuaggcuauucucaaauuggggccggagucuacaaagaggguacauuccacaccauguggcacgugacgcguggcgcaguucugaugcaucgcgggaagcggaucgaaccguccugggccgacgucaaaaaggaucucaucucauacggaggcgguuggaagcuggagggggaauggaaagagggagaagaggugcagguccuugcucuggagccaggcaagaaucccagagccgugcagacuaaaccuggcauuuuuaagaccaacacagggaccaucggagcaguuaguuuggacuucagcccagguacauccggcucucccauaguggauaggaaagggaaggucgugggacuauauggcaaugguguagucacucgaucgggggcuuacgugagcgccauugcgcagaccgaaaagucaaucgaggacaacccugaaauugaggaugacaucuuucggaaaaagcgccugacgauaauggaucuccacccgggagccggcaaaacaaagagauaucugcccgcaauuguuagggaagcuaucaaacggggccuucgaacuuuaauccuggccccaaccagaguggucgcugcagagauggaggaagcccuccgcggguugccuauuagguaccaaacacccgccaucaagaccgagcauacuggacgugaaauuguggaccugaugugucacgcuaccuucacaaugcggcuccuguccccaguuagagugccuaacuauaaucuuauaaucauggacgaggcgcauuucacggaucccgcaaguauugccgcuagggguuacaucucuacucgcgucgagaugggcgaagccgcagggaucuuuaugaccgccacaccaccgggaagccgagacccuuucccccaguccaacgcuccaauuauggaugaggaaagagagauacccgaacggucauggaacucuggccacgagugggugaccgacuuuaaggguaaaacuguaugguucgugccuagcaucaaggcggggaacgauauugccgcaugccugaggaaaaauggaaagaaaguuauccaguugagucgcaagacauuugacuccgaguaugucaagacccgugcuaacgauugggacuucguggugacgacugauauuagcgaaaugggcgccaauuuuaaagcagagagagucaucgacccacggagguguaugaagcccguaauacuaacagauggcgaggaacgcgugauccuggccgggccuaugccgguuacccacucuucagcugcccaacgaagaggacggauugguaggaaccccaaaaaugaaaacgaccaguacaucuacaugggcgagccccucgagaaugacgaagauugcgcgcauuggaaggaggcaaaaauguuacuggacaacauuaauaccccugaagggaucauacccuccauguucgagccagaacgcgagaagguggaugccauugacggagaguauagacuuaggggcgaagcucggaaaacuuuugucgaucugaugcgucgcggugaccucccugugugguuggccuacaagguugcugcagaggggaucaacuaugccgaucgaaagugguguuucgacggcauuaaaaauaaccagauccuggaagagaacauggagguggaaauauggacaaaggagggagaaaggaaaaagcucaaacccagauggcuggaugcucggaucuacagugacccacuugcccuaaaggaguuuaaggaguucgcagcgggccgcaaaagccugaccuugaauuuaauuacagagauggggagacugccuacuuucaugacgcagaaggccaggaacgcucucgauaaucuggccguccuucacaccgcagaggcuggaggucgggccuauaaccaugcacugucggaacucccggagacauuggaaacucugcuacugcucacccuucuggccacagugaccggcgggaucuuuuuauucuugaugucuggaaaaggcauugguaagaugacucuggggaugugcugcaucauaacggcuuccauucuccugugguacgcgcaaauccagccccacuggaucgccgcaagcauuauccuugaguuuuuccugauaguacucuugauuccagaaccugagaaacagcgaaccccacaggacaaucaacugacauaugugguuaucgcuauuuuaacugucguggccgccaccauggcaaacgagaugggcuuucuagaaaagacaaagaaagaucugggacucggcucaaucaccacucaggagagugaaucuaauauacuugacaucgaccugagaccagcuuccgccuggacauuguacgcgguggcuacgaccuucgucacuccuaugcugcgccacagcauugagaacucaaguguuaaugugagccucacagccaucgcaaaccaggccaccguacugauggggcuuggaaaggguuggccccucuccaaaauggauauuggcgugccgcuguuggcuaucggguguuacucucaggucaauccaauuacccugacagcagccuuacuacugcucguggcgcauuaugcuaucauaggaccuggccuucaagccaaggcaacuagggaagcccagaaacgggcugccgcagguauuaugaagaaccccacgguugacgggaucaccgugaucgaucuggagccaauucccuacgacccuaaguuugagaaacaguugggccaggucaugcugcucauacugugcguaacacaagugcuuaugaugcguacuaccugggcuuuaugugaagcccugacacucgcgaccggaccgaucagcacuuugugggagggcaaucccgggagauucuggaacacgacaauugccguuuccauggcaaauaucuuuaggggaucauaucuggcuggcgccggucuacuguucucuauuaugaagaacaccacuaauacccgccgggggacaggaaacaucggcgaaacucucggugagaaauggaagagucgacuuaacgcacugggcaaaucggaguuucagauauacaagaaaagcgggauccaggaaguggauagaaccuuggcuaaggagggaauuaagaggggcgaaacagaccaccaugccgucucccgcgggucugccaaacugcggugguucguggagagaaauauggucacgccagaaggaaaggugguugaucucggcugcggucgugggggauggucauauuacuguggcggucugaaagacgugagggagguaaagggcuuaaccaaagggggaccuggccacgaggaacccaucccuaugagcacuuauggguggaaccuugugcggcugcaauccggaauugaugucuuuuucacaccacccgagaagugcgacacccuccuaugugauaucggcgaaaguucuccuaauccaacuauagaggcgggucgcacacugcgaguuuugaaccugguggaaaauuggcucaacaauaacacccaguucugcauuaagguccuuaaucccuacaugccgagcgugaucgagaaaauggagacgcugcagagaaaguacgggggagcuuugguaaggaacccucugucaagaaauuccacccaugaaauguauugggugaguaacgcaacaggcaauaucguuagcucugugaacaugauuucccgcaugcucauaaauagauuuacuaugaaacacaagaaagccaccuacgagccagacgucgauuuaggcucagggacaaggaacaucggaauugaaagcgagauccccaaccuggacauuaucgguaagcgaauagaaaagaucaaacaggagcacgagacuucguggcauuaugaccaagaucacccuuacaagaccugggcuuaucauggcucuuacgaaacaaaacagaccgggagugccuccagcauggugaauggagucgugcggcuucugacuaagccaugggacguuguacccauggugacgcagauggcaaugacagauaccacuccguucggccagcaacgugucuuuaaagagaagguggacaccagaacacaggaaccuaaggaggguacgaaaaagcuaaugaaaauuaccgccgaguggcucuggaaggaacuggggaaaaagaaaacuccccgcauguguacaagggaggaguucacccggaagguuagaucaaacgcugcguugggagccaucuuuacugaugagaauaaguggaaauccgcacgcgaagcuguggaggacggcagguucugggagcuggucgaucgagaacggaaccuccaccuugagggcaagugcgaaacauguguguauaauaugauggggaaaagagagaagaaacugggagaauuugguaaggccaagggcucuagggcaauuugguacaugugguuaggggcccgcuuccuggaguuugaggcuuugggauuccucaacgaagaccacugguuuagccguggcaauagucuguccgguguagagggggaaggacuacaucggcuuggcuacauccugagagaugugggcaaaaaggaagggggagccauguaugcggacgauaccgcagguugggacacaaggauuacucucgaagaccugaaaaacgaggagaugguuaccaaucacaugaagggcgaacauaaaaaguuggccgaggcuauauucaagcugacguaccagaacaaagucgugcgcgugcagcgaccaaccccucgggggacagucauggauaucauuagcagaagggaccaacgcggaucuggccagguugguacuuaugggcucaauaccuuuacaaacauggaagcccagcuuaucagacaaauggagggagagggcaucuucaagucaauucagcaccugacugcaaccgaagagauagcugugcagaauugguuagcccggguaggcagggaacgucugagucgaauggcuaucuccggggaugacugcguggucaaacccauugaugaccgcuucgccagcgcauugacggcgcucaacgauaugggaaaggugagaaaagacauccagcaaugggagccaucucgggguuggaaugauuggacacagguucccuuuugcucgcaucacuuccacgaacuggugaugaaggacggcaggguccuagugguaccuugucgcaaccaggaugagcuuauugggagagcccggaucucacagggagcuggcuggagccugaaggagaccgccugccucgguaaauccuacgcacaaauguggacucugauguauuuucauaggcgagacuugcguuuagcugccaacgcaauauguagugccguuccaucucacugggugccgacaagcagaaccacuugguccauccaugcgaagcacgaauggaugaccacagaggauaugcuggcugucuggaaucgcguguggauucaggaaaaccccuggauggaggacaaaacgccuguggaaucaugggaggaggucccauaccucgggaagcgggaagaccaguggugcggaagucuuaucggccugaccucuagggccacuugggccaaaaauauucagacagccaucaaccaaguuagaagccuaauaggcaaugaggaauauaccgauuacaugcccuccaugaagcgcuuccggaaggaggaagaggaggcuggggugcugugguga

SEQ ID NO: 14462 - RNA, 9876 nt, Artificial Sequence
  derived and/or modified CDS sequence (opt3) from DENV-2__GQ868515__SS-prME
accgccggcgugaucgucaugcugauucccacaguuauggcuuuccaccucacuacgagaaacggggagccucauaugauagugggaaggcaggaaaaggguaaaagccuucuguuuaagaccgaggacggcguaaauaugugcacauugauggcaaucgauuuaggggaacugugugaggacacuauuaccuacaaaugcccacuacuccggcaaaacgaaccggaggauaucgacuguuggugcaauuccacaucuaccuggauuacuuauggaacauguucaaccacgggcgagcaccgccgagaaaagcguaguguggcccuggucccccauguggguauggggcuugagacuagaaccgaaacauggaugagcuccgagggagcguggaaacacguucagaggaucgagacuuggauacugcggcauccuggcuucaccaucauggcugccauuuuggcauacacaaucggcaccacgcacuuucagcgcgcccucauuuucauccugcugacugcuguggcaccaucuaugacaaugagaugcauagggauuucgaacagggauuuugucgaaggagugucagguggcagcuggguagacaucguucucgagcacgggaguugugugaccacuauggccaagaauaagcccacauuagauuucgaacugauuaaaaccgaggcuaagcagccugccacgcuucggaaauauugcaucgaagcgaaguugaccaacacaacuaccgagucccgcuguccaacacaaggagagcccucucugaaugaagagcaggacaaacgauuuaucugcaagcauagcauggucgauagaggcugggguaacggguguggacuauucggcaagggcgggauugugacuugcgcaauguuuaccugcaaaaagaauauggaaggaaaagugguccagccugagaaccucgaauacacaauaguuaucaccccacacuccggugaggagcaugccgugggcaaugacacugggaagcacggaaaagaaauuaagaucacgccgcagucaaguauaacagaggcugaacugaccggcuaugguacuguaaccauggaguguagccccaggacagggcuugauuucaacgaaauggugcuguugcaaauggaggacaaagccuggcucguccaccggcagugguuucuggauuuaccucugccauggcuccccggcgcagacacccagggaucuaauuggauucagaaggagacucuugugacauucaagaacccucaugcuaaaaagcaagacguugugguccugggcucccaggaaggggccaugcacacggcguugaccggagccacugagauccagaugucaagcgguaaucuacuguuuacaggccaucucaaaugccgucugcgcauggauaagcuucaacugaaagggaugaguuacucuauguguaccggaaaguucaagaucgugaaagaaauugcagagacacagcacggcacuaucguaauuagaguuagguaugagggugacggguccccaugcaagauacccuucgaaaucaccgauagcgagaaacggcauguguugggccgacucauuacggucaacccgaucgugaccgaaaaggacucgccugucaacaucgaggcugaacccccauuuggagauucuuacauuauaaucggcguggagccugggcagcugaaauuaaauugguucaagaagggauccucaauuggucagauguuugagacaacuaugcgcggcgccaaaagaauggcuauccugggggacaccgccugggauuucggaagucuaggcgguguuuuuacaagcauugggaaggcacuccaccaaguguucggcgccaucuacggagcugcguuuuccggcguaucuuggacuaugaaaauacugaucggggucauuaucaccuggauuggaaugaacagcaggucaacgagucuuuccgugagcuugguucuggugggcgucgugauccucuaucugggugcaaugguacaggccgacucugggugugugguuucauggaagaauaaagaacuuaagugcggaaguggcauauucauuacagauaacguccacaccuggacugagcaguacaaguuucagcccgaaagcccauccaaacuggcuucugccauccaaaaggcacaugaggaagguauuuguggcauccggucggugacacgcuuggagaaucucauguggaaacagauaacccccgagcugaaccacaucuuaagcgaaaaugaggugaagcugacuauuaugaccggggacaucaaaggaauuaugcaggccggcaagagaucccuaaggccucagccaacagaacucaaauauucauggaagacgugggggaaggcuaaaaugcugaguaccgagucucauaaccaaacuuuccuuaucgauggaccggaaacagccgagugccccaauaccaaccgugcauggaauagcuuggaggucgaagacuacggcuuugguguuuucacaacuaacauauggcugaagcuccgggagaaacaggacguguuuugugauuccaagcugaugucagcggcuauuaaagacaaucgagccgugcacgcagauaugggguauuggaucgaaagcgccuuaaacgacaccuggaagauggagaaggcuucuuucaucgagguaaaauccugccacuggccuaagagucauacgcuguggagcaauggaguccuugaaucugagaugauuaucccaaaaaacuucgccggccccgugucccagcacaacuacagaccugguuaucauacacagaccgcaggcccauggcacuuggggaagcucgaaauggauuuugaccugugugagggaacuaccguuguggucacagaagauugcggcaauagggggcccucacuacgcacuaccacagcuaguggaaaacugauuacggaguggugcugucggagcugcacccucccgccucugagauacaggggcgaggacgguuguugguacgggauggaaauacgcccacuuaaggagaaggaagagaacuuggugaauucgcugguuacugccggacauggccaaaucgauaacuucuccuuaggugugcucggcauggcgcuguuucuugaagagaugcugcgaacacggauugggaccaaacacgccaucuugcucguagcugcaucuuucgucacucugauuacaggaaauaugagcuuucgugaccuaggcagagugauggugauggucggggccaccaugacggaugacaucggaaugggcguuacuuaucuggcucuccuggccgcauucaaggugaggcccaccuuugcggccggucuuuugcugcgcaaauuaacaucaaaggagcucaugauggcuaccauagggaucgcccugcuuagucaguccacuauuccugaaucuauccuggagcuaacagaugcacucgcucugggaaugaugguauugaaaauugugcggaacauggaaaaguaccagcuggccgucaccaucauggcaauaagcugcgugcccaaugccguuauuuuacaaaacgcuuggaagguguccuguacaauccucgcggccgucucagugagcccacugcuucugacuaguucucagcagaaagcagacuggaucccuuuggcucucaccauuaagggccugaaucccacggccauauuccuaacaacccuguccagaacuagcaaaaagaggucguggccacuuaacgaggccguuauggcugugggcauggucucaauccucgcaucuagucuguugaaaaaugacauuccgaugaccgggccucugguagccggagguuuacucacagugugcuauguucugacuggccgauccgcggaucuugaacuggagcgcgcugccgacgugaagugggaggaucaggcagaaaucagcgggucuagccccauuuuguccaucaccauaucagaggacggaaguaugagcaucaaaaacgaagaggaggaacaaacgcucacaauucugauccggaccggccuacuggucauuucugguguguuuccaguauccauccccauaacugccgcugcaugguaccuuugggaggugaagaagcagagagccgggguccucugggauguuccuucaccacccccuguggaaaaagcggagcuggaagacggagcuuauaggauuaagcagcguggcaucuugggcuacagucagaucggggccggaguguauaaagaggguacauuccacaccauguggcaugucacucgcggcgcaguguuaaugcaccgggggaagagaauugagccgagcugggccgauguuaaaaaggaccugaucuccuacggaggcgguuggaagcucgaaggggaguggaaagaaggagaggaaguacaagugcuggcucuugagccaggcaagaaucccagggccguccagacaaaaccuggcauauuuaagaccaacacggggacuauuggagcagugucucuggauuucucgccagguaccagcggcucacccaucguugaccgaaaagggaagguggucggauuguacggcaauggugugguaacacgguccggggcuuaugucagugccauugcgcagaccgagaagucuaucgaagauaacccugagauagaagacgauauuuuucgcaaaaagagacuaacaaucauggaccugcauccgggagccggcaaaacuaagagguaccuccccgcaaucgugcgggaggcuauuaaacgaggccugagaacccuuaucuuagccccaacgcgcguuguggcugcagaaauggaggaggcccugagggggcucccuauucguuaucagacacccgccauaaagacugaacacaccggacgggagaucgucgacuugaugugucaugcuacauucaccaugagacugcucagcccagugaggguuccuaacuacaaucugauuaucauggaugaagcgcacuucacugaccccgcauccaucgccgcucgcgguuauauuucaacccgaguggagaugggcgaggccgcagggauauuuaugacagccacgccaccgggaucuagagauccuuucccccaaagcaacgcuccaaucauggacgaagagcgggaaauucccgagaggaguuggaauuccggccacgaaugggucacugauuuuaaggguaaaaccgugugguucguaccuagcaucaaggcggggaacgacauugccgcaugccuucgcaaaaauggaaagaaagugauccagcugucucguaagacauuugauucagaguacguuaagaccagagcuaacgacugggauuucgucgugacuacagacauauccgagaugggcgccaauuuuaaagcagaacgggugaucgauccaaggcgcuguaugaagcccgucauuuugaccgacggcgaggaacgaguaauccuagccgggccuaugccggugacgcauaguagcgcugcccagagacggggaaggauuggucgcaacccaaaaaaugagaacgaccaauauaucuacaugggcgaaccccuggagaaugaugaggacugcgcgcacuggaaggaagcaaaaaugcucuuagauaacauaaauacuccugaggggauuauccccucgauguucgaaccagagagagaaaagguugacgccauugauggagaguacaggcugcggggcgaggcucguaaaacauuuguggaccuuaugcgccgaggugaucugccugucuggcucgccuauaagguggcugcagaagggaucaacuacgccgacagaaagugguguuucgauggcauaaaaaauaaccagaucuuggaggaaaacauggagguugagauuuggaccaaggaaggagagaggaaaaagcugaaaccccgguggcucgacgcucgcaucuauucugauccacuggcccuuaaggaauuuaaggaguucgcagcgggcagaaaaucccuaacccugaauuugauuacugaaauggggagguuaccuacauucaugacccagaaggcccggaacgcucuggacaaucucgccgugcugcauacagcagaggcuggaggucgagccuacaaccacgcacuuagcgagcugccggaaacucucgagacguugcugcuacugacccuccuugccacagucacuggcgggaucuuucuguucuuaaugucaggaaaaggcauagguaagaugaccuuggggaugugcugcauuaucacagcuaguauccugcucugguaugcgcagauucaaccccacuggaucgccgcaucuauaauucuggaauuuuuccuuaucgugcugcucauuccagagccugaaaaacagagaaccccccaggauaaucaguugacuuacguagugaucgcuauacugacgguugucgccgccaccauggcaaacgagaugggcuuuuuagagaagacaaagaaagaccuaggacugggcuccaucacuacccaagaaagcgagucaaauauucucgacaucgaucuucgcccagcuagugccuggacacuguaugcgguggcuaccacuuucgugacaccuauguugaggcauagcauugaaaacuccucugucaauguuagccugacggccaucgcaaaccaggccaccgugcucauggggcugggaaaggguuggccccuuuccaaaauggacauuggcguaccgcuccuggcuaucggguguuacucacaggugaauccaauaacuuugacagcagcccuguuacuacuggucgcgcacuacgcuauuaucggaccuggccuccaggccaaggcaacccgggaggcccaaaaacgugcugccgcagguaucaugaagaaccccaccguggaugggauuacaguuauagaccuugaaccaauccccuaugauccuaaguuugagaaacagcugggccaggugauguugcugauucucugcgucacucagguacugaugaugagaacgaccugggcucuuugugaggccuuaacacuggcgacuggaccgaucucuacccucugggaaggcaaucccgggagguucuggaacacaaccauugccgugaguauggcaaauaucuuucgcggaucguacuuggcuggcgccggucugcuauucagcauaaugaagaacacuacgaauacacggcgagggaccggaaacaucggcgagacucugggugaaaaauggaaguccagacucaacgcacuuggcaaaucugaguuucaaauuuauaagaaaucagggauccaggagguugacaggacccuggcuaaggaaggaauuaagcgcggcgagacagaucaucacgccgugagccggggguccgccaaauugagaugguucgucgaacguaauauggugacuccagagggaaaggucguggaccugggcugcgguagggggggauggaguuacuauuguggcggucucaaagauguucgggaagugaagggccugaccaaagggggaccuggccaugaggagcccaucccuaugucuacauacggguggaacuuaguacgccuucagagcggaauagacguguuuuucacgccacccgaaaagugcgauacccugcucugugacauuggcgagucauccccuaauccaacuaucgaagcgggucgaacacuaagaguccugaacuugguugagaauuggcugaacaauaacacccaauucugcaucaaggugcucaaucccuauaugccgagugucauugaaaaaauggagacucuucagaggaaguacgggggagcucuggugcggaacccuuugagccgcaauucuacacacgagauguacuggguauccaacgcaaccggcaauauagugucaagcguuaacaugaucucgagaaugcugauuaauagguuuacgaugaaacacaagaaagccaccuaugaaccagauguggaccucggcucugggacacgaaacaucggaauugagagugaaauccccaacuuagacauaaucgguaagcggauugagaagaucaaacaggaacaugagacuuccuggcacuacgaucaggaccauccuuauaagaccugggcuuaccacggcagcuaugagacaaaacaaacugggucagccuccucuauggucaauggagugguccgucugcuuaccaagccaugggaugugguucccaugguaacacagauggcaaugaccgacacuacgccguucggccagcagagaguguuuaaagaaaaggucgauacacgcacccaagagccuaaggaagguacuaaaaagcugaugaaaauuaccgccgaguggcuauggaaggagcucgggaaaaagaaaacacccaggauguguacgcgggaagaguucaccagaaaggugcgcagcaacgcugcgcugggagccaucuuuacugacgaaaauaaguggaaaagugcaagggaggcuguugaagauggccgauucugggaguugguggaccgggagagaaaccugcaccucgaaggcaagugcgagacaugugucuacaauaugauggggaaaagggaaaagaaacuuggagaguuugguaaggccaagggcucccgcgcaauuugguauauguggcugggggcccguuucuuagaauuugaggcucugggauucuugaacgaggaucauugguuuagccggggcaauucucucucagguguggaaggggagggacugcacagacuaggcuacauacuuagggacguaggcaaaaaggaagggggagccauguacgcggaugacaccgcagguugggacacucgcaucacacuggaggaucucaaaaacgaagagauggugaccaaucauaugaagggcgagcacaaaaagcuggccgaagcuauuuucaaguugacauaucagaacaaaguuguccgagugcagcggccaacuccuagagggaccgugauggacaucaucaguaggcgcgaucagagaggauccggccaagucgguacguacgggcugaauaccuuuacaaacauggaggcccagcucauucggcagauggaaggagagggcauauucaagaauauccaacaucuuacugcaaccgaggaaauugcuguucagaacuggcuggccagggugggccgugagcgauuaagccgcauggcuaucucuggggacgauugcguagugaaacccauugacgauagauucgccucggcacugacagcguugaaugacaugggaaagguccggaaagauauccagcagugggaaccaucaagggguuggaacgacuggacucaagugcccuuuugcagccaccacuuccaugagcucguuaugaaggauggccgcgugcuggucgugccuuguagaaaccaggacgaacuaauagggcgggccaggaucucccagggagcuggcuggagucuuaaggagaccgccugccuggguaaaucuuaugcacagauguggacgcucauguacuuucaccgacgugaucugagauuggcugccaaugcaauuuguagcgccguaccaucccauuggguuccgacaucacgcaccacuuggaguauccacgcgaagcacgaguggaugacaaccgaagacauguuagcuguguggaaccgggucuggauucaagagaaucccuggauggaagacaaaacuccuguggagucuugggaagaggugccauaucuggggaagagggaggaucaguggugcggaagccucaucggccuuaccuccagagccacaugggcaaaaaacauacagacggccauuaaucagguccgcucacugaucggcaacgaagaguacaccgacuauaugcccagcaugaagcgguucaggaaggaagaggaagaggcugggguucuaugguga

SEQ ID NO: 14463 - RNA, 9876 nt, Artificial Sequence
  derived and/or modified CDS sequence (opt3) from DENV-2__GQ868516__SS-prME
accgccggcgugaucgucaugcugauucccacaguuauggcuuuccaccucacuacgagaaacggggagccucauaugauagugggaaggcaggaaaaggguaaaagccuucuguuuaagaccgaggacggcguaaauaugugcacauugauggcaaucgauuuaggggaacugugugaggacacuauuaccuacaaaugcccacuacuccggcaaaacgaaccggaggauaucgacuguuggugcaauuccacaucuaccuggauuacuuauggaacauguucaaccacgggcgagcaccgccgagaaaagcguaguguggcccuggucccccauguggguauggggcuugagacuagaaccgaaacauggaugagcuccgagggagcguggaaacacguucagaggaucgagacuuggauacugcggcauccuggcuucaccaucauggcugccauuuuggcauacacaaucggcaccacgcacuuucagcgcgcccucauuuucauccugcugacugcuguggcaccaucuaugacaaugagaugcauagggauuucgaacagggauuuugucgaaggagugucagguggcagcuggguagacaucguucucgagcacgggaguugugugaccacuauggccaagaauaagcccacauuagauuucgaacugauuaaaaccgaggcuaagcagccugccacgcuucggaaauauugcaucgaagcgaaguugaccaacacaacuaccgagucccgcuguccaacacaaggagagcccucucugaaugaagagcaggacaaacgauuuaucugcaagcauagcauggucgauagaggcugggguaacggguguggacuauucggcaagggcgggauugugacuugcgcaauguuuaccugcaaaaagaauauggaaggaaaagugguccagccugagaaccucgaauacacaauaguuaucaccccacacuccggugaggagcaugccgugggcaaugacacugggaagcacggaaaagaaauuaagaucacgccgcagucaaguauaacagaggcugaacugaccggcuaugguacuguaaccauggaguguagccccaggacagggcuugauuucaacgaaauggugcuguugcaaauggaggacaaagccuggcucguccaccggcagugguuucuggauuuaccucugccauggcuccccggcgcagacacccagggaucuaauuggauucagaaggagacucuugugacauucaagaacccucaugcuaaaaagcaagacguugugguccugggcucccaggaaggggccaugcacacggcguugaccggagccacugagauccagaugucaagcgguaaucuacuguuuacaggccaucucaaaugccgucugcgcauggauaagcuucaacugaaagggaugaguuacucuauguguaccggaaaguucaagaucgugaaagaaauugcagagacacagcacggcacuaucguaauuagaguucaguaugagggugacggguccccaugcaagauacccuucgaaaucaccgauuuggagaaaaggcaugugcucggccggcugauuacggucaacccgaucgugaccgaaaaggacagcccugucaacaucgaggcugaacccccauuuggagauucguacauuauaaucggcguggagccugggcaguuaaaacugaauugguucaagaagggaucuuccauuggucaaauguuugagacaacuaugcgaggcgccaaacgcauggcuauccuaggggacaccgccugggauuucggaucacucggcgguguuuuuacaaguauugggaaggcacugcaccagguguucggcgccaucuacggagcugcguuuagcggcguauccuggacuaugaaaauacuuaucggggucauuaucaccuggauuggaaugaacucuagaagcacgucauugagugugucccugguucucgugggcgucgugauccuguaucuuggugcaaugguacaggccgacagcgggugugugguuucuuggaagaauaaagaacugaagugcggaucaggcauauucauuacagauaacguccacaccuggacugagcaguacaaguuucaacccgaaaguccaagcaaauuggcuuccgccauccagaaggcacaugaggaagguauuuguggcaucaggucugugacacggcucgagaaucugauguggaaacagauaacccccgaguuaaaccacauccugucggaaaaugaggugaagcuaacuauuaugaccggggacaucaaaggaauuaugcaggccggcaagcgcagccucagaccucaaccaacagaacugaaauauuccuggaagacgugggggaaggcuaaaaugcuuucaaccgagagucauaaccagacuuucuugaucgauggaccggaaacagccgagugccccaauaccaacagggcauggaauucucuggaggucgaagacuacggcuuugguguuuucacaacuaacauauggcucaagcugcgugagaaacaggacguguuuugugauagcaaguuaauguccgcggcuauuaaagacaaucgggccgugcacgcagauaugggguauuggaucgaaucagcccugaacgacaccuggaagauggagaaggcuagcuucaucgagguaaaaucuugccacuggccuaagucccauacgcuuuggaguaauggagucuuggaaagcgagaugauuaucccaaaaaacuucgccggccccgugucucagcacaacuaccgaccugguuaucauacacaaaccgcaggcccauggcaccucgggaagcuggaaauggauuuugaccuaugugagggaacuaccguuguggucacagaagauugcggcaauagagggcccucccugaggacuaccacagcuucaggaaaacucauuacggaguggugcugucgcaguugcacccugccgccucuucgguacagaggcgaggacgguuguugguacgggauggaaauaaggccauugaaggagaaggaagagaaccuggugaauagcuuaguuacugccggacauggccagaucgauaacuucucgcucggugugcugggcauggcgcuuuuucuggaagagauguugcgcacacgaauugggaccaaacacgccauccuccugguagcugcauccuucgucacucuaauuacaggaaauaugucuuuucgggaccugggccgugugauggugauggucggggccaccaugacggaugacaucggaaugggcguuacuuaucucgcucugcuugccgcauucaaggugagacccaccuuugcggccgguuugcuguuaaggaaacucacaagcaaggagcugaugauggcuaccauagggaucgcccuucugucacagaguacuauuccugaauccauccuagagcucacagaugcacuggcuuugggaaugaugguacugaaaauugugcgcaacauggaaaaguaccaauuagccgucaccaucauggcaauaucuugcgugcccaaugccguuauucuccagaacgcuuggaaggugagcuguacaauccuggcggccgucuccgugucaccacuucuguugacuagcagucagcagaaagcagacuggaucccucucgcucugaccauuaagggccuaaaucccacggccauauuccugacaacccuuucucggacuuccaaaaagagaagcuggccacucaacgaggccguuauggcugugggcauggucucgauccuggcaucaucuuugcugaaaaaugacauuccgaugaccgggccuuuaguagccggaggucuccugacagugugcuauguucuuacuggcaggagugcggaucuggaauuggagcgagcugccgacgugaagugggaggaucaagcagaaaucuccgggagcucucccauucucagcaucaccauauccgaggacggaucaaugaguaucaaaaacgaagaggaggaacagacgcugacaauucuaauccgcaccggccugcuugucauuagcgguguguuuccaguaucuauccccauaacugccgcugcaugguaccucugggaggugaagaagcagcgggccgggguccugugggauguuccuuccccacccccuguggaaaaagcggaguuggaagacggagcuuauagaauuaagcagaggggcaucuuaggcuacucacaaaucggggccggaguguauaaagaggguacauuccacaccauguggcaugucacucguggcgcagugcugaugcaccgcgggaagcggauugagccgaguugggccgauguuaaaaaggaccucaucagcuacggaggcgguuggaagcuggaaggggaguggaaagaaggagaggaaguacaggugcuugcucuggagccaggcaagaaucccagagccguccagacaaaaccuggcauauuuaagaccaacacggggacuauuggagcaguguccuuggauuucucuccagguaccucgggcagccccaucguugacaggaaagggaagguggucggacuauacggcaauggugugguaacacgaucaggggcuuaugucuccgccauugcgcagaccgagaagaguaucgaagauaacccugagauagaagacgauauuuuucggaaaaagcgccugacaaucauggaccuccauccgggagccggcaaaacuaagagauaccugcccgcaaucgugagggaggcuauuaaacggggccuucgaaccuuaauccuggccccaacgagaguuguggcugcagaaauggaggaggcccuccgcggguugccuauuagguaucaaacacccgccauaaagacugaacacaccggacgugagaucgucgaccugaugugucaugcuacauucaccaugcggcuccugucuccagugagaguuccuaacuacaaucuuauuaucauggaugaagcgcacuucacugaccccgcaagcaucgccgcuagggguuauauuuccacccgcguggagaugggcgaggccgcagggauauuuaugacagccacgccaccgggaucacgagauccuuucccccagucuaacgcuccaaucauggacgaagagagagaaauucccgagcggagcuggaauaguggccacgaaugggucacugauuuuaaggguaaaaccgugugguucguaccuuccaucaaggcggggaacgacauugccgcaugccugaggaaaaauggaaagaaagugauccaguugagccgcaagacauuugauucugaguacguuaagacccgugcuaacgacugggauuucgucgugacuacagacauaucagagaugggcgccaauuuuaaagcagaaagagugaucgauccacggagguguaugaagcccgucauucuaaccgacggcgaggaacgcguaauccuggccgggccuaugccggugacgcauuccagugcugcccaacgaagaggacggauugguaggaacccaaaaaaugagaacgaccaguauaucuacaugggcgaaccccucgagaaugaugaggacugcgcgcacuggaaggaagcaaaaauguuacuggauaacauaaauacuccugaggggauuauccccagcauguucgaaccagagcgcgaaaagguugacgccauugauggagaguacagacuuaggggcgaggcucggaaaacauuuguggaccugaugcgucgcggugaucucccugucugguuggccuauaagguggcugcagaagggaucaacuacgccgaccgaaagugguguuucgauggcauaaaaaauaaccagauccuggaggaaaacauggagguugagauuuggaccaaggaaggagagagaaaaaagcucaaacccagguggcuggacgcucggaucuauucggauccacuugcccuaaaggaauuuaaggaguucgcagcgggccgcaaaucucugaccuugaauuuaauuacugaaauggggagacugccuacauucaugacccagaaggccaggaacgcucucgacaaucuggccgugcuucauacagcagaggcuggaggucgggccuacaaccacgcacuguccgagcucccggaaacuuuggagacgcugcuacugcucacccuucuggccacagucacuggcgggaucuuuuuauucuugaugagcggaaaaggcauagguaagaugacccuggggaugugcugcauuaucacagcuucaauccuccugugguaugcgcaaauucagccccacuggaucgccgcaaguauaauucuugaauuuuuccugaucgugcucuugauuccagagccugaaaaacagcgaaccccccaggauaaucaacugacuuacguagugaucgcuauauuaacgguugucgccgccaccauggcaaacgagaugggcuuucuagagaagacaaagaaagaccugggacucggcucuaucacuacccaggaauccgagagcaauauucuugacaucgaucugagaccagcuucagccuggacauuguaugcgguggcuaccacuuucgugacaccuaugcugcgccauaguauugaaaacagcuccgucaauguuucucucacggccaucgcaaaccaggccaccgugcugauggggcuuggaaaggguuggccccucagcaaaauggacauuggcguaccgcuguuggcuaucggguguuacucccaggugaauccaauaacucugacagcagccuuacuacugcucgucgcgcacuacgcuauuaucggaccuggccuucaagccaaggcaaccagggaggcccagaaacgggcugccgcagguaucaugaagaaccccaccguggaugggauuacaguuauagaccuggaaccaauccccuaugauccuaaguuugagaaacaguugggccaggugaugcugcucauucugugcgucacucaaguacuuaugaugcguacgaccugggcuuuaugugaggcccugacacucgcgacuggaccgaucucaaccuugugggaaggcaaucccgggagauucuggaacacaaccauugccgugucuauggcaaauaucuuuaggggaaguuaccuggcuggcgccggucuacuguucucgauaaugaagaacacuacgaauacacgccgggggaccggaaacaucggcgagacucucggugaaaaauggaagagccgacuuaacgcacugggcaaauccgaguuucagauuuauaagaaaucugggauccaggagguugacagaaccuuggcuaaggaaggaauuaagaggggcgagacagaucaucacgccgugucacgcgggagcgccaaacugcggugguucgucgaaagaaauauggugacuccagagggaaaggucguggaccucggcugcggucgugggggaugguccuacuauuguggcggucugaaagauguuagggaagugaagggcuuaaccaaagggggaccuggccaugaggagcccaucccuaugaguacauacggguggaaccuuguacggcugcaaucuggaauagacguguuuuucacgccacccgaaaagugcgauacccuccuaugugacauuggcgagagcucaccuaauccaacuaucgaagcgggucgcacacugcgagucuugaaccugguugagaauuggcucaacaauaacacccaguucugcaucaaggugcuuaaucccuauaugccguccgucauugaaaaaauggagacucugcagagaaaguacgggggagcuuuggugaggaacccucugagucggaauagcacacacgagauguacuggguaucuaacgcaaccggcaauauaguguccucaguuaacaugaucagccgcaugcucauuaauagauuuacgaugaaacacaagaaagccaccuaugaaccagauguggacuuaggcucggggacaaggaacaucggaauugagucugaaauccccaaccuggacauaaucgguaagcgaauugagaagaucaaacaggaacaugagacuaguuggcacuacgaucaagaccauccuuauaagaccugggcuuaccacggcuccuaugagacaaaacagacugggagcgccucauccauggucaauggagugguccggcuucugaccaagccaugggaugugguucccaugguaacacagauggcaaugaccgacacuacgccguucggccagcaacguguguuuaaagaaaaggucgauacaagaacccaggagccuaaggaagguacuaaaaagcuaaugaaaauuaccgccgaguggcucuggaaggagcuggggaaaaagaaaacaccccgcauguguacgagggaagaguucacccggaaggugagaucuaacgcugcguugggagccaucuuuacugacgaaaauaaguggaaaagcgcacgcgaggcuguugaagauggcagguucugggagcugguggaccgagagcggaaccuccaccuugaaggcaagugcgagacaugugucuacaauaugauggggaaaagagaaaagaaacugggagaguuugguaaggccaagggcaguagggcaauuugguauaugugguuaggggcccgcuuccuggaauuugaggcuuugggauuccucaacgaggaucauugguuuucccguggcaauagccugucugguguggaaggggagggacuacaccggcuuggcuacauacugagagacguaggcaaaaaggaagggggagccauguacgcggaugacaccgcagguugggacacuaggaucacacucgaggaucugaaaaacgaagagauggugaccaaucauaugaagggcgagcacaaaaaguuggccgaagcuauuuucaagcugacauaucagaacaaaguuguccgcgugcagcgaccaacuccucgggggaccgugauggacaucaucucaagaagggaucaacgcggaaguggccaggucgguacguacgggcucaauaccuuuacaaacauggaggcccagcuuauuagacaaauggaaggagagggcauauucaagaauauccagcaucugacugcaaccgaggaaauugcuguucagaacugguuagcccgggugggcagggagcgucugucccgaauggcuaucagcggggacgauugcguagugaaacccauugacgaucgcuucgccucugcauugacagcgcucaaugacaugggaaaggucagaaaagauauccagcaaugggaaccaucgcgggguuggaacgacuggacucaggugcccuuuugcucacaccacuuccaugagcugguuaugaaggauggcagggugcuagucgugccuugucgcaaccaggacgaacuuauagggagagcccggaucagccagggagcuggcuggucccugaaggagaccgccugccucgguaaaaguuaugcacaaauguggacgcugauguacuuucacaggcgagauuugcguuuagcugccaaugcaauuuguucugccguaccaagccauuggguuccgacauccagaaccacuuggucaauccacgcgaagcacgaguggaugacaaccgaagacaugcuggcuguguggaaccgcgucuggauucaggagaaucccuggauggaagacaaaacuccuguggagaguugggaagaggugccauaucucgggaagcgggaggaucaguggugcggaucucuuaucggccugaccagcagggccacaugggcaaaaaacauacagacggccauuaaucaagucagaucccuaaucggcaacgaagaguacaccgacuauaugcccucaaugaagcgcuuccggaaggaagaggaagaggcugggguucugugguga

SEQ ID NO: 14464 - RNA, 9876 nt, Artificial Sequence
  derived and/or modified CDS sequence (opt3) from DENV-2__GU131975__SS-prME
accgccggcgugaucgucaugcugauucccacaguuauggcuuuccaccucacuacgagaaacggggagccucauaugauagugggaaggcaggaaaaggguaaaagccuucuguuuaagaccgaggacggcguaaauaugugcacauugauggcaaucgauuuaggggaacugugugaggacacuauuaccuacaaaugcccacuacuccggcaaaacgaaccggaggauaucgacuguuggugcaauuccacaucuaccuggauuacuuauggaacauguucaaccacgggcgagcaccgccgagaaaagcguaguguggcccuggucccccauguggguauggggcuugagacuagaaccgaaacauggaugagcuccgagggagcguggaaacacguucagaggaucgagacuuggauacugcggcauccuggcuucaccaucauggcugccauuuuggcauacacaaucggcaccacgcacuuucagcgcgcccucauuuucauccugcugacugcuguggcaccaucuaugacaaugagaugcauagggauuucgaacagggauuuugucgaaggagugucagguggcagcuggguagacaucguucucgagcacgggaguugugugaccacuauggccaagaauaagcccacauuagauuucgaacugauuaaaaccgaggcuaagcagccugccacgcuucggaaauauugcaucgaagcgaaguugaccaacacaacuaccgagucccgcuguccaacacaaggagagcccucucugaaugaagagcaggacaaacgauuuaucugcaagcauagcauggucgauagaggcugggguaacggguguggacuauucggcaagggcgggauugugacuugcgcaauguuuaccugcaaaaagaauauggaaggaaaagugguccagccugagaaccucgaauacacaauaguuaucaccccacacuccggugaggagcaugccgugggcaaugacacugggaagcacggaaaagaaauuaagaucacgccgcagucaaguauaacagaggcugaacugaccggcuaugguacuguaaccauggaguguagccccaggacagggcuugauuucaacgaaauggugcuguugcaaauggaggacaaagccuggcucguccaccggcagugguuucuggauuuaccucugccauggcuccccggcgcagacacccagggaucuaauuggauucagaaggagacucuugugacauucaagaacccucaugcuaaaaagcaagacguugugguccugggcucccaggaaggggccaugcacacggcguugaccggagccacugagauccagaugucaagcgguaaucuacuguuuacaggccaucucaaaugccgucugcgcauggauaagcuucaacugaaagggaugaguuacucuauguguaccggaaaguucaagaucgugaaagaaauugcagagacacagcacggcacuaucguaauuagaguucaguaugagggugacggguccccaugcaagauacccuucgaaaucaccgauuuggagaaaaggcaugugcucggccggcugauuacggucaacccgaucgugaccgaaaaggacagcccugucaacaucgaggcugaacccccauuuggagauucguacauuauaaucggcguggagccugggcaguuaaaacugaauugguucaagaagggaucuuccauuggucaaauguuugagacaacuaugcgaggcgccaaacgcauggcuauccuaggggacaccgccugggauuucggaucacucggcgguguuuuuacaaguauugggaaggcacugcaccagguguucggcgccaucuacggagcugcguuuagcggcguauccuggacuaugaaaauacuuaucggggucauuaucaccuggauuggaaugaacucuagaagcacgucauugagugugucccugguucucgugggcgucgugauccuguaucuuggugcaaugguacaggccgacagcgggugugugguuucuuggaagaauaaagaacugaagugcggaucaggcauauucauuacagauaacguccacaccuggacugagcaguacaaguuucaacccgaaaguccaagcaaauuggcuuccgccauccagaaggcacaugaggaagguauuuguggcaucaggucugugacacggcucgagaaucugauguggaaacagauaacccccgaguuaaaccacauccugucggaaaaugaggugaagcuaacuauuaugaccggggacaucaaaggaauuaugcaggccggcaagcgcagccucagaccucaaccaacagaacugaaauauuccuggaagacgugggggaaggcuaaaaugcuuucaaccgagagucauaaccagacuuucuugaucgauggaccggaaacagccgagugccccaauaccaacagggcauggaauucucuggaggucgaagacuacggcuuugguguuuucacaacuaacauauggcucaagcugcgugagaaacaggacguguuuugugauagcaaguuaauguccgcggcuauuaaagacaaucgggccgugcacgcagauaugggguauuggaucgaaucagcccugaacgacaccuggaagauggagaaggcuagcuucaucgagguaaaaucuugccacuggccuaagucccauacgcuuuggaguaauggagucuuggaaagcgagaugauuaucccaaaaaacuucgccggccccgugucucagcacaacuaccgaccugguuaucauacacaaaccgcaggcccauggcaccucgggaagcuggaaauggauuuugaccuaugugagggaacuaccguuguggucacagaagauugcggcaauagagggcccucccugaggacuaccacagcuucaggaaaacucauuacggaguggugcugucgcaguugcacccugccgccucuucgguacagaggcgaggacgguuguugguacgggauggaaauaaggccauugaaggagaaggaagagaaccuggugaauagcuuaguuacugccggacauggccagaucgauaacuucucgcucggugugcugggcauggcgcuuuuucuggaagagauguugcgcacacgaauugggaccaaacacgccauccuccugguagcugcauccuucgucacucuaauuacaggaaauaugucuuuucgggaccugggccgugugauggugauggucggggccaccaugacggaugacaucggaaugggcguuacuuaucucgcucugcuugccgcauucaaggugagacccaccuuugcggccgguuugcuguuaaggaaacucacaagcaaggagcugaugauggcuaccauagggaucgcccuucugucacagaguacuauuccugaauccauccuagagcucacagaugcacuggcuuugggaaugaugguacugaaaauugugcgcaacauggaaaaguaccaauuagccgucaccaucauggcaauaucuugcgugcccaaugccguuauucuccagaacgcuuggaaggugagcuguacaauccuggcggccgucuccgugucaccacuucuguugacuagcagucagcagaaagcagacuggaucccucucgcucugaccauuaagggccuaaaucccacggccauauuccugacaacccuuucucggacuuccaaaaagagaagcuggccacucaacgaggccguuauggcugugggcauggucucgauccuggcaucaucuuugcugaaaaaugacauuccgaugaccgggccuuuaguagccggaggucuccugacagugugcuauguucuuacuggcaggagugcggaucuggaauuggagcgagcugccgacgugaagugggaggaucaagcagaaaucuccgggagcucucccauucucagcaucaccauauccgaggacggaucaaugaguaucaaaaacgaagaggaggaacagacgcugacaauucuaauccgcaccggccugcuugucauuagcgguguguuuccaguaucuauccccauaacugccgcugcaugguaccucugggaggugaagaagcagcgggccgggguccugugggauguuccuuccccacccccuguggaaaaagcggaguuggaagacggagcuuauagaauuaagcagaggggcaucuuaggcuacucacaaaucggggccggaguguauaaagaggguacauuccacaccauguggcaugucacucguggcgcagugcugaugcaccgcgggaagcggauugagccgaguugggccgauguuaaaaaggaccucaucagcuacggaggcgguuggaagcuggaaggggaguggaaagaaggagaggaaguacaggugcuugcucuggagccaggcaagaaucccagagccguccagacaaaaccuggcauauuuaagaccaacacggggacuauuggagcaguguccuuggauuucucuccagguaccucgggcagccccaucguugacaggaaagggaagguggucggacuauacggcaauggugugguaacacgaucaggggcuuaugucuccgccauugcgcagaccgagaagaguaucgaagauaacccugagauagaagacgauauuuuucggaaaaagcgccugacaaucauggaccuccauccgggagccggcaaaacuaagagauaccugcccgcaaucgugagggaggcuauuaaacggggccuucgaaccuuaauccuggccccaacgagaguuguggcugcagaaauggaggaggcccuccgcggguugccuauuagguaucaaacacccgccauaaagacugaacacaccggacgugagaucgucgaccugaugugucaugcuacauucaccaugcggcuccugucuccagugagaguuccuaacuacaaucuuauuaucauggaugaagcgcacuucacugaccccgcaagcaucgccgcuagggguuauauuuccacccgcguggagaugggcgaggccgcagggauauuuaugacagccacgccaccgggaucacgagauccuuucccccagucuaacgcuccaaucauggacgaagagagagaaauucccgagcggagcuggaauaguggccacgaaugggucacugauuuuaaggguaaaaccgugugguucguaccuuccaucaaggcggggaacgacauugccgcaugccugaggaaaaauggaaagaaagugauccaguugagccgcaagacauuugauucugaguacguuaagacccgugcuaacgacugggauuucgucgugacuacagacauaucagagaugggcgccaauuuuaaagcagaaagagugaucgauccacggagguguaugaagcccgucauucuaaccgacggcgaggaacgcguaauccuggccgggccuaugccggugacgcauuccagugcugcccaacgaagaggacggauugguaggaacccaaaaaaugagaacgaccaguauaucuacaugggcgaaccccucgagaaugaugaggacugcgcgcacuggaaggaagcaaaaauguuacuggauaacauaaauacuccugaggggauuauccccagcauguucgaaccagagcgcgaaaagguugacgccauugauggagaguacagacuuaggggcgaggcucggaaaacauuuguggaccugaugcgucgcggugaucucccugucugguuggccuauaagguggcugcagaagggaucaacuacgccgaccgaaagugguguuucgauggcauaaaaaauaaccagauccuggaggaaaacauggagguugagauuuggaccaaggaaggagagagaaaaaagcucaaacccagguggcuggacgcucggaucuauucggauccacuugcccuaaaggaauuuaaggaguucgcagcgggccgcaaaucucugaccuugaauuuaauuacugaaauggggagacugccuacauucaugacccagaaggccaggaacgcucucgacaaucuggccgugcuucauacagcagaggcuggaggucgggccuacaaccacgcacuguccgagcucccggaaacuuuggagacgcugcuacugcucacccuucuggccacagucacuggcgggaucuuuuuauucuugaugagcggaaaaggcauagguaagaugacccuggggaugugcugcauuaucacagcuucaauccuccugugguaugcgcaaauucagccccacuggaucgccgcaaguauaauucuugaauuuuuccugaucgugcucuugauuccagagccugaaaaacagcgaaccccccaggauaaucaacugacuuacguagugaucgcuauauuaacgguugucgccgccaccauggcaaacgagaugggcuuucuagagaagacaaagaaagaccugggacucggcucuaucacuacccaggaauccgagagcaauauucuugacaucgaucugagaccagcuucagccuggacauuguaugcgguggcuaccacuuucgugacaccuaugcugcgccauaguauugaaaacagcuccgucaauguuucucucacggccaucgcaaaccaggccaccgugcugauggggcuuggaaaggguuggccccucagcaaaauggacauuggcguaccgcuguuggcuaucggguguuacucccaggugaauccaauaacucugacagcagccuuacuacugcucgucgcgcacuacgcuauuaucggaccuggccuucaagccaaggcaaccagggaggcccagaaacgggcugccgcagguaucaugaagaaccccaccguggaugggauuacaguuauagaccuggaaccaauccccuaugauccuaaguuugagaaacaguugggccaggugaugcugcucauucugugcgucacucaaguacuuaugaugcguacgaccugggcuuuaugugaggcccugacacucgcgacuggaccgaucucaaccuugugggaaggcaaucccgggagauucuggaacacaaccauugccgugucuauggcaaauaucuuuaggggaaguuaccuggcuggcgccggucuacuguucucgauaaugaagaacacuacgaauacacgccgggggaccggaaacaucggcgagacucucggugaaaaauggaagagccgacuuaacgcacugggcaaauccgaguuucagauuuauaagaaaucugggauccaggagguugacagaaccuuggcuaaggaaggaauuaagaggggcgagacagaucaucacgccgugucacgcgggagcgccaaacugcggugguucgucgaaagaaauauggugacuccagagggaaaggucguggaccucggcugcggucgugggggaugguccuacuauuguggcggucugaaagauguuagggaagugaagggcuuaaccaaagggggaccuggccaugaggagcccaucccuaugaguacauacggguggaaccuuguacggcugcaaucuggaauagacguguuuuucacgccacccgaaaagugcgauacccuccuaugugacauuggcgagagcucaccuaauccaacuaucgaagcgggucgcacacugcgagucuugaaccugguugagaauuggcucaacaauaacacccaguucugcaucaaggugcuuaaucccuauaugccguccgucauugaaaaaauggagacucugcagagaaaguacgggggagcuuuggugaggaacccucugagucggaauagcacacacgagauguacuggguaucuaacgcaaccggcaauauaguguccucaguuaacaugaucagccgcaugcucauuaauagauuuacgaugaaacacaagaaagccaccuaugaaccagauguggacuuaggcucggggacaaggaacaucggaauugagucugaaauccccaaccuggacauaaucgguaagcgaauugagaagaucaaacaggaacaugagacuaguuggcacuacgaucaagaccauccuuauaagaccugggcuuaccacggcuccuaugagacaaaacagacugggagcgccucauccauggucaauggagugguccggcuucugaccaagccaugggaugugguucccaugguaacacagauggcaaugaccgacacuacgccguucggccagcaacguguguuuaaagaaaaggucgauacaagaacccaggagccuaaggaagguacuaaaaagcuaaugaaaauuaccgccgaguggcucuggaaggagcuggggaaaaagaaaacaccccgcauguguacgagggaagaguucacccggaaggugagaucuaacgcugcguugggagccaucuuuacugacgaaaauaaguggaaaagcgcacgcgaggcuguugaagauggcagguucugggagcugguggaccgagagcggagucuccaccuugaaggcaagugcgagacaugugucuacaacaugauggggaaaagagaaaagaaacugggagaguuugguaaggccaagggcuccagggcaauuugguauaugugguuaggggcccgcuuccuggaauuugaggcuuugggauuccucaaugaggaucauugguuuagccguggcaacucucugucagguguggaaggggagggacuacaccggcuuggcuacauacugagagacguaggcaaaaaggaagggggagccauguacgcggaugacaccgcagguugggacacuaggaucacacucgaggaucugaaaaaugaagagauggugaccaaccauaugaagggcgagcacaaaaaguuggccgaagcuauuuucaagcugacauaucagaauaaaguuguccgcgugcagcgaccaacuccucgggggaccgugauggacaucaucaguagaagggaucaacgcggauccggccaggucgguacguacgggcucaacaccuuuacaaauauggaggcccagcuuauuagacaaauggaaggagagggcauauucaagaacauccagcaucugacugcaaccgaggaaauugcuguucagaauugguuagcccgggugggcagggagcgucugagccgaauggcuaucucuggggacgauugcguagugaaacccauugacgaucgcuucgccucggcauugacagcgcucaacgacaugggaaaggucagaaaagauauccagcaaugggaaccaucacgggguuggaaugacuggacucaggugcccuuuugcagccaccacuuccaugagcugguuaugaaggauggcagggugcuagucgugccuugucgcaaccaggacgaacuuauagggagagcccggaucucccagggagcuggcuggagucugaaggagaccgccugccucgguaaaucuuaugcacaaauguggacgcugauguacuuucacaggcgagauuugcguuuagcugccaacgcaauuuguagcgccguaccaucccauuggguuccgacaucaagaaccacuuggaguauccacgcgaagcacgaguggaugacaaccgaagacaugcuggcuguguggaaucgcgucuggauucaggagaaccccuggauggaagacaaaacuccuguggagucuugggaagaggugccauaucucgggaagcgggaggaucaguggugcggaagccuuaucggccugaccuccagggccacaugggcaaaaaauauacagacggccauuaaccaagucagaucacuaaucggcaaugaagaguacaccgacuauaugcccagcaugaagcgcuuccggaaggaagaggaagaggcugggguucugugguga

SEQ ID NO: 14465 - RNA, 9876 nt, Artificial Sequence
  derived and/or modified CDS sequence (opt3) from DENV-2__JN819422__SS-prME
accgccggcgugaucgucaugcugauucccacagcuauggcauuccaccucacuacgagaaacggggagccucauaugauaguuggaaggcaggaaaaggguaaaagccuucuguuuaagaccgaggacggcgugaauaugugcacauugauggccaucgauuuaggggaacugugugaggacacuauuaccuacaaaugcccacuacuccggcaaaacgaaccggaggauaucgacuguuggugcaauuccacaucuaccuggguaacuuauggaacauguaccacgacuggcgagcaccgccgagaaaagcguucaguggcgcuggucccccauguggguauggggcuugagaccagaacagaaacuuggaugaguagcgagggagcuuggaaacacguucagaggauugagaccuggauccugcggcauccuggcuucacaauaauggccgcaaucuuggccuacaccauuggcacgacucacuuucagaaggcucucaucuucauucugcugacagcaguggccccauccaugaccaugcgcugcaucgggauaucuaacagagauuuugucgaaggagugucggguggcucauggguagacauuguucucgagcacgggagcugugugacuacaauggcuaagaauaaacccaccuuagauuucgaacugaucaagacggaggccaaacagccugcgacccuuaggaaguauugcauugaagcaaaauugacaaacacuaccacagagagucgguguccaacucaaggagagcccucccugaaugaagagcaggacaagcgcuuuaucugcaagcauucuauggucgaucgaggcugggguaacggguguggacuauucggcaaaggcgggaucgugaccugcgccauguuuacaugcaagaaaaauauggaaggaaaggugguccagccugagaaccucgaauacaccauuguuauaacuccacacagcggugaggagcaugcugugggcaaugacacggggaaacacggaaaggaaaucaaaauuacaccgcaguccucaaucaccgaggccgaacugacuggcuaugguaccguaacaauggaguguagucccagaaccgggcuugauuucaacgaaauggugcuguugcaaauggaggacaaggcauggcucguccacaggcagugguuucuggauuuaccucugccauggcuccccggcgcugacacucagggaagcaauuggauacagaaggagacacuugugacguucaaaaacccucaugccaagaaacaagacguugugguccugggcucucaggaaggggcgaugcacaccgccuugacuggagcaacagagauucagauguccucagguaaucuacuguuuaccggccaucucaagugccggcugcguauggauaaacuucaacugaaggggaugagcuacaguauguguacaggaaaguucaaaaucgugaaggaaaucgcugagacucagcacggcaccauuguaauccgcguucaguaugagggugacgggucuccaugcaaaauucccuucgaaauaacggauuuggagaagagacaugugcucggcaggcugaucaccgucaacccgauugugacagaaaaagacuccccugucaacaucgaggccgaacccccauuuggagauagcuacaucauuauaggcguggagccugggcaguuaaagcugaauugguucaagaaaggaucgucuaucggucaaauguuugagacuaccaugcggggcgcuaagcgaauggccauucuaggggacacagcaugggauuucggaucccucggcgguguuuuuacuucaaucgggaaagcccugcaccagguguucggcgcuauuuacggagcggcauuuaguggcguaagcuggaccaugaagauccuuauaggggucaucauuacguggaucggaaugaacucccgcucuacaagcuugucagugagucugguucucgugggcgucgugacccuguaucuuggugccaugguacaggcugacuccgggugugugguuagcuggaaaaauaaggaacugaagugcggaucuggcauuuucaucacugauaacguccacacauggaccgagcaguacaaauuucaacccgaaucaccaaguaaguuggccagcgcaauacagaaagcccaugaggaagguauuuguggcaucagauccgugacuaggcucgagaaucugauguggaagcagauuacccccgaguuaaaccacauccugucugaaaaugaggugaaacuaacaauaaugacgggggacaucaagggaauuaugcaggcuggcaaacggucgcuccgcccucaaccaaccgaacugaaguauagcuggaagacuugggggaaagccaagaugcuuuccacagagucacauaaccagaccuucuugaucgauggaccggaaacagcagagugccccaauacuaacagagcguggaauagucuggaggucgaagacuacggcuuugguguuuucaccacgaacauuuggcucaaacugagggagaagcaggacguguuuugugauucuaaauuaaugagcgcugccaucaaggacaaucgugcagugcacgccgauaugggguauuggauagaauccgcucugaacgacacauggaagauggagaaagccucauucauugagguaaagagcugccacuggccuaaaucucauacccuuugguccaauggagucuuggaaagugagaugaucaucccaaagaacuucgcaggccccgugagccagcacaacuaccggccugguuaucauacucaaaccgcuggcccauggcaccucgggaaacuggaaauggauuuugaccuaugugagggaacaacuguuguggucaccgaagauugcggcaaucgagggcccucucugagaacaacgaccgccuccggaaagcucauuacugaguggugcuguaggucaugcacacugccgccucuucgcuaccggggcgaggacgguuguugguacgggauggaaaucagaccauugaaggagaaagaagagaaccuggugaauaguuuaguuaccgcgggacauggccagauugauaacuucagccucggugugcugggcauggcccuuuuucuggaagagauguugaggacucgcauagggacaaagcacgcuauccuccugguagcagucucguucgugacccuaauuacgggaaauauguccuuucgagaccugggccgggugauggucaugguuggggccacuaugaccgaugacaucggaaugggcgugacauaucucgcucugcuugccgcauucaaaguacgucccaccuuugcggccgguuugcuguuaagaaagcucacuucuaaagagcugaugauggcuacaauugggaucgcccuucugagccagucaaccauaccugaaacaauccuagagcucacugaugcacuggcuuugggaaugauggugcugaagauugucaggaacauggaaaaguaccaauuagccgugaccaucauggcaauuaguugcguucccaaugccgugauccuccagaacgcuuggaaagucuccuguacgauacuggcggccgugucuguuagcccacuucuguugacauccucacagcagaaggcagacuggauuccucucgcucugaccaucaaaggccuaaaucccacugccaucuuccugaccacacuuagccgcacuaguaagaaacggucuuggccacucaacgaggccauuauggcugugggcauggucuccauacuggcaagcucguugcugaagaaugacaucccgaugaccgggccuuuaguagccggaggucuccugacggugugcuauguucuuacaggcagaucagcggaucuggaauuggagagggcugccgacgugaaaugggaggaucaagcagaaauuucugggaguucccccauccucagcauuaccaucucugaggacggaagcauguccauaaagaacgaagaggaggaacagacucugacaauccuaauucgaaccggccugcuugucaucucagguguguuuccaguaaguauucccaucacugccgcugcaugguaccucugggaggugaagaaacagcgcgccgggguccugugggauguuccuagcccacccccuguggaaaaggcggaguuggaagacggagcuuaucggauaaaacagagaggcauuuuaggcuacucucaaaucggggccggaguguauaaggaggguacauuccacaccauguggcaugucacgaggggcgcagugcugaugcaccgugggaaacgcaucgagccguccugggccgauguuaagaaggaccucauuucauacggaggcgguuggaaacuggaaggggaguggaaggaaggagaggaaguacaggugcuugcucuggagccaggcaaaaauccccgggccguccagacuaagccuggcaucuuuaaaaccaacacagggaccauaggagcagugaguuuggauuucagcccagguacauccggcucucccauuguugacagaaaggggaagguggucggacuauacggcaauggugugguaacuaggucgggggcuuaugucagcgccaucgcgcagaccgagaaaucaauugaagauaacccugagaucgaagacgauauauuucgaaagaaacggcugacgauuauggaccuccauccgggagccggcaagacaaaacgcuaccugcccgcaaucgugagagaggcuaucaagaggggccuucggacuuuaauucuggccccaacccgaguuguggcugcagaaauggaggaggcccucagaggguugccuauccgcuaucaaacacccgccauuaagacccagcacacuggaagggaaauagucgaccugaugugucaugcuaccuucacaaugcgucuccuguccccagugcggguuccuaacuacaaucuuaucauuauggaugaggcgcacuucacggaccccgcaaguaucgccgcuagagguuauaucucuacuaggguggaaaugggcgaggccgcagggauuuuuaugaccgccacaccaccgggaagccgcgauccuuucccccaguccaacgcuccaauaauggacgaggaacgagagauccccgaaagaucauggaauucuggccacgagugggucaccgauuuuaaagguaagacugugugguucguaccuagcauuaaagcggggaacgacaucgccgcaugccugcggaagaauggaaaaaaggugauucaauugaguaggaagacauuugauuccgaauacguuaaaacccgcgcuaacgacugggauuucgucgugacgacugacaucagcgagaugggcgccaauuuuaaggcagagcgugugauagauccaagacgguguaugaaacccgucauccuaacagacggcgaagagaggguaauucuggccgggccuaugccggugacccauucuucagcugcccagcgccgaggaagaaucggucggaacccaaagaaugaaaacgaccaguauauuuacaugggcgagccccucgaaaaugaugaggacugcgcgcacuggaaagaggcaaagauguuacuggauaacaucaauaccccugaagggauaauucccuccauguucgagccagaaagggagaaaguugacgccaucgauggagaauaccgccuuagaggcgaggcuaggaagacuuuuguggaccugaugcggcguggugaucucccugucugguuggccuauaagguggcugcagaggggauuaacuacgccgaccgcaaaugguguuucgauggcaucaagaauaaccagauacuggaagagaacaucgaaguugagauuuggacaaaagagggagaacgaaagaaacucaagcccagauggcuggacgcuaggaucuauagugauccacuugcccuaaaggaguuuaaagaauucgcagcgggccggaagagccugaccuugaauuuaauuacagagauggggcgccugccuacuuucaugacgcaaaaagccagaaacgcucucgacaaucuggccgugcuucauaccgcagaagcuggagguagggccuacaaccacgcacugucggagcucccggagacauuggaaacucugcuacugcucacccuucuggccacagucaccggcgggaucuuuuuauucuugaugucuggaaagggcguggguaaaaugacucuggggaugugcugcauaauuacggcuuccauccuccugugguaugcgcagauccagccccacuggauugccgcaagcaucauacuugaguuuuuccugauuguacucuugaucccagaaccugagaagcagcggaccccccaagauaaucagcugacauacgugguuauugcuaucuuaacugucguggccgccaccauggcaaacgaaaugggcuuucuagagaagacaaaaaaggaccugggacucggcucaauaaccacucaggagagugaaucuaauauccuugacauugaucugcgaccagcuuccgccuggacauuguaugcgguggcuacgaccuucgucacuccuaugcugagacauagcaucgagaacucaaguguuaaugugagccucacagccauugcaaaccaggccaccguacugauggggcuuggaaaagguuggccccucuccaagauggacaucggcgugccgcuguuggcuauuggguguuacucucaagucaauccaaucacccugacagcagccuuacuacugcucguggcgcacuacgcuauaauuggaccuggccuucaggccaaagcaacucgcgaagcccagaagagggcugccgcagguaucaugaagaaccccacgguugaugggaucaccgugauugaccuggagccaauacccuaugauccuaaauuugaaaagcaguugggccaagucaugcugcucauccugugcguaacacaggugcuuaugaugcggacuaccugggcuuuaugugaggcccugacacucgcgaccggaccgauuagcacuuugugggagggcaaucccgggcguuucuggaacacgacaaucgccguuuccauggcaaauauuuuuagaggaucauaccuggcuggcgccggucuacuguucucuaucaugaaaaacaccacuaauaccaggcgcgggacaggaaacauaggcgaaacucucggugagaaguggaaaagucggcuuaacgcacugggcaagucggaauuucagguguauaaaaagagcgggauccaagaggucgaccgaaccuuggcuaaggagggaauuaaaagaggcgaaacagaucaucacgccguguccagggggucugccaagcugcgcugguucgucgagcggaauauggugacgccagaaggaaaaguuguggaccucggcugcgguagagggggauggucauacuauuguggcggucugaagaacguacgugaggugaaaggcuuaaccaaggggggaccuggccaugaagagcccaucccuaugagcacuuacggguggaaucuugucaggcugcaguccggaguugauguguuuuucacaccacccgagaagugcgacacccuccuaugugauauuggcgaaaguucuccuaacccaacuaucgaggcgggucggacacugcgcgucuugaaucugguggaaaacuggcucaauaacaauacccaguucugcauaaaaguacuuaaccccuauaugccgagcgugauugagaagauggaagcucugcagcgaaaauacgggggagcauugguuagaaauccucugucaaggaacuccacgcacgagauguacugggugaguaaugccaccggcaacaucgucagcucugugaauaugaucucccggaugcucauuaaccgcuuuacaaugaagcacaaaaaggcuacuuaugagccagacgucgauuuaggcucagggaccagaaacauaggaaucgaaagcgagauucccaaucuggacaucauugguaagaggaucgaaaaaauaaagcaagagcaugaaacaucguggcacuacgaccaggaucauccuuauaaaacuugggccuaccacggcucuuaugagaccaagcagacagggagugcauccagcauggugaacggaguuguacgacuucugaccaaaccaugggacgugguccccauggugacucagauggccaugacggauacaaccccguucggccaacagcggguuuuuaaggagaagguggacacucguacccaggaaccuaaagaggguacaaagaaacuaaugaagaucacggcugaauggcucuggaaagagcuggggaagaaaaagacccccagaauguguacucgcgaggaauucacaaggaagguccggucaaaugcggccuugggagcaauuuuuaccgaugagaacaaauggaaguccgcuagagaagccguggaggacggccgcuucugggaacugguagauagggagcgaaaucuccaccuugagggcaaaugcgaaacuuguguguacaacaugauggggaagcgggagaaaaagcugggagaauuugguaaggcaaaaggcucuagagccaucugguauaugugguuaggggcuagguuccuggaguuugaagccuugggauuccucaaugaggaccauugguuuagccgcggcaacagucuguccgguguugagggggaaggacuacaccgucuuggcuacauucugcgggaugucggcaagaaagaggggggagcgauguacgcagacgauacagccgguugggacaccagaaucacacucgaagaccugaagaaugaggaaauggugacuaaccauaugaaaggcgagcacaagaaguuggcugaggccauuuucaaacugaccuaucagaauaagguggucaggguucaacgcccaacgccucgagggaccgugauggauauaaucagccggagagaccagaggggaucuggccagguagguacauacgggcucaacacuuuuaccaauauggaagcacaacuuauucgccagauggagggagaaggcaucuucaaaucaauccagcaucugacagcuacugaggagauugccgugcagaacugguuagcuagagucggccgggaaaggcugagucguauggccauauccggggaugacugcgugguuaagcccaucgaugaccgauucgcaagcgcguugaccgcccucaaugauaugggaaaagugcgcaaggacauucaacagugggagccaucuagagguuggaacgauuggacgcagguccccuuuugcucgcaccacuuccaugaacuggugaugaaggacggccggguacuaguugugccuuguaggaaccaggaugagcuuaucgggcgcgcuagaauuucacaaggagccggcuggagccugaaagaaacagcaugccucgguaaguccuaugcucagauguggacccugauguacuuucaccggagggacuugcgauuagccgcaaaugccaucuguagugcggucccaccgcauugggugcccacuucucguacaaccuggagcauacacgcuaaacacgaguggaugacuaccgaggauaugcuggccguguggaacagagucuggauccaggaaaauccuuggauggaggacaagacaccaguugaauccugggaggaagugcccuaucucgggaaacgcgaggaccaguggugcggaucacuuauuggccugacgagucgggcaaccugggccaagaacauccaaacugcuauuaaucagguaaggucucuaaucggcaacgaggaauacacagauuauaugccuagcaugaagagauuccgccgggaggaagaggaagccggggugcugugguga

SEQ ID NO: 14466 - RNA, 9876 nt, Artificial Sequence
  derived and/or modified CDS sequence (opt3) from DENV-2__GU131955__SS-prME
accgcaggcgugaucguaaugcugauuccaacaguuauggcuuuccaccucacuacgagaaacggggagccucauaugauagugggaagacaggaaaaggguaaaagccuucuguuuaagaccgaggacggcguaaauaugugcacauugauggcaaucgauuuaggggaacugugugaggacacuauuaccuacaaaugcccacuacuccggcaaaacgaaccggaggauaucgacuguuggugcaauuccacaucuaccugggugacuuauggaacauguucaaccacgggcgagcaccgccgagaaaagcguagugucgcccuggugccccauguugguauggggcuugagacuagaaccgaaacauggaugagcuccgagggagcguggaaacacgugcagaggauugagacuuggauccugcggcauccuggcuucaccauaauggcugccaucuuggcauacacaauuggcaccacgcacuuucagcgcgcccucaucuucauucugcugacugcugucgcaccaucuaugacaaugagaugcaucgggauaucgaacagggauuuuguggaaggaguaucagguggcagcuggguugacauugugcucgagcacgggaguugugucaccacuauggccaagaauaagcccacauuagauuucgaacugaucaaaaccgaggcuaagcagccugccacgcuucggaaauauugcauugaagcgaaguugaccaacacaacuaccgagucccgcuguccaacacaaggagagcccucucugaaugaagaacaggacaaacgauuuaucugcaagcauagcaugguggauagaggcugggguaacggguguggacuauucggcaagggcgggaucgugacuugcgcaauguuuaccugcaaaaagaauauggaaggaaaagucguucagccugagaaccucgaauacacaauugugauaaccccacacuccggugaggagcaugccguaggcaaugacacugggaagcacggaaaagaaaucaagauuacgccgcagucaaguaucacagaggcugaacugaccggcuaugguacugugaccauggaguguagccccaggacagggcuugauuucaacgaaaugguccuguugcaaauggaggacaaagccuggcucgugcaccggcagugguuucuggauuuaccucugccauggcuccccggcgcagacacccagggaucuaauuggauacagaaggagacucuuguuacauucaagaacccucaugcuaaaaagcaagacguggucgugcugggcucccaggaaggggccaugcacacggcguugaccggagccacugagauucagaugucaagcgguaaucuacuguuuacaggccaucucaaaugccgucugcgcauggauaaacuucaacugaaagggaugaguuacucuauguguaccggaaaguucaagaucguaaaagaaaucgcagagacacagcacggcacuauuguuaucagagugcaguaugagggugacggguccccaugcaagauucccuucgaaauaaccgauuuggagaaaaggcauguccucggccggcugaucacggugaacccgauugucaccgaaaaggacagcccugugaacaucgaggcugaacccccauuuggagauucguacaucauuauaggcguugagccugggcaguuaaaacugaauugguucaagaagggaucuuccaucggucaaauguuugagacaacuaugcgaggcgccaaacgcauggcuauucuaggggacaccgccugggauuucggaucacucggcgguguguuuacaaguaucgggaaggcacugcaccagguauucggcgccauuuacggagcugcguuuagcggcgucuccuggacuaugaaaauccuuauaggggugaucauuaccuggaucggaaugaacucuagaagcacgucauugaguguuucccuggugcucgucggcgugguaacacuguaucuuggugcaauggugcaggccgacagcggguguguugucucuuggaagaauaaagaacugaagugcggaucaggcauuuucaucaccgauaacgugcacacuuggacagagcaguacaaguuucaacccgaaaguccaagcaaauuggcuuccgccauacagaaggcacaugaggaagguauuuguggcaucaggucugugacccggcucgagaaucugauguggaaacagauuacucccgaguuaaaccacauccugucggaaaaugaggucaagcuaaccauaaugacaggggacaucaaaggaauuaugcaggccggcaagcgcagccucagaccucaaccaacggaacugaaauauuccuggaagaccugggggaaggcuaaaaugcuuucaacugagagucauaaccagacauucuugaucgauggaccggaaaccgccgagugccccaauacaaacagggcauggaacucucuggagguugaagacuacggcuuugguguguucacuaccaacauuuggcucaagcugcgugagaaacaggacguguuuugugauagcaaguuaauguccgcggcuaucaaagacaaucgggccguacacgcagauaugggguauuggauagaaucagcccugaacgacacguggaagauggagaaggcuagcuucauugaggucaaaucuugccacuggccuaagucccauacacuuuggaguaauggaguguuggaaagcgagaugaucauccccaagaauuucgccggccccguuucucagcacaacuaccgaccugguuaucauacccaaacugcaggcccauggcaccucgggaagcuggaaauggauuuugaccuaugugagggaaccacaguggucgugacugaagauugcggcaauagagggcccucccugaggaccacaacggcuucaggaaaacucauuaccgaguggugcugucgcaguugcacucugccgccucuucgguacagaggcgaggacgguuguugguacgggauggaaaucaggccauugaaggagaaggaagagaaccugguuaauagcuuagugacagccggacauggccagauugauaacuucucgcucgguguacugggcauggcgcuuuuucuggaagagauguugcgcacccgaauagggacuaaacacgccauccuccuggucgcugcauccuucgugacacuaauuaccggaaauaugucuuuucgggaccugggccgugugauggucaugguuggggccacgaugacugaugacaucggaaugggcgugaccuaucucgcucugcuugccgcauucaagguaagacccacauuugcggccgguuugcuguuaaggaaacucaccagcaaggagcugaugauggcuacuauugggaucgcccuucugucacagaguacaauaccugaaaccauccuagagcucacagaugcacuggcuuugggaaugauggugcugaaaauuguccgcaacauggaaaaguaccaauuagccgugacuaucauggcaauuuccugcguucccaaugccgugauccuccagaacgcuuggaaggucucuuguaccauacuggcggccgugagcguuuccccacuucuguugacgucaagccagcagaaagcagacuggauuccucucgcucugacaaucaagggccuaaaucccaccgccaucuuccugacuacccuuagucggacaucuaaaaagagauccuggccacucaacgaggccgugauggcugucggcaugguaagcauucuggcaucgucauugcugaaaaaugacauaccgaugacugggccuuuaguggccggaggucuccugaccguuugcuaugugcuuacgggcaggucugcggaucuggaauuggagcgagcugccgacgucaagugggaggaucaagcagaaaucaguggguccagccccauucucucuaucacaauuagcgaggacggauccaugucaaucaaaaacgaagaggaggaacagacccugacuauacuaauccgcacaggccugcuugugauuagugguguauuuccagugagcauccccauuaccgccgcugcaugguaccucugggaggucaagaagcagcgggccgggguucugugggaugugccuucuccacccccuguggaaaaagcggaguuggaagacggagcuuauagaaucaagcagaggggcauauuaggcuacucccaaauuggggccggagucuauaaagaggguacuuuccacacaauguggcaugugacccguggcgcaguucugaugcaccgcgggaagcggaucgagccgucaugggccgaugucaaaaaggaccucaucaguuacggaggcgguuggaagcuggaaggggaguggaaagaaggagaggaagugcagguccuugcucuggagccaggcaagaaucccagagccgugcagacgaaaccuggcauuuuuaagacuaacaccgggacaaucggagcaguuagcuuggauuucuccccagguaccucuggcucgcccauaguggacaggaaagggaaggucgugggacuauacggcaaugguguagucacacgaagcggggcuuaugugucagccauugcgcagacugagaaguccaucgaagauaacccugagauugaagacgauaucuuucggaaaaagcgccugaccauaauggaccuccauccgggagccggcaaaacgaagagauaccugcccgcaauuguuagggaggcuaucaaacggggccuucgaacauuaauccuggccccaacuagaguggucgcugcagaaauggaggaggcccuccgcggguugccuauuagguaucaaacccccgccaucaagacagaacacaccggacgugagauuguggaccugaugugucaugcuacuuucaccaugcggcuccugaguccaguuagagugccuaacuacaaucuuauaaucauggaugaagcgcacuucacagaccccgcaucuauugccgcuagggguuauaucagcacgcgcgucgagaugggcgaggccgcagggaucuuuaugacugccaccccaccgggaucccgagauccuuucccccagucaaacgcuccaauuauggacgaagagagagaaauacccgagcggucuuggaauagcggccacgaaugggugacagauuuuaaggguaaaaccguaugguucgugccuaguaucaaggcggggaacgacauugccgcaugccugaggaaaaauggaaagaaaguuauccaguugucccgcaagacuuuugauagcgaguacgucaagacacgugcuaacgacugggauuucguggugaccacggacauuucugagaugggcgccaauuuuaaagcagaaagagucaucgauccacggagguguaugaagcccguaauacuaacugacggcgaggaacgcgugauccuggccgggccuaugccgguuacacauucauccgcugcccaacgaagaggacggauugguaggaaccccaaaaaugagaacgaccaguauaucuacaugggcgaaccccucgagaaugaugaggacugcgcgcacuggaaggaagcaaaaauguuacuggauaacauuaauaccccugaggggaucauacccaguauguucgaaccagagcgcgaaaagguggacgccauugauggagaguacagacuuaggggcgaggcucggaaaaccuuugucgaccugaugcgucgcggugaucucccugugugguuggccuauaagguugcugcagaagggaucaacuacgccgaccgaaagugguguuucgauggcauuaaaaauaaccagauccuggaggaaaacauggagguggagauauggacuaaggaaggagagaggaaaaagcucaaacccagguggcuggacgcucggaucuauagcgauccacuugcccuaaaggaauuuaaggaguucgcagcgggccgcaaaucgcugacauugaauuuaauuaccgaaauggggagacugccuacauucaugacucagaaggccaggaacgcucucgacaaucuggccguccuucauacggcagaggcuggaggucgggccuacaaccacgcacugucugagcucccggaaaccuuggagacacugcuacugcucacucuucuggccaccgugacaggcgggaucuuuuuauucuugauguccggaaaaggcauugguaagaugacccuggggaugugcugcaucauaacugcuagcauucuccugugguaugcgcaaauccagccccacuggaucgccgcaucaauuauccuugaauuuuuccugauaguacucuugauuccagagccugaaaaacagcgaacgccccaggauaaucaacugaccuacgugguuaucgcuauuuuaacagucguggccgccacuauggcaaacgagaugggcuuucuagagaagaccaagaaagaccugggacucggcaguaucacaacccaggaaucugaguccaauauacuugacaucgaucugagaccagcuagcgccuggacuuuguaugcgguggcuacaacguucgucaccccuaugcugcgccauucaauugaaaacaguagcguuaaugugucccucacugccaucgcaaaccaggccacaguacugauggggcuuggaaaggguuggccccucucuaaaauggacauuggcgugccgcuguuggcuaucggguguuacagccaggucaauccaauuacccugaccgcagccuuacuacugcucguggcgcacuacgcuaucauaggaccuggccuucaagccaaggcaacaagggaggcccagaaacgggcugccgcagguauuaugaagaaccccacuguugaugggaucacggugaucgaccuggaaccaauucccuaugauccuaaguuugagaaacaguugggccaggucaugcugcucauacugugcguaacccaagugcuuaugaugcguacaacuugggcuuuaugugaggcccugacccucgcgacaggaccgaucuccaccuugugggaaggcaaucccgggagauucuggaacacuacgauugccguuucaauggcaaauaucuuuaggggaucuuaccuggcuggcgccggucuacuguucaguauuaugaagaacacaaccaauacucgccgggggaccggaaacaucggcgagacacucggugaaaaauggaagucgcgacuuaacgcacugggcaaaagcgaguuucagauauauaagaaauccgggauccaggagguggacagaacuuuggcuaaggaaggaauuaagaggggcgagaccgaucaucacgccgucucucgcgggucagccaaacugcggugguucguggaaagaaauauggucacaccagagggaaaggugguugaccucggcugcggucgugggggauggagcuacuauuguggcggucugaaagaugugagggaaguaaagggcuuaacgaaagggggaccuggccaugaggagcccaucccuauguccaccuacggguggaaccuugugcggcugcaaaguggaauugacgucuuuuucacuccacccgaaaagugcgauacacuccuaugugacaucggcgagucuagcccuaauccaaccauagaagcgggucgcacucugcgaguuuugaaccugguggagaauuggcucaacaauaacacacaguucugcauuaagguccuuaaucccuauaugccgucagugaucgagaaaauggagacccugcagagaaaguacgggggagcuuugguaaggaacccucugucccggaauaguacgcacgagauguacugggugagcaacgcaaccggcaauaucguuucuuccgugaacaugauuucacgcaugcucauaaauagauuuacaaugaaacacaagaaagccacuuaugaaccagaugucgacuuaggcagcgggaccaggaacaucggaauugagucggaaauccccaaccuggacauuaucgguaagcgaauagagaagaucaaacaggaacaugagacaucuuggcacuacgaucaagaccauccuuauaagacuugggcuuaccacggcaguuaugagaccaaacagacaggguccgccagcucaauggugaauggagucgugcggcuucugaccaagccaugggauguuguacccauggugacucagauggcaaugacggacacaaccccguucggccagcaacgugucuuuaaagaaaagguggauacuagaacccaggagccuaaggaagguacgaaaaagcuaaugaaaauuacagccgaguggcucuggaaggagcuggggaaaaagaaaaccccacgcauguguacuagggaagaguucacacggaagguuagauccaacgcugcguugggagccaucuuuaccgacgaaaauaaguggaaaucugcacgcgaggcuguggaagauggcagguucugggagcuggucgaccgagagcggaaccuccaccuugaaggcaagugcgagacuuguguguacaauaugauggggaaaagagaaaagaaacugggagaguuugguaaggccaagggcagcagggcaauuugguauaugugguuaggggcccgcuuccuggaauuugaggcuuugggauuccucaacgaggaucauugguuuagucguggcaauucccugagcgguguagaaggggagggacuacaccggcuuggcuacauccugagagacgugggcaaaaaggaagggggagccauguacgcggaugacacagcagguugggacaccaggauuacacucgaggaucugaaaaacgaagagaugguuacuaaucauaugaagggcgagcacaaaaaguuggccgaagcuauauucaagcugaccuaucagaacaaagucgugcgcgugcagcgaccaacgccucgggggaccgucauggacaucauuucuagaagggaucaacgcggaucaggccagguugguacauacgggcucaauacuuuuaccaacauggaggcccagcuuaucagacaaauggaaggagagggcaucuucaagaguauucagcaucugacagcaacugaggaaauagcugugcagaauugguuagcccggguaggcagggagcgucugucccgaauggcuaucagcggggacgauugcguggucaaacccauugacgaucgcuucgccucugcauugaccgcgcucaacgacaugggaaaggugagaaaagauauccagcaaugggaaccaucgcgggguuggaaugacuggacgcagguucccuuuugcucacaccacuuccaugagcuggugaugaaggauggcaggguccuagugguaccuugucgcaaccaggacgaacuuauugggagagcccggaucagccagggagcuggcuggucccugaaggagacagccugccucgguaaaaguuaugcacaaauguggacccugauguacuuucacaggcgagauuugcguuuagcugccaacgcaauauguucugccguuccaagccauugggugccgacuuccagaacaaccuggucaauccacgcgaagcacgaguggaugacuaccgaagacaugcuggcugucuggaaucgcguguggauucaggagaaccccuggauggaagacaaaacaccuguggagaguugggaagaggucccauaucucgggaagcgggaggaucaguggugcggaucucuuaucggccugacgagcagggccaccugggccaaaaauauucagacugccaucaaccaaguuagaucccuaauaggcaaugaagaguacacagacuauaugcccucaaugaagcgcuuccggaaggaagaggaagaggcuggggugcugugguga

SEQ ID NO: 14467 - RNA, 9876 nt, Artificial Sequence
  derived and/or modified CDS sequence (opt3) from DENV-2__KJ189311__SS-prME
accgccggcgugaucgucaugcugauucccacaguuauggcuuuccaccucacuacgagaaacggggagccucauaugauagugggaaggcaggaaaaggguaaaagccuucuguuuaagaccgaggacggcguaaauaugugcacauugauggcaaucgauuuaggggaacugugugaggacacuauuaccuacaaaugcccacuacuccggcaaaacgaaccggaggauaucgacuguuggugcaauuccacaucuaccuggauuacuuauggaacauguucaaccacgggcgagcaccgccgagaaaagcguaguguggcccuggucccccauguggguauggggcuugagacuagaaccgaaacauggaugagcuccgagggagcguggaaacacguucagaggaucgagacuuggauacugcggcauccuggcuucaccaucauggcugccauuuuggcauacacaaucggcaccacgcacuuucagcgcgcccucauuuucauccugcugacugcuguggcaccaucuaugacaaugagaugcauagggauuucgaacagggauuuugucgaaggagugucagguggcagcuggguagacaucguucucgagcacgggaguugugugaccacuauggccaagaauaagcccacauuagauuucgaacugauuaaaaccgaggcuaagcagccugccacgcuucggaaauauugcaucgaagcgaaguugaccaacacaacuaccgagucccgcuguccaacacaaggagagcccucucugaaugaagagcaggacaaacgauuuaucugcaagcauagcauggucgauagaggcugggguaacggguguggacuauucggcaagggcgggauugugacuugcgcaauguuuaccugcaaaaagaauauggaaggaaaagugguccagccugagaaccucgaauacacaauaguuaucaccccacacuccggugaggagcaugccgugggcaaugacacugggaagcacggaaaagaaauuaagaucacgccgcagucaaguauaacagaggcugaacugaccggcuaugguacuguaaccauggaguguagccccaggacagggcuugauuucaacgaaauggugcuguugcaaauggaggacaaagccuggcucguccaccggcagugguuucuggauuuaccucugccauggcuccccggcgcagacacccagggaucuaauuggauucagaaggagacucuugugacauucaagaacccucaugcuaaaaagcaagacguugugguccugggcucccaggaaggggccaugcacacggcguugaccggagccacugagauccagaugucaagcgguaaucuacuguuuacaggccaucucaaaugccgucugcgcauggauaagcuucaacugaaagggaugaguuacucuauguguaccggaaaguucaagaucgugaaagaaauugcagagacacagcacggcacuaucguaauuagaguucaguaugagggugacggguccccaugcaagauacccuucgaaaucaccgauuuggagaaaaggcaugugcucggccggcugauuacggucaacccgaucgugaccgaaaaggacagcccugucaacaucgaggcugaacccccauuuggagauucguacauuauaaucggcguggagccugggcaguuaaaacugaauugguucaagaagggaucuuccauuggucaaauguuugagacaacuaugcgaggcgccaaacgcauggcuauccuaggggacaccgccugggauuucggaucacucggcgguguuuuuacaaguauugggaaggcacugcaccagguguucggcgccaucuacggagcugcguuuagcggcguauccuggacuaugaaaauacuuaucggggucauuaucaccuggauuggaaugaacucuagaagcacgucauugagugugucccugguucucgugggcgucgugauccuguaucuuggugcaaugguacaggccgacagcgggugugugguuucuuggaagaauaaagaacugaagugcggaucaggcauauucauuacagauaacguccacaccuggacugagcaguacaaguuucaacccgaaaguccaagcaaauuggcuuccgccauccagaaggcacaugaggaagguauuuguggcaucaggucugugacacggcucgagaaucugauguggaaacagauaacccccgaguuaaaccacauccugucggaaaaugaggugaagcuaacuauuaugaccggggacaucaaaggaauuaugcaggccggcaagcgcagccucagaccucaaccaacagaacugaaauauuccuggaagacgugggggaaggcuaaaaugcuuucaaccgagagucauaaccagacuuucuugaucgauggaccggaaacagccgagugccccaauaccaacagggcauggaauucucuggaggucgaagacuacggcuuugguguuuucacaacuaacauauggcucaagcugcgugagaaacaggacguguuuugugauagcaaguuaauguccgcggcuauuaaagacaaucgggccgugcacgcagauaugggguauuggaucgaaucagcccugaacgacaccuggaagauggagaaggcuagcuucaucgagguaaaaucuugccacuggccuaagucccauacgcuuuggaguaauggagucuuggaaagcgagaugauuaucccaaaaaacuucgccggccccgugucucagcacaacuaccgaccugguuaucauacacaaaccgcaggcccauggcaccucgggaagcuggaaauggauuuugaccuaugugagggaacuaccguuguggucacagaagauugcggcaauagagggcccucccugaggacuaccacagcuucaggaaaacucauuacggaguggugcugucgcaguugcacccugccgccucuucgguacagaggcgaggacgguuguugguacgggauggaaauaaggccauugaaggagaaggaagagaaccuggugaauagcuuaguuacugccggacauggccagaucgauaacuucucgcucggugugcugggcauggcgcuuuuucuggaagagauguugcgcacacgaauugggaccaaacacgccauccuccugguagcugcauccuucgucacucuaauuacaggaaauaugucuuuucgggaccugggccgugugauggugauggucggggccaccaugacggaugacaucggaaugggcguuacuuaucucgcucugcuugccgcauucaaggugagacccaccuuugcggccgguuugcuguuaaggaaacucacaagcaaggagcugaugauggcuaccauagggaucgcccuucugucacagaguacuauuccugaauccauccuagagcucacagaugcacuggcuuugggaaugaugguacugaaaauugugcgcaacauggaaaaguaccaauuagccgucaccaucauggcaauaucuugcgugcccaaugccguuauucuccagaacgcuuggaaggugagcuguacaauccuggcggccgucuccgugucaccacuucuguugacuagcagucagcagaaagcagacuggaucccucucgcucugaccauuaagggccuaaaucccacggccauauuccugacaacccuuucucggacuuccaaaaagagaagcuggccacucaacgaggccguuauggcugugggcauggucucgauccuggcaucaucuuugcugaaaaaugacauuccgaugaccgggccuuuaguagccggaggucuccugacagugugcuauguucuuacuggcaggagugcggaucuggaauuggagcgagcugccgacgugaagugggaggaucaagcagaaaucuccgggagcucucccauucucagcaucaccauauccgaggacggaucaaugaguaucaaaaacgaagaggaggaacagacgcugacaauucuaauccgcaccggccugcuugucauuagcgguguguuuccaguaucuauccccauaacugccgcugcaugguaccucugggaggugaagaagcagcgggccgggguccugugggauguuccuuccccacccccuguggaaaaagcggaguuggaagacggagcuuauagaauuaagcagaggggcaucuuaggcuacucacaaaucggggccggaguguauaaagaggguacauuccacaccauguggcaugucacucguggcgcagugcugaugcaccgcgggaagcggauugagccgaguugggccgauguuaaaaaggaccucaucagcuacggaggcgguuggaagcuggaaggggaguggaaagaaggagaggaaguacaggugcuugcucuggagccaggcaagaaucccagagccguccagacaaaaccuggcauauuuaagaccaacacggggacuauuggagcaguguccuuggauuucucuccagguaccucgggcagccccaucguugacaggaaagggaagguggucggacuauacggcaauggugugguaacacgaucaggggcuuaugucuccgccauugcgcagaccgagaagaguaucgaagauaaccuggagauagaagacgauauuuuucggaaaaagcgccucacaaucauggaccugcauccuggagccggcaaaacuaagagauaccuuccggcaaucgugagggaggcuauuaaacggggcuuacgaacccugauccucgcccccacgagaguuguggcugcagaaauggaggaggccuugcgcgggcugccaauuagguaucaaacaccugccauaaagacugaacacaccggacgugagaucgucgaccucaugugucaugcuacauucaccaugcggcugcuuucucccgugagaguuccaaacuacaaucugauuaucauggaugaagcgcacuucacugacccugcaagcaucgccgcuagggguuauauuuccacccgcguggagaugggcgaggccgcagggauauuuaugacagccacgcccccaggaucacgagauccguucccucagucuaacgcucccaucauggacgaagagagagaaauuccagagcggagcuggaauaguggccacgaaugggucacugauuuuaaggguaaaaccgugugguucguacccuccaucaaggcggggaacgacauugccgcaugcuugaggaaaaauggaaagaaagugauccagcuaagccgcaagacauuugauucugaguacguuaagacccgugcuaacgacugggauuucgucgugacuacagacauaucagagaugggcgccaauuuuaaagcagaaagagugaucgauccucggagguguaugaagccagucauucugaccgacggcgaggaacgcguaauccucgccgggcccaugccugugacgcauuccagugcugcccaacgaagaggacggauugguaggaacccgaaaaaugagaacgaccaguauaucuacaugggcgaaccauuagagaaugaugaggacugcgcgcacuggaaggaagcaaaaaugcugcuugauaacauaaauacucccgaggggauuaucccuagcauguucgaacccgagcgcgaaaagguugacgccauugauggagaguacagacugaggggcgaggcucggaaaacauuuguggaccucaugcgucgcggugauuugccagucuggcuggccuauaagguggcugcagaagggaucaacuacgccgaccgaaagugguguuucgauggcauaaaaaauaaccagauccucgaggaaaacauggagguugagauuuggaccaaggaaggagagagaaaaaagcugaaaccuagguggcuugacgcucggaucuauucggauccccuagcccugaaggaauuuaaggaguucgcagcgggccgcaaaucuuugaccuuaaaucugauuacugaaauggggagacucccaacauucaugacccagaaggccaggaacgcucuggacaaucuugccgugcugcauacagcagaggcuggaggucgggccuacaaccacgcacucuccgaguugccugaaacucuggagacgcuacugcuccuuacccuguuagccacagucacuggcgggaucuuuuuguuccugaugagcggaaaaggcauagguaagaugacccucgggaugugcugcauuaucacagcuucaauccugcuuugguaugcgcaaauucagccgcacuggaucgccgcaaguauaauucuggaauuuuuccucaucguguugcugauucccgagccagaaaaacagcgaaccccucaggauaaucaauuaacuuacguagugaucgcuauacuaacgguugucgccgccaccauggcaaacgagaugggcuuucuggagaagacaaagaaagaccucggacuuggcucuaucacuacccaggaauccgagagcaauauucuggacaucgauuugagacccgcuucagccuggacacuguaugcgguggcuaccacuuucgugacaccaaugcuccgccauaguauugaaaacagcuccgucaauguuucucugacggccaucgcaaaccaggccaccgugcuuauggggcucggaaaggguuggccucugagcaaaauggacauuggcguacccuugcuggcuaucggguguuacucccaggugaauccgauaacuuuaacagcagcccuacugcuccuugucgcgcacuacgcuauuaucggaccaggccugcaagccaaggcaaccagggaggcccagaaacgggcugccgcagguaucaugaagaacccuaccguggaugggauuacaguuauagacuuggaacccaucccauaugaucccaaguuugagaaacagcugggccaggugaugcuccugauucuuugcgucacucaaguauuaaugaugcguacgaccugggcucugugugaggcccucacauuggcgacuggaccuaucucaacccugugggaaggcaauccggggagauucuggaacacaaccauugccgugucuauggcaaauaucuuuaggggaaguuaccuagcuggcgccggucugcucuucucgauaaugaagaacacuacgaauacacgccgggggaccggaaacaucggcgagacucuuggugaaaaauggaagagccgacugaacgcauugggcaaauccgaguuucagauuuauaagaaaucugggauccaggagguugacagaacccuggcuaaggaaggaauuaagaggggcgagacagaucaucacgccgugucacgcgggagcgccaaacuccggugguucgucgaaagaaauauggugacucccgagggaaaggucguggaccugggcugcggucgugggggaugguccuacuauuguggcgguuuaaaagauguuagggaagugaagggccuuaccaaagggggaccaggccaugaggagccuauccccaugaguacauacggguggaaccugguacggcuccaaucuggaauagacguguuuuucacgccuccagaaaagugcgauacccuacugugugacauuggcgagagcucacccaauccuacuaucgaagcgggucgcacauugcgaguccugaaccucguugagaauuggcuuaacaauaacacccaguucugcaucaaggugcugaauccauauaugcccuccgucauugaaaaaauggagacuuugcagagaaaguacgggggagcucuggugaggaacccgcucagucggaauagcacacacgagauguacuggguaucuaacgcaaccggcaauauaguguccucaguuaacaugaucagccgcauguuaauuaauagauuuacgaugaaacacaagaaagccaccuaugaaccugauguggaccugggcucggggacaaggaacaucggaauugagucugaaaucccaaaccuugacauaaucgguaagcgaauugagaagaucaaacaggaacaugagacuaguuggcacuacgaucaagaccaucccuauaagaccugggcuuaccacggcuccuaugagacaaaacagacugggagcgccucauccauggucaauggagugguccggcugcuaaccaagccuugggaugugguuccaaugguaacacagauggcaaugaccgacacuacgcccuucggccagcaacguguguuuaaagaaaaggucgauacaagaacccaggagccgaaggaagguacuaaaaagcucaugaaaauuaccgccgaguggcuguggaaggaguuggggaaaaagaaaacaccucgcauguguacgagggaagaguucacccggaaggugagaucuaacgcugcgcugggagccaucuuuacugacgaaaauaaguggaaaagcgcacgcgaggcuguugaagauggcagguucugggagcucguggaccgagagcggagucuucaccuggaaggcaagugcgagacaugugucuacaacaugauggggaaaagagaaaagaaauuaggagaguuugguaaggccaagggcuccagggcaauuugguauauguggcugggggcccgcuucuuggaauuugaggcucucggauuccugaaugaggaucauugguuuagccguggcaacucucuaucagguguggaaggggagggacuucaccggcugggcuacauacucagagacguaggcaaaaaggaagggggagccauguacgcggaugacaccgcagguugggacacuaggaucacacuggaggauuugaaaaaugaagagauggugaccaaccauaugaagggcgagcacaaaaagcuggccgaagcuauuuucaagcucacauaucagaauaaaguuguccgcgugcagcgacccacuccacgggggaccgugauggacaucaucaguagaagggaucaacgcggauccggccaggucgguacguacgggcuuaacaccuuuacaaauauggaggcccagcugauuagacaaauggaaggagagggcauauucaagaacauccagcauuuaacugcaaccgaggaaauugcuguucagaauuggcuggcccgggugggcagggagcguuugagccgaauggcuaucucuggggacgauugcguagugaaaccuauugacgaucgcuucgccucggcacucacagcgcugaacgacaugggaaaggucagaaaagauauccagcaaugggaacccucacgggguuggaaugacuggacucaggugccauuuugcagccaccacuuccaugagcuaguuaugaaggauggcagggugcuugucgugcccugucgcaaccaggacgaacugauagggagagcccggaucucccagggagcuggcuggagucucaaggagaccgccugccuggguaaaucuuaugcacaaauguggacguugauguacuuucacaggcgagauuuacgucuggcugccaacgcaauuuguagcgccguaccuucccauuggguuccaacaucaagaaccacuuggaguauccacgcgaagcacgaguggaugacaaccgaagacaugcucgcuguguggaaucgcgucuggauucaggagaacccguggauggaagacaaaacucccguggagucuugggaagaggugccuuaucuugggaagcgggaggaucaguggugcggaagccugaucggccuaaccuccagggccacaugggcaaaaaauauacagacggccauuaaccaagucagaucacugaucggcaaugaagaguacaccgacuauaugccaagcaugaagcgcuuccggaaggaagaggaagaggcugggguucucugguga

SEQ ID NO: 14468 - RNA, 9876 nt, Artificial Sequence
  derived and/or modified CDS sequence (opt3) from DENV-2__KJ189370__SS-prME
accgccggcgugaucgucaugcugauucccacagcuauggcauuccaccucacuacgagaaacggggagccucauaugauaguuagcaggcaggaaaagggaaaaucccuucuguuuaagaccgaggacggugugaauaugugcacauugauggccaucgauuuaggcgaacugugugaggacacuauuaccuacaaaugcccacuacuccggcaaaacgaaccggaggauaucgacuguuggugcaauucuacaucaaccuggguaacuuaugggacauguaccacgacuggagagcaccgccgagaaaagcguaguguggcgcuggucccccaugugggcaugggucuugagaccagaacagaaacuuggaugagcuccgagggggcuuggaaacacguucagaggauugagaccuggauccugcggcauccuggauucacaauaauggccgcaaucuuggccuacaccauuggcacgacucacuuucagcgcgcucucaucuucauucugcugacagcaguggccccaucuaugaccaugagaugcaucggcauaucgaacagggauuuugucgaaggggugucaggagguagcuggguagacauuguucucgagcacggcaguugugugacuacaauggcuaagaauaagcccaccuuagauuucgaacugaucaaaacggaggccaagcagccugcgacccuucggaaauauugcauugaagcaaaguugacaaacacuaccacagagucccgcuguccaacucaaggggagcccucucugaaugaagagcaggacaaacgauuuaucugcaagcauagcauggucgauagaggauggggcaacgguugugggcuauucggaaagggcggcaucgugaccugcgccauguuuacaugcaaaaagaauauggaagggaaagugguccagccugagaaccucgaauacaccauuguuauaacuccacacuccggagaggagcaugcuguggguaaugacacgggcaagcacgggaaagaaaucaagauuacaccgcagucaaguaucaccgaggccgaacugacuggauauggcaccguaacaauggaguguagccccaggaccggucuugauuucaacgaaauggugcuguugcaaauggaggacaaagcauggcucguccaccggcagugguuucuggauuuaccucugccauggcuccccggggcugacacucagggcucuaauuggauacagaaggagacacuugugacguucaagaacccucaugccaaaaagcaagacguugugguccugggaucccaggaaggcgcgaugcacaccgccuugacuggggcaacagagauucagaugucaagcggaaaucuacuguuuaccggucaucucaaaugccgucugcgcauggauaagcuucaacugaaaggcaugaguuacucuauguguacagggaaguucaagaucgugaaagaaaucgcugagacucagcacggaaccauuguaaucagaguucaguaugagggcgacgguuccccaugcaagauucccuucgaaauaacggauuuggagaaaaggcaugugcucgggcggcugaucaccgucaacccgauugugacagaaaaggacagcccugucaacaucgaggccgaacccccauuuggcgauucguacaucauuauaggaguggagccuggccaguuaaaacugaauugguucaagaaggggucuuccaucggacaaauguuugagacuaccaugcgaggugcuaaacgcauggccauucuaggcgacacagcaugggauuucgggucacucggaggcguuuuuacuaguaucgguaaggcccugcaccagguguucggggcuauuuacggcgcggcauuuagcggaguauccuggaccaugaaaauccuuauaggcgucaucauuacguggaucgggaugaacucuagaagcacaucauugagugugucccugguucucgugggagucgugacccuguaucuuggcgccaugguacaggcugacagcgguugugugguuucuuggaagaauaaagaacugaagugcgggucaggaauuuucaucacugauaacguccacacauggaccgagcaguacaaguuucaacccgaaaguccaagcaaauuggccuccgcaauacagaaggcccaugaggaaggcauuugugguaucaggucugugacucggcucgagaaucugauguggaaacagauuacccccgaguuaaaccacauccugucggaaaaugaggugaagcuaacaauaaugacgggcgacaucaaagggauuaugcaggcuggaaagcgcagccucagaccucaaccaaccgaacugaaauauuccuggaagacuuggggcaaggccaaaaugcuuucaacagagagucauaaccagaccuucuugaucgaugggccggaaacagcagagugccccaauacuaacagggcguggaauucucuggaggucgaagacuacggauuuggcguuuucaccacgaacauuuggcucaagcugaaagagaagcaggacguguuuugugauagcaaauuaauguccgcugccaucaaggacaaucgugcagugcacgccgauauggguuauuggauagaaucagcucugaacgacacauggaagauggagaaagccagcuucauugagguaaagucuugccacuggccuaaaucccauacccuuuggaguaauggggucuuggaaagcgagaugaucaucccaaagaacuucgcaggacccgugucucagcacaacuaccggccuggcuaucauacucaaaccgcugguccauggcaccucggcaaacuggaaauggauuuugaccuaugugaggggacaacuguuguggucaccgaagauugcggaaaucgaggccccucccugagaacaacgaccgccucagggaagcucauuacugaguggugcuguaggaguugcacacugccgccucuucgcuaccggggagaggacggcuguugguacgguauggaaaucagaccauugaaggagaaagaagagaaccuggugaauagcuuaguuaccgcggggcauggacagauugauaacuucucgcucggcgugcuggguauggcccuuuuucuggaagagauguugaggacucgcauaggcacaaagcacgcuauccuccugguagcagucuccuucgugacccuaauuacggggaauaugucuuuucgagaccugggacgggugauggucaugguuggcgccacuaugaccgaugacaucgggaugggagugacauaucucgcucugcuugccgcauucaaaguacgucccaccuuugcggccggcuugcuguuaagaaagcucacuagcaaagagcugaugauggcuacaauugguaucgcccuucugucacagaguaccauaccugaaacaauccuagagcucacugaugcacuggcuuuggggaugauggugcugaaggucgugaggaacauggaaaaguaccaauuagccguuaccauuauggcaaucuccugcgugcccaaugccgucauucuccagaacgcuuggaaagugucuuguacgauccuggcggccguuagcguguccccacuucuguugacaucaagccagcagaaggcagacuggauaccucucgcucugaccauuaaaggacuaaaucccacugccaucuuccugaccacacuuagucgcacuucuaagaaacgguccuggccacucaacgaggccaucauggcugucggcaugguaagcauucuggcaucgucauugcugaagaaugacauaccgaugaccggcccuuuaguggccgggggacuccugacgguuugcuaugugcuuacagguagaucugcggaucuggaauuggagagggcugccgacgucaaaugggaggaucaagcagaaaucaguggcuccagccccauucucucuaucaccauuagcgaggacggguccaugucaaucaagaacgaagaggaggaacagacucugacaauacuaauccgaaccggacugcuugugauuaguggcguauuuccagugagcauccccauuacugccgcugcaugguaccucugggaggucaagaaacagcgcgccgguguucugugggaugugccuucuccacccccuguggaaaaggcggaguuggaagacggggcuuaucggaucaaacagagaggaauauuaggcuacucccaaauuggcgccggggucuauaaggagggaacauuccacaccauguggcaugugacgaggggugcaguucugaugcaccguggcaaacgcaucgagccgucaugggccgauguaaagaaggaccucaucaguuacgggggaggcuggaaacuggaaggugaguggaaggaaggggaggaagugcagguccuugcucuggagccaggaaaaaauccccgggccgugcagacuaagccuggcauuuuuaaaaccaacacaggcaccaucggggcaguuagcuuggauuucuccccaggaacaucugguucgcccauaguggacagaaagggcaaggucguggggcuauacggaaauggcguagucacuaggagcggugcuuaugugucagccauugcgcagaccgagaaauccaucgaagauaacccugagauugaagacgauaucuuucgaaagaaacggcugacgauaauggaccuccauccgggggccggaaagacaaaacgcuaccugcccgcaauuguuagagaggcuaucaagaggggccuucggacuuuaauccuggccccaacccgaguggucgcugcagaaauggaggaggcccucagaggcuugccuauucgcuaucaaacacccgccaucaaggcugaauacaccgggagggagauuguggaccugaugugucacgcgacuuucaccaugcgucuccugaguccaguucgggugccuaacuauaaucuuauaaucauggaugaagcacauuucacagaccccgccucuauugcugccagaggauacaucagcacgagggucgagaugggugaggcagccggcaucuuuaugacugcuaccccaccggggucccgcgauccuuucccccagucaaacgcgccaauuauggacgaagagcgagaaauacccgagagaucuuggaauagcggacacgaaugggugacagauuuuaaaggcaagaccguaugguucgugccuaguaucaaagccgguaacgacauugcagcuugccugcggaagaaugggaaaaagguuauccaguuguccaggaagacuuuugauagcgaguaugucaaaacacgcgccaacgacugggauuucguggugaccacggacauuucugagaugggagcaaauuuuaaggccgaacgugucaucgauccaagacgguguaugaaacccguaauacuaacugacggcgaggaaagggugauccuggcuggcccuaugccgguuacacacucauccgccgcgcaacgccgagggagaauuggacggaacccaaagaaugagaacgaccaguacaucuacaugggugaaccccucgagaaugaugaggacugcgcacauuggaaagaagccaagauguuacuggauaacauuaauaccccugagggcaucauacccaguauguucgaaccagagagggaaaaaguggacgcuauugauggggaguaucgccuuagaggagaggccaggaagaccuuugucgaccugaugcggcguggcgaucucccugugugguuggcuuacaagguugcagccgaagguaucaacuaugcugaccgcaaaugguguuucgaugggauuaagaauaaccagauccuggaggaaaacauggagguggagauauggacuaaagaaggcgagcgaaagaaacucaagcccagauggcuggacgccaggaucuacagcgauccacuugcacuaaaggaauuuaaagaguucgcggccggacggaagucgcugacauugaauuuaauuaccgaaaugggccgccugccuacauucaugacucagaaagcuagaaacgcccucgacaaucuggcaguccuucacacggcugaggccgggggaagggcauauaaccaugcccugucugagcucccggaaaccuuggagacacugcuacugcucacucuucuggcuaccgugacagguggcaucuuuuuauucuugauguccgggaagggaauuggcaaaaugacccuggguaugugcugcaucauaacugcgagcauucuccugugguacgcccaaauccagccccacuggaucgcagcuucaauuauccuugaauuuuuccugauaguacucuugauuccagagccugaaaagcagcggacgccccaggauaaucaacugaccuaugugguuaucgccauuuuaacagucguggccgcaacuauggcuaacgagaugggguuucuagagaagaccaaaaaggaccugggccucggaaguaucacaacccaggaaucugaguccaauauacuugacaucgaucugcgaccagccagcgcguggacuuuguacgcuguggccacaacguuccugaccccuaugcucagacacucaauugaaaacaguagcgucaauguuucccugacugcaaucgccaaccaggcuacagugcuuaugggccucgggaaaggauggccccugucuaagauggacauugguguaccguugcuggcaaucggcuguuacagccaggugaauccaauuaccuuaaccgccgcgcuacugcuccuugucgcucauuaugccaucauagggccuggacugcaagcaaaagccacacgcgaggcucagaagagggccgcagcuggcauuaugaagaaccccacuguggaugguaucacgguuaucgacuuggauccaauucccuacgacccuaaauuugaaaagcagcuggggcaggugaugcuccugauacuuugcgucacccaaguauuaaugaugcggacaacuugggcccugugugaggcgcucaccuuggccacaggcccgaucuccacccugugggagggaaaucccggccguuucuggaacacuacgauugcagugucaauggcuaauaucuuuagagggucuuaucuagccggagcaggccugcucuucaguauuaugaaaaacacaaccucgacuaggcgcgguaccgggaauaucggagaaacacuuggcgagaaguggaaaagccggcugaacgcuuuggguaaguccgaauuucagauauacaaaaagucuggcauccaggagguugaucgaacucuggccaaggaggggauuaaaagaggagaaaccgaccaccaugccgugucaaggggcagcgcgaagcuccgcugguucgucgagcggaacauggugacaccagaagggaaagucguggaucugggaugcggcagaggugggugguccuauuacuguggaggcuuaaagaauguucgugaggugaaaggucuuacgaagggcgggccuggacacgaagagcccaucccuaugaguaccuauggcuggaaccugguaaggcuccaaucugggguggacgucuuuuucacuccacccgagaagugcgauacacuacugugugacauuggagaaagcucaccuaauccaaccaucgaggcuggccggacuuugcgcguucugaaccucguggaaaauuggcuuaacaauaacacacaguucugcauaaaaguccugaaucccuacaugccguccgugauugagaagauggaagcauugcagcgaaaauacgguggggcccugguaagaaacccucucaguaggaauagcacccaugagauguauugggugucuaacgcuacgggaaauaucguuuccucagugaacaugaucagccggauguuaauuaaucgcuuuaccaugaagcacaaaaaggccacauacgagccagaugucgaccugggcucgggcacuagaaacauagggaucgaaucugaggugcccaaccuugacauuaucggaaagaggauugaaaaaaucaagcaggagcacgaaaccaguuggcauuaugaucaagaccacccuuacaaaacaugggcauaucaugguuccuacgagacuaagcagaccggcagcgccucauccauggucaauggggugguucgacugcuaacaaaaccaugggauguagugcccauggucacccagauggcuaugacugacacgacaccguucggacagcaacggguguuuaaggagaagguugauacccguacucaggaaccuaaagagggcaccaagaaacucaugaagauaacagcggaauggcuguggaaagaguuggguaagaaaaagacgcccagaauguguacccgcgaggaauucacuaggaaggugcggucuaacgccgcacugggggcuaucuuuacagacgagaauaaauggaagagcgccagagaagcagucgaggauggacgcuucugggaacucguggacagggagcgaaaccuucaccuggagggcaaaugcgaaaccuguguauauaauaugaugggcaagcgggagaaaaaguuaggggaauuuggaaaggccaaagguaguagagcuauuugguacauguggcugggcgccagguucuuggaguuugaagcgcucggguuccugaacgaggaucacugguuuucccgcggaaauagccuaucuggcguggagggugaagggcuucaucgucugggauacauccuccgggagguuggcaagaaagaaggcggggcaauguaugccgacgauacugcuggaugggacacaagaauuacccuggaggacuugaagaacgaagagauggucacaaaucacaugaaaggugagcauaagaagcuggccgaagcaaucuucaaacucacuuaccagaacaagguggugaggguccagcgcccaaccccucgaggcacgguuauggauauuauaucacggagagaccaaagggggaguggacaggugggcaccuauggucuuaauacauuuacuaacauggaggcucagcugauccgccaaauggaaggggagggaauuuucaaauccauccagcacuuaaccgccacagaggaaaucgcuguacagaauuggcuggugagagucggccgggagagguugagccguauggccauuucuggcgaugacugcgugguuaagcccauagaugaccgauucgcaucggcgcucacugcccugaacgauauggggaaagugcgcaaggacauccagcaaugggaaccaucaagaggauggaaugauuggacccagguccccuuuugcagccaucacuuccacgagcuagugaugaaggacggucggguacuuguugugccuuguaggaaccaggaugaacugauuggccgcgcuagaaucucccagggggccggauggagucucaaagagacggcaugccugggcaagucuuacgcucaaauguggacauugauguauuuucaucggagggacuuacgacuggccgcaaacgccauuuguagcgcggucccaucccacugggugccgaccucacguacuacauggaguauccaugcuaaacacgaguggaugaccacugaagauaugcucgccguguggaauagagucuggauacaggagaaccccuggauggaagacaagaccccuguugagucuugggaagaggugccauaccuugguaaacgcgaggaccaguggugcgggagccugaucggacuaacaucccgggcaacgugggccaagaauauucagaccgcuaucaaccaaguaaggucacugauuggcaaugaagaguauacugauuacaugcccagcaugaagagauuccgccgggaagaggaagaggccggcgugcucugguga

SEQ ID NO: 14469 - RNA, 9876 nt, Artificial Sequence
  derived and/or modified CDS sequence (opt3) from DENV-2__EU482620__SS-prME
accgccggcgugauaguaaugcugauuccaacggcuauggcauuccaccucacuacgagaaacggggaaccucauaugauaguuggaaggcaggaaaaggguaaaagccuucuguuuaagaccgaagacggcgugaauaugugcacauugauggccaucgauuuaggggaacugugugaagacacuauuaccuacaaaugcccacuacuccggcaaaacgaaccggaagauaucgacuguuggugcaauuccacaucuaccuggguaacuuauggaacauguaccacgacuggcgagcaccgccgagaaaagcguucaguggcgcuggucccccauguggguauggggcuugagaccagaacagaaacuuggaugaguagcgagggagcuuggaaacacguucagaggauugagaccuggauccugcggcauccuggcuucacaauaauggccgcaaucuuggccuacaccauuggcacgacucacuuucagcgcgcucucaucuucauucugcugacagcaguggccccauccaugaccaugagaugcaucgggauaucuaacagggauuuugucgaaggagugucggguggcucauggguagacauuguucucgagcacgggagcugugugacuacaauggcuaagaauaagcccaccuuagauuucgaacugaucaaaacggaggccaagcagccugcgacccuucggaaauauugcauugaagcaaaguugacaaacacuaccacagagagucgcuguccaacucaaggagagcccucccugaaugaagaacaggacaaacgauuuaucugcaagcauucuauggucgauagaggcugggguaacggguguggacuauucggcaagggcgggaucgugaccugcgccauguuuacaugcaaaaagaauauggaaggaaaagugguccagccugagaaccucgaauacaccauuguuauaacuccacacagcggugaggagcaugcugugggcaaugacacggggaagcacggaaaagaaaucaagauuacaccgcaguccucaaucaccgaggccgaacugacuggcuaugguaccguaacaauggaguguagucccaggaccgggcuugauuucaacgaaauggugcuguugcaaauggaggacaaagcauggcucguccaccggcagugguuucuggauuuaccucugccauggcuccccggcgcugacacucagggaagcaauuggauacagaaggagacacuugugacguucaagaacccucaugccaaaaagcaagacguugugguccugggcucucaggaaggggcgaugcacaccgccuugacuggagcaacagagauucagauguccucagguaaucuacuguuuaccggccaucucaaaugccgucugcgcauggauaaacuucaacugaaagggaugagcuacaguauguguacaggaaaguucaagaucgugaaagaaaucgcugagacucagcacggcaccauuguaaucagaguucaguaugagggugacgggucuccaugcaagauucccuucgaaauaacggauuuggagaaaaggcaugugcucggccggcugaucaccgucaacccgauugugacagaaaaggacuccccugucaacaucgaggccgaacccccauuuggagauagcuacaucauuauaggcguggagccugggcaguuaaaacugaauugguucaagaagggaucgucuaucggucaaauguuugagacuaccaugcgaggcgcuaaacgcauggccauucuaggggacacagcaugggauuucggaucccucggcgguguuuuuacuucaaucgggaaggcccugcaccagguguucggcgcuauuuacggagcggcauuuaguggcguaagcuggaccaugaaaauccuuauaggggucaucauuacguggaucggaaugaacuccagaucuacuagcuugucagugagucugguucucgugggcgucgugacccuguaucuuggugccguagugcaggcugacuccggguguguugucagcuggaagaauaaagaacugaagugcggaucuggcauuuucaucacugauaacgugcacacauggaccgagcaguacaaguuucaacccgaaucaccaaguaaauuggccagcgcaauacagaaggcccaugaggaagguauuuguggcaucagguccgugacucggcucgagaaucugauguggaaacagauuacccccgaguuaaaccacauccugucugaaaaugaggucaagcuaacaauaaugacgggggacaucaaaggaauuaugcaggcuggcaagcgcucgcucagaccucaaccaaccgaacugaaauauagcuggaagacuugggggaaggccaaaaugcuuuccacagagucacauaaccagaccuucuugaucgauggaccggaaacagcagagugccccaauacuaacagggcguggaauagucuggagguugaagacuacggcuuugguguguucaccacgaacauuuggcucaagcugcgugagaaacaggacguguuuugugauucuaaguuaaugagcgcugccaucaaagacaaucgggcaguacacgccgauaugggguauuggauagaauccgcucugaacgacacauggaagauggagaaggccucauucauugaggucaaaagcugccacuggccuaagucucauacccuuugguccaauggaguguuggaaagugagaugaucauccccaagaauuucgcaggccccguuagccagcacaacuaccgaccugguuaucauacucaaaccgcuggcccauggcaccucgggaagcuggaaauggauuuugacuucugugagggaacaacuguggucgugaccgaagauugcggcaauagagggcccucucuaaggacaacgaccgccuccggaaaacugauuacugaguggugcugucgcucaugcacacucccgccucugcgguacagaggcgaggacgguuguugguacgggauggaaaucaggccacuuaaggagaaggaagagaacuugguuaauagucuggugaccgcgggacauggccagauugauaacuuuagcuuagguguacucggcauggcccuguuccuugaagagaugcugcgcacucgaauagggacaaaacacgcuaucuugcucgucgcagugucguuugugacccugauuacgggaaauauguccuuccgggaccuaggccgugucaugguuauggugggggccacuaugaccgaugacaucggaaugggcguaacauaucuggcucuccuggccgcauuuaaggugagacccaccuucgcggccggucuuuugcugaggaaauuaacuucuaaggagcucaugauggcuacaauugggaucgcccugcuuagccagucaaccauaccugaaacaauccuggagcuaacugaugcacucgcucugggaaugauggucuugaaaauugugcgcaacauggaaaaguaccaacuggccguuaccaucauggcaauuaguugcgugcccaaugccgucaucuuacagaacgcuuggaagguguccuguacgauacucgcggccguuucugugagcccacugcuucugacauccucacagcagaaagcagacuggauuccuuuggcucucaccaucaagggccugaaucccacugccaucuuucuaaccacacugagccggacaaguaaaaagagaucuuggccacuuaacgaggccauuauggcugucggcaugguauccauacucgcaagcucgcuguugaaaaaugacaucccgaugaccgggccucugguggccggagguuuacucacgguuugcuaugugcugacaggcaggucagcggaucuugaacuggagcgagcugccgacgucaagugggaggaucaagcagaaauuucugggaguucccccaucuugagcauuaccaucucugaggacggaagcauguccaucaagaacgaagaggaggaacagacucucacaauccugauucgcaccggccuacuggugaucucagguguauucccagugaguauucccaucacugccgcugcaugguaccuuugggaggucaagaagcagcgggccgggguucucugggaugugccuagcccacccccuguggaaaaagcggagcuggaagacggagcuuauagaauaaagcagaggggcauuuugggcuacucucaaaucggggccggagucuauaaagaggguacauuucacaccauguggcaugugacgcguggcgcaguuuuaaugcaccgcgggaagcggaucgagccguccugggccgaugucaaaaaggaccugauuucauacggaggcgguuggaagcucgaaggggaguggaaagaaggagaggaagugcagguccuggcucuugagccaggcaagaaucccagagccgugcagacuaaaccuggcaucuucaagaccaacacagggaccauaggagcaguuagucuggauuuuagcccagguacauccggcucucccauuguggacaggaaagggaaggucgugggauuguacggcaaugguguagucacucgaucgggggcuuaugugagcgccaucgcgcagaccgagaagucaauugaagauaacccugagaucgaagacgauauauuccggaaaaagcgccuaacgauuauggaccugcauccgggagccggcaaaacaaagagauaccuccccgcaaucguuagggaggcuaucaaacggggccugcgaacucuuauuuuagccccaaccagaguggucgcugcagaaauggaggaggcccugcgcgggcucccuaucagguaucaaacacccgccauuaagaccgaacacacuggacgugagauaguggacuugaugugucaugcuaccuucacaaugcggcugcucuccccaguuagagugccuaacuacaaucugaucauuauggaugaagcgcacuuuacggaccccgcaaguaucgccgcuagggguuauaucucuacucgcgucgagaugggcgaggccgcagggauuuucaugaccgccacaccaccgggaagccgagauccuuuuccccaguccaacgcuccaauaauggacgaagagagagaaauccccgagcggucauggaacucuggccacgaaugggugaccgauuucaaggguaaaacuguaugguuugugccuagcauuaaggcggggaacgacaucgccgcaugccuuaggaaaaauggaaagaaaguuauucagcugagucgcaagacauucgauuccgaguacgucaagacccgugcuaacgacugggauuuuguggugacgacugacaucagcgagaugggcgccaauuucaaagcagaaagagucauagauccacggagguguaugaagcccguaaucuugacagacggcgaggaacgcgugauucuagccgggccuaugccgguuacccauucuucagcugcccaacgaagaggacggaucgguaggaaccccaaaaaugagaacgaccaguauauuuacaugggcgaaccccuggagaaugaugaggacugcgcgcacuggaaggaagcaaaaaugcucuuagauaacaucaauaccccugaggggauaauucccuccauguuugaaccagagcgcgaaaagguggacgccaucgauggagaguacagacugaggggcgaggcucggaaaacuuucgucgaccuuaugcgucgcggugaucugccuguguggcucgccuauaagguugcugcagaagggauuaacuacacagaccgaaagugguguuuugauggcaucaaaaauaaccagauauuggaggaaaacauggagguggagaucuggaccaaggaaggagagaggaaaaagcugaaacccagauggcucgacgcccggauuuauagugauccacuggcucuuaaggaguucaaggaguucgccgcaggccgcaaaagccuaacacugaauuugaucacugaaauggggagauuaccuacguuuaugacccagaaggcgaggaacgcccuggacaaucucgcuguccugcauacagccgaggcaggaggucgggcuuacaaccacgcccuuucggagcugccggaaacucucgagaccuugcugcuacugacacuccuugcaaccgugacuggcgggauuuuccuguuuuuaaugucuggaaaaggcaucgguaagaugacguuggggaugugcugcauaauuaccgccuccauccugcucugguaugcucaaauccagccccacuggauugcggccagcaucauacuggaguucuuucuuauuguacugcucaucccagagccugaaaaacagcgaacaccccaggauaaucaauugacuuacgugguuauugcaauccugaccgucguggcugccacaauggccaacgagaugggcuucuuagagaagaccaagaaagaccuaggacugggcucaauaacuacacaggaaagugagucuaauauccucgacauugaucuuagaccagcauccgcuuggacgcuguaugccguggcgaccacuuuugucacaccuauguugcgccauagcaucgaaaacucaaguguuaaugugagccugaccgcuauugccaaccaggcaaccguacucauggggcugggaaaggguuggccccuuuccaaaauggacaucggcgugccgcuccuggccauuggguguuacucucaggucaauccaaucacauugacugcugcacuguuacuacugguggcccacuacgcgauaauuggaccuggccuccaagcuaaggccacgagggaggcacagaaacgggccgcugccgguaucaugaagaaccccaccguugaugggaucacagugauugaccuugaaccaauacccuaugauccuaaguucgagaaacagcugggccaggucauguugcugauccucugcguaacucaagugcugaugaugcguaccacaugggcacuuugugaggcuuuaacccuggccacuggaccgauuagcacgcucugggaaggcaaucccgggagauuuuggaacacaaccaucgcgguuuccauggccaauauuuucaggggaucauacuuggcaggcgcuggucugcuauuuucuaucaugaagaacacuaccaguacacgccgggggacuggaaauauaggcgagacccugggugaaaaauggaagucgcgacucaacgcccuuggcaaaagcgaguuccagaucuauaagaaauccgggauucaggagguggacagaacacuggcaaaggaaggaaucaagaggggcgagacggaucaucacgcugucucucgcgggucagccaaauugcggugguuuguggaaagaaacauggucaccccagagggaaaggugguugaccugggcugcggucgugggggauggagcuacuauuguggcggucucaaaaaugugagggaaguaaagggccugacuaaagggggaccuggccaugaggagcccauuccuauguccacauacggguggaacuuagugcggcuucaaaguggagucgauguuuucuucaccccacccgaaaagugcgacacucugcucugugauaucggcgagucuagcccuaauccaacaauagaagccggucgcacccuacgagugcugaacuuggucgagaauuggcugaacaauaacacgcaguuuugcauuaaggugcucaaucccuauaugccgucaguaaucgagaaaauggaggcgcuucagagacaguacgggggagcucuggugaggaacccuuugucccggaauaguacccacgagauguacuggguuagcaacgcaacaggcaauaucgugucuuccgucaacaugauuucacgcaugcugauaaauagauucacuaugaagcacaaaaaggccaccuaugaaccagacguggaucucggcagcgggacaaggaacaucggaauugagucggaaauccccaacuuagacauuaucgguaaacgaauagagaagaucaagcaagaacaugagauuucuuggcacuacgaccaggaucauccuuauaaaacuugggcuuaccacggcaguuaugagaccaagcagacaggguccgccagcucaauggucaauggagugguucggcugcuuaccaaaccaugggacguagugcccauggucacucagauggcaaugacggauacaaccccguuuggccaacagcguguguucaaggaaaaaguugacacuagaacccaggagccuaaggaagguacaaagaaacugaugaagaucacggccgaguggcuauggaaagagcucgggaagaaaaagaccccacgcauguguacuagggaagaguuuacacggaaagugagauccaacgcugcgcugggagccauuuucaccgaugaaaauaaguggaagucugcacgcgaggcugucgaagacggcagguuuugggaguugguggaucgagagcggaaccugcaccucgaaggcaaaugcgagacuuguguauacaauaugauggggaagagagagaagaaacuuggagaguucgguaaagccaaaggcagcagggcaaucugguauauguggcugggggcccgcuuuuuagaguucgaggcucugggauuuuugaacgaggaccauugguucagucguggcaauucccucagcgguguggaaggggagggacugcaccggcuaggcuacauucuuagagauguuggcaagaaagaagggggagccauguacgcggacgauacagcagguugggacaccaggauaacacuggaggaccucaagaacgaagagauggucacuaaucauaugaaaggcgagcacaagaaacuggccgaagcuaucuuuaaguugaccuaucagaacaagguggugcgcguccaacgaccaacgccucgggggaccguuauggauauuaucucuagaagggaccagcgcggaucaggccagguggguacauacgggcugaauacuuucaccaacauggaggcccaacucaucagacagauggaaggagagggcauuuucaaaaguauacagcaucuuacagcaacugaggaaaucgcuguacagaauuggcuggcccgggugggcagggagcguuuaucccgaauggcuauuagcggggaugacugcgucgugaagcccaucgaugaccgcuuugccucugcacugaccgcguugaacgauaugggaaaaguuagaaaggacauucaacagugggaaccaucgcgggguuggaaugauuggacacaggugcccuucugcucacaccacuuucaugagcucgucaugaaagacggcagggugcugguaguuccuugucgcaaccaggaugaacuaaucgggagagcccggauaagccaaggagcuggcuggucccuuaaggagacagccugccuggguaagaguuaugcacagauguggacccucauguacuuccacaggcgagaccugcguuuggcugccaacgcaaucuguucugccgugccaagccauugggucccgacuuccagaacaaccuggucaauucacgcgaaacacgaguggaugacuaccgaagauauguuagcuguguggaaucgcguguggauccaggagaaccccuggauggaagacaagacaccugucgagaguugggaagagguuccauaucuggggaaacgggaggaccaguggugcggaucucucauuggccuuacgagcagggccaccugggcaaagaauauccaaacugccauaaaccaggugagaucccugauuggcaaugaagaguacacagauuauaugcccucaaugaaacgcuuucggagggaagaggaagaggcugggguacuaugguga

SEQ ID NO: 14470 - RNA, 9876 nt, Artificial Sequence
  derived and/or modified CDS sequence (opt3) from DENV-2__FJ373300__SS-prME
acagccggcgugaucgucaugcugauuccaacagcuauggcuuuccaccucacuacgagaaacggggaaccucauaugauaguuggaaggcaggaaaaggguaaaagccuucuguuuaagaccgaagacggcgugaauaugugcacauugauggccaucgauuuaggggaacugugugaagacacuauuaccuacaaaugcccacuacuccggcaaaacgaaccggaggauaucgacuguuggugcaauuccacaucuaccuggguaacuuauggaacauguaccacgacuggcgagcaccgccgagaaaagcguucaguggcgcuggucccccauguggguauggggcuugagaccagaacagaaacuuggaugaguagcgagggagcuuggaaacacguucagaggauugagaccuggauccugcggcauccuggcuucacaauaauggccgcaaucuuggccuacaccauuggcacgacucacuuucagcgcgcucucaucuucauucugcugacagcaguggccccauccaugaccaugagaugcaucgggauaucuaacagggauuuugucgaaggagugucggguggcucauggguagacauuguucucgagcacgggagcugugugacuacaauggcuaagaauaagcccaccuuagauuucgaacugaucaaaacggaggccaagcagccugcgacccuucggaaauauugcauugaagcaaaguugacaaacacuaccacagagagucgcuguccaacucaaggagagcccucccugaaugaagaacaggacaaacgauuuaucugcaagcauucuauggucgauagaggcugggguaacggguguggacuauucggcaagggcgggaucgugaccugcgccauguuuacaugcaaaaagaauauggaaggaaaagugguccagccugagaaccucgaauacaccauuguuauaacuccacacagcggugaggagcaugcugugggcaaugacacggggaagcacggaaaagaaaucaagauuacaccgcaguccucaaucaccgaggccgaacugacuggcuaugguaccguaacaauggaguguagucccaggaccgggcuugauuucaacgaaauggugcuguugcaaauggaggacaaagcauggcucguccaccggcagugguuucuggauuuaccucugccauggcuccccggcgcugacacucagggaagcaauuggauacagaaggagacacuugugacguucaagaacccucaugccaaaaagcaagacguugugguccugggcucucaggaaggggcgaugcacaccgccuugacuggagcaacagagauucagauguccucagguaaucuacuguuuaccggccaucucaaaugccgucugcgcauggauaaacuucaacugaaagggaugagcuacaguauguguacaggaaaguucaagaucgugaaagaaaucgcugagacucagcacggcaccauuguaaucagaguucaguaugagggugacgggucuccaugcaagauucccuucgaaauaacggauuuggagaaaaggcaugugcucggccggcugaucaccgucaacccgauugugacagaaaaggacuccccugucaacaucgaggccgaacccccauuuggagauagcuacaucauuauaggcguggagccugggcaguuaaaacugaauugguucaagaagggaucgucuaucggucaaauguuugagacuaccaugcgaggcgcuaaacgcauggccauucuaggggacacagcaugggauuucggaucccucggcgguguuuuuacuucaaucgggaaggcccugcaccagguguucggcgcuauuuacggagcggcauuuaguggcguaagcuggaccaugaaaauccuuauaggggucaucauuacguggaucggaaugaacuccagaucuaccagcuugucagugagucugguucucgugggcgucgugacccuguaucuuggugccguagugcaggcugacuccggguguguugucagcuggaagaauaaagaacugaagugcggaucuggcauuuucaucacugauaacgugcacacauggaccgagcaguacaaguuucaacccgaaucaccaaguaaauuggccagcgcaauacagaaggcccaugaggaagguauuuguggcaucagguccgugacucggcucgagaaucugauguggaaacagauuacccccgaguuaaaccacauccugucugaaaaugaggucaagcuaacaauaaugacgggggacaucaaaggaaccaugcaggcuggcaagcgcucgcucagaccucaaccaacugaacugaaauauagcuggaagacaugggggaaggccaaaaugcuuuccaccgagucacauaaccagacauucuugauugauggaccggaaacugcagagugccccaauaccaacagggcguggaauagucuggagguugaagacuacggcuuugguguguucacgacaaacaucuggcucaagcugcgugagaaacaggacguguuuugugauucuaaguuaaugagcgcugccauuaaagacaaucgggcaguacacgccgauaugggguauuggaucgaauccgcucugaacgacaccuggaagauggagaaggccucauucauagaggucaaaagcugccacuggccuaagucucauacucuuugguccaauggaguguuggaaagugagaugauuauccccaagaauuucgcaggccccguuagccagcacaacuaccgaccugguuaucauacccaaacagcuggcccauggcaccucgggaagcuggaaauggauuuugacuucugugagggaacuaccguggucgugacagaagauugcggcaauagagggcccucucuaaggacgaccacugccuccggaaaacugaucacagaguggugcugucgcucaugcacccucccgccucugcgguacagaggcgaggacgguuguugguacgggauggaaauuaggccacuuaaggagaaggaagagaacuugguuaauagucuggugacugcgggacauggccagaucgauaacuuuagcuuagguguacucggcauggcccuguuccuugaagagaugcugcgcacacgaauugggaccaaacacgcuauauugcucgucgcagugucguuugugacgcugaucacuggaaauauguccuuccgggaccuaggccgugucaugguuauggugggggccaccaugacagaugacauuggaaugggcguaaccuaucuggcucuccuggccgcauuuaaggugagacccacuuucgcggccggucuuuugcugaggaaauuaacaucuaaggagcucaugauggcuaccaucgggauugcccugcuuagccagucaacaaucccugaaacuauacuggagcuaaccgaugcacucgcucugggaaugauggucuugaaaaucgugcgcaacauggaaaaguaccaacuggccguuacgauuauggcaaucaguugcgugcccaaugccgucauuuuacagaacgcuuggaagguguccuguacaguucucgcggccgugucugucagcccacugcuucugaccuccucacagcagaaagcagacuggaucccuuuggcucucacuauaaagggccugaaucccaccgccauuuuucuaacaacucugagccggaccaguaaaaagagaucuuggccacuuaacgaggccaucauggcuguaggcaugguguccauccucgcaagcucgcuguugaaaaaugacauuccgaugacggggccucugguugccggagguuuacucacagugugcuauguccugaccggcaggucagcggaucuugaacuggagcgagcugccgacgugaagugggaggaucaagcagaaauaucugggaguucccccaucuugagcauuacuaucucugaggacggaagcauguccauuaaaaacgaagaggaggaacagacacucaccauccugauacgcacuggccuacugguaaucucagguguguucccagucaguauucccaucacagccgcugcaugguaccuuugggagguuaagaagcagcgggccggggugcucugggaugugccuagcccacccccugucgaaaaagcggagcuggaagacggagcuuauagaauuaagcagaggggcaucuugggcuacucucaaauaggggccggaguguauaaagaggguaccuuucacacgauguggcauguuacucguggcgcaguauuaaugcaccgcgggaagcggauugagccguccugggccgaugugaaaaaggaccugaucucauacggaggcgguuggaagcucgaaggggaguggaaagaaggagaggaaguccaggugcuggcucuugagccaggcaagaaucccagagccguucagaccaaaccuggcaucuucaagacaaacaccgggacaauuggagcagugagucuggauuuuagcccagguacuuccggcucucccaucgucgacaggaaagggaaggugguaggauuguacggcaauggugucgugacccgaucgggggcuuauguuagcgccauagcgcagacggagaagucaauugaagauaacccugagaucgaagacgauauuuuccggaaaaagcgccuaacaaucauggaccugcauccgggagccggcaaaacuaagagauaccuccccgcaauagugagggaggcuauuaaacggggccugcgaacccuuaucuuagccccaacaagagucguggcugcagaaauggaggaggcccugcgcgggcucccuaucagguaucaaacccccgccauuaagacugaacacaccggacgugagaucguugacuugaugugucaugcuacauucacgaugcggcugcucuccccagugagagucccuaacuacaaucugauuauaauggaugaagcgcacuuuacugaccccgcaaguaucgccgcuagggguuauauuucuacccgcguggagaugggcgaggccgcagggaucuucaugacagccaccccaccgggaagccgagauccuuuuccccaguccaacgcuccaaucauggacgaagagagagaaauucccgagcggucauggaacucuggccacgaauggguaacugauuucaaggguaaaacagugugguuuguuccuagcauaaaggcggggaacgacaucgccgcaugccuuaggaaaaauggaaagaaagucauucagcugagucgcaagaccuucgauuccgaguacgugaagacgcgugcuaacgacugggauuuuguggucacuacagacaucagcgagaugggcgccaauuucaaagcagaaagaguaauugauccacggagguguaugaagcccgugaucuugaccgacggcgaggaacgcguuauacuagccgggccuaugccggugacccauucuucagcugcccaacgaagaggacggaucgguaggaaccccaaaaaugagaacgaccaguauauuuacaugggcgaaccccuggagaaugaugaggacugcgcgcacuggaaggaagcaaaaaugcucuuagauaacaucaauacuccugaggggauuauccccuccauguuugaaccagagcgcgaaaaggucgacgccauagauggagaguacagacugaggggcgaggcucggaaaacauucguggaccuuaugcgucgcggugaucugccuguuuggcucgccuauaagguggcugcagaagggauuaacuacgccgaccgaaagugguguuuugauggcaucaaaaauaaccagauuuuggaggaaaacauggaggucgagaucuggaccaaggaaggagagaggaaaaagcugaaacccagauggcucgacgcucggauauauagugauccacuggcccuuaaggaguucaaggaguucgcagcgggccgcaaaagccuaacacugaauuugaucacugaaauggggagauuaccuacguuuaugacccagaaggccaggaacgcucuggacaaucucgccgugcugcauacagcagaggcuggaggucgggccuacaaccacgcacuuucggagcugccggaaacucucgagaccuugcugcuacugacacuccuugccaccguaacuggcgggauuuuccuguuuuuaaugucuggaaaaggcaucgguaagaugacguuggggaugugcugcauuaucaccgcuuccauacugcucugguaugcgcaaauucagccccacuggaucgccgcaagcaucauucuggaguucuuucuuaucgugcugcucauaccagagccugaaaaacagcgaacaccccaggauaaucaauugacuuacguugucauugcuauccugaccgugguggccgccacaauggcaaacgagaugggcuucuuagagaagaccaagaaagaccuaggacugggcucaauuacuacacaggaaagugagucuaauauccucgacauagaucuuagaccagcuuccgccuggacgcuguaugcggucgcuaccacuuuuguuacaccuauguugcgccauagcaucgaaaacucaagugugaauguaagccugaccgccauugcaaaccaggccaccgugcucauggggcugggaaaggguuggccccuuuccaaaauggacaucggcgucccgcuccuggcuauuggguguuacucucaggugaauccaaucacauugacugcagcccuguuacuacugguugcgcacuacgcuauuaucggaccuggccuccaagccaaggcaacgagggaggcccagaaacgggcugccgcagguauaaugaagaaccccaccguggaugggauuacagucaucgaccuugaaccaauccccuaugauccuaaguucgagaaacagcugggccagguaauguugcugauucucugcgugacucaaguucugaugaugcguaccacaugggcucuuugugaggccuuaacccuggcgacuggaccgauaagcacgcucugggaaggcaaucccgggagauuuuggaacacaaccaucgccguguccauggcaaauauuuucaggggaucauacuuggcuggcgccggucugcuauuuucuaucaugaagaacacuaccaguacacgccgggggacuggaaauauuggcgagacccugggugaaaaauggaagucgcgacucaacgcacuuggcaaaagcgaguuccagaucuauaagaaauccgggauacaggaggucgacagaacacuggcuaaggaaggaaucaagaggggcgagacggaucaucacgccgugucucgcgggucagccaaauugcggugguuugucgaaagaaacauggugaccccagagggaaagguuguggaccugggcugcggucgugggggauggagcuacuauuguggcggucucaaaaauguaagggaagugaagggccugacuaaagggggaccuggccaugaggagcccauuccuauguccacauacggguggaacuuaguccggcuucaaaguggaguugauguguucuucaccccacccgaaaagugcgacacucugcucugugauaucggcgagucuagcccuaauccaacaauugaagcgggucgcacccuacgaguccugaacuugguggagaauuggcugaacaauaacacgcaguuuugcaucaagguacucaaucccuauaugccgucagugauagagaaaauggaggcacuucagagacaguacgggggagcacugguuaggaacccuuugucccggaauaguacccacgagauguacugggugagcaacgccacaggcaauauugucucuuccgugaacaugaucucacgcaugcugaucaauagauucacuaugaagcacaaaaaggcuaccuaugaaccagacgucgaucucggcagcgggacaaggaacauuggaauagagucggaaauccccaacuuagacauuaucgguaaacgaauugagaagaucaagcaagaacaugagauaucuuggcacuacgaccaggaucauccuuauaaaacuugggccuaccacggcaguuaugagaccaagcagacaggguccgcaagcucaauggugaauggaguuguacggcugcuuaccaaaccaugggacgugguccccauggugacucagauggccaugacggauacaaccccguuuggccaacagcguguuuucaaggaaaaaguggacacuagaacccaggagccuaaggaagguacaaagaaacugaugaagaucacggcugaguggcuauggaaagagcucgggaagaaaaagacaccacgcauguguacuagggaagaguuuaccaaaaagguccgguccaacgcggcccugggagcaauuuucaccgaugaaaauaaguggaaaucugcuagagaggccguggaagacggccgcuuuugggaguugguagauagggagcgaaaccugcaccucgaaggcaagugcgagacuuguguguacaauaugauggggaaacgggaaaagaaacuuggagaguucgguaaggcaaagggcagcagagccaucugguauauguggcugggggcuagguuuuuagaguucgaggcccugggauuuuugaacgaggaccauugguucagucgcggcaauucccucagcgguguugaaggggagggacugcaccgucuaggcuacauucuucgggaugucggcaaaaaggaagggggagcgauguacgcagacgauacagccgguugggacaccagaaucacacuggaggaccucaaaaacgaagagauggugacuaaucauaugaagggcgagcacaaaaagcuggcugaagccauuuuuaaguugaccuaucagaacaaaguggucaggguucaacgcccaacgccucgagggaccgugauggauauaaucucucggagagaccagaggggaucaggccagguagguacauacgggcugaauacuuucaccaacauggaggcacaacucauucgccagauggaaggagagggcaucuucaagaguauccagcaucuuacagcuacugaggaaauugccgugcagaauuggcuggcuagagucggccgggagagguuaucccguauggccauaagcggggaugacugcgugguuaaacccaucgaugaccgauuugcaucugcgcugaccgccuugaacgauaugggaaaggugcgcaaagacauucaacagugggaaccaucgagagguuggaaugauuggacgcagguccccuucugcucacaccacuuucaugagcucgugaugaaggacggccggguacugguugugccuuguaggaaccaggaugaacuaaucgggcgcgcuagaauuagccaaggagccggcuggucccuuaaggagacagcaugccuggguaaaaguuaugcucagauguggacccucauguacuuccaccggagggaccugcgauuggccgcaaacgccaucuguucugcggucccaagccauugggugccgacuucccguacaaccuggucaauacacgcuaagcacgaguggaugacuaccgaagauauguuagccguguggaauagagucuggauccaggagaaccccuggauggaagacaaaacaccuguugagaguugggaagaggugccauaucuggggaagcgcgaggaccaguggugcggaucucucauuggccuuacgagccgggcaaccugggccaaaaauauccaaacugcuauuaaccagguaaggucccugaucggcaaugaagaguacacagauuauaugcccucaaugaagagauuucgccgggaagaggaagaggccggggugcuaugguga

SEQ ID NO: 14471 - RNA, 9876 nt, Artificial Sequence
  derived and/or modified CDS sequence (opt3) from DENV-2__EU596495__SS-prME
accgccggagugauaguaaugcugauucccacugcuauggcuuuccaccucacuacgaggaacggggagccucauaugauaguuggaaggcaggaaaaggguaaaagccuucuguuuaagaccgaggacggcgugaauaugugcacauugauggccaucgauuuaggggaacugugugaggacacuauuaccuacaaaugcccacuacuccggcaaaacgaaccggaggauaucgacuguuggugcaauuccacaucuaccuggguaacuuauggaacauguaccacgacuggcgagcaccgccgagaaaagcguucaguggcgcuggucccccauguggguauggggcuugagaccagaacagaaacuuggaugaguagcgagggagcuuggaaacacguucagaggauugagaccuggauccugcggcauccuggcuucacaauaauggccgcaaucuuggccuacaccauuggcacgacucacuuucagcgcgcucucaucuucauucugcugacagcaguggccccauccaugaccaugagaugcaucgggauaucuaacagggauuuugucgaaggagugucggguggcucauggguagacauuguucucgagcacgggagcugugugacuacaauggcuaagaauaagcccaccuuagauuucgaacugaucaaaacggaggccaagcagccugcgacccuucggaaauauugcauugaagcaaaguugacaaacacuaccacagagagucgcuguccaacucaaggagagcccucccugaaugaagaacaggacaaacgauuuaucugcaagcauucuauggucgauagaggcugggguaacggguguggacuauucggcaagggcgggaucgugaccugcgccauguuuacaugcaaaaagaauauggaaggaaaagugguccagccugagaaccucgaauacaccauuguuauaacuccacacagcggugaggagcaugcugugggcaaugacacggggaagcacggaaaagaaaucaagauuacaccgcaguccucaaucaccgaggccgaacugacuggcuaugguaccguaacaauggaguguagucccaggaccgggcuugauuucaacgaaauggugcuguugcaaauggaggacaaagcauggcucguccaccggcagugguuucuggauuuaccucugccauggcuccccggcgcugacacucagggaagcaauuggauacagaaggagacacuugugacguucaagaacccucaugccaaaaagcaagacguugugguccugggcucucaggaaggggcgaugcacaccgccuugacuggagcaacagagauucagauguccucagguaaucuacuguuuaccggccaucucaaaugccgucugcgcauggauaaacuucaacugaaagggaugagcuacaguauguguacaggaaaguucaagaucgugaaagaaaucgcugagacucagcacggcaccauuguaaucagaguucaguaugagggugacgggucuccaugcaagauucccuucgaaauaacggauuuggagaaaaggcaugugcucggccggcugaucaccgucaacccgauugugacaggaaaggacuccccugucaacaucgaagccgagcccccauuuggcgauagcuacaucauuauagggguggaaccuggacaguuaaaacugaauugguucaagaaggguucgucuaucggccaaauguuugagacuaccaugcgaggggcuaaacgcauggccauucuaggagacacagcaugggauuucggcucccucggugggguuuuuacuucaaucggcaaggcccugcaccagguguucggagcuauuuacggcgcggcauuuagugggguaagcuggaccaugaaaauccuuauaggagucaucauuacguggaucggcaugaacuccagaucuacuagcuugucagugagucugguucucgugggugucgugacccuguaucuuggggccguagugcaggcugacuccggauguguugucagcuggaagaauaaagagcugaagugcggcucugguauuuucaucacugauaacgugcacacauggaccgaacaguacaaguuucaacccgagucaccaaguaaauuggccagcgcaauacagaaggcccaugaagagggcauuugugggaucagguccgugacucggcucgaaaaucugauguggaaacagauuacccccgaguuaaaccacauccugucugagaaugaagucaagcuaacaauaaugacgggagacaucaaaggcauuaugcaggcugggaagcgcucgcucagaccucaaccaaccgagcugaaauauagcuggaagacuuggggaaaggccaaaaugcuuuccacagaaucacauaaccagaccuucuugaucgauggcccggagacagcagaaugccccaauacuaacagggcguggaauagucuggagguugaggacuacgguuuugggguguucaccacgaacauuuggcucaagcugcgugaaaaacaggacguguuuugugauucuaaguuaaugagcgcugccaucaaagacaaucgggcaguacacgccgauaugggauauuggauagaguccgcucugaacgacacauggaagauggaaaaggccucauucauugaggucaaaagcugccacuggccuaagucucauacccuuugguccaauggcguguuggagagugaaaugaucauccccaagaauuucgcaggucccguuagccagcacaacuaccgaccuggcuaucauacucaaaccgcugggccauggcaccucggaaagcuggagauggauuuugacuucugugaaggcacaacuguggucgugaccgaggauugcgggaauagaggacccucucuaaggacaacgaccgccuccggcaaacugauuacugaauggugcugucgcucaugcacacucccgccucugcgguacagaggugaggacggguguugguacggaauggagaucaggccacuuaaggaaaaggaggaaaacuugguuaauagucuggugaccgcgggccauggucagauugauaacuuuagcuuaggcguacucgggauggcccuguuccuugaggaaaugcugcgcacucgaauaggaacaaaacacgcuaucuugcucgucgcagugucguuugugacccugauuacgggcaauauguccuuccgggaccuagggcgugucaugguuauggugggagccacuaugaccgaugacaucggcauggguguaacauaucuggcucuccuggccgcauuuaaggugagacccaccuucgcggccgggcuuuugcugaggaaauuaacuucuaaggagcucaugauggcuacaauuggaaucgcccugcuuagccagucaaccauaccugagacaauccuggaacuaacugaugcacucgcucugggcaugauggucuugaaaauugugcgcaacauggagaaguaccaacuggccguuaccaucauggcaauuaguugcgugcccaaugccgucaucuuacagaacgcuuggaagguguccuguacgauacucgcggccguuucugugagcccacugcuucugacauccucacagcagaaagcagacuggauuccuuuggcucucaccaucaagggccugaaucccacugccaucuuucuaaccacacugagccggacaaguaaaaagagaucuuggccacuuaacgaagccauuauggcugucgggaugguauccauacucgcaagcucgcuguugaaaaaugacaucccgaugaccggaccucugguggccgguggcuuacucacgguuugcuaugugcugacagggaggucagcggaucuugagcuggaacgagcugccgacgucaagugggaggaucaagcagagauuucuggaaguucccccaucuugagcauuaccaucucugaagacggcagcauguccaucaaaaacgaggaagaggagcagacucucacaauccugauucgcaccggucuacuggugaucucagggguauucccagugaguauucccaucacugccgcugcaugguaccuuugggaagucaagaagcagcgggccggaguucucugggaugugccuagcccacccccuguggagaaagcggaacuggaggacggcgcuuauagaauaaagcagaggggcauuuugggguacucucaaaucggagccggugucuauaaagaaggcacauuucacaccauguggcaugugacgcguggggcaguuuuaaugcaccgcggaaagcggaucgagccguccugggccgaugucaaaaaggaccugauuucauacggcgguggguggaagcucgagggagaauggaaagagggcgaagaggugcagguccuggcucuugaaccaggcaagaaucccagagccgugcagacuaaaccugggaucuucaagaccaacacaggaaccauaggugcaguuagucuggauuuuagcccaggcacauccgggucucccauuguggacaggaaaggaaaggucgugggcuuguacgguaaugggguagucacucgaucgggagcuuaugugagcgccaucgcgcagaccgagaagucaauugaggauaacccugaaaucgaggacgauauauuccggaaaaagcgccuaacgauuauggaccugcauccgggcgccggcaaaacaaagagauaccuccccgcaaucguuagggaagcuaucaaacgggggcugcgaacucuuauuuuagccccaaccagaguggucgcugcagagauggaagaggcccugcgcggacucccuaucagguaucaaacacccgccauuaagaccgagcacacuggucgugaaauaguggacuugaugugucaugcuaccuucacaaugcggcugcucuccccaguuagagugccuaacuacaaucugaucauuauggaugaggcgcacuuuacggaccccgcaaguaucgccgcuaggggcuauaucucuacucgcgucgaaaugggggaggccgcaggaauuuucaugaccgccacaccaccgggcagccgagauccuuuuccccaguccaacgcuccaauaauggacgaggaaagagagauccccgaacggucauggaacucuggucacgagugggugaccgauuucaaggggaaaacuguaugguuugugccuagcauuaaggcgggaaacgacaucgccgcaugccuuaggaaaaauggcaagaaaguuauucagcugagucgcaagacauucgauuccgaauacgucaagacccgugcuaacgacugggauuuuguggugacgacugacaucagcgagaugggcgccaauuucaaagcagagagagucauagauccacggagguguaugaagcccguaaucuugacagacggggaagaacgcgugauucuagccggaccuaugccgguuacccauucuucagcugcccaacgaagaggucggaucggcaggaaccccaaaaaugaaaacgaccaguauauuuacaugggggagccccuggaaaaugaugaggacugcgcgcacuggaaggaggcaaaaaugcucuuagauaacaucaauaccccugaaggaauaauucccuccauguuugagccagaacgcgagaagguggacgccaucgauggcgaauacagacugaggggugaggcucggaaaacuuucgucgaccuuaugcgucgcggggaucugccuguguggcucgccuauaagguugcugcagagggcauuaacuacgccgaccgaaagugguguuuugauggaaucaaaaauaaccagauauuggaagagaacauggaaguggagaucuggacaaaggagggcgaaaggaaaaagcugaaacccagauggcucgacgcucggauuuauagugauccacuggcccuuaaggaguucaaggaguucgcagcggggcgcaaaagccuaacccugaauuugaucacagagaugggaagauuaccuacuuuuaugacgcagaaggccaggaacgcucuggacaaucucgccguccugcauaccgcagaagcugguggccgggccuacaaccacgcacuuucggagcugccggagacacucgaaacuuugcugcuacugacccuccuugccacagugaccgggggaauuuuccuguuuuuaaugucuggcaaagguaucgggaagaugacuuugggcaugugcugcauaauuacggcuuccauccugcucugguaugcgcaaauccagccccacuggauugccgcaagcaucauacuggaguucuuucuuauuguacugcucaucccagaaccugagaaacagcgaaccccacaggauaaucaauugacauacgugguuauugcuauccugacugucguggccgccaccauggcaaacgaaaugggauucuuagagaagacaaagaaagaccuaggccuggggucaauaaccacucaggagagugaaucuaauauccucgacauugaucuuagaccagcuuccgccuggacacuguaugcgguggcuacgaccuuugucacuccuauguugcgccauagcaucgagaacucaaguguuaaugugagccugacagccauugcaaaccaggccaccguacucaugggacuggguaagggcuggccccuuuccaaaauggacaucggggugccgcuccuggcuauuggauguuacucucaggucaauccaaucaccuugacagcagcccuguuacuacugguggcgcacuacgcuauaauuggcccuggucuccaagccaaggcaacuagggaagcccagaaacgggcugccgcagggaucaugaagaaccccacgguugauggcaucaccgugauugaccuugagccaauacccuaugauccuaaguucgaaaaacagcugggacaggucauguugcugauccucugcguaacacaagugcugaugaugcguacuaccugggcucuuugugaggccuuaacacuggcgaccggcccgauuagcacucucugggaggggaaucccggaagauuuuggaacacgacaaucgccguuuccauggcaaauauuuucaggggcucauacuuggcuggugccgggcugcuauuuucuaucaugaagaacaccacaaguacccgccggggaacaggcaauauaggugaaacucugggcgagaaauggaagucgcgacucaacgcacuugggaaaagcgaguuccagaucuauaagaaauccggcauucaggagguggacagaacccuggcuaaggagggcaucaagagaggggaaacagaucaucacgccgucucucgcggaucagccaaauugcggugguuuguggagagaaacauggucacgccagaaggcaaggugguugaccuggguugcgggcguggaggcuggagcuacuauugugguggccucaaaaaugugagggagguaaaggggcugaccaaaggaggcccugggcaugaagaaccaauuccuauguccacuuacggauggaacuuagugcggcuucaaaguggcgucgauguuuucuucacaccacccgagaagugcgacacccugcucugugauaucggugaaucuagcccuaauccaacuauagaggcggggcgcacacuacgagugcugaacuuggucgaaaauuggcugaacaauaacacccaguuuugcauuaaggugcucaaucccuauaugccgucaguaaucgagaaaauggaagcacuucagagacaguacggaggcgcacuggugaggaacccuuugucccggaauaguacgcacgagauguacuggguuagcaacgccaccggcaauaucgugucuuccgucaacaugauuucacgcaugcugauaaauagauucacaaugaagcacaaaaaggcuacuuaugagccagacguggaucucgggagcggaaccaggaacaucgguauugaaucggagauccccaacuuagacauuaucggcaaacgaauagaaaagaucaagcaagagcaugaaauuucuuggcacuacgaccaggaucauccuuauaaaacaugggccuaccacgggaguuaugagacuaagcagaccggauccgcaagcucaauggucaauggcgugguucggcugcuuacaaaaccaugggacguagugcccauggucacccagauggccaugacugauacgacaccguuuggucaacagcguguguucaaggagaaaguugacaccagaacucaggaaccuaaggaggggaccaagaaacugaugaagaucacagcugaauggcuauggaaagagcucggaaagaaaaagacgccccgcauguguaccagggaggaauuuacuaaaaaggugcgguccaacgcggcccugggcgcaauuuucacagaugagaauaaguggaaaucugcuagagaagccgucgaggacggccgcuuuugggaauugguggauagggagcgaaaccugcaccucgaggggaagugcgaaaccuguguauacaauaugaugggaaaacgggagaagaaacuuggugaguucggcaaggcaaaggggagcagagccaucugguauauguggcugggagcuagguuuuuagaguucgaagcccugggcuuuuugaacgaggaccauugguucagucgcgguaauucccucagcgggguggagggagaaggccugcaccgucuaggcuacauucuucgggauguugggaaaaaggagggaggugcgauguacgcagacgauacugccggcugggacacaagaauaacccuggaagaccucaaaaacgaggaaauggucacaaaucauaugaagggggagcacaaaaagcuggcugaggccaucuuuaaguugacuuaucagaacaaaguggugaggguccaacgcccaaccccucgaggaacgguuauggauauuaucucucggagagaccagaggggcucaggucagguggggaccuacggacugaauacauucacuaacauggaagcacaacucauccgccagauggagggcgaaggcauuuucaagaguauacagcaucuuaccgcuacagaggagaucgccguacagaauuggcuggcuagaguggggcgggaaagguuaucccguauggccauuagcggagaugacugcgucgugaaacccaucgaugaccgauuugcaucugcgcugacugccuugaacgauauggguaagguucgcaaagacauucaacagugggagccaucgagaggcuggaaugauuggacccaggugcccuucugcucacaccacuuucaugaacucgucaugaaggacgggcgggugcugguaguuccuuguaggaaccaggaugagcuaaucggacgcgcuagaauaagccaaggcgccgguuggucccuuaaggaaacggcaugccuggggaaaaguuaugcucagauguggacacucauguacuuccaccggagggaccugcgauuggccgcaaacgccaucuguucugcggugccaagccauugggucccgaccucccguacuacauggucaauucacgcuaagcacgaguggaugaccacugaggauauguuagccguguggaauagaguguggauccaggaaaaccccuggauggaggacaaaaccccugucgaaaguugggaggaaguuccauaucugggaaagcgcgaggaccaguggugcggcucucucauuggccuuacaagccgggcaacgugggccaaaaauauccaaaccgcuauaaaccaggugaggucccugauugggaaugaggaauacacugauuauaugcccucaaugaagagauuucgccgggaggaagaggaagccggaguacuaugguga

SEQ ID NO: 14472 - RNA, 9876 nt, Artificial Sequence
  derived and/or modified CDS sequence (opt3) from DENV-2__EU596497__SS-prME
accgccggcgugaucgucaugcugauucccacagcuauggcauuccaccucacuacgagaaacggggagccucauaugauaguuggaaggcaggaaaaggguaaaagccuucuguuuaagaccgaggacggcgugaauaugugcacauugauggccaucgauuuaggggaacugugugaggacacuauuaccuacaaaugcccacuacuccggcaaaacgaaccggaggauaucgacuguuggugcaauuccacaucuaccuggguaacuuauggaacauguaccacgacuggcgagcaccgccgagaaaagcguucaguggcgcuggucccccauguggguauggggcuugagaccagaacagaaacuuggaugaguagcgagggagcuuggaaacacguucagaggauugagaccuggauccugcggcauccuggcuucacaauaauggccgcaaucuuggccuacaccauuggcacgacucacuuucagcgcgcucucaucuucauucugcugacagcaguggccccauccaugaccaugagaugcaucgggauaucuaacagggauuuugucgaaggagugucggguggcucauggguagacauuguucucgagcacgggagcugugugacuacaauggcuaagaauaagcccaccuuagauuucgaacugaucaaaacggaggccaagcagccugcgacccuucggaaauauugcauugaagcaaaguugacaaacacuaucaccgagagucgcuguccaacacaaggagagcccucccugaaugaagagcaggacaaacgauuuaucugcaagcauucuauggucgauagaggcugggguaacggguguggacuauucggcaagggcgggauugugacuugcgccauguuuaccugcaaaaagaauauggaaggaaaagugguccagccugagaaccucgaauacacaauaguuaucaccccacacagcggugaggagcaugcugugggcaaugacacugggaagcacggaaaagaaauuaagaucacgccgcaguccucaauaacagaggccgaacugaccggcuaugguacuguaaccauggaguguagucccaggacagggcuugauuucaacgaaauggugcuguugcaaauggaggacaaagcauggcucguccaccggcagugguuucuggauuuaccucugccauggcuccccggcgcugacacccagggaagcaauuggauucagaaggagacucuugugacauucaagaacccucaugccaaaaagcaagacguugugguccugggcucucaggaaggggcgaugcacacggccuugaccggagcaacugagauccagauguccucagguaaucuacuguuuacaggccaucucaaaugccgucugcgcauggauaagcuucaacugaaagggaugagcuacaguauguguaccggaaaguucaagaucgugaaagaaauugcugagacacagcacggcacuaucguaauuagaguucaguaugagggugacgggucuccaugcaagauacccuucgaaaucaccgauuuggagaaaaggcaugugcucggccggcugauuacggucaacccgaucgugaccgaaaaggacuccccugucaacaucgaggccgaacccccauuuggagauagcuacauuauaaucggcguggagccugggcaguuaaaacugaauugguucaagaagggaucgucuauuggucaaauguuugagacaacuaugcgaggcgcuaaacgcauggccauccuaggggacaccgcaugggauuucggaucccucggcgguguuuuuacaucaauugggaaggcccugcaccagguguucggcgcuaucuacggagcggcauuuaguggcguaagcuggacuaugaaaauacuuaucggggucauuaucaccuggauuggaaugaacuccagaucuacgagcuugucagugagucugguucucgugggcgucgugacacuguaucuuggugccguagugcaggcugacuccggguguguugucagcuggaagaauaaagaacugaagugcggaucuggcaucuucauaaccgauaacgugcacacuuggacagagcaguacaaguuucaacccgaaucaccaaguaaauuggccagcgcaauucagaaggcccaugaggaagguaucuguggcauuagguccgugacccggcucgagaaucugauguggaaacagaucacucccgaguuaaaccacauacugucugaaaaugaggucaagcuaaccaucaugacaggggacauuaaaggaaucaugcaggcuggcaagcgcucgcucagaccucaaccaacggaacugaaauauagcuggaagaccugggggaaggccaaaaugcuuuccacugagucacauaaccagacauucuugauugauggaccggaaaccgcagagugccccaauacaaacagggcguggaauagucuggagguugaagacuacggcuuugguguguucacuaccaacaucuggcucaagcugcgugagaaacaggacguguuuugugauucuaaguuaaugagcgcugccauaaaagacaaucgggcaguacacgccgauaugggguauuggauugaauccgcucugaacgacacguggaagauggagaaggccucauucaucgaggucaaaagcugccacuggccuaagucuuacacacuuugguccaauggaguguuggaaagugagaugaucauuccaaaaaacuucgcaggccccguuagccagcauaacuaucgaccugguuaccacacccaaacugcuggcccauggcaucucgggaagcuggaaauggauuuugacuucugugagggaaccacaguggucgugacugaagauugcggcaauagagggcccucucuaaggaccacaacggccuccggaaaacugaucaccgaguggugcugucgcucaugcacucucccgccucugcgguacagaggcgaggacgguuguugguaugggauggaaauuaggccacuuaaggagaaggaagagaacuugguuaauagucuggugacagcgggacacggccagauagauaacuuuagcuuagguguacucggcauggcccuguuccuugaagagaugcugcgcacccgaaucgggacuaaacaugcuauuuugcucgucgcagugucguuugugacacugaucaccggaaauauguccuuccgggaccuaggccgugucaugguuauggugggggccacgaugacugaugacauuggaaugggcguaaccuaccuggcucuccuggccgcauuuaaggugagacccacauucgcggccggucuuuugcugaggaaauuaaccucuaaggagcucaugauggcuacuaucgggauagcccugcuuagccagucaacaaucccugaaaccauucuggagcuaacagaugcacucgcucugggaaugauggucuugaaaaucgugcgcaacauggaaaaguaucaacuggccguuacuauuauggcaaucaguugcgugcccaaugccgucauauuacagaacgcuuggaagguguccuguaccauucucgcggccguuucugugagcccacugcuucugacguccucacagcagaaagcagacuggaucccuuuggcucucacaaucaagggccugaaucccaccgccauuuuucuaacuacccugagccggacaaguaaaaagagaucuuggccacuuaacgaggccauaauggcugucggcaugguauccauccucgcaagcucgcuguugaaaaaugacauuccgaugacugggccucugguggccggagguuuacucaccguuugcuacgugcugacgggcaggucagcggaucuugaacuggagcgagcugccgacgucaagugggaggaucaagcagaaaucucugggaguucccccauuuugagcaucacaauaucugaggacggaagcauguccaucaaaaacgaagaggaggaacagacccucacuauucugauccgcacaggccuacuggugauuucagguguauucccagugaguauccccauaaccgccgcugcaugguaucuuugggaggucaagaagcagcgggccgggguucucugggaugugccuagcccacccccuguggaaaaagcggagcuggaagacggagcuuacagaauuaagcagaggggcaucuugggcuauucucaaaucggggccggagucuacaaagaggguacuuuucacacaauguggcacgugacccguggcgcaguuuuaaugcaucgcgggaagcggauugagccguccugggccgauguaaaaaaggaccugaucucauacggaggcgguuggaagcucgaaggggaguggaaagaaggagaggaagugcagguccuggcucuugagccaggcaagaaucccagagccgugcagacgaaaccuggcauauucaagacuaacaccgggacaauuggagcaguuagucuggauuuuagcccagguaccuccggcucucccaucguggacaggaaagggaaggucgugggauuguauggcaaugguguagucacacgaucgggggcuuacgugagcgccauugcgcagacugagaagucaaucgaagauaacccugagauagaagacgauauuuuccggaaaaagcgccuaaccaucauggaccugcacccgggagccggcaaaacgaagagauaucuccccgcaaucguuagggaggcuauuaaacggggccugcgaacacuuaucuuagccccaacuagaguggucgcugcagaaauggaggaggcccugcgcgggcucccuauuagguaccaaacccccgccauaaagacagaacauaccggacgugagaucguggacuugaugugucacgcuacuuucaccaugcggcugcucuccccaguuagagugccuaacuauaaucugauuaucauggaugaagcgcauuuuacagaccccgcaaguaucgccgcuagggguuacauuucuacgcgcgucgagaugggcgaggccgcagggauauucaugacugccaccccaccgggaagccgagauccuuuuccccaguccaacgcuccaaucauggacgaagagagagaaauucccgagcggucauggaauucuggccacgaaugggugacagauuucaaggguaaaaccguaugguuugugccuagcaucaaggcggggaacgacauugccgcaugccuuaggaaaaauggaaagaaaguuauccagcugagucgcaagacuuucgauuccgaguaugucaagacacgugcuaacgacugggauuuuguggugaccacggacauaagcgagaugggcgccaauuucaaagcagaaagagucaucgauccacggagguguaugaagcccguaauuuugacugacggcgaggaacgcgugauccuagccgggccuaugccgguuacacacucuucagcugcccaacgaagaggacggauugguaggaacccaaaaaaugagaacgaccaguacaucuacaugggcgaaccccuggagaaugaugaggacugcgcgcauuggaaggaagcaaaaaugcucuuagauaacauaaauaccccugaggggauuauccccuccauguuugaaccagagcgcgaaaagguggacgccauugauggagaguauagacugaggggcgaggcucggaaaaccuucgucgaccuuaugcgucgcggugaucugccuguguggcucgccuacaagguugcugcagaagggaucaacuaugccgaccgaaagugguguuuugauggcauaaaaaauaaccagaucuuggaggaaaacauggagguggagauuuggacuaaggaaggagagagaaaaaagcugaaacccagguggcucgacgcucggaucuacagugauccacuggcccuuaaggaauucaaggaguucgcagcgggccgcaaaagccuaacacugaauuugauuaccgaaauggggagauuaccuacauuuaugacucagaaggccaggaacgcucuggacaaucucgccguccugcacacggcagaggcuggaggucgggccuauaaccaugcacuuucggagcugccggaaacccucgagacauugcugcuacugacucuccuugccaccgugacaggcgggaucuuccuguuuuuaaugucuggaaaaggcauagguaagaugaccuuggggaugugcugcauuaucacugcuuccauccugcucugguacgcgcaaauucagccccacuggaucgccgcaagcauaauucuggaauucuuucuuaucguacugcucauuccagagccugaaaaacagcgaacgccccaggauaaucaauugaccuaugugguuaucgcuauacugacagucguggccgccacuauggcaaacgagaugggcuucuuagagaagaccaagaaagaccuaggacugggcucaaucacaacccaggaaagugagucuaauauucucgacaucgaucuuagaccagcuuccgccuggacucuguacgcgguggcuacaacguuugucaccccuauguugcgccacagcauugaaaacucaaguguuaaugugagccugacugccaucgcaaaccaggccacaguacucauggggcugggaaaggguuggccccuuuccaaaauggacauuggcgugccgcuccuggcuaucggguguuacucucaggucaauccaauaaccuugaccgcagcccuguuacuacugguggcgcauuaugcuauuaucggaccuggccuccaagccaaggcaacaagggaggcccagaaacgggcugccgcagguaucaugaagaaccccacuguugaugggauuacggugauagaccuugaaccaauccccuacgauccuaaguucgagaaacagcugggccaggucauguugcugauucucugcguaacccaagugcugaugaugcguacaacuugggcucuuugugaggccuuaacccuggcgacaggaccgaucagcacccucugggaaggcaaucccgggagauuuuggaacacuacgauugccguuuccauggcaaauaucuucaggggaucauauuuggcuggcgccggucugcuauuuucuauaaugaagaacacaaccaguacucgccgggggaccggaaauaucggcgagacacugggugaaaaauggaagucgcgacucaacgcacuuggcaaaagcgaguuccagauuuacaagaaauccgggauccaggagguggacagaacucuggcuaaggaaggaauuaagaggggcgagaccgaucaccaugccgucucucgcgggucagccaaauugcggugguuuguggaaagaaacauggucacaccagagggaaaggugguugaccugggcugcggucgugggggauggagcuauuacuguggcggucucaaaaaugugagggaaguaaagggccugacgaaagggggaccuggccacgaggagcccaucccuauguccaccuauggguggaacuuagugcggcuucaaaguggagucgauguuuucuucacuccacccgaaaagugcgacacacugcucugugauauaggcgagucuagcccuaauccaaccauugaagcgggucgcacucuacgagugcugaacuuggucgagaauuggcugaacaauaacacacaguuuugcaucaaggugcucaaucccuacaugccgucaguaaucgaaaaaauggaggcucuucagagacaguacgggggagcacuggugaggaacccuuugucccggaauaguacccaugagauguauuggguuagcaacgccacgggcaauauugugucuuccgucaacaugauaucacgcaugcugaucaauagauucaccaugaagcacaaaaaggcuacauacgaaccagacguggaucucggcagcgggacuaggaacauuggaaucgagucggaaauucccaacuuagacaucauagguaaacgaaucgagaagauuaagcaagaacacgagaucucuuggcauuaugaccaggaucacccuuacaaaaccugggccuaucauggcaguuacgagacaaagcagacuggguccgcaagcucaauggucaauggagugguucggcugcuuaccaaaccaugggacguagugcccauggucacacagauggccaugaccgauacuacgccguuuggccaacagcguguguucaaggaaaaaguugacacaagaacccaggagccuaaggaagguacuaagaaacugaugaagauuaccgcugaguggcuauggaaagagcucgggaagaaaaagacaccccgcauguguacgagggaagaguuuaccaaaaaggugcgguccaacgcggcccugggagcaaucuucacugaugaaaauaaguggaaaucugcuagagaggccgucgaagacggccgcuuuugggaguugguggauagggagcgaaaccugcaccucgaaggcaagugcgagacauguguauauaauaugauggggaaacgggaaaagaaacuuggagaguucgguaaggcaaagggcagcagagccauuugguacauguggcugggggcuagguuuuuagaauucgaggcccugggauuuuugaacgaggaccacugguucagucgcggcaauucccucagcgguguggaaggggagggacugcaucgucuaggcuacauacuucgggauguuggcaaaaaggaagggggagcgauguaugcagacgauaccgccgguugggacacuagaaucacacuggaggaccucaaaaacgaagagauggucaccaaucacaugaagggcgagcauaaaaagcuggcugaagccauuuuuaaguugacauaccagaacaaaguggugaggguccaacgcccaacuccucgagggaccguuauggauaucaucucucggagagaccagaggggaucaggccagguggguacguaugggcugaauaccuucacaaacauggaggcacaacucauucgccagauggaaggagagggcauauucaagaguauccagcaccuuacugcuaccgaggaaauugccguacagaauuggcuggcuagagugggccgggagagguuaucccguauggccaucagcggggaugacugcgucgugaaacccauugaugaccgauuugcaucugcgcugacagccuugaacgauaugggaaagguucgcaaagacauccaacagugggaaccaucgagagguuggaaugauuggacucaggugcccuucugcucacaucacuuucacgagcucgucaugaaggacggccgggugcugguaguuccuuguaggaaccaggaugaacuaauagggcgcgcuagaaucagccaaggagccggcuggucccuuaaggagaccgcaugccuggguaaaaguuacgcucagauguggacgcucauguauuuccaucggagggaccugcgauuggccgcaaacgccauuuguucugcggugccaagccacugggucccgacaucccguaccacuuggucaauccaugcuaagcacgaguggaugacaaccgaagauauguuagccguguggaauagaguguggauucaggagaaccccuggauggaagacaaaacuccugucgagaguugggaagagguuccauaccuggggaagcgcgaggaccaguggugcggaucucucaucggccuuaccagccgggcaacaugggccaaaaauauacaaacggcuauuaaccaggugaggucccugaucggcaaugaagaguauaccgauuacaugcccucaaugaagagauuucgccgggaagaggaagaggccgggguacuaugguga

SEQ ID NO: 14473 - RNA, 9876 nt, Artificial Sequence
  derived and/or modified CDS sequence (opt3) from DENV-2__EU569695__SS-prME
accgccggcgugauaguaaugcugauuccaacugcuauggcuuuccaccucacuacgagaaacggggaaccucauaugauaguuggaaggcaggaaaaggguaaaagccuucuguuuaagaccgaagacggcgugaauaugugcacauugauggccaucgauuuaggggaacugugugaagacacuauuaccuacaaaugcccacuacuccggcaaaacgaaccggaggauaucgacuguuggugcaauuccacaucuaccuggguaacuuauggaacauguaccacgacuggcgagcaccgccgagaaaagcguucaguggcgcuggucccccauguggguauggggcuugagaccagaacagaaacuuggaugaguagcgagggagcuuggaaacacguucagaggauugagaccuggauccugcggcauccuggcuucacaauaauggccgcaaucuuggccuacaccauuggcacgacucacuuucagcgcgcucucaucuucauucugcugacagcaguggccccauccaugaccaugagaugcaucgggauaucuaacagggauuuugucgaaggagugucggguggcucauggguagacauuguucucgagcacgggagcugugugacuacaauggcuaagaauaagcccaccuuagauuucgaacugaucaaaacggaggccaagcagccugcgacccuucggaaauauugcauugaagcaaaguugacaaacacuaccacagagagucgcuguccaacucaaggagagcccucccugaaugaagaacaggacaaacgauuuaucugcaagcauucuauggucgauagaggcugggguaacggguguggacuauucggcaagggcgggaucgugaccugcgccauguuuacaugcaaaaagaauauggaaggaaaagugguccagccugagaaccucgaauacaccauuguuauaacuccacacagcggugaggagcaugcugugggcaaugacacggggaagcacggaaaagaaaucaagauuacaccgcaguccucaaucaccgaggccgaacugacuggcuaugguaccguaacaauggaguguagucccaggaccgggcuugauuucaacgaaauggugcuguugcaaauggaggacaaagcauggcucguccaccggcagugguuucuggauuuaccucugccauggcuccccggcgcugacacucagggaagcaauuggauacagaaggagacacuugugacguucaagaacccucaugccaaaaagcaagacguugugguccugggcucucaggaaggggcgaugcacaccgccuugacuggagcaacagagauucagauguccucagguaaucuacuguuuaccggccaucucaaaugccgucugcgcauggauaaacuucaacugaaagggaugagcuacaguauguguacaggaaaguucaagaucgugaaagaaaucgcugagacucagcacggcaccauuguaaucagaguucaguaugagggugacgggucuccaugcaagauucccuucgaaauaacggauuuggagaaaaggcaugugcucggccggcugaucaccgucaacccgauugugacagaaaaggacuccccugucaacaucgaggccgaacccccauuuggagauagcuacaucauuauaggcguggagccugggcaguuaaaacugaauugguucaagaagggaucgucuaucggucaaauguuugagacuaccaugcgaggcgcuaaacgcauggccauucuaggggacacagcaugggauuucggaucccucggcgguguuuuuacuucaaucgggaaggcccugcaccagguguucggcgcuauuuacggagcggcauuuaguggcguaagcuggaccaugaaaauccuuauaggggucaucauuacguggaucggaaugaacuccagaucuacuagcuugucagugagucugguucucgugggcgucgugacccuguaucuuggugccguagugcaggcugacuccggguguguugucagcuggaagaauaaagaacugaagugcggaucuggcauuuucaucacugauaacgugcacacauggaccgagcaguacaaguuucaacccgaaucaccaaguaaauuggccagcgcaauacagaaggcccaugaggaagguauuuguggcaucagguccgugacucggcucgagaaucugauguggaaacagauuacccccgaguuaaaccacauccugucugaaaaugaggucaagcuaacaauaaugacgggggacaucaaaggaauuaugcaggcuggcaagcgcucgcucagaccucaaccaaccgaacugaaauauagcuggaagacuugggggaaggccaaaaugcuuuccacagagucacauaaccagaccuucuugaucgauggaccggaaacagcagagugccccaauacuaacagggcguggaauagucuggagguugaagacuacggcuuugguguguucaccacgaacauuuggcucaagcugcgugagaaacaggacguguuuugugauucuaaguuaaugagcgcugccaucaaagacaaucgggcaguacacgccgauaugggguauuggauagaauccgcucugaacgacacauggaagauggagaaggccucauucauugaggucaaaagcugccacuggccuaagucucauacccuuugguccaauggaguguuggaaagugagaugaucauccccaagaauuucgcaggccccguuagccagcacaacuaccgaccugguuaucauacucaaaccgcuggcccauggcaccucgggaagcuggaaauggauuuugacuucugugagggaacaacuguggucgugaccgaagauugcggcaauagagggcccucucuaaggacaacgaccgccuccggaaaacugauuacugaguggugcugucgcucaugcacacucccgccucugcgguacagaggcgaggacgguuguugguacgggauggaaaucaggccacuuaaggagaaggaagagaacuugguuaauagucuggugaccgcgggacauggccagauugauaacuuuagcuuagguguacucggcauggcccuguuccuugaagagaugcugcgcacucgaauagggacaaaacacgcuaucuugcucgucgcagugucguuugugacccugauuacgggaaauauguccuuccgggaccuaggccgugucaugguuauggugggggccacuaugaccgaugacaucggaaugggcguaacauaucuggcucuccuggccgcauuuaaggugagacccaccuucgcggccggucuuuugcugaggaaauuaacuucuaaggagcucaugauggcuacaauugggaucgcccugcuuagccagucaaccauaccugaaacaauccuggagcuaacugaugcacucgcucugggaaugauggucuugaaaauugugcgcaacauggaaaaguaccaacuggccguuaccaucauggcaauuaguugcgugcccaaugccgucaucuuacagaacgcuuggaagguguccuguacgauacucgcggccguuucugugagcccacugcuucugacauccucacagcagaaagcagacuggauuccuuuggcucucaccaucaagggccugaaucccacugccaucuuucuaaccacacugagccggacaaguaaaaagagaucuuggccacuuaacgaggccauuauggcugucggcaugguauccauacucgcaagcucgcuguugaaaaaugacaucccgaugaccgggccucugguggccggagguuuacucacgguuugcuaugugcugacaggcaggucagcggaucuugaacuggagcgagcugccgacgucaagugggaggaucaagcagaaauuucugggaguucccccaucuugagcauuaccaucucugaggacggaagcauguccaucaaaaacgaagaggaggaacagacucucacaauccugauucgcaccggccuacuggugaucucagguguauucccagugaguauucccaucacugccgcugcaugguaccuuugggaggucaagaagcagcgggccgggguucucugggaugugccuagcccacccccuguggaaaaagcggagcuggaagacggagcuuauagaauaaagcagaggggcauuuugggcuacucucaaaucggggccggagucuauaaagaggguacauuucacaccauguggcaugugacgcguggcgcaguuuuaaugcaccgcgggaagcggaucgagccguccugggccgaugucaaaaaggaccugauuucauacggaggcgguuggaagcucgaaggggaguggaaagaaggagaggaagugcagguccuggcucuugagccaggcaagaaucccagagccgugcagacuaaaccuggcaucuucaagaccaacacagggaccauaggagcaguuagucuggauuuuagcccagguacauccggcucucccauuguggacaggaaagggaaggucgugggauuguacggcaaugguguagucacucgaucgggggcuuaugugagcgccaucgcgcagaccgagaagucaauugaagauaacccugagaucgaagacgauauauuccggaaaaagcgccuaacgauuauggaccugcauccgggagccggcaaaacaaagagauaccuccccgcaaucguuagggaggcuaucaaacggggccugcgaacucuuauuuuagccccaaccagaguggucgcugcagaaauggaggaggcccugcgcgggcucccuaucagguaucaaacacccgccauuaagaccgaacacacuggacgugagauaguggacuugaugugucaugcuaccuucacaaugcggcugcucuccccaguuagagugccuaacuacaaucugaucauuauggaugaagcgcacuuuacggaccccgcaaguaucgccgcuagggguuauaucucuacucgcgucgagaugggcgaggccgcagggauuuucaugaccgccacaccaccgggaagccgagauccuuuuccccaguccaacgcuccaauaauggacgaagagagagaaauccccgagcggucauggaacucuggccacgaaugggugaccgauuucaaggguaaaacuguaugguuugugccuagcauuaaggcggggaacgacaucgccgcaugccuuaggaaaaauggaaagaaaguuauucagcugagucgcaagacauucgauuccgaguacgucaagacccgugcuaacgacugggauuuuguggugacgacugacaucagcgagaugggcgccaauuucaaagcagaaagagucauagauccacggagguguaugaagcccguaaucuugacagacggcgaggaacgcgugauucuagccgggccuaugccgguuacccauucuucagcugcccaacgaagaggacggaucgguaggaaccccaaaaaugagaacgaccaguauauuuacaugggcgaaccccuggagaaugaugaggacugcgcgcacuggaaggaagcaaaaaugcucuuagauaacaucaauaccccugaggggauaauucccuccauguuugaaccagagcgcgaaaagguggacgccaucgauggagaguacagacugaggggcgaggcucggaaaacuuucgucgaccuuaugcgucgcggugaucugccuguguggcucgccuauaagguugcugcagaagggauuaacuacgccgaccgaaagugguguuuugauggcaucaaaaauaaccagauauuggaggaaaacauggagguggagaucuggacaaaggaaggagagaggaaaaagcugaaacccagauggcucgacgcucggauuuauagugauccacuggcccuuaaggaguucaaggaguucgcagcgggccgcaaaagccuaacccugaauuugaucacagaaauggggagauuaccuacuuuuaugacgcagaaggccaggaacgcucuggacaaucucgccguccugcauaccgcagaggcuggaggucgggccuacaaccacgcacuuucggagcugccggaaacacucgagacuuugcugcuacugacccuccuugccacagugaccggcgggauuuuccuguuuuuaaugucuggaaaaggcaucgguaagaugacuuuggggaugugcugcauaauuacggcuuccauccugcucugguaugcgcaaauccagccccacuggauugccgcaagcaucauacuggaguucuuucuuauuguacugcucaucccagagccugaaaaacagcgaaccccacaggauaaucaauugacauacgugguuauugcuauccugacugucguggccgccaccauggcaaacgagaugggcuucuuagagaagacaaagaaagaccuaggacugggcucaauaaccacucaggaaagugagucuaauauccucgacauugaucuuagaccagcuuccgccuggacacuguaugcgguggcuacgaccuuugucacuccuauguugcgccauagcaucgaaaacucaaguguuaaugugagccugacagccguagcaaaccaggccaccgugcucauggggcugggaaaggguuggccccuuuccaaaauggacauuggcgucccgcuccuggcuaucggguguuacucucaggugaauccaauuaccuugacagcagcccuguuacuacugguugcgcacuacgcuaucauaggaccuggccuccaagccaaggcaacuagggaggcccagaaacgggcugccgcagguauuaugaagaaccccacgguggaugggaucaccgucaucgaccuugaaccaauucccuaugauccuaaguucgagaaacagcugggccagguaauguugcugauacucugcgugacacaaguucugaugaugcguacuaccugggcucuuugugaggccuuaacacuggcgaccggaccgaucagcacucucugggaaggcaaucccgggagauuuuggaacacgacaauugccguguccauggcaaauaucuucaggggaucauacuuggcuggcgccggucugcuauuuucuauuaugaagaacaccacaaguacccgccgggggacaggaaauaucggcgagacucugggugaaaaauggaagucgcgacucaacgcacuuggcaaaagcgaguuccagauauauaagaaauccgggauccaggaggucgacagaacccuggcuaaggaaggaauuaagaggggcgagacagaucaucacgccgugucucgcgggucagccaaauugcggugguuugucgaaagaaacauggugacgccagagggaaagguuguggaccugggcugcggucgugggggauggagcuacuauuguggcggucucaaaaauguaagggaagugaagggccugaccaaagggggaccuggccaugaggagcccaucccuauguccacuuacggguggaacuuaguccggcuucaaaguggaguugauguguucuucacaccacccgaaaagugcgacacccugcucugugauauuggcgagucuagcccuaauccaacuaucgaagcgggucgcacacuacgaguccugaacuugguggagaauuggcugaacaauaacacccaguuuugcauaaagguacucaaucccuauaugccgucagugauugagaaaauggaggcacuucagagacaguacgggggagcacugguuaggaacccuuugucccggaauaguacgcacgagauguacugggugagcaacgccaccggcaauaucgucucuuccgugaacaugaucucacgcaugcugauuaauagauucacaaugaagcacaaaaaggcuacuuaugaaccagacgucgaucucggcagcgggaccaggaacauaggaaucgagucggaaauucccaacuuagacaucauugguaaacgaaucgagaagauaaagcaagaacaugagaucucuuggcacuacgaccaggaucauccuuauaaaacaugggccuaccacggcaguuaugagacuaagcagaccggguccgcaagcucaauggugaauggaguuguacggcugcuuacaaaaccaugggacgugguccccauggugacccagauggccaugacugauacgacaccguuuggccaacagcguguuuucaaggaaaaaguggacaccagaacucaggagccuaaggaagguaccaagaaacugaugaagauuacagcugaguggcuauggaaagagcucgggaagaaaaagacgccccgcauguguaccagggaagaguuuacuaaaaagguccgguccaacgcggcccugggagcaaucuucacagaugaaaauaaguggaaaucugcuagagaggccguggaagacggccgcuuuugggaguugguagauagggagcgaaaccugcaccucgaaggcaagugcgagaccuguguguacaauaugauggggaaacgggaaaagaaacuuggagaguucgguaaggcaaagggcagcagagccauuugguauauguggcugggggcuagguuuuuagaguucgaggcccugggauuuuugaacgaggaccauugguucagucgcggcaauucccucagcgguguugaaggggagggacugcaccgucuaggcuacauccuucgggaugucggcaaaaaggaagggggagcgauguacgcagacgauacugccgguugggacacaagaauuacccuggaggaccucaaaaacgaagagauggugacaaaucauaugaagggcgagcacaaaaagcuggcugaagccauauuuaaguugacuuaucagaacaaaguggucaggguucaacgcccaaccccucgagggacggugauggauaucauuucucggagagaccagaggggaucaggccagguagguaccuacgggcugaauacauucacuaacauggaggcacaacucauccgccagauggaaggagagggcaucuucaagaguauucagcaucuuaccgcuacagaggaaauagccgugcagaauuggcuggcuagagucggccgggagagguuaucccguauggccaucagcggggaugacugcgugguuaaacccauugaugaccgauuugcaucugcgcugacugccuugaacgauaugggaaaggugcgcaaagacauccaacagugggaaccaucgagagguuggaaugauuggacccagguccccuucugcucacaccacuuucaugagcucgugaugaaggacggccggguacugguugugccuuguaggaaccaggaugaacuaauugggcgcgcuagaaucagccaaggagccggcuggucccuuaaggagacggcaugccuggguaaaaguuaugcucagauguggacacucauguacuuccaccggagggaccugcgauuggccgcaaacgccauauguucugcggucccaagccauugggugccgaccucccguacuacauggucaauccacgcuaagcacgaguggaugaccacugaagauauguuagccguguggaauagagucuggauucaggagaaccccuggauggaagacaaaaccccuguugagaguugggaagaggugccauaucuggggaagcgcgaggaccaguggugcggaucucucaucggccuuacaagccgggcaacgugggccaaaaauauucaaaccgcuaucaaccagguaaggucccugauaggcaaugaagaguacacugauuauaugcccucaaugaagagauuucgccgggaagaggaagaggccggggugcuaugguga

SEQ ID NO: 14474 - RNA, 9876 nt, Artificial Sequence
  derived and/or modified CDS sequence (opt3) from DENV-2__EU482623__SS-prME
accgccggcgugauaguaaugcugauuccaacagcuauggcauuccaccucacuacgagaaacggggagccucauaugauaguuggaaggcaggaaaaggguaaaagccuucuguuuaagaccgaggacggcgugaauaugugcacauugauggccauagauuuaggggaacugugugaggacacuauuaccuacaaaugcccacuacuccggcaaaacgaaccggaggauaucgacuguuggugcaauuccacaucuaccuggguaacuuauggaacauguaccacgacuggcgagcaccgccgagaaaagcguucaguggcgcuggucccacauguggguauggggcuugagaccagaacagaaacuuggaugaguagcgagggagcuuggaaacacguucagaggauugagaccuggauccugcggcauccuggcuucacaauaauggccgcaaucuuggccuacaccauuggcacgacucacuuucagcgcgcucucaucuucauucugcugacagcaguggccccauccaugaccaugagaugcaucgggauaucuaacagggauuuugucgaaggagugucggguggcucauggguugacauuguucucgagcacgggagcugugugacuacaauggcuaagaauaagcccaccuuagauuucgaacugaucaaaacggaggccaagcagccugcgacccuucggaaauauugcauugaagcaaaguugacaaacacuaccacagagagucgcuguccaacucaaggagagcccucccugaaugaagaacaggacaaacgauuuaucugcaagcauucuauggucgauagaggcugggguaacggguguggacuauucggcaagggcgggaucgugaccugcgccauguuuacaugcaaaaagaauauggaaggaaaagugguccagccugagaaccucgaauacaccauuguuauaacuccacacagcggugaggagcaugcugugggcaaugacacggggaagcacggaaaagaaaucaagauuacaccgcaguccucaaucaccgaggccgaacugacuggcuaugguaccguaacaauggaguguagucccaggaccgggcuugauuucaacgaaauggugcuguugcaaauggaggacaaagcauggcucguccaccggcagugguuucuggauuuaccucugccauggcuccccggcgcugacacucaggagagcaauuggauacagaaggaaacacuugugacguucaagaacccucaugccaaaaagcaagacguugugguccugggaucucaggagggcgcgaugcacaccgccuugacuggggcaacagaaauucagauguccucaggaaaucuacuguuuaccggucaucucaaaugccgucugcgcauggauaaacuucaacugaaaggcaugagcuacaguauguguacagggaaguucaagaucgugaaagagaucgcugagacucagcacggaaccauuguaaucagaguucaguaugaaggcgacgguucuccaugcaagauucccuucgagauaacggauuuggagaagaggcaugugcucgggcggcugaucaccgucaacccgauugugacagagaaggacuccccugucaacaucgaagccgagcccccauuuggcgauagcuacaucauuauaggaguggagccuggccaguuaaaacugaauugguucaagaaggggucgucuaucggacaaauguuugaaacuaccaugcgaggugcuaaacgcauggccauucuaggcgacacagcaugggauuucgggucccucggaggcguuuuuacuucaaucgguaaggcccugcaccagguguucggggcuauuuacggcgcggcauuuaguggaguaagcuggaccaugaaaauccuuauaggcgucaucauuacguggaucgggaugaacuccagaucuacuagcuugucagugagucugguucucgugggagucgugacccuguaucuuggcgccguagugcaggcugacuccgguuguguugucagcuggaagaauaaagagcugaagugcgggucuggaauuuucaucacugauaacgugcacacauggaccgaacaguacaaguuucaacccgagucaccaaguaaauuggccagcgcaauacagaaggcccaugaagagggcauuugugguaucagguccgugacucggcucgagaaucugauguggaaacagauuacccccgaauuaaaccacauccugucugagaaugaagucaagcuaacaauaaugacgggcgacaucaaagggauuaugcaggcuggaaagcgcucgcucagaccucaaccaaccgagcugaaauauagcuggaagacuuggggcaaggccaaaaugcuuuccacagaaucacauaaccagaccuucuugaucgaugggccggagacagcagagugccccaauacuaacagggcguggaauagucuggaaguugaggacuacggauuuggcguguucaccacgaacauuuggcucaagcugcgugaaaaacaggacguguuuugugauucuaaguuaaugagcgcugccaucaaagacaaucgggcaguacacgccgauauggguuauuggauagaguccgcucugaacgacacauggaagauggagaaggccucauucauugaagucaaaagcugccacuggccuaagucucauacccuuugguccaaugggguguuggagagugaaaugaucauccccaagaacuucgcaggacccguuagccagcacaacuaccgaccuggcuaucauacucaaaccgcugguccauggcaccucggcaagcuggagauggauuuugacuucugugaagggacaacuguggucgugaccgaggauugcggaaauagaggccccucucuaaggacaacgaccgccuccgggaaacugauuacugaguggugcugucgcucaugcacacucccgccucugcgguacagaggagaagacggcuguugguacgguauggagaucaggccacuuaaggaaaaggaggaaaacuugguuaauagucuggugaccgcggggcauggacagauugauaacuuuagcuuaggcguacucgguauggcccugcuucuggaggagauguugcgcacucgaauaggcacaaaacacgcuauccuccuggucgcagugucguucgugacccuaauuacggggaauauguccuuucgggaccugggacgugucaugguuauggugggcgccacuaugaccgaugacaucgggaugggaguaacauaucucgcucugcuugccgcauucaaggugagacccaccuuugcggccggcuugcuguuaaggaaacucacuucuaaggaacugaugauggcuacaauugguaucgcccuucugagccagucaaccauaccugagacaauccuagaacucacugaugcacuggcuuuggggaugaugguccugaaaauugugcgcaacauggagaaguaccaauuagccguuaccaucauggcaauuaguugcgugcccaaugccgucauccuccagaacgcuuggaagguguccuguacgauacuggcggccguuucugugagcccacuucuguugacauccucacagcagaaagcagacuggauuccucucgcucugaccaucaagggacuaaaucccacugccaucuuccugaccacacuuagccggacaaguaaaaagagaucuuggccacucaacgaagccauuauggcugucggcaugguauccauacuggcaagcucguugcugaaaaaugacaucccgaugaccggcccuuuaguggccgggggacuccugacgguuugcuaugugcuuacagguaggucagcggaucuggaguuggagcgagcugccgacgucaagugggaagaucaagcagagauuucuggcaguucccccauccucagcauuaccaucucugaagacgggagcauguccaucaaaaacgaggaggaagaacagacucugacaauccuaauucgcaccggacugcuugugaucucaggcguauuuccagugaguauucccaucacugccgcugcaugguaccucugggaagucaagaagcagcgggccgguguucugugggaugugccuagcccacccccuguggagaaagcggaauuggaggacggggcuuauagaauaaagcagaggggaauuuuaggcuacucucaaaucggcgccggggucuauaaagagggaacauuccacaccauguggcaugugacgcguggugcaguucugaugcaccgcggcaagcggaucgaaccguccugggccgaugucaaaaaggaccucauuucauacgggggaggcuggaagcuggagggugaauggaaagagggggaagaggugcagguccuugcucuggagccaggaaagaaucccagagccgugcagacuaaaccuggcaucuuuaagaccaacaguggcacaauaggggcaguuagcuuggauuucuccccaggaaccucugguucgcccauuguggacaggaaaggcaaggucguggggcuauacggaaauggcguagucacacgaagcggugcuuaugugucagccaucgcgcagacugaaaaguccauugaggauaacccugaaaucgaggacgauauauuucggaaaaagcgccugaccauuauggaccuccauccgggggccggaaaaacgaagagauaccugcccgcaaucguuagggaagcuaucaaacggggccuucgaacauuaauucuggccccaacuagaguggucgcugcagagauggaggaagcccuccgcggcuugccuaucagguaucaaacccccgccauuaagacagagcacaccgggcgugaaauaguggaccugaugugucaugcuacuuucaccaugcggcuccugaguccaguuagagugccuaacuacaaucuuaucauuauggaugaggcgcacuucacagaccccgcaucuaucgccgcuaggggauauaucagcacgcgcgucgagaugggugaagccgcaggcauuuuuaugacugccaccccaccggggucccgagauccuuucccccagucaaacgcuccaauaauggacgaggaaagagagauccccgaacggucuuggaauagcggacacgagugggugacagauuuuaagggcaaaaccguaugguucgugccuaguauuaaggcggguaacgacaucgccgcaugccugaggaaaaaugggaagaaaguuauucaguugucccgcaagacuuuugauagcgaguacgucaagacacgugcuaucgacugggauuucguggugaccacggacauaucugaaaugggagccaacuuuaaagcagagagagucaucgauccacggagguguaugaagcccguaauucuaacugacggcgaagaacgcgugauccuggccggcccuaugccgguuacacauucauccgcugcccaacgaagagggcggauuggaaggaaucccaaaaacgaaaaugaccaguauaucuacaugggugagccccucgagaacgaugaagacugcgcgcacuggaaggaggcaaaaauguuacuggauaauauaaacaccccugaaggcauuauccccaguauguucgagccagaacgcgagaagguggacgccauugauggggaguacagacuuaggggagaagcucggaaaaccuuugucgaccugaugcgucgcggcgaucucccugugugguuggccuauaagguugcugcagaggguaucaauuacgccgaccgaaagugguguuucgaugggaucaaaaacaaucagauccuggaagagaacauggagguggaaauuuggacuaaggagggcgaaaggaaaaagcucaaacccagauggcuggacgcucggaucuauagcgauccacuugcccuaaaggaguuuaaggaguucgcagcgggacgcaaaucgcugacauugaacuuaauuaccgagaugggcagacugccuacauucaugacucagaaggccaggaaugcucucgacaaccuggccguccuucauacggcagaggcugggggacgggccuacaaucacgcacugucugaacucccggagaccuuggaaacacugcuacugcucacucuucuggccaccgugacagguggcaucuuuuuauucuugauguccgggaaaggaauaggcaagaugacccuggguaugugcugcauuaucacugcuagcauccuccugugguaugcgcaaauucagccccacuggaucgccgcaucaauaauucuugaguuuuuccugaucguacucuugauuccagaaccugagaaacagcgaacgccccaggauaaccaacugaccuacgugguuaucgcuauauuaacagucguggccgccacuauggcaaaugagaugggguuucuagaaaagaccaagaaagaccugggccucggaaguaucacaacccaggagucugaauccaacauucuugacaucgaucugagaccagcuagcgccuggacuuuguaugcgguggcuacaacguucgucaccccuaugcugcgccauucaauugagaauaguagcguuaacgugucccucacugccaucgcaaaucaggccacaguacugaugggccuugggaagggauggccccucucuaaaauggacauuggugugccgcuguuggcuaucggcuguuacagccaggucaacccaauaacccugaccgcagccuuacuacugcucguggcgcacuacgcuauuaucgggccuggacuucaagccaaggcaacaagggaagcccagaaacgggcugccgcaggcaucaugaagaaucccacuguugaugguauuacggugauagaccuggagccaauccccuaugauccuaaguuugagaaacaguuggggcaggucaugcugcucauucugugcguaacccaagugcuuaugaugcguacaacuugggcuuuaugugaagcccugacccucgcgacaggcccgaucuccaccuugugggagggaaaccccggcagauucuggaauacuacgauugccguuucaauggcaaacaucuuuagggggucuuaccuggcuggagccggccuacuguucaguauaaugaagaauacaaccucgacucgccgggguaccgggaacaucggagaaacacucggcgagaaauggaaaagccgacuuaaugcacuggguaaauccgaguuucagauuuauaagaaaucuggcauccaggaaguggacagaacuuuggcuaaggaggggauuaagaggggagaaaccgaucaucacgccgucucacgcggcagcgccaaacugcggugguucguggagagaaacauggucacaccagaagggaaggugguugaccucggaugcggccguggugggugguccuacuauuguggaggccugaaaaacgugagggagguaaaggguuuaacgaaaggcgggccuggacaugaggaacccaucccuaugaguaccuacggcuggaaucuugugcggcugcaaucuggggucgauguauuuuucacuccacccgagaagugcgacacacuccuaugugauauaggagaaagcucaccuaacccaaccauugaggcgggccgcacucugcgaguguugaaucuggucgaaaacuggcucaauaacaauacacaguucugcaucaaggugcuuaaccccuauaugccguccguaaucgagaaaauggaggcucugcagagacaguacgguggggcauuggugaggaauccucugagucggaacagcacccacgaaauguacuggguuucuaaugccacgggaaacauuguguccucagucaauaugauaagccgcaugcucaucaacagauuuaccaugaagcacaaaaaggcuacauaugagccagacguggauuuaggcucgggcacuaggaauauugggaucgaaucugagauucccaaccuggacaucauaggaaaacgaaucgaaaagauuaagcaagagcaugagaucaguuggcacuacgaccaggaucauccuuauaaaaccugggccuaccacgguuccuaugaaacaaagcagacuggcagcgcaucauccauggucaacggggugguucggcuucugaccaaaccaugggacguagugcccauggucacacagauggccaugaccgauacuacgccguucggacaacagcguguguuuaaggagaaaguugacacaagaacccaggaaccuaaggagggcacuaagaaacuaaugaagauuaccgcugaguggcucuggaaagaacuggguaagaaaaagacaccccgcauguguacgagggaggaguucaccaaaaaggugcggucuaaugcggccuugggggcaaucuuuacugaugagaacaaguggaaaagcgcuagagaagccgucgaggacggacgcuucugggagcugguggauagggaacgaaaucuccaccuugagggcaagugcgaaacauguguauacaacaugaugggcaaacgggagaagaaacugggggaauuuggaaaggcaaaggguaguagagccauuugguauaugugguuaggcgcuagguuccuggaguuugaggccuugggguuccucaaugaagaccauugguuuucccgcggaaacagccugucuggcguggagggugaagggcuacaccgucuuggauacauacugcgggauguuggcaaaaaggagggcggggcgauguacgcagacgauaccgccggaugggacacuagaaucacacucgaagaccugaaaaaugaggagauggucaccaaccauaugaagggugaacacaaaaaguuggcugaggccauuuucaagcugacauaucagaauaaaguggugaggguccaacgcccaacuccucgaggcaccguuauggauaucaucucacggagagaccagagggggaguggacaggugggcacguacggucucaacaccuuuacaaauauggaagcacaacuuauucgccagauggagggggagggaauauucaaguccauccagcaucugacugcuaccgaagagauugccguacagaacugguuagcuagagugggccgggaaaggcugagccguauggccaucucuggcgaugacugcgucgugaaacccauugaugaccgauucgcaucggcguugacagcccucaaugauauggggaagguucgcaaagacauccaacagugggagccaucaagaggauggaacgauuggacucaggugcccuuuugcagccaccacuuccaugaacuggucaugaaggacggucgggugcuaguaguuccuuguaggaaucaggaugagcuuauaggccgcgcuagaaucucccaaggggccggauggagucugaaggagaccgcaugccucggcaaaucuuaugcucagauguggacgcugauguacuuucaccggagggacuugcgauuagccgcaaacgccauuuguagcgcggugccaucccauugggucccgacaucacguaccacuuggaguauccacgcuaagcacgaauggaugacaaccgaggauaugcuggccguguggaacagaguguggauucaggaaaaucccuggauggaggacaaaacuccugucgaaucuugggaggagguuccauaucucgguaagcgcgaagaccaguggugcgggagccuuaucggacugaccucccgggcaacaugggccaaaaacauacaaacggcuauuaaucaggugaggucacuaaucggcaacgaggaauacaccgauuauaugcccagcaugaagagauuccgccgggaggaagaggaggccggcguacugugguga

SEQ ID NO: 14475 - RNA, 9876 nt, Artificial Sequence
  derived and/or modified CDS sequence (opt3) from DENV-2__EU569698__SS-prME
accgccggcgugauaguaaugcugauuccaacagcuauggcuuuccaccucacuacgagaaacggggaaccucauaugauaguuggaaggcaggaaaaggguaaaagccuucuguuuaagaccgaagacggcgugaauaugugcacauugauggccaucgauuuaggggaacugugugaagacacuauuaccuacaaaugcccacuacuccggcaaaacgaaccggaggauaucgacuguuggugcaauuccacaucuaccuggguaacuuauggaacauguaccacgacuggcgagcaccgccgagaaaagcguucaguggcgcuggucccccauguggguauggggcuugagaccagaacagaaacuuggaugaguagcgagggagcuuggaaacacguucagaggauugagaccuggauccugcggcauccuggcuucacaauaauggccgcaaucuuggccuacaccauuggcacgacucacuuucagcgcgcucucaucuucauucugcugacagcaguggccccauccaugaccaugagaugcaucgggauaucuaacagggauuuugucgaaggagugucggguggcucauggguagacauuguucucgagcacgggagcugugugacuacaauggcuaagaauaagcccaccuuagauuucgaacugaucaaaacggaggccaagcagccugcgacccuucggaaauauugcauugaagcaaaguugacaaacacuaccacagagagucgcuguccaacucaaggagagcccucccugaaugaagaacaggacaaacgauuuaucugcaagcauucuauggucgauagaggcugggguaacggguguggacuauucggcaagggcgggaucgugaccugcgccauguuuacaugcaaaaagaauauggaaggaaaagugguccagccugagaaccucgaauacaccauuguuauaacuccacacagcggugaggagcaugcugugggcaaugacacggggaagcacggaaaagaaaucaagauuacaccgcaguccucaaucaccgaggccgaacugacuggcuaugguaccguaacaauggaguguagucccaggaccgggcuugauuucaacgaaauggugcuguugcaaauggaggacaaagcauggcucguccaccggcagugguuucuggauuuaccucugccauggcuccccggcgcugacacucagggaagcaauuggauacagaaggagacacuugugacguucaagaacccucaugccaaaaagcaagacguugugguccugggcucucaggaaggggcgaugcacaccgccuugacuggagcaacagagauucagauguccucagguaaucuacuguuuaccggccaucucaaaugccgucugcgcauggauaaacuucaacugaaagggaugagcuacaguauguguacaggaaaguucaagaucgugaaagaaaucgcugagacucagcacggcaccauuguaaucagaguucaguaugagggugacgggucuccaugcaagauucccuucgaaauaacggauuuggagaaaaggcaugugcucggccggcugaucaccgucaacccgauugugacagaaaaggacuccccugucaacaucgaggccgaacccccauuuggagauagcuacaucauuauaggcguggagccugggcaguuaaaacugaauugguucaagaagggaucgucuaucggucaaauguuugagacuaccaugcgaggcgcuaaacgcauggccauucuaggggacacagcaugggauuucggaucccucggcgguguuuuuacuucaaucgggaaggcccugcaccagguguucggcgcuauuuacggagcggcauuuaguggcguaagcuggaccaugaaaauccuuauaggggucaucauuacguggaucggaaugaacuccagaucuacuagcuugucagugagucugguucucgugggcgucgugacccuguaucuuggugccguagugcaggcugacuccggguguguugucagcuggaagaauaaagaacugaagugcggaucuggcauuuucaucacugauaacgugcacacauggaccgagcaguacaaguuucaacccgaaucaccaaguaaauuggccagcgcaauacagaaggcccaugaggaagguauuuguggcaucagguccgugacucggcucgagaaucugauguggaaacagauuacccccgaguuaaaccacauccugucugaaaaugaggucaagcuaacaauaaugacgggggacaucaaaggaauuaugcaggcuggcaagcgcucgcucagaccucaaccaaccgaacugaaauauagcuggaagacuugggggaaggccaaaaugcuuuccacagagucacauaaccagaccuucuugaucgauggaccggaaacagcagagugccccaauacuaacagggcguggaauagucuggagguugaagacuacggcuuugguguguucaccacgaacauuuggcucaagcugcgugagaaacaggacguguuuugugauucuaaguuaaugagcgcugccaucaaagacaaucgggcaguacacgccgauaugggguauuggauagaauccgcucugaacgacacauggaagauggagaaggccucauucauugaggucaaaagcugccacuggccuaagucucauacccuuugguccaauggaguguuggaaagugagaugaucauccccaagaacuucgcaggccccguuagccagcacaacuaccgaccugguuaucauacucaaaccgcuggcccauggcaccucgggaagcuggaaauggauuuugacuucugugagggaacaacuguggucgugaccgaagauugcggcaauagagggcccucucuaaggacaacgaccgccuccggaaaacugauuacugaguggugcugucgcucaugcacacucccgccucugcgguacagaggcgaggacgguuguugguacgggauggaaaucaggccacuuaaggagaaggaagagaacuugguuaauagucuggugaccgcgggacauggccagauugauaacuuuagcuuagguguacucggcauggcccuguuccuugaagagaugcugcgcacucgaauagggacaaaacacgcuaucuugcucgucgcagugucguuugugacccugauuacgggaaauauguccuuccgggaccuaggccgugucaugguuauggugggggccacuaugaccgaugacaucggaaugggcguaacauaucuggcucuccuggccgcauuuaaggugagacccaccuucgcggccggucuuuugcugaggaaauuaacuucuaaggagcucaugauggcuacaauugggaucgcccugcuuagccagucaaccauaccugaaacaauccuggagcuaacugaugcacucgcucugggaaugauggucuugaaaauugugcgcaacauggaaaaguaccaacuggccguuaccaucauggcaauuaguugcgugcccaaugccgucaucuuacagaacgcuuggaagguguccuguacgauacucgcggccguuucugugagcccacugcuucugacauccucacagcagaaagcagacuggauuccuuuggcucucaccaucaagggccugaaucccacugccaucuuucuaaccacacugagccggacaaguaaaaagagaucuuggccacuuaacgaggccauuauggcugucggcaugguauccauacucgcaagcucgcuguugaaaaaugacaucccgaugaccgggccucugguggccggagguuuacucacgguuugcuaugugcugacaggcaggucagcggaucuugaacuggagcgagcugccgacgucaagugggaggaucaagcagaaauuucugggaguucccccaucuugagcauuaccaucucugaggacggaagcauguccaucaagaacgaagaggaggaacagacucucacaauccugauucgcaccggccuacuggugaucucagguguauucccagugaguauucccaucacugccgcugcaugguaccuuugggaggucaagaagcagcgggccgggguucucugggaugugccuagcccacccccuguggaaaaagcggagcuggaagacggagcuuauagaauaaagcagaggggcauuuugggcuacucucaaaucggggccggagucuauaaagaggguacauuucacaccauguggcaugugacgcguggcgcaguuuuaaugcaccgcgggaagcggaucgagccguccugggccgaugucaaaaaggaccugauuucauacggaggcgguuggaagcucgaaggggaguggaaagaaggagaggaagugcagguccuggcucuugagccaggcaagaaucccagagccgugcagacuaaaccuggcaucuucaagaccaacacagggaccauaggagcaguuagucuggauuuuagcccagguacauccggcucucccauuguggacaggaaagggaaggucgugggauuguacggcaaugguguagucacucgaucgggggcuuaugugagcgccaucgcgcagaccgagaagucaauugaagauaacccugagaucgaagacgauauauuccggaaaaagcgccuaacgauuauggaccugcauccgggagccggcaaaacaaagagauaccuccccgcaaucguuagggaggcuaucaaacggggccugcgaacucuuauuuuagccccaaccagaguggucgcugcagaaauggaggaggcccugcgcgggcucccuaucagguaucaaacacccgccauuaagaccgaacacacuggacgugagauaguggacuugaugugucaugcuaccuucacaaugcggcugcucuccccaguuagagugccuaacuacaaucugaucauuauggaugaagcgcacuuuacggaccccgcaaguaucgccgcuagggguuauaucucuacucgcgucgagaugggcgaggccgcagggauuuucaugaccgccacaccaccgggaagccgagauuccuuuccucagucaaacgcucccauaauggacgaagagagagaaaucccagagcggucuuggaauagcggccacgaaugggugaccgauuucaaggguaaaacuguaugguuugugcccaguauuaaggcggggaacgacaucgccgcaugccuuaggaaaaauggaaagaaaguuauucagcugucccgcaagacauucgauagcgaguacgucaagacccgugcuaacgacugggauuuuguggugacgacugacaucucugagaugggcgccaauuucaaagcagaaagagucauagauccucggagguguaugaagccaguaaucuugacagacggcgaggaacgcgugauucuagccgggcccaugccuguuacccauucauccgcugcccaacgaagaggacggaucgguaggaacccgaaaaaugagaacgaccaguauauuuacaugggcgaaccacuggagaaugaugaggacugcgcgcacuggaaggaagcaaaaaugcucuuagauaacaucaauacccccgaggggauaauuccuaguauguuugaacccgagcgcgaaaagguggacgccaucgauggagaguacagacugaggggcgaggcucggaaaacuuucgucgaccuuaugcgucgcggugaucugccaguguggcucgccuauaagguugcugcagaagggauuaacuacgccgaccgaaagugguguuuugauggcaucaaaaauaaccagauauuggaggaaaacauggagguggagaucuggacaaaggaaggagagaggaaaaagcugaaaccuagauggcucgacgcucggauuuauagcgauccccuggcccuuaaggaguucaaggaguucgcagcgggccgcaaaucgcuaacccugaauuugaucacagaaauggggagauuaccaacuuuuaugacgcagaaggccaggaacgcucuggacaaucucgccguccugcauaccgcagaggcuggaggucgggccuacaaccacgcacuuucugagcugccugaaacacucgagacuuugcugcuacugacccuccuugccacagugaccggcgggauuuuccuguuuuuaauguccggaaaaggcaucgguaagaugacuuuggggaugugcugcauaauuacggcuagcauccugcucugguaugcgcaaauccagccgcacuggauugccgcaucaaucauacuggaguucuuucuuauuguacugcucauccccgagccagaaaaacagcgaaccccucaggauaaucaauugacauacgugguuauugcuauccugacugucguggccgccaccauggcaaacgagaugggcuucuuagagaagacaaagaaagaccuaggacugggcaguauaaccacucaggaaucugaguccaauauccucgacauugaucuuagacccgcuagcgccuggacacuguaugcgguggcuacgaccuuugucacuccaauguugcgccauucaaucgaaaacaguagcguuaaugugucccugacagccauugcaaaccaggccaccguacucauggggcugggaaaggguuggccucuuucuaaaauggacaucggcgugccccuccuggcuauuggguguuacagccaggucaauccgaucaccuugacagcagcccuguuacuacugguggcgcacuacgcuauaauuggaccaggccuccaagccaaggcaacuagggaggcccagaaacgggcugccgcagguaucaugaagaacccuacgguugaugggaucaccgugauugaccuugaacccauaccauaugaucccaaguucgagaaacagcugggccaggucauguugcugauccucugcguaacacaagugcugaugaugcguacuaccugggcucuuugugaggccuuaacacuggcgaccggaccuauuuccacucucugggaaggcaauccggggagauuuuggaacacgacaaucgccguuucaauggcaaauauuuucaggggaucuuacuuggcuggcgccggucugcuauuuaguaucaugaagaacaccacuucgacccgccgggggacaggaaauauaggcgagacucugggugaaaaauggaaaagccgacucaacgcacuuggcaaauccgaguuccagaucuauaagaaaucugggauucaggagguggacagaacccuggcuaaggaaggaaucaagaggggcgagacagaucaucacgccgucucacgcgggagcgccaaauugcggugguuuguggaaagaaacauggucacgcccgagggaaaggugguugaccugggcugcggucgugggggaugguccuacuauuguggcggucucaaaaaugugagggaaguaaagggccugaccaaagggggaccaggccaugaggagccuauucccaugaguacuuacggguggaacuuagugcggcuucaaucuggagucgauguuuucuucacaccuccagaaaagugcgacacccugcucugugauaucggcgagagcucacccaauccuacuauagaagcgggucgcacacuacgagugcugaacuuggucgagaauuggcugaacaauaacacccaguuuugcauuaaggugcucaauccauauaugcccuccguaaucgagaaaauggaggcacuucagagacaguacgggggagcacuggugaggaacccguugagucggaauagcacgcacgagauguacuggguuucuaacgccaccggcaauaucguguccucagucaacaugauuagccgcaugcugauaaauagauucacaaugaagcacaaaaaggcuacuuaugaaccugacguggaucucggcucggggaccaggaacaucggaauugagucugaaaucccaaacuuagacauuaucgguaaacgaauagagaagaucaagcaagaacaugagauuaguuggcacuacgaccaggaucaucccuauaaaacaugggccuaccacggcuccuaugagacuaagcagaccgggagcgcaucauccauggucaauggagugguucggcugcuuacaaaaccuugggacguagugccaauggucacccagauggccaugacugauacgacacccuuuggccaacagcguguguucaaggaaaaaguugacaccagaacucaggagccgaaggaagguaccaagaaacugaugaagaucacagcugaguggcuauggaaagagcucgggaagaaaaagacgccucgcauguguaccagggaagaguuuacuaaaaaggugcggucuaacgcggcccugggagcaauuuucacagaugaaaauaaguggaaaagcgcuagagaggccgucgaagacggccgcuuuugggaguugguggauagggagcgaaaccugcaccucgaaggcaagugcgagaccuguguauacaauaugauggggaaacgggaaaagaaacuuggagaguucgguaaggcaaagggcaguagagccaucugguauauguggcugggggcuagguuuuuagaguucgaggcccugggauuuuugaacgaggaccauugguucucccgcggcaauagccucucugguguggaaggggagggacugcaccgucuaggcuacauucuucgggauguuggcaaaaaggaagggggagcgauguacgcagacgauacugccgguugggacacaagaauaacccuggaggaccucaaaaacgaagagauggucacaaaucauaugaagggcgagcacaaaaagcuggcugaagccaucuuuaaguugacuuaucagaacaaaguggugaggguccaacgccccaccccacgagggacgguuauggauauuaucucacggagagaccagaggggaaguggccagguggguaccuacgggcugaauacauucacuaacauggaggcacaacucauccgccagauggaaggagagggcauuuucaaguccauacagcaucuuaccgcuacagaggaaaucgccguacagaauuggcuggcuagagugggccgggagagguuaagccguauggccauuucuggggaugacugcgucgugaaaccuaucgaugaccgauuugcaucggcgcugacugccuugaacgauaugggaaagguucgcaaagacauucaacagugggaacccucaagagguuggaaugauuggacccaggugccauucugcagccaccacuuucaugagcucgucaugaaggacggccgggugcugguaguucccuguaggaaccaggaugaacuaaucgggcgcgcuagaauaucccaaggagccggcuggagucuuaaggagacggcaugccuggguaaaucuuaugcucagauguggacacucauguacuuccaccggagggaccugcgauuggccgcaaacgccaucuguagcgcggugccuucccauugggucccaaccucacguacuacauggaguauucacgcuaagcacgaguggaugaccacugaagauauguuagccguguggaauagaguguggauccaggagaacccguggauggaagacaaaacccccgucgagucuugggaagagguuccuuaucuggggaagcgcgaggaccaguggugcggaagccucauuggccuuacaucccgggcaacgugggccaaaaauauccaaaccgcuauaaaccaggugaggucacugauuggcaaugaagaguacacugauuauaugccaagcaugaagagauuucgccgggaagaggaagaggccgggguacuaugguga

SEQ ID NO: 14476 - RNA, 9876 nt, Artificial Sequence
  derived and/or modified CDS sequence (opt3) from DENV-2__EU569699__SS-prME
accgccggcgugaucguaaugcugauucccaccgcuauggcauuccaccucacuacgcguaacggggaaccucauaugauaguuggaaggcaggaaaaggguaaaagccuucuguuuaagaccgaggacggcgugaauaugugcacauugauggccaucgauuuaggggaacugugugaggacacuauuaccuacaaaugcccauuacuccggcaaaacgaaccggaggauaucgacuguuggugcaauuccacaucuaccuggguaacuuauggaacauguaccacgacuggcgagcaccgccgagaaaagcguucaguggcgcuggucccccauguggguauggggcuugagaccaggacagaaacuuggaugaguagcgagggagcuuggaaacacguucagaggauugagaccuggauccugcggcauccuggcuucacaauaauggccgcaaucuuggccuacaccauuggcacgacucacuuucagcgcgcucucaucuucauucugcugacagcaguggccccauccaugaccaugagaugcaucgggauaucuaacagggauuuugucgaaggagugucggguggcucauggguagacauuguucucgagcacgggagcugugugacuacaauggcuaagaauaagcccaccuuagauuucgaacugaucaaaacggaggccaagcagccugcgacccuucggaaauauugcauugaagcaaaguugacaaacacuaccacagagagucgcuguccaacucaaggagagcccucccugaaugaggaacaggacaaacgauuuaucugcaagcauucuauggucgauagaggcugggguaacggguguggacuauucggcaagggcgggaucgugaccugcgccaaauuuacaugcaagaaaaauauggaaggaaaggugguccagccugagaaccucgaauacaccauuguuauaacuccacacagcggugaggagcaugcugugggcaaugacacggggaaacacggaaaggaaaucaaaauuacaccgcaguccucaaucaccgaggccgaacugacuggcuaugguaccguaacaauggaguguagucccaggaccgggcuugauuucaacgaaauggugcuguugcaaauggaggacaaggcauggcucguccaccggcagugguuucuggauuuaccucugccauggcuccccggcgcugacacucagggaagcaauuggauacagaaggagacacuugugacguucaaaaacccucaugccaagaaacaagacguugugguccugggcucucaggaaggggcgaugcacaccgccuugacuggagcaacagagauucagauguccucagguaaucuacuguuuaccggccaucucaagugccgucugcgcauggauaaacuucaacugaaggggaugagcuacaguauguguacaggaaaguucaaaaucgugaaggaaaucgcugagacucagcacggcaccauuguaaucagaguucaguaugagggugacgggucuccaugcaaaauucccuucgaaauaacggauuuggagaagaggcaugugcucggccggcugaucaccgucaacccgauugugacagaaaaagacuccccugucaacaucgaggccgaacccccauuuggagauagcuacaucauuauaggcguggagccugggcaguuaaagcugaauugguucaagaaaggaucgucuaucggucaaauguuugagacuaccaugcgaggcgcuaagcgcauggccauucuaggggacacagcaugggauuucggaucccucggcgguguuuuuacuucaaucgggaaagcccugcaccagguguucggcgcuauuuacggagcggcauuuaguggcguaagcuggaccaugaagauccuuauaggggucaucauuacguggaucggaaugaacuccagaucuacuagcuugucagugagucugguucucgugggcgucgugacccuguaucuuggugccaugguacaggcugacuccgggugugugguuagcuggaaaaauaaggaacugaagugcggaucuggcauuuucaucacugauaacguccacacauggaccgagcaguacaaauuucaacccgaaucaccaaguaaguuggccagcgcaauacagaaagcccaugaggaagguauuuguggcaucagguccgugacucggcucgagaaucugauguggaagcagauuacccccgaguuaaaccacauccugucugaaaaugaggugaaacuaacaauaaugacgggggacauccgcggaauuaugcaggcuggcaagagaucgcucaggccucaaccaaccgaacugaaauauagcuggaagacuugggggaaggccaaaaugcuuuccacagagucacauaaccagaccuucuugaucgauggaccggaaacagcagagugccccaauacuaaccgugcguggaauagucuggaggucgaagacuacggcuuugguguuuucaccacgaacauuuggcucaagcugcgggacaaacaggauguguuuugugacucuaaguuaaugagcgcugccaucaaagauaaucgagcagugcacgccgacaugggguauuggauagaguccgcucugaacgauacauggaagauggaaaaggccucauucauugagguaaaaagcugccacuggccuaagucucauacccuuugguccaauggagucuuggagagugaaaugaucauccccaagaauuucgcaggccccgugagccagcacaacuacagaccugguuaucauacucaaaccgcuggcccauggcaccucgggaagcuggagauggacuuugaucuaugugaaggaacaacuguuguggucaccgaggacugcggcaauagggggcccucucugcgcacaacgaccgccuccggaaaacucauuacugaauggugcugucggucaugcacacugccgccucuuagauacaggggcgaggaugguuguugguacgggauggagauccgcccauugaaggaaaaggaggaaaaccuggugaauaguuuaguuaccgcgggacauggccagauugacaacuucagccucggugugcugggcauggcccuucuguuggaggaaaugcuccgaacucggauagggacaaaacacgcuauccugcuaguagcagucucguuugugacccugauuacgggaaauauguccuuccgugaucucggcagagugauggucaugguuggggccacuaugaccgacgauaucggaaugggcgugacauaucuggcucuuuuggccgcauuuaagguaaggcccaccuucgcggccggucuguuacuccgcaaacugacuucuaaggagcuuaugauggcuacaauugggaucgcccugcuaagccagucaaccauaccugagacaauccucgaacugacugacgcauuggcucugggaaugaugguguuaaaaauuguccggaacauggagaaguaccaacucgccgugaccguuauggcaaucaguugcgugcccaaugccgucauucugcagaacgcuuggaagguguccuguacgauccuugcggccguuucugugagcccacuguugcucacauccucacagcagaaagcagacuggauaccucuggcucuaaccauuaagggccugaaucccacugccaucuuucuuaccacacucagcagaacaaguaaaaagaggucuuggccacugaacgaagccaucauggcugucggcaugguauccauuuuggcaagcucgcugcucaaaaaugauauaccgaugaccgggccucuaguggccggaggucugcuuacgguuugcuaugugcugacaggccgaucagcggacuuggagcucgaacgcgcugccgaugucaagugggaggaccaagcagagaucucugggaguucccccauucugagcaucaccauuucugaagauggaagcauguccaucaaaaacgaggaagaggagcagacucuaacaauacugauccggaccggccuucucgugauuucagguguauucccagugaguauccccauuacugccgcugcaugguaccugugggaagucaagaagcagagagccgggguuuugugggacgugccuagcccacccccuguggagaaagcggaauuagaggauggagcuuauaggaucaagcagcguggcauacugggcuacucucaaauuggggccggagucuauaaagaagguacauuucacaccauguggcaugugacgcgcggcgcaguucucaugcaccgggggaagagaaucgagccguccugggccgacgucaagaaagaucugaucucauacggaggcgguuggaaacuugagggggaauggaaagagggagaagaggugcagguccuggcuuuggaaccaggcaaaaaucccagggccgugcagacuaaaccuggcauuuucaagaccaacacagggaccaucggagcaguuagucuagacuuuagcccagguacauccggcucucccauaguggaucgaaaagggaaggucgugggacuguacggcaaugguguagucacucggucgggggcuuaugugagcgccauugcgcagaccgagaagucaaucgaggacaacccugaaauugaggaugacaucuuccgcaaaaagagacucacgauaauggaccugcauccgggagccggcaaaacaaagagguaccuucccgcaauuguucgggaagcuaucaaacgaggcuuaagaacucugauccucgccccaacccgcguggucgcugcagagauggaagaggccuugagggggcugccuauucguuaucaaacaaccgccaucaagacugagcacaccggacgggaaauuguggaucucaugugucaugcuacauuuacgaugagacugcuuucccccguuagggugccaaacuacaaucugauaaucauggacgaggcgcacuucacugauccugcaaguauugccgcucgcgguuauaucucuacccgagucgaaaugggcgaggccgcagggaucuucaugacagccacaccaccaggaagcagagacccguuuccucaguccaacgcucccauuauggaugaggaacgggagauaccagaaaggucauggaacucuggccacgagugggugacugacuucaaggguaaaacaguaugguuugugcccagcaucaaggcggggaacgauauugccgcaugcuugcgcaaaaauggaaagaaaguuauccagcuaagucguaagaccuucgacuccgaauacgucaagacgagagcuaacgauugggacuuuguggugacuacagauauuagcgagaugggcgccaauuucaaagcagagcgggucaucgacccuaggcgcuguaugaagccaguaauacugaccgacggcgaagaacgagugauccucgccgggcccaugccuguuacccauucuucagcugcccaaagacggggaaggauuggucgcaacccgaaaaaugaaaacgaucaguauaucuacaugggcgagccauuagaaaaugacgaggauugcgcgcacuggaaggaggcaaaaaugcugcuugacaacauuaauacucccgaagggaucauaccuuccauguuugagcccgaaagagagaagguggaugccauugacggagaauacaggcugcggggcgaggcucguaaaacauucgucgaucucaugcgccgaggugacuugccaguguggcuggccuauaagguugcugcagaggggaucaacuacgccgauagaaagugguguuuugacggcauuaaaaauaaccagauccucgaagagaacauggaaguggagauauggaccaaggagggagaaaggaaaaagcugaaaccucgguggcuugaugcucgcaucuauagugacccccuagcccugaaggaguucaaggaauuugcagcgggcagaaagagcuugacauuaaaucugauuacugagauggggaggcucccaacguucaugacccagaaggcccggaacgcucuggauaaucuugccguccugcauacagcagaagcuggaggucgagccuacaaccacgcacucucggaguugccugagacucuggaaacccuacugcuccuuacacuguuagccaccgugacuggcgggaucuucuuguuucugaugucuggaaaaggcauugguaagaugacgcucgggaugugcugcaucauaaccgcuuccauucugcuuugguaugcgcaaauccagccgcacuggaucgccgcaagcauuauccuggaguucuuucucauaguauugcugauucccgaaccagagaaacagagaacaccucaggacaaucaauuaacuuacgugguuaucgcuauucuaaccgucguggccgccacaauggcaaacgaaaugggcuuccuggagaagaccaagaaagaccucggacuuggcucaaucacuacacaggagagugaaucuaauauacuggauaucgacuugcgccccgcuuccgccuggacgcuguaugcgguggcuaccacuuuugucacaccaaugcucaggcauagcauugagaacucaaguguuaaugugagccugaccgccaucgcaaaccaggccaccguacuuauggggcucggaaaggguuggccucuguccaaaauggauauuggcgugcccuugcuggcuaucggguguuacucucaggucaauccgauuacauuaacugcagcccuacugcuccuuguggcgcacuacgcuaucauaggaccaggccugcaagccaaggcaacgcgggaagcccagaaacgugcugccgcagguauuaugaagaacccuaccguugacgggaucacagugaucgauuuggagcccauuccauaugaccccaaguucgaaaaacagcugggccaggucaugcuccugauacuuugcguaacucaaguguuaaugaugagaaccacaugggcucugugugaggcccucaccuuggcgacuggaccuaucagcacgcugugggagggcaauccggggagguuuuggaacacaaccauugccguuuccauggcaaauaucuuccgcggaucauaccuagcuggcgccggucugcucuuuucuauuaugaagaacacuaccaauacacggcgagggacuggaaacaucggcgaaacccuuggugagaaauggaagaguagacugaacgcauugggcaaaucggaguuccagauauauaagaaaagcgggauccaggagguggauaggacacuggcuaaggagggaauuaagcgcggcgaaacggaccaucacgccgucucccgggggucugccaaacucagaugguuuguggagcguaauauggucacccccgaaggaaaggugguugaucugggcugcgguagagggggauggucauacuauuguggcggucuuaaaaacgugcgggagguaaagggccuaacuaaagggggaccaggccaugaagaaccuauccccaugagcacauacggguggaaucuggugcgccuccaauccggagucgacguuuucuuuaccccuccagagaagugcgauacucuacugugugacauuggcgaaaguucucccaacccuacaaucgaggcgggucgaaccuugagagugcugaaucucgucgaaaacuggcuuaauaacaauacgcaguucugcauaaaggugcugaacccauauaugcccagcguaauugagaaaauggaggcuuugcagaggaaguacgggggagcacuggugcggaauccgcucucacgcaacuccacccacgagauguacuggguuaguaaugccacaggcaacaucgugagcucugucaauaugaucuccagaauguuaauuaacagguucacuaugaaacacaagaaagcuaccuaugagccugauguggaccugggcucagggacacgaaacauaggaaucgaaagcgagauuccaaaucuugacaucauugguaagcggaucgaaaagauaaaacaggagcaugaaacuucguggcacuacgaucaagaccaucccuauaagaccugggccuaccacggcucuuaugagacaaaacagaccgggagugcauccagcauggucaacggagugguucgucugcuaacuaagccuugggauguagugccaauggucacgcagauggccaugacagacaccacucccuuuggccagcaaagaguguucaaagagaagguugauacccgcacacaggaaccgaaggaggguacgaaaaagcucaugaaaaucaccgcugaauggcuguggaaggaguuggggaaaaagaaaacuccuaggauguguacacgggaggaauuuaccagaaaggugcgcucaaaugcggcccugggagcaauuuucacugacgagaacaaguggaaauccgcuagggaagccgucgaggauggccgauuuugggaacucguggaccgggagagaaaucuucaccuggagggcaagugcgaaacauguguauacaacaugauggggaaaagggagaagaaauuaggagaguucgguaaggcaaagggcucucgcgccaucugguauauguggcugggggcuagauuuuuggaguucgaagcccucggauuucugaaugaggaucauugguucagccggggcaacagucuauccgguguggagggggaaggacuucacagacugggcuacauucucagggacguuggcaaaaaggaagggggagcgauguacgcagaugacaccgccgguugggacacacgcaucacucuggaagauuugaaaaaugaggaaauggucaccaaccauaugaagggcgagcacaaaaagcuggcugaggccauuuuuaagcucacguaucagaauaaaguggugcgaguccagcggcccaccccaagagggacaguuauggacauaaucagcaggcgcgaucaaagaggaucuggccagguggguacuuacgggcuuaacaccuucacaaauauggaagcacagcugauucggcaaauggagggagaaggcaucuuuaagucaauccagcauuuaacugcuauugaggagauagccguacagaacuggcuggcuagggugggccgugaacgauugagucgcauggccaucuccggggacgauugcgucauuaaaccuaucgacgauagauucgcaagcgcgcucaccgcccugaaugacaugggaaaggugcggaaagauauucagcaaugggagcccucuagggguuggaacgacuggacgcagguuccauucugcucgcaccacuuucaugaguuagugaugaaggauggccgcguccuugugguacccuguagaaaccaggacgagcugaucgggcgggcuaggauaucacagggagccggcuggagccucaaggaaacagcaugccuggguaaauccuaugcucaaauguggaccuugauguacuuccaccgacgugauuuaagacuggccgcaaaugccaucuguagugcgguuccuucucauugggugccaacuagccgcacaaccugguccauucacgcuaagcacgaguggaugacuaccgaggacaugcucgccgucuggaaccggguguggauccaggaaaauccguggauggaggacaaaacacccguggaaucaugggaggaagucccuuaucuugggaagagggaggaucaguggugcggaagucugauuggccuaacgucuagagcaaccugggccaaaaacauccagacugcuauaaaucaaguucgcagccugauuggcaacgaggaauacacagacuauaugccauccaugaagcgguuuaggcgagaggaagaggaagccggggugcucugguga

SEQ ID NO: 14477 - RNA, 9876 nt, Artificial Sequence
  derived and/or modified CDS sequence (opt3) from DENV-2__KF955366__SS-prME
accgccggcgugauaguaaugcugauuccaacagcuauggcuuuccaccucacuacgagaaacggggaaccucauaugauaguuggaaggcaggaaaaggguaaaagccuucuguuuaagaccgaagacggcgugaauaugugcacauugauggccaucgauuuaggggaacugugugaagacacuauuaccuacaaaugcccacuacuccggcaaaacgaaccggaggauaucgacuguuggugcaauuccacaucuaccuggguaacuuauggaacauguaccacgacuggcgagcaccgccgagaaaagcguucaguggcgcuggucccccauguggguauggggcuugagaccagaacagaaacuuggaugaguagcgagggagcuuggaaacacguucagaggauugagaccuggauccugcggcauccuggcuucacaauaauggccgcaaucuuggccuacaccauuggcacgacucacuuucagcgcgcucucaucuucauucugcugacagcaguggccccauccaugaccaugagaugcaucgggauaucuaacagggauuuugucgaaggagugucggguggcucauggguagacauuguucucgagcacgggagcugugugacuacaauggcuaagaauaagcccaccuuagauuucgaacugaucaaaacggaggccaagcagccugcgacccuucggaaauauugcauugaagcaaaguugacaaacacuaccacagagagucgcuguccaacucaaggagagcccucccugaaugaagaacaggacaaacgauuuaucugcaagcauucuauggucgauagaggcugggguaacggguguggacuauucggcaagggcgggaucgugaccugcgccauguuuacaugcaaaaagaauauggaaggaaaagugguccagccugagaaccucgaauacaccauuguuauaacuccacacagcggugaggagcaugcugugggcaaugacacggggaagcacggaaaagaaaucaagauuacaccgcaguccucaaucaccgaggccgaacugacuggcuaugguaccguaacaauggaguguagucccaggaccgggcuugauuucaacgaaauggugcuguugcaaauggaggacaaagcauggcucguccaccggcagugguuucuggauuuaccucugccauggcuccccggcgcugacacucagggaagcaauuggauacagaaggagacacuugugacguucaagaacccucaugccaaaaagcaagacguugugguccugggcucucaggaaggggcgaugcacaccgccuugacuggagcaacagagauucagauguccucagguaaucuacuguuuaccggccaucucaaaugccgucugcgcauggauaaacuucaacugaaagggaugagcuacaguauguguacaggaaaguucaagaucgugaaagaaaucgcugagacucagcacggcaccauuguaaucagaguucaguaugagggugacgggucuccaugcaagauucccuucgaaauaacggauuuggagaaaaggcaugugcucggccggcugaucaccgucaacccgauugugacagaaaaggacuccccugucaacaucgaggccgaacccccauuuggagauagcuacaucauuauaggcguggagccugggcaguuaaaacugaauugguucaagaagggaucgucuaucggucaaauguuugagacuaccaugcgaggcgcuaaacgcauggccauucuaggggacacagcaugggauuucggaucccucggcgguguuuuuacuucaaucgggaaggcccugcaccagguguucggcgcuauuuacggagcggcauuuaguggcguaagcuggaccaugaaaauccuuauaggggucaucauuacguggaucggaaugaacuccagaucuacuagcuugucagugagucugguucucgugggcgucgugacccuguaucuuggugccguagugcaggcugacuccggguguguugucagcuggaagaauaaagaacugaagugcggaucuggcauuuucaucacugauaacgugcacacauggaccgagcaguacaaguuucaacccgaaucaccaaguaaauuggccagcgcaauacagaaggcccaugaggaagguauuuguggcaucagguccgugacucggcucgagaaucugauguggaaacagauuacccccgaguuaaaccacauccugucugaaaaugaggucaagcuaacaauaaugacgggggacaucaaaggaauuaugcaggcuggcaagcgcucgcucagaccucaaccaaccgaacugaaauauagcuggaagacuugggggaaggccaaaaugcuuuccacagagucacauaaccagaccuucuugaucgauggaccggaaacagcagagugccccaauacuaacagggcguggaauagucuggagguugaagacuacggcuuugguguguucaccacgaacauuuggcucaagcugcgugagaaacaggacguguuuugugauucuaaguuaaugagcgcugccaucaaagacaaucgggcaguacacgccgauaugggguauuggauagaauccgcucugaacgacacauggaagauggagaaggccucauucauugaggucaaaagcugccacuggccuaagucucauacccuuugguccaauggaguguuggaaagugagaugaucauccccaagaacuucgcaggccccguuagccagcacaacuaccgaccugguuaucauacucaaaccgcuggcccauggcaccucgggaagcuggaaauggauuuugacuucugugagggaacaacuguggucgugaccgaagauugcggcaauagagggcccucucuaaggacaacgaccgccuccggaaaacugauuacugaguggugcugucgcucaugcacacucccgccucugcgguacagaggcgaggacgguuguugguacgggauggaaaucaggccacuuaaggagaaggaagagaacuugguuaauagucuggugaccgcgggacauggccagauugauaacuuuagcuuagguguacucggcauggcccuguuccuugaagagaugcugcgcacucgaauagggacaaaacacgcuaucuugcucgucgcagugucguuugugacccugauuacgggaaauauguccuuccgggaccuaggccgugucaugguuauggugggggccacuaugaccgaugacaucggaaugggcguaacauaucuggcucuccuggccgcauuuaaggugagacccaccuucgcggccggucuuuugcugaggaaauuaacuucuaaggagcucaugauggcuacaauugggaucgcccugcuuagccagucaaccauaccugaaacaauccuggagcuaacugaugcacucgcucugggaaugauggucuugaaaauugugcgcaacauggaaaaguaccaacuggccguuaccaucauggcaauuaguugcgugcccaaugccgucaucuuacagaacgcuuggaagguguccuguacgauacucgcggccguuucugugagcccacugcuucugacauccucacagcagaaagcagacuggauuccuuuggcucucaccaucaagggccugaaucccacugccaucuuucuaaccacacugagccggacaaguaaaaagagaucuuggccacuuaacgaggccauuauggcugucggcaugguauccauacucgcaagcucgcuguugaaaaaugacaucccgaugaccgggccucugguggccggagguuuacucacgguuugcuaugugcugacaggcaggucagcggaucuugaacuggagcgagcugccgacgucaagugggaggaucaagcagaaauuucugggaguucccccaucuugagcauuaccaucucugaggacggaagcauguccaucaagaacgaagaggaggaacagacucucacaauccugauucgcaccggccuacuggugaucucagguguauucccagugaguauucccaucacugccgcugcaugguaccuuugggaggucaagaagcagcgggccgggguucucugggaugugccuagcccacccccuguggaaaaagcggagcuggaagacggagcuuauagaauaaagcagaggggcauuuugggcuacucucaaaucggggccggagucuauaaagaggguacauuucacaccauguggcaugugacgcguggcgcaguuuuaaugcaccgcgggaagcggaucgagccguccugggccgaugucaaaaaggaccugauuucauacggaggcgguuggaagcucgaaggggaguggaaagaaggagaggaagugcagguccuggcucuugagccaggcaagaaucccagagccgugcagacuaaaccuggcaucuucaagaccaacacagggaccauaggagcaguuagucuggauuuuagcccagguacauccggcucucccauuguggacaggaaagggaaggucgugggauuguacggcaaugguguagucacucgaucgggggcuuaugugagcgccaucgcgcagaccgagaagucaauugaagauaacccugagaucgaagacgauauauuccggaaaaagcgccuaacgauuauggaccugcauccgggagccggcaaaacaaagagauaccuccccgcaaucguuagggaggcuaucaaacggggccugcgaacucuuauuuuagccccaaccagaguggucgcugcagaaauggaggaggcccugcgcgggcucccuaucagguaucaaacacccgccauuaagaccgaacacacuggacgugagauaguggacuugaugugucaugcuaccuucacaaugcggcugcucuccccaguuagagugccuaacuacaaucugaucauuauggaugaagcgcacuuuacggaccccgcaaguaucgccgcuagggguuauaucucuacucgcgucgagaugggcgaggccgcagggauuuucaugaccgccacaagcccaggaucccgagauccguuuccucagucaaacgcucccauaauggacgaagagagagaaaucccagagcggucuuggaauagcggccacgaaugggugaccgauuucaaggguaaaacuguaugguuugugcccaguauuaaggcggggaacgacaucgccgcaugccuuaggaaaaauggaaagaaaguuauucagcugucccgcaagacauucgauagcgaguacgucaagacccgugcuaacgacugggauuuuguggugacgacugacaucucugagaugggcgccaauuucaaagcagaaagagucauagauccucggagguguaugaagccaguaaucuugacagacggcgaggaacgcgugauucuagccgggcccaugccuguuacccauucauccgcugcccaacgaagaggacggaucgguaggaacccgaaaaaugagaacgaccaguauauuuacaugggcgaaccacuggagaaugaugaggacugcgcgcacuggaaggaagcaaaaaugcucuuagauaacaucaauacccccgaggggauaauuccuaguauguuugaacccgagcgcgaaaagguggacgccaucgauggagaguacagacugaggggcgaggcucggaaaacuuucgucgaccuuaugcgucgcggugaucugccaguguggcucgccuauaagguugcugcagaagggauuaacuacgccgaccgaaagugguguuuugauggcaucaaaaauaaccagauauuggaggaaaacauggagguggagaucuggacaaaggaaggagagaggaaaaagcugaaaccuagauggcucgacgcucggauuuauagcgauccccuggcccuuaaggaguucaaggaguucgcagcgggccgcaaaucgcuaacccugaauuugaucacagaaauggggagauuaccaacuuuuaugacgcagaaggccaggaacgcucuggacaaucucgccguccugcauaccgcagaggcuggaggucgggccuacaaccacgcacuuucugagcugccugaaacacucgagacuuugcugcuacugacccuccuugccacagugaccggcgggauuuuccuguuuuuaauguccggaaaaggcaucgguaagaugacuuuggggaugugcugcauaauuacggcuagcauccugcucugguaugcgcaaauccagccgcacuggauugccgcaucaaucauacuggaguucuuucuuauuguacugcucauccccgagccagaaaaacagcgaaccccucaggauaaucaauugacauacgugguuauugcuauccugacugucguggccgccaccauggcaaacgagaugggcuucuuagagaagacaaagaaagaccuaggacugggcaguauaaccacucaggaaucugaguccaauauccucgacauugaucuuagacccgcuagcgccuggacacuguaugcgguggcuacgaccuuugucacuccaauguugcgccauucaaucgaaaacaguagcguuaaugugucccugacagccauugcaaaccaggccaccguacucauggggcugggaaaggguuggccucuuucuaaaauggacaucggcgugccccuccuggcuauuggguguuacagccaggucaauccgaucaccuugacagcagcccuguuacuacugguggcgcacuacgcuauaauuggaccaggccuccaagccaaggcaacuagggaggcccagaaacgggcugccgcagguaucaugaagaacccuacgguugaugggaucaccgugauugaccuugaacccauaccauaugaucccaaguucgagaaacagcugggccaggucauguugcugauccucugcguaacacaagugcugaugaugcguacuaccugggcucuuugugaggccuuaacacuggcgaccggaccuauuuccacucucugggaaggcaauccggggagauuuuggaacacgacaaucgccguuucaauggcaaauauuuucaggggaucuuacuuggcuggcgccggucugcuauuuaguaucaugaagaacaccacuucgacccgccgggggacaggaaauauaggcgagacucugggugaaaaauggaaaagccgacucaacgcacuuggcaaauccgaguuccagaucuauaagaaaucugggauucaggagguggacagaacccuggcuaaggaaggaaucaagaggggcgagacagaucaucacgccgucucacgcgggagcgccaaauugcggugguuuguggaaagaaacauggucacgcccgagggaaaggugguugaccugggcugcggucgugggggaugguccuacuauuguggcggucucaaaaaugugagggaaguaaagggccugaccaaagggggaccaggccaugaggagccuauucccaugaguacuuacggguggaacuuagugcggcuucaaucuggagucgauguuuucuucacaccuccagaaaagugcgacacccugcucugugauaucggcgagagcucacccaauccuacuauagaagcgggucgcacacuacgagugcugaacuuggucgagaauuggcugaacaauaacacccaguuuugcauuaaggugcucaauccauauaugcccuccguaaucgagaaaauggaggcacuucagagacaguacgggggagcacuggugaggaacccguugagucggaauagcacgcacgagauguacuggguuucuaacgccaccggcaauaucguguccucagucaacaugauuagccgcaugcugauaaauagauucacaaugaagcacaaaaaggcuacuuaugaaccugacguggaucucggcucggggaccaggaacaucggaauugagucugaaaucccaaacuuagacauuaucgguaaacgaauagagaagaucaagcaagaacaugagauuaguuggcacuacgaccaggaucaucccuauaaaacaugggccuaccacggcuccuaugagacuaagcagaccgggagcgcaucauccauggucaauggagugguucggcugcuuacaaaaccuugggacguagugccaauggucacccagauggccaugacugauacgacacccuuuggccaacagcguguguucaaggaaaaaguugacaccagaacucaggagccgaaggaagguaccaagaaacugaugaagaucacagcugaguggcuauggaaagagcucgggaagaaaaagacgccucgcauguguaccagggaagaguuuacuaaaaaggugcggucuaacgcggcccugggagcaauuuucacagaugaaaauaaguggaaaagcgcuagagaggccgucgaagacggccgcuuuugggaguugguggauagggagcgaaaccugcaccucgaaggcaagugcgagaccuguguauacaauaugauggggaaacgggaaaagaaacuuggagaguucgguaaggcaaagggcaguagagccaucugguauauguggcugggggcuagguuuuuagaguucgaggcccugggauuuuugaacgaggaccauugguucucccgcggcaauagccucucugguguggaaggggagggacugcaccgucuaggcuacauucuucgggauguuggcaaaaaggaagggggagcgauguacgcagacgauacugccgguugggacacaagaauaacccuggaggaccucaaaaacgaagagauggucacaaaucauaugaagggcgagcacaaaaagcuggcugaagccaucuuuaaguugacuuaucagaacaaaguggugaggguccaacgccccaccccacgagggacgguuauggauauuaucucacggagagaccagaggggaaguggccagguggguaccuacgggcugaauacauucacuaacauggaggcacaacucauccgccagauggaaggagagggcauuuucaaguccauacagcaucuuaccgcuacagaggaaaucgccguacagaauuggcuggcuagagugggccgggagagguuaagccguauggccauuucuggggaugacugcgucgugaaaccuaucgaugaccgauuugcaucggcgcugacugccuugaacgauaugggaaagguucgcaaagacauucaacagugggaacccucaagagguuggaaugauuggacccaggugccauucugcagccaccacuuucaugagcucgucaugaaggacggccgggugcugguaguucccuguaggaaccaggaugaacuaaucgggcgcgcuagaauaucccaaggagccggcuggagucuuaaggagacggcaugccuggguaaaucuuaugcucagauguggacacucauguacuuccaccggagggaccugcgauuggccgcaaacgccaucuguagcgcggugccuucccauugggucccaaccucacguacuacauggaguauucacgcuaagcacgaguggaugaccacugaagauauguuagccguguggaauagaguguggauccaggagaacccguggauggaagacaaaacccccgucgagucuugggaagagguuccuuaucuggggaagcgcgaggaccaguggugcggaagccucauuggccuuacaucccgggcaacgugggccaaaaauauccaaaccgcuauaaaccaggugaggucacugauuggcaaugaagaguacacugauuauaugccaagcaugaagagauuucgccgggaagaggaagaggccgggguacuaugguga

SEQ ID NO: 14478 - RNA, 9876 nt, Artificial Sequence
  derived and/or modified CDS sequence (opt3) from DENV-2__EU569700__SS-prME
accgccggcgugauaguaaugcugauuccaacugcuauggcuuuccaccucacuacgagaaacggggaaccucauaugauaguuggaaggcaggaaaaggguaaaagccuucuguuuaagaccgaagacggcgugaauaugugcacauugauggccaucgauuuaggggaacugugugaagacacuauuaccuacaaaugcccacuacuccggcaaaacgaaccggaggauaucgacuguuggugcaauuccacaucuaccuggguaacuuauggaacauguaccacgacuggcgagcaccgccgagaaaagcguucaguggcgcuggucccccauguggguauggggcuugagaccagaacagaaacuuggaugaguagcgagggagcuuggaaacacguucagaggauugagaccuggauccugcggcauccuggcuucacaauaauggccgcaaucuuggccuacaccauuggcacgacucacuuucagcgcgcucucaucuucauucugcugacagcaguggccccauccaugaccaugagaugcaucgggauaucuaacagggauuuugucgaaggagugucggguggcucauggguagacauuguucucgagcacgggagcugugugacuacaauggcuaagaauaagcccaccuuagauuucgaacugaucaaaacggaggccaagcagccugcgacccuucggaaauauugcauugaagcaaaguugacaaacacuaccacagagagucgcuguccaacucaaggagagcccucccugaaugaagaacaggacaaacgauuuaucugcaagcauucuauggucgauagaggcugggguaacggguguggacuauucggcaagggcgggaucgugaccugcgccauguuuacaugcaaaaagaauauggaaggaaaagugguccagccugagaaccucgaauacaccauuguuauaacuccacacagcggugaggagcaugcugugggcaaugacacggggaagcacggaaaagaaaucaagauuacaccgcaguccucaaucaccgaggccgaacugacuggcuaugguaccguaacaauggaguguagucccaggaccgggcuugauuucaacgaaauggugcuguugcaaauggaggacaaagcauggcucguccaccggcagugguuucuggauuuaccucugccauggcuccccggcgcugacacucagggaagcaauuggauacagaaggagacacuugugacguucaagaacccucaugccaaaaagcaagacguugugguccugggcucucaggaaggggcgaugcacaccgccuugacuggagcaacagagauucagauguccucagguaaucuacuguuuaccggccaucucaaaugccgucugcgcauggauaaacuucaacugaaagggaugagcuacaguauguguacaggaaaguucaagaucgugaaagaaaucgcugagacucagcacggcaccauuguaaucagaguucaguaugagggugacgggucuccaugcaagauucccuucgaaauaacggauuuggagaaaaggcaugugcucggccggcugaucaccgucaacccgauugugacagaaaaggacuccccugucaacaucgaggccgaacccccauuuggagauagcuacaucauuauaggcguggagccugggcaguuaaaacugaauugguucaagaagggaucgucuaucggucaaauguuugagacuaccaugcgaggcgcuaaacgcauggccauucuaggggacacagcaugggauuucggaucccucggcgguguuuuuacuucaaucgggaaggcccugcaccagguguucggcgcuauuuacggagcggcauuuaguggcguaagcuggaccaugaaaauccuuauaggggucaucauuacguggaucggaaugaacuccagaucuacuagcuugucagugagucugguucucgugggcgucgugacccuguaucuuggugccguagugcaggcugacuccggguguguugucagcuggaagaauaaagaacugaagugcggaucuggcauuuucaucacugauaacgugcacacauggaccgagcaguacaaguuucaacccgaaucaccaaguaaauuggccagcgcaauacagaaggcccaugaggaagguauuuguggcaucagguccgugacucggcucgagaaucugauguggaaacagauuacccccgaguuaaaccacauccugucugaaaaugaggucaagcuaacaauaaugacgggggacaucaaaggaauuaugcaggcuggcaagcgcucgcucagaccucaaccaaccgaacugaaauauagcuggaagacuugggggaaggccaaaaugcuuuccacagagucacauaaccagaccuucuugaucgauggaccggaaacagcagagugccccaauacuaacagggcguggaauagucuggagguugaagacuacggcuuugguguguucaccacgaacauuuggcucaagcugcgugagaaacaggacguguuuugugauucuaaguuaaugagcgcugccaucaaagacaaucgggcaguacacgccgauaugggguauuggauagaauccgcucugaacgacacauggaagauggagaaggccucauucauugaggucaaaagcugccacuggccuaagucucauacccuuugguccaauggaguguuggaaagugagaugaucauccccaagaauuucgcaggccccguuagccagcacaacuaccgaccugguuaucauacucaaaccgcuggcccauggcaccucgggaagcuggaaauggauuuugacuucugugagggaacaacuguggucgugaccgaagauugcggcaauagagggcccucucuaaggacaacgaccgccuccggaaaacugauuacugaguggugcugucgcucaugcacacucccgccucugcgguacagaggcgaggacgguuguugguacgggauggaaaucaggccacuuaaggagaaggaagagaacuugguuaauagucuggugaccgcgggacauggccagauugauaacuuuagcuuagguguacucggcauggcccuguuccuugaagagaugcugcgcacucgaauagggacaaaacacgcuaucuugcucgucgcagugucguuugugacccugauuacgggaaauauguccuuccgggaccuaggccgugucaugguuauggugggggccacuaugaccgaugacaucggaaugggcguaacauaucuggcucuccuggccgcauuuaaggugagacccaccuucgcggccggucuuuugcugaggaaauuaacuucuaaggagcucaugauggcuacaauugggaucgcccugcuuagccagucaaccauaccugaaacaauccuggagcuaacugaugcacucgcucugggaaugauggucuugaaaauugugcgcaacauggaaaaguaccaacuggccguuaccaucauggcaauuaguugcgugcccaaugccgucaucuuacagaacgcuuggaagguguccuguacgauacucgcggccguuucugugagcccacugcuucugacauccucacagcagaaagcagacuggauuccuuuggcucucaccaucaagggccugaaucccacugccaucuuucuaaccacacugagccggacaaguaaaaagagaucuuggccacuuaacgaggccauuauggcugucggcaugguauccauacucgcaagcucgcuguugaaaaaugacaucccgaugaccgggccucugguggccggagguuuacucacgguuugcuaugugcugacaggcaggucagcggaucuugaacuggagcgagcugccgacgucaagugggaggaucaagcagaaauuucugggaguucccccaucuugagcauuaccaucucugaggacggaagcauguccaucaaaaacgaagaggaggaacagacucucacaauccugauucgcaccggccuacuggugaucucagguguauucccagugaguauucccaucacugccgcugcaugguaccuuugggaggucaagaagcagcgggccgggguucucugggaugugccuagcccacccccuguggaaaaagcggagcuggaagacggagcuuauagaauaaagcagaggggcauuuugggcuacucucaaaucggggccggagucuauaaagaggguacauuucacaccauguggcaugugacgcguggcgcaguuuuaaugcaccgcgggaagcggaucgagccguccugggccgaugucaaaaaggaccugauuucauacggaggcgguuggaagcucgaaggggaguggaaagaaggagaggaagugcagguccuggcucuugagccaggcaagaaucccagagccgugcagacuaaaccuggcaucuucaagaccaacacagggaccauaggagcaguuagucuggauuuuagcccagguacauccggcucucccauuguggacaggaaagggaaggucgugggauuguacggcaaugguguagucacucgaucgggggcuuaugugagcgccaucgcgcagaccgagaagucaauugaagauaacccugagaucgaagacgauauauuccggaaaaagcgccuaacgauuauggaccugcauccgggagccggcaaaacaaagagauaccuccccgcaaucguuagggaggcuaucaaacggggccugcgaacucuuauuuuagccccaaccagaguggucgcugcagaaauggaggaggcccugcgcgggcucccuaucagguaucaaacacccgccauuaagaccgaacacacuggacgugagauaguggacuugaugugucaugcuaccuucacaaugcggcugcucuccccaguuagagugccuaacuacaaucugaucauuauggaugaagcgcacuuuacggaccccgcaaguaucgccgcuagggguuauaucucuacucgcgucgagaugggcgaggccgcagggauuuucaugaccgccacaccaccgggaagccgagauccuuuuccccaguccaacgcuccaauaauggacgaagagagagaaauccccgagcggucauggaacucuggccacgaaugggugaccgauuucaaggguaaaacuguaugguuugugccuagcauuaaggcggggaacgacaucgccgcaugccuuaggaaaaauggaaagaaaguuauucagcugagucgcaagacauucgauuccgaguacgucaagacccgugcuaacgacugggauuuuguggugacgacugacaucagcgagaugggcgccaauuucaaagcagaaagagucauagauccacggagguguaugaagcccguaaucuugacagacggcgaggaacgcgugauucuagccgggccuaugccgguuacccauucuucagcugcccaacgaagaggacggaucgguaggaaccccaaaaaugagaacgaccaguauauuuacaugggcgaaccccuggagaaugaugaggacugcgcgcacuggaaggaagcaaaaaugcucuuagauaacaucaauaccccugaggggauaauucccuccauguuugaaccagagcgcgaaaagguggacgccaucgauggagaguacagacugaggggcgaggcucggaaaacuuucgucgaccuuaugcgucgcggugaucugccuguguggcucgccuauaagguugcugcagaagggauuaacuacgccgaccgaaagugguguuuugauggcaucaaaaauaaccagauauuggaggaaaacauggagguggagaucuggacaaaggaaggagagaggaaaaagcugaaacccagauggcucgacgcucggauuuauagugauccacuggcccuuaaggaguucaaggaguucgcagcgggccgcaaaagccuaacccugaauuugaucacagaaauggggagauuaccuacuuuuaugacgcagaaggccaggaacgcucuggacaaucucgccguccugcauaccgcagaggcuggaggucgggccuacaaccacgcacuuucggagcugccggaaacacucgagacuuugcugcuacugacccuccuugccacagugaccggcgggauuuuccuguuuuuaaugucuggaaaaggcaucgguaagaugacuuuggggaugugcugcauaauuacggcuuccauccugcucugguaugcgcaaauccagccccacuggauugccgcaagcaucauacuggaguucuuucuuauuguacugcucaucccagagccugaaaaacagcgaaccccacaggauaaucaauugacauacgugguuauugcuauccugacugucguggccgccaccauggcaaacgagaugggcuucuuagagaagacaaagaaagaccuaggacugggcucaauaaccacucaggaaagugagucuaauauccucgacauugaucuuagaccagcuuccgccuggacacuguaugcgguggcuacgaccuuugucacuccuauguugcgccauagcaucgaaaacucaaguguuaaugugagccugacagccauugcaaaccaggccaccguacucauggggcugggaaaggguuggccccuuuccaaaauggacaucggcgugccgcuccuggcuauuggguguuacucucaggucaauccaaucaccuugacagcagcccuguuacuacugguggcgcacuacgcuauaauuggaccuggccuccaagccaaggcaacuagggaggcccagaaacgggcugccgcagguaucaugaagaaccccacgguugaugggaucaccgugauugaccuugaaccaauacccuaugauccuaaguucgagaaacagcugggccaggucauguugcugauccucugcguaacacaagugcugaugaugcguacuaccugggcucuuugugaggccuuaacacuggcgaccggaccgauuagcacucucugggaaggcaaucccgggagauuuuggaacacgacaaucgccguuuccauggcaaauauuuucaggggaucauacuuggcuggcgccggucugcuauuuucuaucaugaagaacaccacaaguacccgccgggggacaggaaauauaggcgagacucugggugaaaaauggaagucgcgacucaacgcacuuggcaaaagcgaguuccagaucuauaagaaauccgggauucaggagguggacagaacccuggcuaaggaaggaaucaagaggggcgagacagaucaucacgccgucucucgcgggucagccaaauugcggugguuuguggaaagaaacauggucacgccagagggaaaggugguugaccugggcugcggucgugggggauggagcuacuauuguggcggucucaaaaaugugagggaaguaaagggccugaccaaagggggaccuggccaugaggagcccauuccuauguccacuuacggguggaacuuagugcggcuucaaaguggagucgauguuuucuucacaccacccgaaaagugcgacacccugcucugugauaucggcgagucuagcccuaauccaacuauagaagcgggucgcacacuacgagugcugaacuuggucgagaauuggcugaacaauaacacccaguuuugcauuaaggugcucaaucccuauaugccgucaguaaucgagaaaauggaggcacuucagagacaguacgggggagcacuggugaggaacccuuugucccggaauaguacgcacgagauguacuggguuagcaacgccaccggcaauaucgugucuuccgucaacaugauuucacgcaugcugauaaauagauucacaaugaagcacaaaaaggcuacuuaugaaccagacguggaucucggcagcgggaccaggaacaucggaauugagucggaaauccccaacuuagacauuaucgguaaacgaauagagaagaucaagcaagaacaugagauuucuuggcacuacgaccaggaucauccuuauaaaacaugggccuaccacggcaguuaugagacuaagcagaccggguccgcaagcucaauggucaauggagugguucggcugcuuacaaaaccaugggacguagugcccauggucacccagauggccaugacugauacgacaccguuuggccaacagcguguguucaaggaaaaaguugacaccagaacucaggagccuaaggaagguaccaagaaacugaugaagaucacagcugaguggcuauggaaagagcucgggaagaaaaagacgccccgcauguguaccagggaagaguuuacuaaaaaggugcgguccaacgcggcccugggagcaauuuucacagaugaaaauaaguggaaaucugcuagagaggccgucgaagacggccgcuuuugggaguugguggauagggagcgaaaccugcaccucgaaggcaagugcgagaccuguguauacaauaugauggggaaacgggaaaagaaacuuggagaguucgguaaggcaaagggcagcagagccaucugguauauguggcugggggcuagguuuuuagaguucgaggcccugggauuuuugaacgaggaccauugguucagucgcggcaauucccucagcgguguggaaggggagggacugcaccgucuaggcuacauucuucgggauguuggcaaaaaggaagggggagcgauguacgcagacgauacugccgguugggacacaagaauaacccuggaggaccucaaaaacgaagagauggucacaaaucauaugaagggcgagcacaaaaagcuggcugaagccaucuuuaaguugacuuaucagaacaaaguggugaggguccaacgcccaaccccucgagggacgguuauggauauuaucucucggagagaccagaggggaucaggccagguggguaccuacgggcugaauacauucacuaacauggaggcacaacucauccgccagauggaaggagagggcauuuucaagaguauacagcaucuuaccgcuacagaggaaaucgccguacagaauuggcuggcuagagugggccgggagagguuaucccguauggccauuagcggggaugacugcgucgugaaacccaucgaugaccgauuugcaucugcgcugacugccuugaacgauaugggaaagguucgcaaagacauucaacagugggaaccaucgagagguuggaaugauuggacccaggugcccuucugcucacaccacuuucaugagcucgucaugaaggacggccgggugcugguaguuccuuguaggaaccaggaugaacuaaucgggcgcgcuagaauaagccaaggagccggcuggucccuuaaggagacggcaugccuggguaaaaguuaugcucagauguggacacucauguacuuccaccggagggaccugcgauuggccgcaaacgccaucuguucugcggugccaagccauugggucccgaccucccguacuacauggucaauucacgcuaagcacgaguggaugaccacugaagauauguuagccguguggaauagaguguggauccaggagaaccccuggauggaagacaaaaccccugucgagaguugggaagagguuccauaucuggggaagcgcgaggaccaguggugcggaucucucauuggccuuacaagccgggcaacgugggccaaaaauauccaaaccgcuauaaaccaggugaggucccugauuggcaaugaagaguacacugauuauaugcccucaaugaagagauuucgccgggaagaggaagaggccgggguacuaugguga

SEQ ID NO: 14479 - RNA, 9876 nt, Artificial Sequence
  derived and/or modified CDS sequence (opt3) from DENV-2__KF955369__SS-prME
accgccggcgugaucgucaugcugauucccacagcuauggcauuccaccucacuacgagaaacggggagccucauaugauaguuggaaggcaggaaaaggguaaaagccuucuguuuaagaccgaggacggcgugaauaugugcacauugauggccaucgauuuaggggaacugugugaggacacuauuaccuacaaaugcccacuacuccggcaaaacgaaccggaggauaucgacuguuggugcaauuccacaucuaccuggguaacuuauggaacauguaccacgacuggcgagcaccgccgagaaaagcguucaguggcgcuggucccccauguggguauggggcuugagaccagaacagaaacuuggaugaguagcgagggagcuuggaaacacguucagaggauugagaccuggauccugcggcauccuggcuucacaauaauggccgcaaucuuggccuacaccauuggcacgacucacuuucagcgcgcucucaucuucauucugcugacaaccguggcaccauccaugacuaugagaugcaucgggauaucuaacagggauuuugucgaaggagugucggguggcucauggguagacauuguucucgagcacgggagcugugugacaaccauggccaagaauaagcccacguuagauuucgaacugaucaaaaccgaggcuaagcagccugccacacuucggaaauauugcauugaagcgaaguugacuaacaccacaacugagagucgcuguccaacccaaggagagcccucccugaaugaagagcaggacaaacgauuuaucugcaagcauucuauggucgauagaggcugggguaacggguguggacuauucggcaagggcgggaucgugacaugcgcaauguuuaccugcaaaaagaauauggaaggaaaagugguccagccugagaaccucgaauacacuauuguuauaacgccacacagcggugaggagcaugccgugggcaaugacacagggaagcacggaaaagaaaucaagauuaccccgcaguccucaaucacugaggcugaacugaccggcuaugguacaguaaccauggaguguagucccaggacugggcuugauuucaacgaaauggugcuguugcaaauggaggacaaagccuggcucguccaccggcagugguuucuggauuuaccucugccauggcuccccggcgcagacacacagggaagcaauuggauacagaaggagacgcuugugaccuucaagaacccucaugcuaaaaagcaagacguugugguccugggcucucaggaaggggccaugcacacugcguugacaggagccaccgagauucagauguccucagguaaucuacuguuuacaggccaucucaaaugccgucugcgcauggauaagcuucaacugaaagggaugagcuacaguauguguacuggaaaguucaagaucgugaaagaaaucgcagagacccagcacggcacgauuguaaucagaguucaguaugagggugacgggucuccaugcaagauucccuucgaaauaaccgauuuggagaaaaggcaugugcucggccggcugaucacagucaacccgauugugacugaaaaggacuccccugucaacaucgaggcugaacccccauuuggagauagcuacaucauuauaggcguggagccugggcaguuaaaacugaauugguucaagaagggaucgucuaucggucaaauguuugagaccacaaugcgaggcgccaaacgcauggcuauucuaggggacacugccugggauuucggaucccucggcgguguuuuuaccucaaucgggaaggcacugcaccagguguucggcgccauuuacggagcugcguuuaguggcguaagcuggacgaugaaaauccuuauaggggucaucauuacauggaucggaaugaacuccagaucuaccagcuugucagugagucugguucucgugggcgucgugacucuguaucuuggugcaguagugcaggccgacuccggguguguugucagcuggaagaauaaagaacugaagugcggaucuggcauuuucaucacagauaacgugcacaccuggacugagcaguacaaguuucaacccgaaucaccaaguaaauuggcuagcgccauacagaaggcacaugaggaagguauuuguggcaucagguccgugacccggcucgagaaucugauguggaaacagauuacacccgaguuaaaccacauccugucugaaaaugaggucaagcuaacgauaaugaccggggacaucaaaggaauuaugcaggccggcaagcgcucgcucagaccucaaccaacugaacugaaauauagcuggaagacaugggggaaggcuaaaaugcuuuccaccgagucacauaaccagacauucuugaucgauggaccggaaacugccgagugccccaauaccaacagggcauggaauagucuggagguugaagacuacggcuuugguguguucacgacaaacauuuggcucaagcugcgugagaaacaggacguguuuugugauucuaaguuaaugagcgcggcuaucaaagacaaucgggccguacacgcagauaugggguauuggauagaauccgcccugaacgacaccuggaagauggagaaggcuucauucauugaggucaaaagcugccacuggccuaagucucauacucuuugguccaauggaguguuggaaagugagaugaucaucccaaaaaacuucgccggccccguuagccagcacaacuaccgaccugguuaucauacccaaacagcaggcccauggcaccucgggaagcuggaaauggauuuugacuucugugagggaacuaccguggucgugacagaagauugcggcaauagagggcccucucuaaggacgaccacugcuuccggaaaacugauuacagaguggugcugucgcucaugcacccucccgccucugcgguacagaggcgaggacgguuguugguacgggauggaaaucaggccacuuaaggagaaggaagagaacuugguuaauagucuggugacugccggacauggccagauugauaacuuuagcuuagguguacucggcauggcgcuguuccuugaagagaugcugcgcacacgaauagggaccaaacacgccaucuugcucgucgcugugucguuugugacgcugauuacuggaaauauguccuuccgggaccuaggccgugucaugguuauggugggggcaaccaugacagaugacaucggaaugggcguaaccuaucuggcccuccuggcugccuuuaaggugagacccacuuucgcagcgggucuuuugcugaggaaauuaacaucuaaggagcucaugauggccaccauugggaucgcucugcuuagccagucaacaauaccugaaacuauccuggagcuaaccgaugcccucgcacugggaaugauggucuugaaaauugugcgcaacauggaaaaguaccaacuggcuguuacgaucauggccauuaguugcgugcccaaugcagucaucuuacagaacgccuggaagguguccuguacaauacucgcugcgguuucugugagcccacugcuucugaccuccucacagcagaaagccgacuggauuccuuuggcacucacuaucaagggccugaaucccaccgcuaucuuucuaacaacucugagccggaccaguaaaaagagaucuuggccacuuaacgaggccauuauggccgucggcaugguauccauacucgcuagcucgcuguugaaaaaugacaucccgaugacggggccucugguggcaggagguuuacucacaguuugcuaugugcugaccggcaggucagccgaucuugaacuggagcgagcggcugacgucaagugggaggaucaagccgaaauuucugggaguucccccaucuugagcauuacuaucucugaggacggaagcauguccauaaaaaacgaagaggaggaacagacacucaccauccugauucgcacuggccuacuggugaucucagguguauucccagugaguauucccaucacagcagccgcuugguaccuuugggaggucaagaagcagcgggcagggguucucugggaugugccuagcccacccccuguggaaaaagccgagcuggaagacggagcguauagaauaaagcagaggggcauuuugggcuacucucaaaucggggcuggagucuauaaagaggguaccuuucacacgauguggcaugugacucguggcgccguuuuaaugcaccgcgggaagcggaucgagccguccugggcagauguaaaaaaggaccugauuucauacggaggcgguuggaagcucgaaggggaguggaaagaaggagaggaagugcagguccuggcccuugagccaggcaagaaucccagagcugugcagaccaaaccuggcaucuucaagacaaacaccgggacaauaggagccguuagucuggauuuuagcccagguacuuccggcucucccauuguggacaggaaagggaaggucgugggauuguacggcaaugguguagucacccgaucgggggcauaugugagcgcuaucgcccagacggagaagucaauugaagauaacccugagaucgaagacgauauauuccggaaaaagcgccuaacaauuauggaccugcauccgggagcgggcaaaacuaagagauaccuccccgccaucguuagggaggcaaucaaacggggccugcgaacccuuauuuuagcuccaacaagaguggucgccgcugaaauggaggaggcacugcgcgggcucccuaucagguaucaaacccccgccauuaagacugaacacaccggacgugagauaguggacuugaugugucaugccacauucacgaugcggcugcucuccccaguuagagugccuaacuacaaucugaucauuauggaugaagcucacuuuacugaccccgcgaguaucgcagccagggguuauaucucuacccgcgucgagaugggcgaggcugccgggauuuucaugacagcaaccccaccgggaagccgagauccuuuuccccaguccaacgccccaauaauggacgaagagagagaaauccccgagcggucauggaauucuggccacgaaugggugacugauuucaaggguaaaacaguaugguuugugccuagcauuaaggcugggaacgacaucgcggccugccuuaggaaaaauggaaagaaaguuauucagcugagucgcaagaccuucgauuccgaguacgucaagacgcgugcaaacgacugggauuuuguggugacuacagacaucagcgagaugggcgcuaauuucaaagccgaaagagucauagauccacggagguguaugaagcccguaaucuugaccgacggcgaggaacgcgugauucuagcagggccuaugccgguuacccauucuucagccgcucaacgaagaggacggaucgguaggaacccaaaaaaugagaacgaccaguauauuuacaugggcgaaccccuggagaaugaugaggacugcgcccacuggaaggaagcgaaaaugcucuuagauaacaucaauacuccugaggggauaauucccuccauguuugaaccagagcgcgaaaagguggacgcaaucgauggagaguacagacugaggggcgaggcccggaaaacauucgucgaccuuaugcgucgcggugaucugccuguguggcucgcuuauaagguugccgcugaagggauuaacuacgcagaccgaaagugguguuuugauggcaucaaaaauaaccagauauuggaggaaaacauggagguggagaucuggaccaaggaaggagagagaaaaaagcugaaacccagguggcucgacgcccggauuuauagugauccacuggcucuuaaggaauucaaggaguucgccgcaggccgcaaaagccuaacacugaauuugaucacugaaauggggagauuaccuacguuuaugacccagaaggcgaggaacgcccuggacaaucucgcuguccugcauacagccgaggcaggaggucgggcuuacaaccacgcccuuucggagcugccggaaacucucgagaccuugcugcuacugacacuccuugcaaccgugacuggcgggauuuuccuguuuuuaaugucuggaaaaggcaucgguaagaugacguuggggaugugcugcauaauuaccgccuccauccugcucugguaugcucaaauccagccccacuggauugcggccagcaucauacuggaauucuuucuuauuguacugcucaucccagagccugaaaaacagcgaacaccccaggauaaucaauugacuuacgugguuauugcaauccugaccgucguggcugccacaauggccaacgagaugggcuucuuagagaagaccaagaaagaccuaggacugggcucaauaacuacacaggaaagugagucuaauauccucgacauugaucuuagaccagcauccgcuuggacgcuguaugccguggcgaccacuuuugucacaccuauguugcgccauagcaucgaaaacucaaguguuaaugugagccugaccgcuauugccaaccaggcaaccguacucauggggcugggaaaggguuggccccuuuccaaaauggacaucggcgugccgcuccuggccauuggguguuacucucaggucaauccaaucacauugacugcugcacuguuacuacugguggcccacuacgcgauaauuggaccuggccuccaagcuaaggccacgagggaggcacagaaacgggccgcugccgguaucaugaagaaccccaccguugaugggaucacagugauugaccuugaaccaauacccuaugauccuaaguucgagaaacagcugggccaggucauguugcugauccucugcguaacucaagugcugaugaugcguaccacaugggcacuuugugaggcuuuaacccuggccacuggaccgauuagcacgcucugggaaggcaaucccgggagauuuuggaacacaaccaucgcgguuuccauggccaauauuuucaggggaucauacuuggcaggcgcuggucugcuauuuucuaucaugaagaacacuaccaguacacgccgggggacuggaaauauaggcgagacccugggugaaaaauggaagucgcgacucaacgcccuuggcaaaagcgaguuccagaucuauaagaaauccgggauucaggagguggacagaacacuggcaaaggaaggaaucaagaggggcgagacggaucaucacgcugucucucgcgggucagccaaauugcggugguuuguggaaagaaacauggucaccccagagggaaaggugguugaccugggcugcggucgugggggauggagcuacuauuguggcggucucaaaaaugugagggaaguaaagggccugacuaaagggggaccuggccaugaggagcccauuccuauguccacauacggguggaacuuagugcggcuucaaaguggagucgauguuuucuucaccccacccgaaaagugcgacacucugcucugugauaucggcgagucuagcccuaauccaacaauagaagccggucgcacccuacgagugcugaacuuggucgagaauuggcugaacaauaacacgcaguuuugcauuaaggugcucaaucccuauaugccgucaguaaucgaaaaaauggaggcgcuucagagacaguacgggggagcucuggugaggaacccuuugucccggaauaguacccacgagauguacuggguuagcaacgcaacaggcaauaucgugucuuccgucaacaugauuucacgcaugcugauaaauagauucacuaugaagcacaaaaaggccaccuaugaaccagacguggaucucggcagcgggacaaggaacaucggaauugagucggaaauccccaacuuagacauuaucgguaaacgaauagagaagaucaagcaagaacaugagauuucuuggcacuacgaccaggaucauccuuauaaaacuugggcuuaccacggcaguuaugagaccaagcagacaggguccgccagcucaauggucaauggagugguucggcugcuuaccaaaccaugggacguagugcccauggucacucagauggcaaugacggauacaaccccguuuggccaacagcguguguucaaggaaaaaguugacacuagaacccaggagccuaaggaagguacaaagaaacugaugaagaucacggccgaguggcuauggaaagagcucgggaagaaaaagaccccccgcauguguacuagggaagaguuuacaaaaaaggugcgguccaacgcugcgcugggagccauuuucaccgaugaaaauaaguggaaaucugcaagagaggcugucgaagacggccgcuuuugggaguugguggauagggagcgaaaccugcaccucgaaggcaagugcgagacuuguguauacaauaugauggggaaacgggaaaagaaacuuggagaguucgguaaggccaagggcagcagagcaaucugguauauguggcugggggccagguuuuuagaauucgaggcucugggauuuuugaacgaggaccauugguucagucgcggcaauucccucagcgguguggaaggggagggacugcaccgucuaggcuacauucuucgggauguuggcaaaaaggaagggggagccauguacgcggacgauacagcagguugggacaccagaauaacacuggaggaccucaaaaacgaagagauggucacuaaucauaugaagggcgagcacaaaaagcuggccgaagcuaucuuuaaguugaccuaucagaacaaaguggugaggguccaacgcccaacgccucgagggaccguuauggauauuaucucucggagagaccagaggggaucaggccagguggguacauacgggcugaauacuuucaccaacauggaggcccaacucauccgccagauggaaggagagggcauuuucaagaguauacagcaucuuacagcaacugaggaaaucgcuguacagaauuggcuggccagagugggccgggagagguuaucccguauggcuauuagcggggaugacugcgucgugaaacccaucgaugaccgauuugccucugcacugaccgcguugaacgauaugggaaagguucgcaaagacauucaacagugggaaccaucgagagguuggaaugauuggacgcaggugcccuucugcucacaccacuuucaugagcucgucaugaaggacggccgggugcugguaguuccuuguaggaaccaggaugaacuaaucgggcgcgccagaauaagccaaggagcuggcuggucccuuaaggagacagccugccuggguaaaaguuaugcacagauguggacccucauguacuuccaccggagggaccugcgauuggcugccaacgcaaucuguucugccgugccaagccauugggucccgacuucccguacaaccuggucaauucacgcgaagcacgaguggaugacuaccgaagauauguuagcuguguggaauagaguguggauccaggagaaccccuggauggaagacaaaacaccugucgagaguugggaagagguuccauaucuggggaagcgcgaggaccaguggugcggaucucucauuggccuuacgagccgggccaccugggcaaaaaauauccaaacugccauaaaccaggugaggucccugauuggcaaugaagaguacacagauuauaugcccucaaugaagagauuucgccgggaagaggaagaggcugggguacuaugguga

SEQ ID NO: 14480 - RNA, 9876 nt, Artificial Sequence
  derived and/or modified CDS sequence (opt3) from DENV-2__EU569702__SS-prME
accgccggcgugaucgucaugcugauucccacagcuauggcauuccaccucacuacgagaaacggggagccucauaugauaguuggaaggcaggaaaaggguaaaagccuucuguuuaagaccgaggacggcgugaauaugugcacauugauggccaucgauuuaggggaacugugugaggacacuauuaccuacaaaugcccacuacuccggcaaaacgaaccggaggauaucgacuguuggugcaauuccacaucuaccuggguaacuuauggaacauguaccacgacuggcgagcaccgccgagaaaagcguucaguggcgcuggucccccauguggguauggggcuugagaccagaacagaaacuuggaugaguagcgagggagcuuggaaacacguucagaggauugagaccuggauccugcggcauccuggcuucacaauaauggccgcaaucuuggccuacaccauuggcacgacucacuuucagcgcgcucucaucuucauucugcugacagcaguggccccauccaugaccaugagaugcaucgggauaucuaacagggauuuugucgaaggagugucggguggcucauggguagacauuguucucgagcacgggagcugugugacuacaauggcuaagaauaagcccaccuuagauuucgaacugaucaaaacggaggccaagcagccugcgacccuucggaaauauugcauugaagcaaaguugacaaacacuaccacagagagucgcuguccaacucaaggagagcccucccugaaugaagagcaggacaaacgauuuaucugcaagcauucuauggucgauagaggcugggguaacggguguggacuauucggcaagggcgggaucgugaccugcgccauguuuacaugcaaaaagaauauggaaggaaaagugguccagccugagaaccucgaauacaccauuguuauaacuccacacagcggugaggagcaugcugugggcaaugacacggggaagcacggaaaagaaaucaagauuacaccgcaguccucaaucaccgaggccgaacugacuggcuaugguaccguaacaauggaguguagucccaggaccgggcuugauuucaacgaaauggugcuguugcaaauggaggacaaagcauggcucguccaccggcagugguuucuggauuuaccucugccauggcuccccggcgcugacacucagggaagcaauuggauacagaaggagacacuugugacguucaagaacccucaugccaaaaagcaagacguugugguccugggcucucaggaaggggcgaugcacaccgccuugacuggagcaacagagauucagauguccucagguaaucuacuguuuaccggccaucucaaaugccgucugcgcauggauaagcuucaacugaaagggaugagcuacaguauguguacaggaaaguucaagaucgugaaagaaaucgcugagacucagcacggcaccauuguaaucagaguucaguaugagggugacgggucuccaugcaagauucccuucgaaauaacggauuuggagaaaaggcaugugcucggccggcugaucaccgucaacccgauugugacagaaaaggacuccccugucaacaucgaggccgaacccccauuuggagauagcuacaucauuauaggcguggagccugggcaguuaaaacugaauugguucaagaagggaucgucuaucggucaaauguuugagacuaccaugcgaggcgcuaaacgcauggccauucuaggggacacagcaugggauuucggaucccucggcgguguuuuuacuucaaucgggaaggcccugcaccagguguucggcgcuauuuacggagcggcauuuaguggcguaagcuggaccaugaaaauccuuauaggggucaucauuacguggaucggaaugaacuccagaucuacaagcuugucagugagucugguucucgugggcgucgugacccuguaucuuggugccguagugcaggcugacuccggguguguugucagcuggaagaauaaagaacugaagugcggaucuggcauuuucaucacugauaacgugcacacauggaccgagcaguacaaguuucaacccgaaucaccaaguaaauuggccagcgcaauacagaaggcccaugaggaagguauuuguggcaucagguccgugacucggcucgagaaucugauguggaaacagauuacccccgaguuaaaccacauccugucugaaaaugaggucaagcuaacaauaaugacgggggacaucaaaggaauuaugcaggcuggcaagcgcucgcucagaccucaaccaaccgaacugaaauauagcuggaagacuugggggaaggccaaaaugcuuuccacagagucacauaaccagaccuucuugaucgauggaccggaaacagcagagugccccaauacuaacagggcguggaauagucuggagguugaagacuacggcuuugguguguucaccacgaacauuuggcucaagcugcgugagaaacaggacguguuuugugauucuaaguuaaugagcgcugccaucaaagacaaucgggcaguacacgccgauaugggguauuggauagaauccgcucugaacgacacauggaagauggagcgagccucauucauugaggucaagagcugccacuggccuaaaucucauacccuuugguccaauggaguguuggaaagugagaugaucaucccaaagaacuucgcaggccccguuagccagcacaacuacagaccugguuaucauacucaaaccgcuggcccauggcaccucgggaaacuggaaauggauuuugacuucugugagggaacaacuguggucgugaccgaagauugcggcaauagggggcccucucuacgcacaacgaccgccuccggaaagcugauuacugaguggugcugucggucaugcacacucccgccucugagauacaggggcgaggacgguuguugguacgggauggaaauccgcccacuuaaagagaaggaagagaacuugguuaauagucuggugaccgcgggacauggccagauugauaacuuuagcuuagguguacucggcauggcccuguuccuugaagagaugcugcgaacucggauagggacaaagcacgcuaucuugcucgucgcagugucguuugugacccugauuacgggaaauauguccuuccgugaccuaggcagagucaugguuauggugggggccacuaugaccgaugacaucggaaugggcguaacauaucuggcucuccuggccgcauuuaaagugaggcccaccuucgcggccggucuuuugcugcgcaaguuaacuucuaaagagcucaugauggcuacaauugggaucgcccugcuuagccagucaaccauaccugaaacaauccuggagcuaacugaugcacucgcucugggaaugauggucuugaagauugugcggaacauggaaaaauaccaacuggccguuaccaucauggcaauuaguugcgugcccaaugccgucaucuuacagaacgcuuggaagguguccuguacgauacucgcggccguuucugugagcccacugcuucugacauccucacagcagaaggcagacuggauuccuuuggcucucaccaucaaaggccugaaucccacugccaucuuucuaaccacacugagcagaacuaguaagaaaaggucuuggccacuuaacgaggccauuauggcugucggcaugguauccauacucgcaagcucgcuguugaagaaugacaucccgaugaccgggccucugguggccggagguuuacucacgguuugcuaugugcugacaggccgaucagcggaucuugaacuggagcgcgcugccgacgucaaaugggaggaucaagcagaaauuucugggaguucccccaucuugagcauuaccaucucugaggacggaagcauguccauaaagaacgaagaggaggaacagacucucacaauccugauucggaccggccuacuggugaucucagguguauucccagugaguauucccaucacugccgcugcaugguaccuuugggaggucaaaaagcagagagccgggguucucugggaugugccuagcccacccccuguggaaaaggcggagcuggaagacggagcuuauaggauaaaacagcguggcauuuugggcuacucucaaaucggggccggagucuauaaggaggguacauuucacaccauguggcaugugacgcgcggcgcaguuuuaaugcaccgggggaaaagaaucgagccguccugggccgauguaaagaaagaccugauuucauacggaggcgguuggaagcucgaaggggaguggaaggaaggagaggaagugcagguccuggcucuugagccaggcaaaaaucccagggccgugcagacuaagccuggcaucuucaaaaccaacacagggaccauaggagcaguuagucuggauuuuagcccagguacauccggcucucccauuguggaccgaaaggggaaagucgugggauuguacggcaaugguguagucacucggucgggggcuuaugugagcgccaucgcgcagaccgagaagucaauugaagauaacccugagaucgaagacgauauauuccgcaagaaaagacuaacgauuauggaccugcauccgggagccggcaagacaaaaagguaccuccccgcaaucguucgggaggcuaucaagcgaggccugagaacucuuauuuuagccccaacccgcguggucgcugcagaaauggaggaggcccugagggggcucccuauccguuaucaaacacccgccauuaaaaccgaacacacuggacgggagauaguggacuugaugugucaugcuaccuucacaaugagacugcucuccccaguuagggugccuaacuacaaucugaucauuauggaugaagcgcacuuuacggaccccgcaaguaucgccgcucgcgguuauaucucuacucgagucgagaugggcgaggccgcagggauuuucaugaccgccacaccaccgggaagcagagauccuuuuccccaguccaacgcuccaauaauggacgaagagcgggaaauccccgagaggucauggaauucuggccacgaaugggugaccgauuucaaggguaagacuguaugguuugugccuagcauuaaagcggggaacgacaucgccgcaugccuucgcaagaauggaaaaaagguuauucagcugagucguaaaacauucgauuccgaguacgucaagaccagagcuaacgacugggauuuuguggugacgacugacaucagcgagaugggcgccaauuucaaggcagaacgggucauagauccaaggcgcuguaugaaacccguaaucuugacagacucugaggaacgagugauucuagccggcccuaugccgguuacccauucauccgcugcccaaagacgggggaggaucggacgcaacccaaagaaugagaacgaccaguauauuuacaugggugaaccccuggagaaugaugaggacugcgcgcacuggaaagaagcaaagaugcucuuagauaacaucaauaccccugagggcauaauucccaguauguuugaaccagagagagaaaaaguggacgccaucgauggggaguacaggcugcggggagaggcucguaagacuuucgucgaccuuaugcgccgaggcgaucugccuguguggcucgccuauaaaguugcugcagaagguauuaacuacgccgacagaaagugguguuuugaugggaucaagaauaaccagauauuggaggaaaacauggagguggagaucuggacaaaagaaggcgagaggaagaaacugaagccccgguggcucgacgcucgcauuuauagcgauccacuggcccuuaaagaauucaaggaguucgcagcgggaagaaagucgcuaacccugaauuugaucacagaaaugggcagguuaccuacuuuuaugacgcagaaagcccggaacgcucuggacaaucucgccguccugcauaccgcagaggcugggggacgagccuacaaccacgcacuuucugagcugccggaaacacucgagacuuugcugcuacugacccuccuugccacagugaccgguggcauuuuccuguuuuuaauguccgggaagggaaucggcaaaaugacuuuggguaugugcugcauaauuacggcuagcauccugcucugguaugcgcaaauccagccccacuggauugccgcaucaaucauacuggaauucuuucuuauuguacugcucaucccagagccugaaaagcagagaaccccccaggauaaucaauugacauacgugguuauugcuauccugacugucguggccgccaccauggcaaacgagaugggguucuuagagaaaacaaagaaggaccuaggccugggaaguauaaccacucaggaaucugaguccaauauccucgacauugaucuucgcccagcuagcgccuggacacuguaugcgguggcuacgaccuuugucacuccuauguugaggcauucaaucgaaaacaguagcguuaaugugucccugacagccauugcaaaccaggccaccguacucaugggccuggggaaaggauggccccuuucuaagauggacaucggugugccgcuccuggcuauuggcuguuacagccaggucaauccaaucaccuugacagcagcccuguuacuacugguggcgcacuacgcuauaauugggccuggacuccaagccaaagcaacucgggaggcccagaagcgugcugccgcaggcaucaugaaaaaccccacgguugaugguaucaccgugauugaccuugaaccaauacccuaugauccuaaguucgagaagcagcuggggcaggucauguugcugauccucugcguaacacaagugcugaugaugagaacuaccugggcucuuugugaggccuuaacacuggcgaccggcccgauuuccacucucugggaaggaaaucccggcagguuuuggaacacgacaaucgccguuucaauggcaaauauuuuccgcgggucuuacuuggcuggagccggccugcuauuuaguaucaugaaaaacaccacuucgacccggcgagguacagggaauauaggagagacucugggcgaaaaguggaaaagcagacucaacgcacuugguaaguccgaguuccagaucuauaaaaagucuggcauucaggagguggacaggacccuggcuaaagaagggaucaagcgcggagagacagaucaucacgccgucucacggggcagcgccaaguugagaugguuuguggaacguaacauggucacgccagaggggaaagugguugaccugggaugcggcaggggugggugguccuacuauuguggaggccucaagaaugugcgggaaguaaaaggucugaccaagggcgggccuggacaugaggagcccauuccuaugaguacuuacggcuggaacuuagugcgccuucaaucuggggucgauguuuucuucacaccacccgaaaaaugcgacacccugcucugugauaucggagagagcucaccuaauccaacuauagaagcgggccgaacacuaagagugcugaacuuggucgagaauuggcugaacaauaacacccaguuuugcauuaaggugcucaaucccuauaugccguccguaaucgaaaagauggaggcucuucagaggcaguacgguggggcacuggugcggaacccuuugagucgcaauagcacgcacgagauguacuggguuucuaacgccaccggaaauaucguguccucagucaacaugauuagcagaaugcugauaaauagguucacaaugaaacacaagaaagcuacuuaugaaccagacguggaucucggcucgggcacccgaaacaucgggauugagucugaaauccccaacuuagacauuaucggaaagcggauagagaaaaucaagcaagaacaugagauuaguuggcacuacgaccaggaucauccuuauaagacaugggccuaccacgguuccuaugagacuaaacagaccggcagcgcaucauccauggucaauggggugguucgucugcuuacaaagccaugggacguagugcccauggucacccagauggccaugacugauacgacaccguuuggacaacagagaguguucaaagaaaagguugacacccgcacucaggagccuaaagaaggcaccaagaagcugaugaaaaucacagcugaguggcuauggaaggagcucgguaaaaagaaaacgcccaggauguguacccgggaagaguuuacuaagaaagugagaucuaacgcggcccugggggcaauuuucacagaugaaaauaaguggaagagcgcucgcgaggccgucgaagacggaagguuuugggaguugguggaucgagagcggaaccugcaccucgaaggcaaaugcgagaccuguguauacaauaugaugggcaagagagaaaaaaagcuuggggaguucggaaaagcaaaggguaguagggccaucugguauauguggcugggcgcucgcuuuuuagaauucgaggcccugggguuuuugaacgaggaccauugguucucccguggaaauagccucucuggcguggaaggugaggggcugcaccggcuaggauacauucuuagagauguuggcaagaaagaaggcggggcgauguacgcagacgauacugccggaugggacacaaggauaacccuggaggaccucaagaacgaagagauggucacaaaucauaugaaaggugagcacaagaaacuggcugaagccaucuuuaaguugacuuaucagaacaagguggugcgcguccaacgaccaaccccucggggcacgguuauggauauuaucucaagaagggaccagcgcgggaguggacaggugggcaccuacggucugaauacauucacuaacauggaggcacaacucaucagacagauggaaggggagggaauuuucaaauccauacagcaucuuaccgcuacagaggaaaucgccguacagaauuggcuggcucgggugggcagggagcguuuaagccgaauggccauuucuggcgaugacugcgucgugaagcccaucgaugaccgcuuugcaucggcgcugacugccuugaacgauauggggaaaguuagaaaggacauucaacagugggaaccaucacggggauggaaugauuggacccaggugcccuucugcagccaccacuuucaugagcucgucaugaaagacgguagggugcugguaguuccuugucgcaaccaggaugaacuaaucggcagagcucggauaucccaaggggccggauggagucuuaaggagacggcaugccugggcaagucuuaugcucagauguggacacucauguacuuccacaggcgagaccugcguuuggccgcaaacgccaucuguagcgcggugccaucccauugggucccgaccucaagaacuacauggaguauucacgcuaaacacgaguggaugaccacugaagauauguuagccguguggaaucgcguguggauccaggagaaccccuggauggaagacaagaccccugucgagucuugggaagagguuccauaucuggguaaacgggaggaccaguggugcgggagccucauuggacuuacauccagggcaacgugggccaagaauauccaaaccgcuauaaaccaggugagaucacugauuggcaaugaagaguacacugauuauaugcccagcaugaaacgcuuucggagggaagaggaagaggccggcguacuaugguga

SEQ ID NO: 14481 - RNA, 9876 nt, Artificial Sequence
  derived and/or modified CDS sequence (opt3) from DENV-2__EU482624__SS-prME
accgccggcgugaucguaaugcugauuccaacagcuauggcuuuccaccucacuacgagaaacggggaaccucauaugauaguuggaagacaggaaaaggguaaaagccuucuguuuaagaccgaagacggcgugaauaugugcacauugauggccaucgauuuaggggaacugugugaagacacuauuaccuacaaaugcccacuacuccggcaaaacgaaccggaggauaucgacuguuggugcaauuccacaucuaccuggguaacuuauggaacauguaccacgacuggcgagcaccgccgagaaaagcguucaguggcgcuggucccacauguggguauggggcuugagaccagaacagaaacuuggaugaguagcgagggagcuuggaaacacguucagaggauugagaccuggauccugcggcauccuggcuucacaauaauggccgcaaucuuggccaacaccauuggcacgacucacuuucagcgcgcucucaucuucauucugcugacagcaguggccccauccaugaccaugagaugcaucgggauaucuaauagggauuuugucgaaggagugucggguggcucauggguagacauuguucucgagcacgggagcugugugacuacaauggcuaagaacaagcccaccuuagauuucgaacugaucaaaacggaggccaagcagccugcgacccuucggaaauacugcauugaagcaaaguugacaaauacuaccacagagagucgcuguccaacucaaggagagcccucccugaacgaagaacaggacaaacgauuuaucugcaagcauucuauggucgauagaggcugggguaauggguguggacuauucggcaagggcgggaucgugaccugcgccauguuuacaugcaaaaagaacauggaaggaaaagugguccagccugagaaucucgaauauaccauuguuauaacuccacacagcggugaggagcaugcugugggcaacgacacggggaagcacggaaaagaaaucaagauuacaccgcaguccucaaucaccgaggccgaacugacuggcuacgguaccguaacaauggaguguagucccaggaccgggcuugauuucaaugaaauggugcuguugcaaauggaggacaaagcauggcucguccaccggcagugguuucuggauuuaccucugccauggcuccccggcgcugacauacagggaagcaacuggauucagaaggagacucuugugacauucaagaauccucaugccaaaaagcaagacguugugguccugggcucucaggaaggggcgaugcacacggccuugaccggagcaacugagauccagauguccucagguaaccuacuguuuacaggccaucucaaaugccgucugcgcauggauaaacuucaacugaaagggaugagcuauaguauguguaccggaaaguucaagaucgugaaagaaauugcugagacacagcacggcacuaucguaauuagaguucaguacgagggugacgggucuccaugcaagauacccuucgaaaucaccgauuuggagaaaaggcaugugcucggccggcugauuacggucaacccgaucgugaccgaaaaggacuccccugucaauaucgaggccgaacccccauuuggagauagcuauauuauaaucggcguggagccugggcaguuaaaacugaacugguucaagaagggaucgucuauuggucaaauguuugagacaacuaugcgaggcgcuaaacgcauggccauccuaggggacaccgcaugggauuucggaucccucggcgguguuuuuacaucaauugggaaggcccugcaccagguguucggcgcuaucuacggagcggcauuuaguggcguaagcuggacuaugaaaauacuuaucggggucauuaucaccuggauuggaaugaacuccagaucuacgagcuugucagugagucugguucucgugggcgucgugacacuguaccuuggugccguagugcaggcugacuccggguguguugucagcuggaagaacaaagaacugaagugcggaucuggcaucuucauaaccgauaaugugcacacuuggacagagcaguauaaguuucaacccgaaucaccaaguaaauuggccagcgcaauucagaaggcccaugaggaagguaucuguggcauuagguccgugacccggcucgagaaccugauguggaaacagaucacucccgaguuaaaucacauacugucugaaaacgaggucaagcuaaccaucaugacaggggacauuaaaggaaucaugcaggcuggcaagcgcucgcucagaccucaaccaacggaacugaaauacagcuggaagaccugggggaaggccaaaaugcuuuccacugagucacauaaucagacauucuugauugauggaccggaaaccgcagagugccccaacacaaauagggcguggaacagucuggagguugaagacuauggcuuugguguguucacuaccaauaucuggcucaagcugcgugagaaacaggacguguuuugugauucuaaguuaaugagcgcugccauaaaagacaaccgggcaguacacgccgauaugggguacuggauugaauccgcucugaaugacacguggaagauggagaaggccucauucaucgaggucaaaagcugccacuggccuaagucucauacacuuugguccaacggaguguuggaaagugagaugaucauucccaagaauuucgcaggccccguuagccagcacaauuaucgaccugguuaccauacccaaacugcuggcccauggcaccucgggaagcuggaaauggauuuugacuucugugagggaaccacaguggucgugacugaagauugcggcaacagagggcccucucuaaggaccacaacggccuccggaaaacugaucaccgaguggugcugucgcucaugcacucucccgccucugcgguauagaggcgaggacgguuguugguacgggauggaaauuaggccacuuaaggagaaggaagagaauuugguuaacagucuggugacagcgggacauggccagauagauaauuuuagcuuagguguacucggcauggcccuguuccuugaagagaugcugcgcacccgaaucgggacuaaacacgcuauuuugcucgucgcagugucguuugugacacugaucaccggaaacauguccuuccgggaccuaggccgugucaugguuauggugggggccacgaugacugaugacauuggaaugggcguaaccuaccuggcucuccuggccgcauuuaaggugagacccacauucgcggccggucuuuugcugaggaaauuaaccucuaaggagcucaugauggcuacuaucgggauagcccugcuuagccagucaacaaucccugaaaccauucuggagcuaacagaugcacucgcucugggaaugauggucuugaaaaucgugcgcaauauggaaaaguaucaacuggccguuacuauuauggcaaucaguugcgugcccaacgccgucauauuacagaaugcuuggaagguguccuguaccauucucgcggccguuucugugagcccacugcuucugacguccucacagcagaaagcagacuggaucccuuuggcucucacaaucaagggccugaaccccaccgccauuuuucuaacuacccugagccggacaaguaaaaagagaucuuggccacuuaaugaggccauaauggcugucggcaugguauccauccucgcaagcucgcuguugaaaaacgacauuccgaugacugggccucugguggccggagguuuacucaccguuugcuacgugcugacgggcaggucagcggaucuugaacuggagcgagcugccgacgucaagugggaggaucaagcagaaaucucugggaguucccccauuuugagcaucacaauaucugaggacggaagcauguccaucaaaaaugaagaggaggaacagacccucacuauucugauccgcacaggccuacuggugauuucagguguauucccagugaguauccccauaaccgccgcugcaugguaucuuugggaggucaagaagcagcgggccgggguucucugggaugugccuagcccacccccuguggaaaaagcggagcuggaagacggagcuuacagaauuaagcagaggggcaucuugggcuauucucaaaucggggccggagucuacaaagaggguacuuuucacacaauguggcaugugacccguggcgcaguuuuaaugcaccgcgggaagcggauugagccguccugggccgaugucaaaaaggaccugaucucauauggaggcgguuggaagcucgaaggggaguggaaagaaggagaggaagugcagguccuggcucuugagccaggcaagaaccccagagccgugcagacgaaaccuggcauauucaagacuaauaccgggacaauuggagcaguuagucuggauuuuagcccagguaccuccggcucucccaucguggacaggaaagggaaggucgugggauuguacggcaacgguguagucacacgaucgggggcuuacgugagcgccauugcgcagacugagaagucaaucgaagauaacccugagauagaagacgauauuuuccggaaaaagcgccuaaccaucauggaccugcauccgggagccggcaaaacgaagagauaucuccccgcaaucguuagggaggcuauuaaacggggccugcgaacacuuaucuuagccccaacuagaguggucgcugcagaaauggaggaggcccugcgcgggcucccuauuagguaccaaacccccgccauaaagacagaacacaccggacgugagaucguggacuugaugugucaugcuacuuucaccaugcggcugcucuccccaguuagagugccuaauuauaaccugauuaucauggaugaagcgcacuuuacagaccccgcaaguaucgccgcuagggguuacauuucuacgcgcgucgagaugggcgaggccgcagggauauucaugacugccaccccaccgggaagccgagauccuuuuccccaguccaaugcuccaaucauggacgaagagagagaaauucccgagcggucauggaacucuggccacgaaugggugacagauuucaaggguaaaaccguaugguuugugccuagcaucaaggcggggaaugacauugccgcaugccuuaggaaaaacggaaagaaaguuauccagcugagucgcaagacuuucgauuccgaguaugucaagacacgugcuaaugacugggauuuuguggugaccacggacauaagcgagaugggcgccaacuucaaagcagaaagagucaucgauccacggagguguaugaagcccguaauuuugacugacggcgaggaacgcgugauccuagccgggccuaugccgguuacacauucuucagcugcccaacgaagaggacggauugguaggaaucccaaaaacgagaaugaccaguacaucuauaugggcgaaccccuggagaacgaugaggacugcgcgcacuggaaggaagcaaaaaugcucuuagauaauauaaacaccccugaggggauuauccccuccauguuugaaccagagcgcgaaaagguggacgccauugauggagaguacagacugaggggcgaggcucggaaaaccuucgucgaccuuaugcgucgcggugaucugccuguguggcucgccuacaagguugcugcagaagggaucaauuaugccgaccgaaagugguguuuugauggcaucaaaaacaaccagauauuggaggaaaauauggagguggagauuuggacuaaggaaggagagaggaaaaagcugaaacccagguggcucgacgcucggaucuacagugauccacuggcccuuaaggaguucaaggaguucgcagcgggccgcaaaagccuaacacugaacuugauuaccgaaauggggagauuaccuacauuuaugacucagaaggccaggaaugcucuggacaaccucgccguccugcauacggcagaggcuggaggucgggccuauaaucacgcacuuucggagcugccggaaacccucgagacauugcugcuacugacucuccuugccaccgugacaggcgggaucuuccuguuuuuaaugucuggaaaaggcauagguaagaugaccuuggggaugugcugcauuaucacugcuuccauccugcucugguacgcgcaaauucagccccacuggaucgccgcaagcauaauucuggaguucuuucuuaucguacugcucauuccagagccugaaaaacagcgaacgccccaggauaaccaauugaccuaugugguuaucgcuauacugacagucguggccgccacuauggcaaaugagaugggcuucuuagagaagaccaagaaagaccuaggacugggcucaaucacaacccaggaaagugagucuaacauucucgacaucgaucuuagaccagcuuccgccuggacucuguacgcgguggcuacaacguuugucaccccuauguugcgccauagcauugaaaauucaaguguuaacgugagccugacugccaucgcaaaucaggccacaguacucauggggcugggaaaggguuggccccuuuccaaaauggacauuggcgugccgcuccuggcuaucggguguuauucucaggucaacccaauaaccuugaccgcagcccuguuacuacugguggcgcacuacgcuauuaucggaccuggccuccaagccaaggcaacaagggaggcccagaaacgggcugccgcagguaucaugaagaaucccacuguugaugggauuacggugauagaccuugaaccaauccccuacgauccuaaguucgagaaacagcugggccaggucauguugcugauucucugcguaacccaagugcugaugaugcguacaacuugggcucuuugugaggccuuaacccuggcgacaggaccgaucagcacccucugggaaggcaaccccgggagauuuuggaauacuacgauugccguuuccauggcaaacaucuucaggggaucauauuuggcuggcgccggucugcuauuuucuauaaugaagaauacaaccaguacucgccgggggaccggaaacaucggcgagacacugggugaaaaauggaagucgcgacucaacgcacuuggcaaaagcgaguuccagauuuacaagaaauccgggauccaggagguggacagaacucuggcuaaggaaggaauuaagaggggcgagaccgaucaucacgccgucucucgcgggucagccaaauugcggugguuuguggaaagaaauauggucacaccagagggaaaggugguugaccugggcugcggucgugggggauggagcuauuacuguggcggucucaaaaacgugagggaaguaaagggccugacgaaagggggaccuggccaugaggagcccaucccuauguccaccuauggguggaauuuagugcggcuucaaaguggagucgauguuuucuucacuccacccgaaaagugcgacacacugcucugugauauaggcgagucuagcccuaacccaaccauugaagcgggucgcacucuacgagugcugaauuuggucgagaacuggcugaauaacaauacacaguuuugcaucaaggugcucaaccccuacaugccgucaguaaucgagaaaauggaggcacuucagagacaguaugggggagcacuggugaggaauccuuugucccggaacaguacccacgagauguacuggguuagcaaugccacgggcaacauugugucuuccgucaauaugauaucacgcaugcugaucaacagauucaccaugaagcacaaaaaggcuacauacgaaccagacguggaucucggcagcgggacuaggaacauuggaaucgagucggaaauucccaauuuagacaucauagguaaacgaaucgagaagauuaagcaagaacaugagaucucuuggcacuaugaccaggaucauccuuacaaaaccugggccuaucacggcaguuacgagacaaagcagacuggguccgcaagcucaauggucaacggagugguucggcugcuuaccaaaccaugggacguagugcccauggucacacagauggccaugaccgauacuacgccguuuggccaacagcguguguucaaggaaaaaguugacacaagaacccaggagccuaaggaagguacuaagaaacugaugaagauuaccgcugaguggcuauggaaagagcucgggaagaaaaagacaccccgcauguguacgagggaagaguuuaccaaaaaggugcgguccaaugcggcccugggagcaaucuucacugaugaaaacaaguggaaaucugcuagagaggccgucgaagacggccgcuuuugggaguugguggauagggagcgaaaucugcaccucgaaggcaagugcgagacauguguauauaacaugauggggaaacgggaaaagaaacuuggagaguucgguaaggcaaagggcagcagagccauuugguacauguggcugggggcuagguuuuuagaguucgaggcccugggauuuuugaaugaggaccauugguucagucgcggcaacucccucagcgguguggaaggggagggacugcaccgucuaggcuauauacuucgggauguuggcaaaaaggaagggggagcgauguacgcagacgauaccgccgguugggacacuagaaucacacuggaggaccucaaaaaugaagagauggucaccaaccauaugaagggcgagcacaaaaagcuggcugaagccauuuuuaaguugacauaccagaauaaaguggugaggguccaacgcccaacuccucgagggaccguuauggauaucaucucucggagagaccagaggggaucaggccagguggguacguaugggcugaacaccuucacaaauauggaggcacaacucauucgccagauggaaggagagggcauauucaagaguauccagcaucuuacugcuaccgaggaaauugccguacagaacuggcuggcuagagugggccgggagagguuaucccguauggccaucagcggggaugacugcgucgugaaacccauugaugaccgauuugcaucugcgcugacagccuugaaugauaugggaaagguucgcaaagacauccaacagugggaaccaucgagagguuggaacgauuggacucaggugcccuucugcucacaccacuuucaugagcucgucaugaaggacggccgggugcugguaguuccuuguaggaaccaggaugaacuaauagggcgcgcuagaaucagccaaggagccggcuggucccuuaaggagaccgcaugccuggguaaaaguuacgcucagauguggacgcucauguauuuccaccggagggaccugcgauuggccgcaaaugccauuuguucugcggugccaagccauugggucccgacaucccguaccacuuggucaauccacgcuaagcacgaguggaugacaaccgaagauauguuagccguguggaacagaguguggauucaggagaaucccuggauggaagacaaaacuccugucgagaguugggaagagguuccauaccuggggaagcgcgaggaccaguggugcggaucucucaucggccuuaccagccgggcaacaugggccaaaaacauacaaacggcuauuaaucaggugaggucccugaucggcaacgaagaguauaccgauuacaugcccucaaugaagagauuucgccgggaagaggaagaggccgggguacuaugguga

SEQ ID NO: 14482 - RNA, 9876 nt, Artificial Sequence
  derived and/or modified CDS sequence (opt3) from DENV-2__EU596500__SS-prME
accgccggcgugaucgucaugcugauuccaacugcuauggcauuccaccucacuacgagaaacggggaaccucauaugauaguuggaaggcaggaaaaggguaaaagccuucuguuuaagaccgaagacggcgugaauaugugcacauugauggccaucgauuuaggggaacugugugaagacacuauuaccuacaaaugcccgcuacuccggcaaaacgaaccggaggauaucgacuguuggugcaauuccacaucuaccuggguaacuuauggaacauguaccacgacuggcgagcaccgccgagaaaagcguucaguggcgcuggucccccauguggguauggggcuugagaccagaacagaaacuuggaugaguagcgagggagcuuggaaacacguucagaggauugagaccuggauccugcggcauccuggcuucacaauaauggccgcaaucuuggccuacaccauuggcacgacucacuuucagcgcgcucucaucuucauucugcugacagcaguggccccauccaugaccaugagaugcaucgggauaucuaacagggauuuugucgaaggagugucggguggcucauggguagacauuguucucgagcacgggagcugugugacuacaauggcuaagaauaagcccaccuuagauuucgaacugaucaaaacggaggccaagcagccugcgacccuucggaaauauugcauugaagcaaaguugacaaacacuaccacagagagucgcuguccaacucaaggagagcccucccugaaugaagaacaggacaaacgauuuaucugcaagcauucuauggucgauagaggcugggguaacggguguggacuauucggcaagggcgggaucgugaccugcgccauguuuacaugcaaaaagaauauggaaggaaaagugguccagccugagaaccucgaauacaccauuguuauaacuccacacagcggugaggagcaugcugugggcaaugacacggggaagcacggaaaagaaaucaagauuacaccgcaguccucaaucaccgaggccgaacugacuggcuaugguaccguaacaauggaguguagucccaggaccgggcuugauuucaacgaaauggugcuguugcaaauggaggacaaagcauggcucguccaccggcagugguuucuggauuuaccucugccauggcuccccggcgcugacacucagggaagcaauuggauacagaaggagacacuugugacguucaagaacccucaugccaaaaagcaagacguugugguccugggcucucaggaaggggcgaugcacaccgccuugacuggagcaacagagauucagauguccucagguaaucuacuguuuaccggccaucucaaaugccgucugcgcauggauaaacuucaacugaaagggaugagcuacaguauguguacaggaaaguucaagaucgugaaagaaaucgcugagacucagcacggcaccauuguaaucagaguucaguaugagggugacgggucuccaugcaagauucccuucgaaauaacggauuuggagaaaaggcaugugcucggccggcugaucaccgucaacccgauugugacagaaaaggacuccccugucaacaucgaggccgaacccccauuuggagauagcuacaucauuauaggcguggagccugggcaguuaaaacugaauugguucaagaagggaucgucuaucggucaaauguuugagacuaccaugcgaggcgcuaaacgcauggccauucuaggggacacagcaugggauuucggaucccucggcgguguuuuuacuucaaucgggaaggcccugcaccagguguucggcgcuauuuacggagcggcauuuaguggcguaagcuggaccaugaaaauccuuauaggggucaucauuacguggaucggaaugaacuccagaucuacuagcuugucagugagucugguucucgugggcgucgugacccuguaucuuggugccguagugcaggcugacuccggguguguugucagcuggaagaauaaagaacugaagugcggaucuggcauuuucaucacugauaacgugcacacauggaccgagcaguacaaguuucaacccgaaucaccaaguaaauuggccagcgcaauacagaaggcccaugaggaagguauuuguggcaucagguccgugacucggcucgagaaucugauguggaaacagauuacccccgaguuaaaccacauccugucugaaaaugaggucaagcuaacaauaaugacgggggacaucaaaggaauuaugcaggcuggcaagcgcucgcucagaccucaaccaaccgaacugaaauauagcuggaagacuugggggaaggccaaaaugcuuuccacagagucacauaaccagaccuucuugaucgauggaccggaaacagcagagugccccaauacuaacagggcguggaauagucuggagguugaagacuacggcuuugguguguucaccacgaacauuuggcucaagcugcgugagaaacaggacguguuuugugauucuaaguuaaugagcgcugccaucaaagacaaucgggcaguacacgccgauaugggguauuggauagaauccgcucugaacgacacauggaagauggagaaggccucauucauugaggucaaaagcugccacuggccuaagucucauacccuuugguccaauggaguguuggaaagugagaugguuauccccaagaauuucgcaggccccgugagccagcacaacuaccgaccugguuaucauacucaaaccgcuggcccauggcaccucgggaagcuggaaauggauuuugacuucugugagggaacaacugucgugguuaccgaagauugcggcaauagagggcccucucuaaggacaacgaccgccuccggaaaacugaucacugaguggugcugucgcucaugcacacucccgccucugcgguacagaggcgaggacgguuguugguacgggauggaaauuaggccacuuaaggagaaggaagagaacuuggugaauagucugguaaccgcgggacauggccagaucgauaacuuuagcuuagguguccucggcauggcccuguuccuugaagagaugcugcgcacucgaauugggacaaaacacgcuauauugcucguggcagugucguuugucacccugaucacgggaaauauguccuuccgggaccuaggccguguuauggugaugguaggggccacuaugaccgaugacauuggaaugggcgugacauaucuggcucuccuggccgcauuuaaggucagacccaccuucgcggccggucuuuugcugaggaaauuaacuucuaaggagcucaugauggcuacaaucgggauugcccugcuuagccagucaaccaucccugaaacaauacuggagcuaacugaugcacucgcucugggaaugaugguguugaaaaucguucgcaacauggaaaaguaccaacuggccgugaccauuauggcaaucaguugcguccccaaugccgugauuuuacagaacgcuuggaagguuuccuguacgauccucgcggccgugucugucagcccacugcuucugacauccucacagcagaaagcagacuggauaccuuuggcucucaccauuaagggccugaaucccacugccaucuuucuaaccacacugagccggacaaguaaaaagagaucuuggccacuuaacgaggccaucauggcuguaggcaugguguccauucucgcaagcucgcuguugaaaaaugacauaccgaugaccgggccucugguugccggagguuuacucacggugugcuauguccugacaggcaggucagcggaucuugaacuggagcgagcugccgacgugaagugggaggaucaagcagaaaucucugggaguucccccauuuugagcaucaccauuucugaggacggaagcauguccaucaaaaacgaagaggaggaacagacucucacaauacugauccgcaccggccuacugguaauuucagguguguucccagucaguauccccauuacugccgcugcaugguaccuuugggagguuaagaagcagcgggccggggugcucugggaugugccuagcccacccccugucgaaaaagcggagcuggaagacggagcuuauagaaucaagcagaggggcauauugggcuacucucaaauuggggccggaguguauaaagaggguacauuucacaccauguggcauguuacgcguggcgcaguauuaaugcaccgcgggaagcggaucgagccguccugggccgaugugaaaaaggaccugaucucauacggaggcgguuggaagcucgaaggggaguggaaagaaggagaggaaguccaggugcuggcucuugagccaggcaagaaucccagagccguucagacuaaaccuggcauuuucaagaccaacacagggaccaucggagcagugagucuggauuuuagcccagguacauccggcucucccauagucgacaggaaagggaaggugguaggauuguacggcaauggugucgugacucgaucgggggcuuauguuagcgccauugcgcagaccgagaagucaaucgaagauaacccugagauugaagacgauaucuuccggaaaaagcgccuaacgauaauggaccugcauccgggagccggcaaaacaaagagauaccuccccgcaauugugagggaggcuaucaaacggggccugcgaacucuuaucuuagccccaaccagagucguggcugcagaaauggaggaggcccugcgcgggcucccuauuagguaucaaacacccgccaucaagaccgaacacacuggacgugagauuguugacuugaugugucaugcuaccuucacaaugcggcugcucuccccagugagagucccuaacuacaaucugauaaucauggaugaagcgcacuuuacggaccccgcaaguauugccgcuagggguuauaucucuacucgcguggagaugggcgaggccgcagggaucuucaugaccgccacaccaccgggaagccgagauccuuuuccccaguccaacgcuccaauuauggacgaagagagagaaauacccgagcggucauggaacucuggccacgaauggguaaccgauuucaaggguaaaacugugugguuuguuccuagcaucaaggcggggaacgacauugccgcaugccuuaggaaaaauggaaagaaagucauccagcugagucgcaagacauucgauuccgaguacgugaagacccgugcuaacgacugggauuuuguggucacgacugacauuagcgagaugggcgccaauuucaaagcagaaagaguaaucgauccacggagguguaugaagcccgugauauugacagacggcgaggaacgcguuauccuagccgggccuaugccggugacccauucuucagcugcccaacgaagaggacggauugguaggaaccccaaaaaugagaacgaccaguauaucuacaugggcgaaccccuggagaaugaugaggacugcgcgcacuggaaggaagcaaaaaugcucuuagauaacauuaauaccccugaggggaucauacccuccauguuugaaccagagcgcgaaaaggucgacgccauugauggagaguacagacugaggggcgaggcucggaaaacuuucguggaccuuaugcgucgcggugaucugccuguuuggcucgccuauaagguggcugcagaagggaucaacuacgccgaccgaaagugguguuuugauggcauuaaaaauaaccagaucuuggaggaaaacauggaggucgagauauggacaaaggaaggagagaggaaaaagcugaaacccagauggcucgacgcucggaucuauagugauccacuggcccuuaaggaguucaaggaguucgcagcgggccgcaaaagccuaacccugaauuugauuacagaaauggggagauuaccuacuuuuaugacgcagaaggccaggaacgcucuggacaaucucgccgugcugcauaccgcagaggcuggaggucgggccuacaaccacgcacuuucggagcugccggaaacacucgagacuuugcugcuacugacccuccuugccacaguaaccggcgggaucuuccuguuuuuaaugucuggaaaauccauuggcaagaugacuuuggguaugugcugcaucauaacggcuagcauucugcucuggcacgcgcaaauccagccccauuggaucgccgcaucaauuauccuggaguucuuucuuauagugcugcucauuccagagccugaaaaacagcgaaccccacaggauaaucaauugacauauguugucaucgcuauucugacugugguggccgccaccauggcaaacgagaugggguucuuagagaagacaaagaaagaccuaggccugggaaguaucaccacucaggaaucugaguccaauauacucgacaucgaucuuagaccagcuagcgccuggacacuguacgcggucgcuacgaccuuuguuacuccuauguugcgccacucaauugaaaacaguagcgugaauguaucccugacagccaucgcaaaccaggccaccgugcucaugggccuggggaagggauggccccuuucuaaaauggacauuggugucccacucuucgcuaucggcuguuauuaccaggugaauccaauuacccugacagcagccuugcugcuauuaguugcgcauaacgcuaucauagggcaaggacugcaggccaaggcaacuagggaggcccagaaacgggcugccgcaggcauuaugaagaauccuacgguggaugguaucaccgucaucgaccucgaacccauuccauacgaucccaaguuugagaaacagcuugggcaaguaaugcuguugauacugugcgugacacagguucucaugaugcguacuaccugggcucugugugaggcccuuacauuagcgaccggcccuaucagcacucugugggaaggaaacccgggcagauucuggaauacgacaauugccguguccauggcaaacaucuuuagggggucauaucucgcuggagccggcuugcuguucucuauuaugaagaauaccacaaguacccgccgggguacagggaacaucggagagacucuaggcgaaaaauggaagucgcgacugaacgcacucgguaaaagcgaguuucagauauacaagaaauccggcauccaagaggucgacagaacccuugcuaaggaagggauuaagaggggagagacagaucaccaugccgugucucgcggcucagccaaacugcggugguucgucgaaagaaauauggugacgcccgaggggaagguuguggacuugggaugcggccgugguggguggagcuauuacuguggaggccugaaaaacguaagggaagugaagggucucaccaaaggcgggccaggacacgaggagccuauccccauguccacuuauggcuggaaucugguccgguuacagagugggguugauguguucuuuacaccuccagaaaagugcgacacccuucugugugauauuggagagucuagccccaacccuacuaucgaagcgggccgcacacuccgaguccuaaaucugguggagaacugguugaauaacaauacccaguucugcauaaagguacugaacccauacaugcccucagugauugagaaaauggaggcucuccagagacaauaugguggggcacuuguuaggaauccgcugucccggaacaguacgcacgagauguacugggugagcaaugccaccggaaacaucgucucuuccgugaauaugaucucacgcauguugauuaacagauuuacaaugaagcauaaaaaggcuacuuacgaaccugacgucgaucugggcagcggcaccaggaacauagggaucgagaaugaaauuccaaaccucgacaucauuggaaaacgaaucgagaagauaaagcaggaacacgagaucucguggcauuaugaccaggaucaccccuacaaaacaugggccuaucacgguucuuacgagacuaagcagaccggcagugcauccagcauggugaaugggguuguacgguuacugacaaaaccuugggacguggucccaauggugacccaaauggccaugacugauacgacacccuucggacagcagcguguuuuuaaggaaaaaguggacaccagaacucaggagccgaaggaaggcaccaagaaacuuaugaagauuacagcugaguggcuguggaaagagcuagguaagaaaaagacgccucgcauguguaccagggaagaguucacucggaaagucagaucaaacgcggcccucggggcaaucuuuacagaugaaaauaaguggaaguccgcucgcgaggccguggaagacggaagguucugggagcugguagaucgagagcggaacuugcaucuggaaggcaaaugcgagaccuguguguauaauaugaugggcaagagagagaaaaagcucggggaguuuggaaaagcaaaggguucuagggccauuugguacauguggcuuggcgcucgcuuccuggaauuugaggccuuaggguuccugaacgaggaccacugguuuagccguggaaauaguuuguccggcguugaaggugaggggcuccaucggcugggauauauccuaagagaugucggcaagaaagaaggcggggcgauguacgcagacgauacugccggaugggacacaaggauuacccuugaggaccugaagaacgaagagauggugacaaaucacaugaaaggugagcauaagaaacucgcugaagccauauucaagcugacuuaccaaaacaaggugguccgcguucagcgacccaccccacggggcacggugauggauaucauuagcagaagggaccagcgcgggucuggacaaguaggcaccuaugguuugaauacauucacuaacauggaggcacagcugaucagacagauggaaggggagggaaucuuuaaaucaauucagcaccucaccgcuacagaggaaauagccgugcaaaauuggcuugcucgggucggcagggagcgucugagucgaauggccaucuccggcgaugacugcgugguuaagccuauugaugaccgcuucgcaagcgcguuaacugcccugaacgauauggggaaagugagaaaggacauccagcagugggaacccucucggggauggaacgauuggacccaggucccauuuugcucgcaccauuuccacgaguuggugaugaaagacgguaggguacucguugugcccugucgcaaucaagaugaacugauuggcagagcucggaucucacagggggccggauggagccuaaaggagacggcaugccuuggcaaguccuacgcucagauguggacacugauguauuuucauaggcgagaccuccgucuggccgcaaacgccauauguagugcggucccuucucacugggugccaaccagcagaacuacaugguccauccacgcuaaacaugaguggaugaccacugaagauauguuggccguguggaaucgcgucuggauucaggagaacccguggauggaagacaagacccccguugagucaugggaagaggugccuuacuuagguaaacgggaggaccaauggugcgggagucugaucggacucacaucuagggcaacgugggccaagaauauucagaccgcuaucaaccagguaagaagccuuauaggcaaugaagaguauacugauuacaugccauccaugaaacgcuuccggagggaagaggaagaggccggcgugcugugguga

SEQ ID NO: 14483 - RNA, 9876 nt, Artificial Sequence
  derived and/or modified CDS sequence (opt3) from DENV-2__EU482626__SS-prME
accgccggcgugaucgucaugcugauucccacagcuauggcauuccaccucacuacgagaaacggggagccucauaugauaguuggaaggcaggaaaaggguaaaagccuucuguuuaagaccgaggacggcgugaauaugugcacauugauggccaucgauuuaggggaacugugugaggacacuauuaccuacaaaugcccacuacuccggcaaaacgaaccggaggauaucgacuguuggugcaauuccacaucuaccuggguaacuuauggaacauguaccacgacuggcgagcaccgccgagaaaagcguucaguggcgcuggucccccauguggguauggggcuugagaccagaacagaaacuuggaugaguagcgagggagcuuggaaacacguucagaggauugagaccuggauccugcggcauccuggcuucacaauaauggccgcaaucuuggccuacaccauuggcacgacucacuuucagcgcgcucucaucuucauucugcugacagcaguggccccauccaugaccaugagaugcaucgggauaucuaacagggauuuugucgaaggagugucggguggcucauggguagacauuguucucgagcacgggagcugugugacuacaauggcuaagaauaagcccaccuuagauuucgaacugaucaaaacggaggccaagcagccugcgacccuucggaaauauugcauugaagcaaaguugacaaacacuaccacagagagucgcuguccaacucaaggagagcccucccugaaugaagagcaggacaaacgauuuaucugcaagcauucuauggucgauagaggcugggguaacggguguggacuauucggcaagggcgggaucgugaccugcgccauguuuacaugcaaaaagaauauggaaggaaaagugguccagccugagaaccucgaauacaccauuguuauaacuccacacagcggugaggagcaugcugugggcaaugacacggggaagcacggaaaagaaaucaagauuacaccgcaguccucaaucaccgaggccgaacugacuggcuaugguaccguaacaauggaguguagucccaggaccgggcuugauuucaacgaaauggugcuguugcaaauggaggacaaagcauggcucguccaccggcagugguuucuggauuuaccucugccauggcuccccggcgcugacauacagggaagcaauuggauucagaaggagacucuugugacauucaagaacccucaugccaaaaagcaagacguugugguccugggcucucaggaaggggcgaugcacacggccuugaccggagcaacugagauccagauguccucagguaaucuacuguuuacaggccaucucaaaugccgucugcgcauggauaagcuucaacugaaagggaugagcuacaguauguguaccggaaaguucaagaucgugaaagaaauugcugagacacagcacggcacuaucguaauuagaguucaguaugagggugacgggucuccaugcaagauacccuucgaaaucaccgauuuggagaaaaggcaugugcucggccggcugauuacggucaacccgaucgugaccgaaaaggacuccccugucaacaucgaggccgaacccccauuuggagauagcuacauuauaaucggcguggagccugggcaguuaaaacugaauugguucaagaagggaucgucuauuggucaaauguuugagacaacuaugcgaggcgcuaaacgcauggccauccuaggggacaccgcaugggauuucggaucccucggcgguguuuuuacaucaauugggaaggcccugcaccagguguucggcgcuaucuacggagcggcauuuaguggcguaagcuggacuaugaaaauacuuaucggggucauuaucaccuggauuggaaugaacuccagaucuacgagcuugucagugagucugguucucgugggcgucgugacacuguaucuuggugccguagugcaggcugacuccggguguguugucagcuggaagaauaaagaacugaagugcggaucuggcaucuucauaaccgauaacgugcacacuuggacagagcaguacaaguuucaacccgaaucaccaaguaaauuggccagcgcaauucagaaggcccaugaggaagguaucuguggcauuagguccgugacccggcucgagaaucugauguggaaacagaucacucccgaguuaaaccacauacugucugaaaaugaggucaagcuaaccaucaugacaggggacauuaaaggaaucaugcaggcuggcaagcgcucgcucagaccucaaccaacgcagcugaaauauagcuggaagaccugggggaaggccaaaaugcuuuccacugaaucacauaaccagacauucuugauugauggaccggagaccgcagaaugccccaauacaaacagggcguggaauagucuggagguugaggacuacggcuuugguguguucacuaccaacaucuggcucaagcugcgugaaaaacaggacguguuuugugauucuaaguuaaugagcgcugccauaaaagacaaucgggcaguacacgccgauaugggguauuggauugaguccgcucugaacgacacguggaagauggaaaaggccucauucaucgaggucaaaagcugccacuggccuaagucucauacacuuugguccaauggaguguuggagagugaaaugaucauuccaaaaaacuucgcaggccccguuagccaacacaacuaccgaccugguuaucauacccagacugcuggcccauggcaccucgggaagcuggagauggauuuugacuucugugaaggaaccacaguggucgugacugaggauugcggcaauagagggcccucucuaaggaccacaacggccuccggaaaacugaucaccgaauggugcugucgcucaugcacucucccgccucugcgguacagaggcgaggacgguuguugguacgggauggagauuaggccacuuaaggaaaaggaggaaaacuugguuaauagucuggugacagcgggacauggccagauagauaacuuuagcuuagguguacucggcauggcccuguuccuugaggaaaugcugcgcacccgaaucgggacuaaacacgcuauuuugcucgucgcagugucguuugugacacugaucaccggaaauauguccuuccgggaccuaggccgugucaugguuauggugggggccacgaugacugaugacauuggaaugggcguaaccuaucuggcucuccuggccgcauuuaaggugagacccacauucgcggccggucuuuugcugaggaaauuaaccucuaaggagcucaugauggcuacuaucgggauagcccugcuuagccaaucaacaaucccugagaccauucuggaacuaacagaugcacucgcucugggaaugauggucuugaaaaucgugcgcaacauggagaaguaccagcuggccguuacuauuauggcaaucaguugcgugcccaaugccgucauauuacagaacgcuuggaagguguccuguaccauucucgcggccguuucugugagcccacugcuucugacguccucacagcaaaaagcagacuggaucccuuuggcucucacaaucaagggccugaaucccaccgccauuuuucuaacuacccugagccggacaaguaaaaagagaucuuggccacuuaacgaagccauaauggcugucggcaugguauccauccucgcaagcucgcuguugaaaaaugacauuccgaugacugggccucugguggccggagguuuacucaccguuugcuaugugcugacgggcaggucagcggaucuugagcuggaacgagcugccgacgucaagugggaggaucaggcagagaucucugggaguucccccauuuugagcaucacaauaucugaagacggaagcauguccaucaaaaacgaggaagaggagcagacccucacuauucugauccgcacaggccuacuggugauuucagguguauucccagugaguauccccauaaccgccgcugcaugguaccuuugggaagucaagaagcagcgggccgggguucucugggaugugccuagcccacccccuguggagaaagcggaacuggaggacggagcuuauagaauuaagcaaaggggcaucuugggcuacucucagaucggggccggagucuauaaagaagguacuuuucacacaauguggcaugugacccguggcgcaguuuuaaugcaccgcgggaagcggauugagccguccugggccgauguaaaaaaggaccugaucucauacggaggcgguuggaagcucgagggggaauggaaagagggagaagaggugcagguccuggcucuugaaccaggcaagaaucccagagccgugcagacgaaaccuggcauauucaagacuaacaccgggacaauuggagcaguuagucuggauuuuagcccagguaccuccggcucucccaucguggacaggaaagggaaggucgugggauuguacggcaaugguguagucacacgaucgggggcuuaugugagcgccauugcgcaaacugagaagucaaucgaggauaacccugaaauagaggacgauauuuuccggaaaaagcgccuaaccaucauggaccugcauccgggagccggcaaaacgaagagauaccuccccgcaaucguuagggaagcuauuaaacggggccugcgaacacuuaucuuagccccaacuagaguggucgcugcagagauggaagaggcccugcgcgggcucccuauuagguaucagacccccgccauaaagacagagcacaccggacgugaaaucguggacuugaugugucaugcuacuuucaccaugcggcugcucuccccaguuagagugccuaacuacaaucugauuaucauggaugaggcgcacuuuacagaccccgcaaguaucgccgcuagggguuauauuucuacgcgcgucgaaaugggcgaggccgcagggauauucaugacugccaccccaccgggaagccgagauccuuuuccccaguccaacgcuccaaucauggacgaggaaagagagauucccgaacggucauggaauucuggccacgagugggugacagauuucaaggguaaaaccguaugguuugugccuagcaucaaggcggggaacgacauugccgcaugccuuaggaaaaauggaaagaaaguuauccaacugagucgcaagacuuucgauuccgaauacgucaagacacgugcuaacgacugggauuuuguggugaccacggacauaagcgagaugggcgccaauuucaaagcagagagagucaucgauccacggagguguaugaagcccguaauuuugacugacggcgaagagcgcgugauccuagccgggccuaugccgguuacacauucuucagcugcccagcgaagaggacggauugguaggaacccaaaaaaugaaaacgaccaguauaucuacaugggcgagccccuggaaaaugaugaggacugcgcgcacuggaaggaggcaaaaaugcucuuagauaacauaaauaccccugaagggauuauccccuccauguuugagccagaacgcgagaagguggacgccauugauggagaauacagacugaggggcgaggcucggaaaaccuucgucgaccuuaugcgucgcggugaucugccuguguggcucgccuauaagguugcugcagaggggaucaacuacgccgaccgaaagugguguuuugauggcauaaaaaauaaccagaucuuggaagagaacauggaaguggagauuuggacuaaggagggagaaagaaaaaagcugaaacccagguggcucgacgcucggaucuauagugauccacuggcccuuaaggaguucaaggaauucgcagcgggccgcaaaagccuaacacugaauuugauuaccgagauggggagauuaccuacauuuaugacucaaaaggccaggaacgcucuggacaaucucgccguccugcauacggcagaagcuggaggucgggccuacaaccacgcacuuucggagcugccggagacccucgaaacauugcugcuacugacucuccuugccaccgugacaggcgggaucuuccuguuuuuaaugucuggaaaaggcauagguaagaugaccuuggggaugugcugcauuaucacugcuuccauccugcucugguaugcgcagauucagccccacuggaucgccgcaagcauaauucuggaguucuuucuuaucguacugcucauuccagaaccugagaaacagcgaacgccccaagauaaucaguugaccuacgugguuaucgcuauacugacagucguggccgccacuauggcaaacgaaaugggcuucuuagagaagaccaagaaagaccuaggacugggcucaaucacaacccaggagagugaaucuaauauucucgacaucgaucuuagaccagcuuccgccuggacucuguaugcgguggcuacaacguuugucaccccuauguugcgccauagcauugagaacucaaguguuaaugugagccugacugccaucgcaaaccaggccacaguacucauggggcugggaaaggguuggccccuuuccaaaauggacauuggcgugccgcuccuggcuaucggguguuacucucaagucaauccaauaaccuugaccgcagcccuguuacuacugguggcgcacuacgcuauuaucggaccuggccuccaggccaaggcaacaagggaagcccagaaacgggcugccgcagguaucaugaagaaccccacuguugaugggauuacggugauagaccuugagccaauccccuaugauccuaaguucgaaaaacagcugggccaagucauguugcugauucucugcguaacccaggugcugaugaugcguacaacuugggcucuuugugaggccuuaacccuggcgacaggaccgaucagcacccucugggagggcaaucccgggagauuuuggaacacuacgauugccguuuccauggcaaauaucuucaggggaucauacuuggcuggcgccggucugcuauuuucuauaaugaagaacacaaccaguacucgccgggggaccggaaauaucggcgaaacacugggugagaaauggaagucgcgacucaacgcacuuggcaaaagcgaauuccagauuuauaagaaauccgggauccaagagguggacagaacucuggcuaaggagggaauuaagaggggcgaaaccgaucaucacgccgucucucgcgggucagccaaauugcggugguuuguggagagaaacauggucacaccagaaggaaaggugguugaccugggcugcggucgugggggauggagcuacuauuguggcggucucaaaaaugugagggagguaaagggccugacgaaagggggaccuggccaugaagagcccaucccuauguccaccuacggguggaacuuagugcggcuucagaguggagucgauguuuucuucacuccacccgagaagugcgacacacugcucugugauauaggcgaaucuagcccuaauccaaccauugaggcgggucgcacucuacgagugcugaacuuggucgaaaauuggcugaacaauaacacacaguuuugcaucaaggugcucaaucccuauaugccgucaguaaucgagaaaauggaagcucuucagagacaauacgggggagcacuggugaggaacccuuugucccggaauaguacccacgagauguacuggguuagcaacgccacgggcaauauugugucuuccgucaacaugauaucacgcaugcugaucaauagauucaccaugaagcacaaaaaggcuacauaugagccagacguggaucucggcagcgggacuaggaacauuggaaucgaaucggagauucccaacuuagacaucauagguaaacgaaucgaaaagauuaagcaggagcaugaaaucucuuggcacuacgaccaggaucauccuuauaaaaccugggccuaccacggcaguuaugagacaaagcagacuggguccgcaagcucaauggucaauggagugguucggcugcuuaccaaaccaugggacguagugcccauggucacacaaauggccaugaccgauacuacgccguuuggccagcagcguguguucaaggagaaaguugacacaagaacccaggaaccuaaggaggguacuaagaaacugaugaagauuaccgcugaauggcuauggaaagagcucgggaagaaaaagacaccccgcauguguacgagggaggaauuuaccaaaaaggugcgguccaacgcggcccugggagcaaucuucacugaugagaauaaguggaaaucugcuagagaagccgucgaggacggccgcuuuugggaauugguggauagggagcgaaaccugcaccucgagggcaagugcgaaacauguguauacaauaugauggggaaacgggagaagaaacuuggagaauucgguaaggcaaagggcagcagagccauuugguauauguggcugggggcuagguuuuuagaguucgaagcccugggauuuuugaacgaggaccauugguucagucgcggcaauucccucagcgguguggagggggaaggacugcaccgucuaggcuacauacuucgggauguuggcaaaaaggaggggggagcgauguacgcagacgauaccgccgguugggacacuagaaucacacuggaagaccucaaaaacgaggaaauggucaccaaucauaugaagggcgagcacaaaaagcuggcugaggccauuuuuaaguugacauaucaaaacaaaguggugaggguccagcgcccaacuccucgagggaccguuauggauaucaucucucggagagaccagaggggaucaggccaaguggguacguacgggcugaauaccuucacaaacauggaagcacagcucauucgccagauggagggagaaggcauauucaagaguauccagcaucuuacugcuaccgaggagauugccguacaaaauuggcuggcuagagugggccgggaaagguuaucccguauggccaucagcggggaugacugcgucgugaaacccauugaugaccgauuugcaucugcgcugacagccuugaacgauaugggaaagguucgcaaagacauccagcagugggagccaucgagagguuggaaugauuggacucaggugcccuucugcucacaccacuuucaugaacucgucaugaaggacggccgggugcugguaguuccuuguaggaaccaagaugagcuaauagggcgcgcuagaaucagccagggagccggcuggucccuuaaggaaaccgcaugccuggguaaaaguuaugcucagauguggacgcucauguacuuccaccggagggaccugcgauuggccgcaaacgccauuuguucugcggugccaagccauugggucccgacaucccguaccacuuggucaauccacgcuaagcacgaguggaugacaaccgaggauauguuagccguguggaauagaguguggauucaggaaaaccccuggauggaggacaaaacuccugucgaaaguugggaggaaguuccauaucuggggaagcgcgaggaccaauggugcggaucucucaucggccuuaccagccgggcaacaugggccaaaaauauacagacggcuauuaaccaggugaggucccugaucggcaaugaggaauacaccgauuauaugcccucaaugaagagauuucgccgggaggaagaggaagccgggguacuaugguga

SEQ ID NO: 14484 - RNA, 9876 nt, Artificial Sequence
  derived and/or modified CDS sequence (opt3) from DENV-2__EU482629__SS-prME
accgccggcgugauagucaugcugauucccacagcuauggcauuccaccucacuacgagaaauggggagccucauaugauaguuggaaggcaggaaaaggguaaaagccuucuguuuaagaccgaggacggcgugaauaugugcaccuugauggccaucgauuuaggggaacugugugaggacacuauuaccuacaaaugcccacuacuccggcaaaacgaaccggaggauaucgacuguuggugcaauuccacaucuaccuggguuacuuauggaacauguaccacgacuggcgagcaccgccgagaaaagcguucaguggcgcuggucccccauguggguauggggcuugagaccagaacagaaacuuggaugaguagcgagggagcuuggaaacacguucagaggauugagaccuggauccugcggcauccuggcuucacaauaauggccgcaaucuuggccuacaccauuggcacgacucacuuucagcgcgcucucaucuucauucugcugacagcaguggccccauccaugaccaugagaugcaucgggauaucuaacagggauuuugucgaaggagugucggguggcucauggguggacauuguucucgagcacgggagcugugugacuacaauggcuaagaauaagcccaccuuagauuucgaacugaucaaaacggaggccaagcagccugcgacccuucggaaauauugcauugaagcaaaguugacaaacacuaccacagagagucgcuguccaacucaaggagagcccucccugaaugaagaacaggacaaacgauuuaucugcaagcauucuauggucgauagaggcugggguaacggguguggacuauucggcaagggcgggaucgugaccugcgccauguuuacaugcaaaaagaauauggaaggaaaaauugugcagccugagaaccucgaauacaccauagucaucacuccacacagcggugaggagcaugcuguuggcaaugacacggggaagcacggaaaagaaauuaagaucacaccgcaguccucaauaaccgaggccgaacugacuggcuaugguaccgugacaauggaguguagucccaggaccgggcuugauuucaacgaaaugguacuguugcaaauggaggacaaagcauggcucgugcaccggcagugguuucuggauuuaccucugccauggcuccccggcgcugacacucagggaagcaauuggauucagaaggagacacuugucacguucaagaacccucaugccaaaaagcaagacgugguugugcugggcucucaggaaggggcgaugcacaccgccuugacuggagcaacagagauccagauguccucagguaaucuacuguuuaccggccaucucaaaugccgucugcgcauggauaaacuucaacugaaagggaugagcuacaguauguguacaggaaaguucaagaucgucaaagaaauugcugagacucagcacggcaccaucgugauuagaguacaguaugagggugacgggucuccaugcaagauacccuucgaaaucacggauuuggagaaaaggcauguucucggccggcugauuaccgugaacccgaucgucacagaaaaggacuccccugugaacaucgaggccgaacccccauuuggagauagcuacauuauaaucggcgucgagccugggcaguuaaaacugaauugguucaagaagggaucgucuauuggucaaauguuugagacuaccaugcgaggcgcuaaacgcauggccauccuaggggacacagcaugggauuucggaucccucggcgguguguuuacuucaauugggaaggcccugcaccagguuuucggcgcuaucuacggagcggcauuuaguggcgugagcuggaccaugaaaauacuuaucgggguaauuaucacguggauuggaaugaacuccagaucuacuagcuugucagucagucuggugcucguuggcguggucacccuguaucuuggugccauggugcaggcugacuccggguguguagugagcuggaagaauaaagaacugaagugcggaucuggcaucuucauaacugauaacguucacacauggaccgagcaguacaaguuucaacccgaaucaccaaguaaauuggccagcgcaauucagaaggcccaugaggaagguaucuguggcauuagguccgucacucggcucgagaaucugauguggaaacagaucacccccgaguuaaaccacauacugucugaaaaugaggugaagcuaacaaucaugacgggggacauucgcggaaucaugcaggcuggcaaaagaucgcucaggccucaaccaaccgaacugaaguauagcuggaaaacuugggggaaggccaagaugcuuuccacagagucacauaaccagaccuucuugauugauggaccggaaacagcagagugccccaauacuaaccgugcguggaauagucuggagguggaagacuacggcuuuggugucuucaccacgaacaucuggcucaaacugcgggagaagcaggacguauuuugugauucuaaauuaaugagcgcugccauaaaggacaaucgagcagugcacgccgauaugggguauuggauugaauccgcucugaacgacacauggaaaauggagaaggccucauucaucgagguaaagagcugccacuggccuaaaucucauacccuuugguccaauggaguauuggaaagugagaugaucauuccaaagaacuucgcaggccccgucagccagcacaacuacagaccugguuaucauacucaaaccgcuggcccauggcaccucgggaaacuggaaauggauuuugaccuaugugagggaacaacugugguugugaccgaagauugcggcaauagggggcccucucugcgcacaacgaccgccuccggaaagcucaucacugaguggugcugucggucaugcacacugccgccucuuagauacaggggcgaggacgguuguugguacgggauggaaauucgcccauugaaagagaaggaagagaaccuggucaauaguuuagugaccgcgggacauggccagauagauaacuucagccucgguguucugggcauggcccuuuuucuggaagagauguugcgaacucggaucgggacaaagcacgcuauucuccugguggcaguaucguucgucacccuaaucacgggaaauauguccuuuaaagaccugggccgugugauggugaugaugggggccacuaugaccgaugacauuggaaugggcgucacauaucucgcucugcuugccgcauucaagguuagacccaccuuugcggccgguuugcuguuaaggaaacucacuucuaaggagcugaugauggcuacaaucgggauagcccuucugagccagucaaccaucccugaaacaauucuagagcucacugaugcacuggcuuugggaaugauggugcugaaaaucguacgcaacauggaaaaguaccaauuagccgugaccauuauggcaaucaguugcguccccaaugccgugauacuccagaacgcuuggaagguuuccuguacgauucuggcggccgugucugucagcccacuucuguugacauccucacagcagaaagcagacuggaucccucucgcucugaccaucaagggccuaaaucccacugccauuuuccugaccacacuuagccggacaaguaaaaagagaucuuggccacucaacgaggccauaauggcugugggcaugguuuccauccuggcaagcucguugcugaaaaaugacauuccgaugaccgggccuuuaguggccggaggucuccugacggucugcuauguacuuacaggcaggucagcggaucuggaauuggagcgagcugccgacgugaagugggaggaucaagcagaaaucucugggaguucccccauucucagcaucaccauaucugaggacggaagcauguccaucaaaaacgaagaggaggaacagacucugacaauucuaauccgcaccggccugcuuguuauuucagguguguuuccagucaguauccccauaacugccgcugcaugguaccucugggaggugaagaagcagcgggccgggguacugugggaugugccuagcccacccccugucgaaaaagcggaguuggaagacggagcuuauagaauuaagcagaggggcaucuuaggcuacucucaaaucggggccggaguuuauaaagaggguacauuccacaccauguggcaugugacgcguggcgcagugcugaugcaccgcgggaagcggauugagccguccugggccgaugucaaaaaggaccucaucucauacggaggcgguuggaagcuggaaggggaguggaaagaaggagaggaagugcagguucuugcucuggagccaggcaagaaucccagagccguacagacuaaaccuggcauauuuaagaccaacacagggaccauuggagcagugaguuuggauuucagcccagguacauccggcucucccaucgucgacaggaaagggaaggugguuggacuauacggcaaugguguggucacucgaucgggggcuuaugugagcgccauugcgcagaccgagaagucaaucgaagauaacccugagauagaagacgauauuuuucggaaaaagcgccugacgaucauggaccuccauccgggagccggcaaaacaaagagauaccugcccgcaaucguaagggaggcuauuaaacggggccuucgaacuuuaauccuggccccaaccagagucguggcugcagaaauggaggaggcccuccgcggguugccuauuagguaucaaacaaccgccauaaagacugaacacaccggacgugagaucguugaccugaugugucaugcuacauucacgaugcggcuccugucccccgugagagucccaaacuacaaucuuauuaucauggaugaagcgcacuucacugacccugcaaguaucgccgcuagggguuauauuucuacccgcguggagaugggcgaggccgcagggauauuuaugacagccacacccccaggaagccgagauccguucccucaguccaacgcucccaucauggacgaagagagagaaauuccagagcggucauggaacucuggccacgaauggguuacugauuuuaaggguaaaacagugugguucguccccagcaucaaggcggggaacgacauugccgcaugccugaggaaaaauggaaagaaagugauccaguugagucgcaagaccuuugauuccgaguacguaaagacgcgugcuaacgacugggauuucgugguuacuacagacauaagcgagaugggcgccaauuuuaaagcagaaagagucaucgauccucggagguguaugaagccagugauucuaaccgacggcgaggaacgcgugauccuggccgggcccaugccugucacccauucuucagcugcccaacgaagaggacggauugguaggaacccgaaaaaugagaacgaccaguauaucuacaugggcgaaccacucgagaaugaugaggacugcgcgcacuggaaggaagcaaaaauguuacuggauaacauaaauacucccgaggggauuaucccuuccauguucgaacccgagcgcgaaaagguagacgccauugauggagaguacagacuuaggggcgaggcucggaaaacauuuguggaccugaugcgucgcggugaucucccaguuugguuggccuauaagguggcugcagaagggaucaacuacgccgaccgaaagugguguuucgauggcaucaagaauaaccagauccuggaggaaaacauggaggucgagauuuggaccaaggaaggagagaggaaaaagcucaaaccuagauggcuggacgcucggaucuauagugauccccuugcccuaaaggaauuuaaggaguucgcagcgggccgcaaaagccugacauugaauuuaauuacugaaauggggagacugccaacguucaugacccagaaggccaggaacgcucucgacaaucuggccgugcuucauacagcagaggcuggaggucgggccuacaaccacgcacugucggagcucccugaaacuuuggagacccugcuacugcucacacuucuggccaccguuacuggcgggaucuuuuuauucuugaugucuggaaaaggcauagguaagaugacgcuggggaugugcugcauuaucaccgcuuccauccuccugugguaugcgcaaauucagccgcacuggaucgccgcaagcauaauucuugaauuuuuccugaucgugcucuugauucccgagccagaaaaacagcgaacaccucaggauaaucaacugacuuacgucgugaucgcuauauuaaccguaguggccgccacaauggcaaacgagaugggcuuucuagagaagaccaagaaagaccugggacucggcucaaucacuacacaggaaagugagucuaauauucuugacaucgaucugagacccgcuuccgccuggacguuguaugcgguugcuaccacuuucauuacaccaaugcugcgccauagcaucgaaaacucaagugucaaugugagccucaccgccauugcaaaccaggccaccgugcugauggggcuuggaaaggguuggccucucuccaaaauggacaucggcgucccccuguuggcuauaggguguuacucucagguuaauccgauuacacugacugcagccuuacuacugcucguggcgcacuacgcuaucaucggaccaggccuucaagccaaggcaacgagggaggcccagaaacgggcugccgcagguauuaugaagaacccuaccguagaugggauaacagugaucgaccuggaacccauuccauaugaucccaaguuugagaaacaguugggccaggucaugcugcucauccugugcgugacucaaguucuuaugaugcguaccacaugggcuuuaugugaggcccugacccucgcgacuggaccuauuagcacguugugggaaggcaauccggggagauucuggaacacaaccaucgccguguccauggcaaauauauuuaggggaucauaccuggcuggcgccggucuacuguucucuaucaugaagaacacuaccaauacacgccgggggacuggaaacauuggcgagacccucggugaaaaauggaagagucgacuuaacgcacugggcaaaucggaguuucagaucuauaagaaaagcgggauucaggaggucgacagaacauuggcuaaggaaggaaucaagaggggcgagacggaucaucacgccguaucccgcgggucugccaaacugcggugguucguggaaagaaauaugguuacccccgagggaaagguggucgaccucggcugcggucgugggggauggucauacuauuguggcggucugaaaaacgugagggaagucaagggcuuaacuaaagggggaccaggccaugaggagccuauacccaugagcacauacggguggaaucuugugcggcugcaauccggaguugauguguuuuucaccccuccagaaaagugcgacacucuccuaugugauauuggcgagaguucucccaacccuacaaucgaagcgggucgcacccugcgaguauugaaucugguggagaacuggcucaauaacaauacgcaguucugcaucaagguccuuaacccauauaugcccagcguuauugagaaaauggaggcucugcagagaaaguacgggggagcauuggugaggaauccgcugucacggaacuccacccacgagauguacugggucaguaaugccacaggcaacauagugagcucuguaaauaugaucucccgcaugcucauuaacagauuuacuaugaaacacaagaaagcuaccuaugaaccugacguggauuuaggcucagggacaaggaacaucggaauugagagcgaaaucccaaaucuggacauaaucgguaagcgaauugagaagaucaaacaggaacaugagacuucguggcacuacgaccaagaucaucccuauaagaccugggccuaccacggcucuuaugagacaaaacagaccgggagugcauccagcaugguuaacggagugguccggcuucugacuaagccuugggacguggucccaauggugacgcagauggccaugacagauaccacucccuucggccagcaacguguuuuuaaagaaaagguagacaccagaacacaggagccgaaggaagguacgaaaaagcuaaugaaaauuaccgcugaguggcucuggaaggagcuggggaaaaagaaaacuccucgcauguguacaagggaagaguucacccggaaggugagaucaaaugcggccuugggagcaaucuuuacugaugaaaacaaguggaaauccgcucgcgaggccgucgaagacggcagguucugggagcugguggaucgagagcggaaucuccaccuugaaggcaagugcgagacauguguuuacaacaugauggggaaaagagaaaagaaacugggagaguuugguaaggcaaagggcucuagggccauuugguauaugugguuaggggcucgcuuccuggaauuugaggccuugggauuccucaaugaggaccauugguuuagccguggcaacagucuguccgguguggaaggggagggacuacaccggcuuggcuacauacugagagaugucggcaaaaaggaagggggagcgauguacgcagacgauaccgccgguugggacacaaggaucacucucgaggaccugaaaaaugaagagauggugaccaaccauaugaagggcgagcacaaaaaguuggcugaagccauuuucaagcugacguaucagaauaaaguagugcgcguucagcgacccaccccacgggggacagucauggauaucaucagcagaagggaccaacgcggaucuggccagguggguacuuacgggcucaacaccuuuacaaauauggaggcacagcuuauuagacaaauggaaggagagggcauauucaagucaauccagcaucugacugcuaccgaggaaauugccgugcagaacugguuagcucgggucggcagggagcgucugagucgaauggccaucuccggggaugacugcguugugaaaccuauugaugaccgcuucgcaagcgcguugacggcccucaaugauaugggaaagaucagaaaagacauacagcaaugggaacccucucgggguuggaacgauuggacacagguaccauuuugcucgcaccacuuccaugagcuggugaugaaggacggcaggguccuagugguucccugucgcaaccaggaugaacuuaucgggagagcucggauuucacagggagccggcuggagccugaaggagaccgcaugccucgguaaauccuaugcucaaauguggacucugauguacuuucacaggcgagacuugcguuuagccgcaaaugccaucuguagugcggugccuucucauugggucccaacaagcagaaccacuugguccauucacgcuaagcacgaguggaugaccacagaagauaugcuggccguguggaaccgcguauggauccaggagaauccguggauggaagacaaaacgcccguugagucaugggaagaggugccuuaucucgggaagcgggaggaccaguggugcggaagucuuauaggccugaccucuagggcaacuugggccaaaaacauucagacagcuaucaaucaagucagaagccuaauuggcaacgaagaguacaccgauuauaugccauccaugaagcgcuuccggagggaagaggaagaggccggggugcugugguga

SEQ ID NO: 14485 - RNA, 9876 nt, Artificial Sequence
  derived and/or modified CDS sequence (opt3) from DENV-2__FJ390390__SS-prME
accgccggcgugaucgucaugcugauucccaccgcuauggcauuccaccucacuacgcguaacggggaaccucauaugauaguuggaaggcaggaaaaggguaaaagccuucuguuuaagaccgaggacggcgugaauaugugcacauugauggccaucgauuuaggggaacugugugaggacacuauuaccuacaaaugcccauuacuccggcaaaacgaaccggaggauaucgacuguuggugcaauuccacaucuaccuggguaacuuauggaacauguaccacgacuggcgagcaccgccgagaaaagcguucaguggcgcuggucccccauguggguauggggcuugagaccaggacagaaacuuggaugaguagcgagggagcuuggaaacacguucagaggauugagaccuggauccugcggcauccuggcuucacaauaauggccgcaaucuuggccuacaccauuggcacgacucacuuucagcgcgcucucaucuucauucugcugacagcaguggccccauccaugaccaugagaugcaucgggauaucuaacagggauuuugucgaaggagugucggguggcucauggguagacauuguucucgagcacgggagcugugugacuacaauggcuaagaauaagcccaccuuagauuucgaacugaucaaaacggaggccaagcagccugcgacccuucggaaauauugcauugaagcaaaguugacaaacacuaccacagagagucgcuguccaacucaaggagagcccucccugaaugaggaacaggacaaacgauuuaucugcaagcauucuauggucgauagaggcugggguaacggguguggacuauucggcaagggcgggaucgugaccugcgccaaauuuacaugcaagaaaaauauggaaggaaaggugguccagccugagaaccucgaauacaccauuguuauaacuccacacagcggugaggagcaugcugugggcaaugacacggggaaacacggaaaggaaaucaaaauuacaccgcaguccucaaucaccgaggccgaacugacuggcuaugguaccguaacaauggaguguagucccaggaccgggcuugauuucaacgaaauggugcuguugcaaauggaggacaaggcauggcucguccaccggcagugguuucuggauuuaccucugccauggcuccccggcgcugacacucagggaagcaauuggauacagaaggagacacuugugacguucaaaaacccucaugccaagaaacaagacguugugguccugggcucucaggaaggggcgaugcacaccgccuugacuggagcaacagagauucagauguccucagguaaucuacuguuuaccggccaucucaagugccgucugcgcauggauaaacuucaacugaaggggaugagcuacaguauguguacaggaaaguucaaaaucgugaaggaaaucgcugagacucagcacggcaccauuguaaucagaguucaguaugagggugacgggucuccaugcaaaauucccuucgaaauaacggauuuggagaagaggcaugugcucggccggcugaucaccgucaacccgauugugacagaaaaagacuccccugucaacaucgaggccgaacccccauuuggagauagcuacaucauuauaggcguggagccugggcaguuaaagcugaauugguucaagaaaggaucgucuaucggucaaauguuugagacuaccaugcgaggcgcuaagcgcauggccauucuaggggacacagcaugggauuucggaucccucggcgguguuuuuacuucaaucgggaaagcccugcaccagguguucggcgcuauuuacggagcggcauuuaguggcguaagcuggaccaugaagauccuuauaggggucaucauuacguggaucggaaugaacuccagaucuacuagcuugucagugagucugguucucgugggcgucgugacccuguaucuuggugccaugguacaggcugacuccgggugugugguuagcuggaaaaauaaggaacugaagugcggaucuggcauuuucaucacugauaacguccacacauggaccgagcaguacaaauuucaacccgaaucaccaaguaaguuggccagcgcaauacagaaagcccaugaggaagguauuuguggcaucagguccgugacucggcucgagaaucugauguggaagcagauuacccccgaguuaaaccacauccugucugaaaaugaggugaaacuaacaauaaugacgggggacauccgcggaauuaugcaggcuggcaagagaucgcucaggccucaaccaaccgaacugaaauauagcuggaagacuugggggaaggccaaaaugcuuuccacagagucacauaaccagaccuucuugaucgauggaccggaaacagcagagugccccaauacuaaccgugcguggaauagucuggaggucgaagacuacggcuuugguguuuucaccacgaacauuuggcucaagcugcgggacaaacaggauguguuuugugacucuaaguuaaugagcgcugccaucaaagauaaucgagcagugcacgccgacaugggguauuggauagaguccgcucugaacgauacauggaagauggaaaaggccucauucauugagguaaaaagcugccacuggccuaagucucauacccuuugguccaauggagucuuggagagugaaaugaucauccccaagaauuucgcaggccccgugagccagcacaacuacagaccugguuaucauacucaaaccgcuggcccauggcaccucgggaagcuggagauggacuuugaucuaugugaaggaacaacuguuguggucaccgaggacugcggcaauagggggcccucucugcgcacaacgaccgccuccggaaaacucauuacugaauggugcugucggucaugcacacugccgccucuuagauacaggggcgaggaugguuguugguacgggauggagauccgcccauugaaggaaaaggaggaaaaccuggugaauaguuuaguuaccgcgggacauggccagauugacaacuucagccucggugugcugggcauggcccuucuguuggaggaaaugcuccgaacucggauagggacaaaacacgcuauccugcuaguagcagucucguuugugacccugauuacgggaaauauguccuuccgugaucucggcagagugauggucaugguuggggccacuaugaccgacgauaucggaaugggcgugacauaucuggcucuuuuggccgcauuuaagguaaggcccaccuucgcggccggucuguuacuccgcaaacugacuucuaaggagcuuaugauggcuacaauugggaucgcccugcuaagccagucaaccauaccugagacaauccucgaacugacugacgcauuggcucugggaaugaugguguuaaaaauuguccggaacauggagaaguaccaacucgccgugaccguuauggcaaucaguugcgugcccaaugccgucauucugcagaacgcuuggaagguguccuguacgauccuugcggccguuucugugagcccacuguugcucacauccucacagcagaaagcagacuggauaccucuggcucuaaccauuaagggccugaaucccacugccaucuuucuuaccacacucagcagaacaaguaaaaagaggucuuggccacugaacgaagccaucauggcugucggcaugguauccauuuuggcaagcucgcugcucaaaaaugauauaccgaugaccgggccucuaguggccggaggucugcuuacgguuugcuaugugcugacaggccgaucagcggacuuggagcucgaacgcgcugccgaugucaagugggaggaccaagcagagaucucugggaguucccccauucugagcaucaccauuucugaagauggaagcauguccaucaaaaacgaggaagaggagcagacucuaacaauacugauccggaccggccuucucgugauuucagguguauucccagugaguauccccauuacugccgcugcaugguaccugugggaagucaagaagcagagagccgggguuuugugggacgugccuagcccacccccuguggagaaagcggaauuagaggauggagcuuauaggaucaagcagcguggcauacugggcuacucucaaauuggggccggagucuauaaagaagguacauuucacaccauguggcaugugacgcgcggcgcaguucucaugcaccgggggaagagaaucgagccguccugggccgacgucaagaaagaucugaucucauacggaggcgguuggaaacuugagggggaauggaaagagggagaagaggugcagguccuggcuuuggaaccaggcaaaaaucccagggccgugcagacuaaaccuggcauuuucaagaccaacacagggaccaucggagcaguuagucuagacuuuagcccagguacauccggcucucccauaguggaucgaaaagggaaggucgugggacuguacggcaaugguguagucacucggucgggggcuuaugugagcgccauugcgcagaccgagaagucaaucgaggacaacccugaaauugaggaugacaucuuccgcaaaaagagacucacgauaauggaccugcauccgggagccggcaaaacaaagagguaccuucccgcaauuguucgggaagcuaucaaacgaggcuuaagaacucugauccucgccccaacccgcguggucgcugcagagauggaagaggccuugagggggcugccuauucguuaucaaacaaccgccaucaagacugagcacaccggacgggaaauuguggaucucaugugucaugcuacauuuacgaugagacugcuuucccccguuagggugccaaacuacaaucugauaaucauggacgaggcgcacuucacugauccugcaaguauugccgcucgcgguuauaucucuacccgagucgaaaugggcgaggccgcagggaucuucaugacagccacaccaccaggaagcagagacccguuuccucaguccaacgcucccauuauggaugaggaacgggagauaccagaaaggucauggaacucuggccacgagugggugacugacuucaaggguaaaacaguaugguuugugcccagcaucaaggcggggaacgauauugccgcaugcuugcgcaaaaauggaaagaaaguuauccagcuaagucguaagaccuucgacuccgaauacgucaagacgagagcuaacgauugggacuuuguggugacuacagauauuagcgagaugggcgccaauuucaaagcagagcgggucaucgacccuaggcgcuguaugaagccaguaauacugaccgacggcgaagaacgagugauccucgccgggcccaugccuguuacccauucuucagcugcccaaagacggggaaggauuggucgcaacccgaaaaaugaaaacgaucaguauaucuacaugggcgagccauuagaaaaugacgaggauugcgcgcacuggaaggaggcaaaaaugcugcuugacaacauuaauacucccgaagggaucauaccuuccauguuugagcccgaaagagagaagguggaugccauugacggagaauacaggcugcggggcgaggcucguaaaacauucgucgaucucaugcgccgaggugacuugccaguguggcuggccuauaagguugcugcagaggggaucaacuacgccgauagaaagugguguuuugacggcauuaaaaauaaccagauccucgaagagaacauggaaguggagauauggaccaaggagggagaaaggaaaaagcugaaaccucgguggcuugaugcucgcaucuauagugacccccuagcccugaaggaguucaaggaauuugcagcgggcagaaagagcuugacauuaaaucugauuacugagauggggaggcucccaacguucaugacccagaaggcccggaacgcucuggauaaucuugccguccugcauacagcagaagcuggaggucgagccuacaaccacgcacucucggaguugccugagacucuggaaacccuacugcuccuuacacuguuagccaccgugacuggcgggaucuucuuguuucugaugucuggaaaaggcauugguaagaugacgcucgggaugugcugcaucauaaccgcuuccauucugcuuugguaugcgcaaauccagccgcacuggaucgccgcaagcauuauccuggaguucuuucucauaguauugcugauucccgaaccagagaaacagagaacaccucaggacaaucaauuaacuuacgugguuaucgcuauucuaaccgucguggccgccacaauggcaaacgaaaugggcuuccuggagaagaccaagaaagaccucggacuuggcucaaucacuacacaggagagugaaucuaauauacuggauaucgacuugcgccccgcuuccgccuggacgcuguaugcgguggcuaccacuuuugucacaccaaugcucaggcauagcauugagaacucaaguguuaaugugagccugaccgccaucgcaaaccaggccaccguacuuauggggcucggaaaggguuggccucuguccaaaauggauauuggcgugcccuugcuggcuaucggguguuacucucaggucaauccgauuacauuaacugcagcccuacugcuccuuguggcgcacuacgcuaucauaggaccaggccugcaagccaaggcaacgcgggaagcccagaaacgugcugccgcagguauuaugaagaacccuaccguugacgggaucacagugaucgauuuggagcccauuccauaugaccccaaguucgaaaaacagcugggccaggucaugcuccugauacuuugcguaacucaaguguuaaugaugagaaccacaugggcucugugugaggcccucaccuuggcgacuggaccuaucagcacgcugugggagggcaauccggggagguuuuggaacacaaccauugccguuuccauggcaaauaucuuccgcggaucauaccuagcuggcgccggucugcucuuuucuauuaugaagaacacuaccaauacacggcgagggacuggaaacaucggcgaaacccuuggugagaaauggaagaguagacugaacgcauugggcaaaucggaguuccagauauauaagaaaagcgggauccaggagguggauaggacacuggcuaaggagggaauuaagcgcggcgaaacggaccaucacgccgucucccgggggucugccaaacucagaugguuuguggagcguaauauggucacccccgaaggaaaggugguugaucugggcugcgguagagggggauggucauacuauuguggcggucuuaaaaacgugcgggagguaaagggccuaacuaaagggggaccaggccaugaagaaccuauccccaugagcacauacggguggaaucuggugcgccuccaauccggagucgacguuuucuuuaccccuccagagaagugcgauacucuacugugugacauuggcgaaaguucucccaacccuacaaucgaggcgggucgaaccuugagagugcugaaucucgucgaaaacuggcuuaauaacaauacgcaguucugcauaaaggugcugaacccauauaugcccagcguaauugagaaaauggaggcuuugcagaggaaguacgggggagcacuggugcggaauccgcucucacgcaacuccacccacgagauguacuggguuaguaaugccacaggcaacaucgugagcucugucaauaugaucuccagaauguuaauuaacagguucacuaugaaacacaagaaagcuaccuaugagccugauguggaccugggcucagggacacgaaacauaggaaucgaaagcgagauuccaaaucuugacaucauugguaagcggaucgaaaagauaaaacaggagcaugaaacuucguggcacuacgaucaagaccaucccuauaagaccugggccuaccacggcucuuaugagacaaaacagaccgggagugcauccagcauggucaacggagugguucgucugcuaacuaagccuugggauguagugccaauggucacgcagauggccaugacagacaccacucccuuuggccagcaaagaguguucaaagagaagguugauacccgcacacaggaaccgaaggaggguacgaaaaagcucaugaaaaucaccgcugaauggcuguggaaggaguuggggaaaaagaaaacuccuaggauguguacacgggaggaauuuaccagaaaggugcgcucaaaugcggcccugggagcaauuuucacugacgagaacaaguggaaauccgcuagggaagccgucgaggauggccgauuuugggaacucguggaccgggagagaaaucuucaccuggagggcaagugcgaaacauguguauacaacaugauggggaaaagggagaagaaauuaggagaguucgguaaggcaaagggcucucgcgccaucugguauauguggcugggggcuagauuuuuggaguucgaagcccucggauuucugaaugaggaucauugguucagccggggcaacagucuauccgguguggagggggaaggacuucacagacugggcuacauucucagggacguuggcaaaaaggaagggggagcgauguacgcagaugacaccgccgguugggacacacgcaucacucuggaagauuugaaaaaugaggaaauggucaccaaccauaugaagggcgagcacaaaaagcuggcugaggccauuuuuaagcucacguaucagaauaaaguggugcgaguccagcggcccaccccaagagggacaguuauggacauaaucagcaggcgcgaucaaagaggaucuggccagguggguacuuacgggcuuaacaccuucacaaauauggaagcacagcugauucggcaaauggagggagaaggcaucuuuaagucaauccagcauuuaacugcuaccgaggagauugccguacagaacuggcuggcuagggugggccgugaacgauugagucgcauggccauauccggggacgauugcgucgugaaaccuaucgacgauagauucgcaagcgcgcucacggcccugaaugacaugggaaagguucggaaagauauucagcaaugggagcccucuagggguuggaacgacuggacacaggugccauucugcucgcaccacuuucaugaguuaguaaugaaggauggccgcgugcuuguaguucccuguagaaaccaggacgagcugaucgggcgggcuaggauuucacagggagccggcuggagccucaaggaaaccgcaugccuggguaaauccuaugcucaaauguggacuuugauguacuuccaccgacgugauuuaagacuggccgcaaaugccaucuguagugcggugccuucucauugggucccaacaagccgcaccacuugguccauacacgcuaagcacgaguggaugaccacagaggacaugcucgccguguggaaccggguguggauccaggaaaauccguggauggaggacaaaacgcccgucgaaucaugggaggaaguuccuuaucuugggaagagggaggaucaguggugcggaagucugauuggccuaaccucuagagcaacuugggccaaaaacauccagacagcuauuaaucaagugcgcagccugaucggcaacgaggaauacaccgacuauaugccauccaugaagcgguuuaggcgagaggaagaggaagccgggguacucugguga

SEQ ID NO: 14486 - RNA, 9876 nt, Artificial Sequence
  derived and/or modified CDS sequence (opt3) from DENV-2__FJ390391__SS-prME
accgccggcgugauaguaaugcugauuccaacugcuauggcauuccaccucacuacgagaaacggggaaccucauaugauaguuggaaggcaggaaaaggguaaaagccuucuguuuaagaccgaggacggcgugaauaugugcacauugauggccaucgauuuaggggaacugugugaggacacuauuaccuacaaaugcccacuacuccggcaaaacgaaccggaggauaucgacuguuggugcaauuccacaucuaccuggguaacuuauggaacauguaccacgacuggcgagcaccgccgagaaaagcguucaguggcgcuggucccccauguggguauggggcuugagaccagaacagaaacuuggaugaguagcgagggagcuuggaaacacguucagaggauugagaccuggauccugcggcauccuggcuucacaauaauggccgcaaucuuggccuacaccauuggcacgacucacuuucagcgcgcucucaucuucauucugcugacagcaguggccccauccaugaccaugagaugcaucgggauaucuaacagggauuuugucgaaggagugucggguggcucauggguagacauuguucucgagcacgggagcugugugacuacaauggcuaagaauaagcccaccuuagauuucgaacugaucaaaacggaggccaagcagccugcgacccuucggaaauauugcauugaagcaaaguugacaaacacuaccacagagagucgcuguccaacucaaggagagcccucccugaaugaagaacaggacaaacgauuuaucugcaagcauucuauggucgauagaggcugggguaacggguguggacuauucggcaagggcgggaucgugaccugcgccauguuuacaugcaaaaagaauauggaaggaaaagugguccagccugagaaccucgaauacaccauuguuauaacuccacacagcggugaggagcaugcugugggcaaugacacggggaagcacggaaaagaaaucaagauuacaccgcaguccucaaucaccgaggccgaacugacuggcuaugguaccguaacaauggaguguagucccaggaccgggcuugauuucaacgaaauggugcuguugcaaauggaggacaaagcauggcucguccaccggcagugguuucuggauuuaccucugccauggcuccccggcgcugacacucagggaagcaauuggauacagaaggagacacuugugacguucaagaacccucaugccaaaaagcaagacguugugguccugggcucucaggaaggggcgaugcacaccgccuugacuggagcaacagagauucagauguccucagguaaucuacuguuuaccggccaucucaaaugccgucugcgcauggauaaacuucaacugaaagggaugagcuacaguauguguacaggaaaguucaagaucgugaaagaaaucgcugagacucagcacggcaccauuguaaucagaguucaguaugagggugacgggucuccaugcaagauucccuucgaaauaacggauuuggagaaaaggcaugugcucggccggcugaucaccgucaacccgauugugacagaaaaggacuccccugucaacaucgaggccgaacccccauuuggagauagcuacaucauuauaggcguggagccugggcaguuaaaacugaauugguucaagaagggaucgucuaucggucaaauguuugagacuaccaugcgaggcgcuaaacgcauggccauucuaggggacacagcaugggauuucggaucccucggcgguguuuuuacuucaaucgggaaggcccugcaccagguguucggcgcuauuuacggagcggcauuuaguggcguaagcuggaccaugaaaauccuuauaggggucaucauuacguggaucggaaugaacuccagaucuacuagcuugucagugagucugguucucgugggcgucgugacccuguaucuuggugccguagugcaggcugacuccggguguguugucagcuggaagaauaaagaacugaagugcggaucuggcauuuucaucacugauaacgugcacacauggaccgagcaguacaaguuucaacccgaaucaccaaguaaauuggccagcgcaauacagaaggcccaugaggaagguauuuguggcaucagguccgugacucggcucgagaaucugauguggaaacagauuacccccgaguuaaaccacauccugucugaaaaugaggucaagcuaacaauaaugacgggggacaucaaaggaauuaugcaggcuggcaagcgcucgcucagaccucaaccaaccgaacugaaauauagcuggaagacuugggggaaggccaaaaugcuuuccacagagucacauaaccagaccuucuugaucgauggaccggaaacagcagagugccccaauacuaacagggcguggaauagucuggagguugaagacuacggcuuugguguguucaccacgaacauuuggcucaagcugcgugagaaacaggacguguuuugugauucuaaguuaaugagcgcugccaucaaagacaaucgggcaguacacgccgauaugggguauuggauagaauccgcucugaacgacacauggaagauggagaaggccucauucauugaggucaaaagcugccacuggccuaagucucauacccuuugguccaauggaguguuggaaagugagaugaucauccccaagaauuucgcaggccccguuagccagcacaacuaccgaccugguuaucauacucaaaccgcuggcccauggcaccucgggaagcuggaaauggauuuugacuucugugagggaacaacuguggucgugaccgaagauugcggcaauagagggcccucucuaaggacaacgaccgccuccggaaaacugauuacugaguggugcugucgcucaugcacacucccgccucugcgguacagaggcgaggacgguuguugguacgggauggaaaucaggccacuuaaggagaaggaagagaacuugguuaauagucuggugaccgcgggacauggccagauugauaacuuuagcuuagguguacucggcauggcccuguuccuugaagagaugcugcgcacucgaauagggacaaaacacgcuaucuugcucgucgcagugucguuugugacccugauuacgggaaauauguccuuccgggaccuaggccgugucaugguuauggugggggccacuaugaccgaugacaucggaaugggcguaacauaucuggcucuccuggccgcauuuaaggugagacccaccuucgcggccggucuuuugcugaggaaauuaacuucuaaggagcucaugauggcuacaauugggaucgcccugcuuagccagucaaccauaccugaaacaaucuuugagcugacugaugcacuagcucucggaaugaugguccugaaaauugugcgcaacauggaaaaguaccaauuggccguuaccaucauggcaauuaguugcgugcccaaugccgucauccugcagaacgcuuggaagguguccuguacgauauuagcggccguuucugugagcccacuccugcuuacauccucacagcagaaagcagacuggauuccucuggcuuugaccaucaagggccucaaucccacugccaucuuccugaccacacuaagccggacaaguaaaaagagaucuuggccacugaacgaggccauuauggcugucggcaugguauccauacuugcaagcucgcuccugaaaaaugacaucccgaugaccgggccuuugguggccggaggucuguuaacgguuugcuaugugcucacaggcaggucagcggaucuggaacuugagcgagcugccgacgucaagugggaggaucaagcagaaauuucugggaguucccccauccugagcauuaccaucucugaggacggaagcauguccaucaaaaacgaagaggaggaacagacuuugacaauccucauucgcaccggccugcuagugaucucagguguauuuccagugaguauucccaucacugccgcugcaugguaccugugggaggucaagaagcagcgggccgggguucuuugggaugugccuagcccacccccuguggaaaaagcggagcucgaagacggagcuuauagaauaaagcagaggggcauucugggcuacucucaaaucggggccggagucuauaaagaggguacauuccacaccauguggcaugugacgcguggcgcaguuuugaugcaccgcgggaagcggaucgagccguccugggccgaugucaaaaaggacuuaauuucauacggaggcgguuggaagcuggaaggggaguggaaagaaggagaggaagugcagguccucgcucuggagccaggcaagaaucccagagccgugcagacuaaaccuggcaucuuuaagaccaacacagggaccauaggagcaguuagucuugauuucagcccagguacauccggcucucccauuguggacaggaaagggaaggucgugggacuguacggcaaugguguagucacucgaucgggggcuuaugugagcgccaucgcgcagaccgagaagucaauugaagauaacccugagaucgaagacgauauauuccggaaaaagcgcuugacgauuauggaccuacauccgggagccggcaaaacaaagagauaccugcccgcaaucguuagggaggcuaucaaacggggccuccgaacucugauucuugccccaaccagaguggucgcugcagaaauggaggaggccuuacgcgggcugccuaucagguaucaaacacccgccauuaagaccgaacacacuggacgugagauaguggaccucaugugucaugcuaccuuuacaaugcgguugcuguccccaguuagagugccuaacuacaaucucaucauuauggaugaagcgcacuucacggaccccgcaaguaucgccgcuagggguuauaucucuacucgcgucgagaugggcgaggccgcagggauuuuuaugaccgccacaccaccgggaagccgagauccuuucccccaguccaacgcuccaauaauggacgaagagagagaaauccccgagcggucauggaacucuggccacgaaugggugaccgauuuuaaggguaaaacuguaugguucgugccuagcauuaaggcggggaacgacaucgccgcaugccugaggaaaaauggaaagaaaguuauucagcuuagucgcaagacauuugauuccgaguacgucaagacccgugcuaacgacugggauuucguggugacgacugacaucagcgagaugggcgccaauuuuaaagcagaaagagucauagauccacggagguguaugaagcccguaauccugacagacggcgaggaacgcgugauuuuggccgggccuaugccgguuacccauucuucagcugcccaacgaagaggacggaucgguaggaaccccaaaaaugagaacgaccaguauauuuacaugggcgaaccccuagagaaugaugaggacugcgcgcacuggaaggaagcaaaaaugcugcucgauaacaucaauaccccugaggggauaauucccuccauguucgaaccagagcgcgaaaagguggacgccaucgauggagaguacagauuaaggggcgaggcucggaaaacuuuugucgaccugaugcgucgcggugaucuuccuguguggcuggccuauaagguugcugcagaagggauuaacuacgccgaccgaaagugguguuucgauggcaucaaaaauaaccagauacucgaggaaaacauggagguggagaucuggacaaaggaaggagagaggaaaaaguugaaacccagauggcuggacgcucggauuuauagugauccacucgcccugaaggaguucaaggaguuugcagcgggccgcaaaagccuuacccuaaaucugaucacagaaauggggagauugccuacuuucaugacgcagaaggccaggaacgcuuuagacaaucuggccguccuccauaccgcagaggcuggaggucgggccuacaaccacgcacugucggagcuuccggaaacacuggagacucucuugcugcuaacccugcucgccacagugaccggcgggauuuuucuuuuccugaugucuggaaaaggcaucgguaagaugacuuuagggaugugcugcauaauuacggcuuccaucuugcugugguaugcgcaaauccagccccacuggauugccgcaagcaucauacucgaauuuuuccugauuguacuucugaucccagagccugaaaaacagcgaaccccacaggauaaucaacucacauacgugguuauugcuaucuugacugucguggccgccaccauggcaaacgagaugggcuuucuggagaagacaaagaaagacuuaggacuaggcucaauaaccacucaggaaagugagucuaauauccuggacauugaucucagaccagcuuccgccuggacacuuuaugcgguggcuacgaccuucgucacuccuaugcugcgccauagcaucgaaaacucaaguguuaaugugagcuugacagccauugcaaaccaggccaccguacugauggggcucggaaaggguuggccccuguccaaaauggacaucggcgugccgcuucucgcuauuggguguuacucucaggucaauccaaucacccugacagcagccuugcugcuauuaguggcgcacuacgcuauaauuggaccuggccugcaagccaaggcaacuagggaggcccagaaacgggcugccgcagguaucaugaagaaccccacgguugaugggaucaccgugauugaccucgaaccaauacccuaugauccuaaguuugagaaacagcuuggccaggucaugcuguugauccugugcguaacacaagugcucaugaugcguacuaccugggcucugugugaggcccuuacauuagcgaccggaccgauuagcacucugugggaaggcaaucccgggagauucuggaacacgacaaucgccguuuccauggcaaauauuuuuaggggaucauaccucgcuggcgccgguuugcuguucucuaucaugaagaacaccacaaguacccgccgggggacaggaaauauaggcgagacucuaggugaaaaauggaagucgcgacugaacgcacucggcaaaagcgaguuucagaucuauaagaaauccgggauucaggagguggacagaacccuugcuaaggaaggaaucaagaggggcgagacagaucaucacgccgucucucgcgggucagccaaacugcggugguucguggaaagaaacauggucacgccagagggaaaggugguugacuugggcugcggucgugggggauggagcuacuauuguggcggucugaaaaaugugagggaaguaaagggccucaccaaagggggaccuggccaugaggagcccauuccuauguccacuuacggguggaaccuggugcgguuacaaaguggagucgauguuuucuuuacaccacccgaaaagugcgacacccuucugugugauaucggcgagucuagcccuaauccaacuauagaagcgggucgcacacuccgagugcuaaaccuggucgagaauugguugaacaauaacacccaguucugcauuaaggugcugaaucccuauaugccgucaguaaucgagaaaauggaggcucuccagagacaguacgggggagcacuugugaggaacccucugucccggaauaguacgcacgagauguacuggguuagcaacgccaccggcaauaucgugucuuccgucaacaugauuucacgcauguugauaaauagauuuacaaugaagcacaaaaaggcuacuuaugaaccagacguggaucugggcagcgggaccaggaacaucggaauugagaacgaaauccccaaucucgacauuaucgguaaacgaauagagaagaucaagcaagaacaugagauuucguggcacuacgaccaggaucauccuuauaaaacaugggccuaccacggcucuuaugagacuaagcagaccgggagugcauccagcauggucaacggagugguucgguuacugacaaaaccaugggacguagugcccauggucacccagauggccaugacugauacgacaccguucggccaacagcguguguuuaaggaaaaaguugacaccagaacucaggagccuaaggaagguaccaagaaacuuaugaagaucacagcugaguggcuguggaaagagcuagggaagaaaaagacgccccgcauguguaccagggaagaguucacuaaaaaggugcggucaaaugcggcccucggagcaauuuuuacagaugaaaacaaguggaaauccgcuagagaggccgucgaagacggccgcuucugggagcugguggauagggagcgaaauuugcaccuggaaggcaagugcgagaccuguguauacaacaugauggggaaacgggaaaagaaacucggagaguuugguaaggcaaagggcucuagagccaucugguauauguggcuuggggcuagguuccuggaauuugaggccuuaggauuccugaaugaggaccauugguuuagccgcggcaacaguuuguccgguguggaaggggagggacuccaccgucugggcuacauucuacgggauguuggcaaaaaggaagggggagcgauguacgcagacgauacugccgguugggacacaagaauaacccuugaggaccugaaaaaugaagagauggucacaaaccauaugaagggcgagcacaaaaagcucgcugaagccaucuucaagcugacuuaucagaauaaaguggugaggguccaacgcccaaccccucgagggacgguuauggauauuaucagccggagagaccagaggggaucuggccagguggguaccuacggguugaacacauucacuaauauggaggcacaacugauccgccagauggaaggagagggcauuuuuaagucaauacagcaucucaccgcuacagaggaaaucgccguacagaacuggcuugcuagagugggccgggagaggcugagucguauggccauuuccggggaugacugcgucgugaaacccaucgaugaccgauucgcaagcgcguuaacugcccugaaugauaugggaaagguucgcaaagacauucaacagugggaaccaucuagagguuggaacgauuggacccaggugcccuuuugcucgcaccacuuccaugaguuggucaugaaggacggccgggugcucguaguuccuuguaggaaccaggaugaacugaucgggcgcgcuagaauaucacaaggagccggcuggagccuaaaggagacggcaugccuugguaaauccuaugcucagauguggacacugauguacuuucaccggagggaccuccgacuggccgcaaaugccaucuguagugcggugccaucucauugggucccgaccagccguacuacaugguccauucacgcuaagcacgaguggaugaccacugaagauauguuggccguguggaacagaguguggauccaggagaaucccuggauggaagacaaaaccccugucgagucaugggaagagguuccauauuuagggaagcgcgaggaccaguggugcggaagucugauuggccucacaucucgggcaacgugggccaaaaacauccaaaccgcuauaaaucaggugaggagccuuauuggcaacgaagaguacacugauuauaugcccuccaugaagagauuccgccgggaagaggaagaggccgggguacugugguga

SEQ ID NO: 14487 - RNA, 9876 nt, Artificial Sequence
  derived and/or modified CDS sequence (opt3) from DENV-2__FJ882593__SS-prME
accgccggcgugauaguaaugcugauuccaacugcuauggcuuuccaccucacuacgagaaacggggagccucauaugauaguuggaaggcaggaaaaggguaaaagccuucuguuuaagaccgaggacggcgugaauaugugcacauugauggccaucgauuuaggggaacugugugaggacacuauuaccuacaaaugcccacuacuccggcaaaacgaaccggaggauaucgacuguuggugcaauuccacaucuaccuggguaacuuauggaacauguaccacgacuggcgagcaccgccgagaaaagcguucaguggcgcuggucccccauguggguauggggcuugagaccagaacagaaacuuggaugaguagcgagggagcuuggaaacacguucagaggauugagaccuggauccugcggcauccuggcuucacaauaauggccgcaaucuuggccuacaccauuggcacgacucacuuucagcgcgcucucaucuucauucugcugacagcaguggccccauccaugaccaugagaugcaucgggauaucuaacagggauuuugucgaaggagugucggguggcucauggguagacauuguucucgagcacgggagcugugugacuacaauggcuaagaauaagcccaccuuagauuucgaacugaucaaaacggaggccaagcagccugcgacccuucggaaauauugcauugaagcaaaguugacaaacacuaccacagagagucgcuguccaacucaaggagagcccucccugaaugaagaacaggacaaacgauuuaucugcaagcauucuauggucgauagaggcugggguaacggguguggacuauucggcaagggcgggaucgugaccugcgccauguuuacaugcaaaaagaauauggaaggaaaagugguccagccugagaaccucgaauacaccauuguuauaacuccacacagcggugaggagcaugcugugggcaaugacacggggaagcacggaaaagaaaucaagauuacaccgcaguccucaaucaccgaggccgaacugacuggcuaugguaccguaacaauggaguguagucccaggaccgggcuugauuucaacgaaauggugcuguugcaaauggaggacaaagcauggcucguccaccggcagugguuucuggauuuaccucugccauggcuccccggcgcugacacucaggagagcaauuggauacagaaggaaacacuugugacguucaagaacccucaugccaaaaagcaagacguugugguccugggaucucaggagggcgcgaugcacaccgccuugacuggggcaacagaaauucagauguccucaggaaaucuacuguuuaccggucaucucaaaugccgucugcgcauggauaaacuucaacugaaaggcaugagcuacaguauguguacagggaaguucaagaucgugaaagagaucgcugagacucagcacggaaccauuguaaucagaguucaguaugaaggcgacgguucuccaugcaagauucccuucgagauaacggauuuggagaagaggcaugugcucgggcggcugaucaccgucaacccgauugugacagagaaggacuccccugucaacaucgaagccgagcccccauuuggcgauagcuacaucauuauaggaguggagccuggccaguuaaaacugaauugguucaagaaggggucgucuaucggacaaauguuugaaacuaccaugcgaggugcuaaacgcauggccauucuaggcgacacagcaugggauuucgggucccucggaggcguuuuuacuucaaucgguaaggcccugcaccagguguucggggcuauuuacggcgcggcauuuaguggaguaagcuggaccaugaaaauccuuauaggcgucaucauuacguggaucgggaugaacuccagaucuacuagcuugucagugagucugguucucgugggagucgugacccuguaucuuggcgccguagugcaggcugacuccgguuguguugucagcuggaagaauaaagagcugaagugcgggucuggaauuuucaucacugauaacgugcacacauggaccgaacaguacaaguuucaacccgagucaccaaguaaauuggccagcgcaauacagaaggcccaugaagagggcauuugugguaucagguccgugacucggcucgagaaucugauguggaaacagauuacccccgaauuaaaccacauccugucugagaaugaagucaagcuaacaauaaugacgggcgacaucaaagggauuaugcaggcuggaaagcgcucgcucagaccucaaccaaccgagcugaaauauagcuggaagacuuggggcaaggccaaaaugcuuuccacagaaucacauaaccagaccuucuugaucgaugggccggagacagcagagugccccaauacuaacagggcguggaauagucuggaaguugaggacuacggauuuggcguguucaccacgaacauuuggcucaagcugcgugaaaaacaggacguguuuugugauucuaaguuaaugagcgcugccaucaaagacaaucgggcaguacacgccgauauggguuauuggauagaguccgcucugaacgacacauggaagauggagaaggccucauucauugaagucaaaagcugccacuggccuaagucucauacccuuugguccaaugggguguuggagagugaaaugaucauccccaaaaauuucgcaggacccguuagccagcacaacuaccgaccuggcuaucauacucaaaccgcugguccauggcaccucggcaagcuggagauggauuuugacuucugugaagggacaacuguggucgugaccgaggauugcggaaauagaggccccucucuaaggacaacgaccgccuccgggaaacugauuacugaguggugcugucgcucaugcacacucccgccucugcgguacagaggagaagacggcuguugguacgguauggagaucaggccacuuaaggaaaaggaggaaaacuugguuaauagucuggugaccgcggggcauggacagauugauaacuuuagcuuaggcguacucgguauggcccuguuccuugaggagaugcugcgcacucgaauaggcacaaaacacgcuaucuugcucgucgcagugucguuugugacccugauuacggggaauauguccuuccgggaccuaggacgugucaugguuauggugggcgccacuaugaccgaugacaucgggaugggaguaacauaucuggcucuccuggccgcauuuaaggugagacccaccuucgcggccggccuuuugcugaggaaauuaacuucuaaggaacucaugauggcuacaauugguaucgcccugcuuagccagucaaccauaccugagacaauccuggaacuaacugaugcacucgcucuggggaugauggucuugaaaauugugcgcaacauggagaaguaccaacuggccguuaccaucauggcaauuaguugcgugcccaaugccgucaucuuacagaacgcuuggaagguguccuguacgauacucgcggccguuucugugagcccacugcuucugacauccucacagcagaaagcagacuggauuccuuuggcucucaccaucaagggacugaaucccacugccaucuuucuaaccacacugagccggacaaguaaaaagagaucuuggccacuuaacgaagccauuauggcugucggcaugguauccauacucgcaagcucgcuguugaaaaaugacaucccgaugaccggcccucugguggccgggggauuacucacgguuugcuaugugcugacagguaggucagcggaucuugagcuggagcgagcugccgacgucaagugggaagaucaagcagagauuucuggcaguucccccaucuugagcauuaccaucucugaagacgggagcauguccaucaaaaacgaggaggaagaacagacucucacaauccugauucgcaccggacuacuggugaucucaggcguauucccagugaguauucccaucacugccgcugcaugguaccuuugggaagucaagaagcagcgggccgguguucucugggaugugccuagcccacccccuguggagaaagcggaacuggaggacggggcuuauagaauaaagcagaggggaauuuugggcuacucucaaaucggcgccggggucuauaaagagggaacauuucacaccauguggcaugugacgcguggugcaguuuuaaugcaccgcggcaagcggaucgaaccguccugggccgaugucaaaaaggaccugauuucauacgggggaggcuggaagcucgagggugaauggaaagagggggaagaggugcagguccuggcucuugagccaggaaagaaucccagagccgugcagacuaaaccuggcaucuucaagaccaacacaggcaccauaggggcaguuagucuggauuuuagcccaggaacauccgguucucccauuguggacaggaaaggcaaggucgugggguuguacggaaauggcguagucacucgaucgggugcuuaugugagcgccaucgcgcagaccgaaaagucaauugaggauaacccugaaaucgaggacgauauauuccggaaaaagcgccuaacgauuauggaccugcauccgggggccggaaaaacaaagagauaccuccccgcaaucguuagggaagcuaucaaacggggccugcgaacucuuauuuuagccccaaccagaguggucgcugcagagauggaggaagcccugcgcggccucccuaucagguaucaaacacccgccauuaagaccgagcacacugggcgugaaauaguggacuugaugugucaugcuaccuucacaaugcggcugcucuccccaguuagagugccuaacuacaaucugaucauuauggaugaggcgcacuuuacggaccccgcaaguaucgccgcuaggggauauaucucuacucgcgucgagaugggugaagccgcaggcauuuucaugaccgccacaccaccggggagccgagauccuuuuccccaguccaacgcuccaauaauggacgaggaaagagagauccccgaacggucauggaacucuggacacgagugggugaccgauuucaagggcaaaacuguaugguuugugccuagcauuaaggcggguaacgacaucgccgcaugccuuaggaaaaaugggaagaaaguuauucagcugagucgcaagacauucgauuccgaguacgucaagacccgugcuaacgacugggauuuuguggugacgacugacaucagcgaaaugggagccaauuucaaagcagagagagucauagauccacggagguguaugaagcccguaaucuugacagacggcgaagaacgcgugauucuagccggcccuaugccgguuacccauucuucagcugcccaacgaagagggcggaucggaaggaaccccaaaaaugaaaacgaccaguauauuuacaugggugagccccuggagaaugaugaagacugcgcgcacuggaaggaggcaaaaaugcucuuagauaacaucaauaccccugaaggcauaauucccuccauguuugagccagaacgcgagaagguggacgccaucgauggggaguacagacugaggggagaagcucggaaaacuuucgucgaccuuaugcgucgcggcgaucugccuguguggcucgccuauaagguugcugcagaggguauuaacuacgccgaccgaaagugguguuuugaugggaucaaaaauaaccagauauuggaagagaacauggagguggaaaucuggacaaaggagggcgaaaggaaaaagcugaaacccagauggcucgacgcucggauuuauagugauccacuggcccuuaaggaguucaaggaguucgcagcgggacgcaaaagccuaacccugaauuugaucacagagaugggcagauuaccuacuuuuaugacgcagaaggccaggaacgcucuggacaaucucgccguccugcauaccgcagaggcugggggacgggccuacaaccacgcacuuucggaacugccggagacacucgaaacuuugcugcuacugacccuccuugccacagugaccgguggcauuuuccuguuuuuaaugucugggaaaggaaucggcaagaugacuuuggguaugugcugcauaauuacggcuuccauccugcucugguaugcgcaaauccagccccacuggauugccgcaagcaucauacuggaguucuuucuuauuguacugcucaucccagaaccugagaaacagcgaaccccacaggauaaucaauugacauacgugguuauugcuauccugacugucguggccgccaccauggcaaacgagaugggguucuuagaaaagacaaagaaagaccuaggccugggaucaauaaccacucaggagagugaaucuaauauccucgacauugaucuuagaccagcuuccgccuggacacuguaugcgguggcuacgaccuuugucacuccuauguugcgccauagcaucgagaacucaaguguuaaugugagccugacagccauugcaaaccaggccaccguacucaugggccuggggaagggauggccccuuuccaaaauggacaucggugugccgcuccuggcuauuggcuguuacucucaggucaauccaaucaccuugacagcagcccuguuacuacugguggcgcacuacgcuauaauugggccuggacuccaagccaaggcaacuagggaagcccagaaacgggcugccgcaggcaucaugaagaaccccacgguugaugguaucaccgugauugaccuugagccaauacccuaugauccuaaguucgagaaacagcuggggcaggucauguugcugauccucugcguaacacaagugcugaugaugcguacuaccugggcucuuugugaagccuuaacacuggcgaccggcccgauuagcacucucugggagggaaaucccggcagauuuuggaacacgacaaucgccguuuccauggcaaauauuuucagggggucauacuuggcuggagccggccugcuauuuucuaucaugaagaacaccacaaguacccgccgggguacagggaauauaggagaaacucugggcgagaaauggaagucgcgacucaacgcacuugguaaaagcgaguuccagaucuauaagaaauccggcauucaggaaguggacagaacccuggcuaaggaggggaucaagaggggagaaacagaucaucacgccgucucucgcggcucagccaaauugcggugguuuguggagagaaacauggucacgccagaagggaaggugguugaccugggaugcggccgugguggguggagcuacuauuguggaggccucaaaaaugugagggagguaaagggucugaccaaaggcgggccuggacaugaggaacccauuccuauguccacuuacggcuggaacuuagugcggcuucaaaguggggucgauguuuucuucacaccacccgagaagugcgacacccugcucugugauaucggagaaucuagcccuaauccaacuauagaggcgggccgcacacuacgagugcugaacuuggucgaaaauuggcugaacaauaacacccaguuuugcauuaaggugcucaaucccuauaugccgucaguaaucgagaaaauggaggcacuucagagacaguacgguggggcacuggugaggaacccuuugucccggaauaguacgcacgaaauguacuggguuagcaacgccaccggaaauaucgugucuuccgucaacaugauuucacgcaugcugauaaauagauucacaaugaagcacaaaaaggcuacuuaugagccagacguggaucucggcagcggcaccaggaacaucgggauugaaucggagauccccaacuuagacauuaucggaaaacgaauagaaaagaucaagcaagagcaugagauuucuuggcacuacgaccaggaucauccuuauaaaacaugggccuaccacgguaguuaugaaacuaagcagaccggcuccgcaagcucaauggucaauggggugguucggcugcuuacaaaaccaugggacguagugcccauggucacccagauggccaugacugauacgacaccguuuggacaacagcguguguucaaggagaaaguugacaccagaacucaggaaccuaaggagggcaccaagaaacugaugaagaucacagcugaguggcuauggaaagaacucgguaagaaaaagacgccccgcauguguaccagggaggaauuuacuaaaaaggugcgguccaacgcggcccugggggcaauuuucacagaugagaauaaguggaaaucugcuagagaagccgucgaggacggacgcuuuugggaguugguggauagggaacgaaaccugcaccucgagggcaagugcgaaaccuguguauacaauaugaugggcaaacgggagaagaaacuuggggaguucggaaaggcaaaggguagcagagccaucugguauauguggcugggcgcuagguuuuuagaguucgaggcccugggguuuuugaacgaagaccauugguucagucgcggaaauucccucagcggcguggagggugaagggcugcaccgucuaggauacauucuucgggauguuggcaaaaaggagggcggggcgauguacgcagacgauacugccggaugggacacaagaauaacccuggaagaccucaaaaacgaggagauggucacaaaucauaugaagggugaacacaaaaagcuggcugaggccaucuuuaaguugacuuaucagaacaaaguggugaggguccaacgcccaaccccucgaggcacgguuauggauauuaucucucggagagaccagagggggucaggacaggugggcaccuacggucugaauacauucacuaacauggaagcacaacucauccgccagauggagggggagggaauuuucaagaguauacagcaucuuaccgcuacagaagagaucgccguacagaauuggcuggcuagagugggccgggaaagguuaucccguauggccauuagcggcgaugacugcgucgugaaacccaucgaugaccgauuugcaucugcgcugacugccuugaacgauauggggaagguucgcaaagacauucaacagugggagccaucgagaggauggaaugauuggacccaggugcccuucugcucacaccacuuucaugaacucgucaugaaggacggucgggugcugguaguuccuuguaggaaccaggaugagcuaaucggccgcgcuagaauaagccaaggggccggauggucccuuaaggagacggcaugccugggcaaaaguuaugcucagauguggacacucauguacuuccaccggagggaccugcgauuggccgcaaacgccaucuguucugcggugccaagccauugggucccgaccucccguacuacauggucaauucacgcuaagcacgaauggaugaccacugaggauauguuagccguguggaauagaguguggauccaggaaaaccccuggauggaggacaaaaccccugucgaaaguugggaggagguuccauaucuggguaagcgcgaagaccaguggugcgggucucucauuggacuuacaagccgggcaacgugggccaaaaauauccaaaccgcuauaaaccaggugaggucccugauuggcaaugaggaauacacugauuauaugcccucaaugaagagauuucgccgggaggaagaggaggccggcguacuaugguga

SEQ ID NO: 14488 - RNA, 9876 nt, Artificial Sequence
  derived and/or modified CDS sequence (opt3) from DENV-2__FJ182014__SS-prME
accgccggcgugaucgucaugcugauucccacagcuauggcauuccaccucacuacgagaaacggggagccucauaugauaguuggaaggcaggaaaaggguaaaagccuucuguuuaagaccgaggacggcgugaauaugugcacauugauggccaucgauuuaggggaacugugugaggacacuauuaccuacaaaugcccauuccuacggcaaaacgaaccggaggauaucgacuguuggugcaauuccacaucuaccuggguaacuuauggaacauguaccacgacuggcgagcaccgccgagaaaagcguucaguggcgcucgucccccauguggguauggggcuggagaccagaacagaaacuuggaugaguagcgagggagcuuggaaacacguucagaggauugagaccuggauccuucggcauccuggcuuuacaauaauggccgcaauccuggccuacaccauuggcacgacucacuuccagcgcgcuuugaucuuuauucuccugacagcaguggccccauccaugaccaugagaugcaucgggauaucuaacagggauuucgucgaaggagugucggguggcucauggguagacauuguucuggagcacgggagcugugugacuacaauggcuaagaauaagcccacccucgauuuugaauuaaucaaaacggaggccaagcagccugcgacccugcggaaauauugcauugaagcaaagcuuacaaacacuaccacagagagucgcuguccaacucaaggagagcccuccuugaaugaagagcaggacaaacgauucaucugcaagcauucuauggucgauagaggcugggguaacggguguggacuguuuggcaagggcgggaucgugaccugcgccauguucacaugcaaaaagaauauggaaggaaaagugguccagccugagaaccuagaauacaccauuguuauaacuccacacagcggugaggagcaugcugugggcaaugacacggggaagcacggaaaagaaaucaagauuacaccgcaguccucaaucaccgaggccgaacucacuggcuaugguaccguaacaauggaguguagucccaggaccgggcuggauuuuaacgaaauggugcuucugcaaauggaggacaaagcaugguugguccaccggcagugguuccucgaucugccuuuaccauggcugcccggcgcugacacucagggaagcaauuggauacagaaggagacacucgugacguuuaagaacccucaugccaaaaagcaagacguugugguccuuggcucucaggaaggggcgaugcacaccgcccugacuggagcaacagagauucagauguccucagguaauuugcuauucaccggccaucugaaaugccgucuccgcauggauaagcugcaacuuaaagggaugagcuacaguauguguacaggaaaguucaagaucgugaaagaaaucgcugagacucagcacggcaccauuguaaucagaguucaguaugagggugacgggucuccaugcaagauucccuuugaaauaacggaucuggagaaaaggcauguguugggccggcucaucaccgucaacccgauugugacagaaaaggacuccccugucaacaucgaggccgaacccccauucggagauagcuacaucauuauaggcguggagccugggcagcugaaauuaaauugguuuaagaagggaucgucuaucggucaaauguucgagacuaccaugcgaggcgcuaaacgcauggccauucugggggacacagcaugggauuuuggaucccuaggcgguguuuucacuucaaucgggaaggcccuccaccagguguuuggcgcuauuuacggagcggcauucaguggcguaagcuggaccaugaaaauccugauaggggucaucauuacguggaucggaaugaacuccagaucuacaagccuuucagugaguuugguucuggugggcgucgugacccucuaucugggugccguagugcaggcugacuccggguguguugucagcuggaagaauaaagaacuuaagugcggaucuggcauuuuuaucacugauaacgugcacacauggaccgagcaguacaaguuccaacccgaaucaccaaguaaacuggccagcgcaauacagaaggcccaugaggaagguauuuguggcaucagguccgugacucgguuggagaaucucauguggaaacagauuacccccgagcugaaccacaucuuaucugaaaaugaggucaagcugacaauaaugacgggggacaucaaaggaauuaugcaggcuggcaagcgcucgcuaagaccucaaccaaccgaacucaaauauagcuggaagacuugggggaaggccaaaaugcuguccacagagucacauaaccagaccuuucuuaucgauggaccggaaacagcagagugccccaauacuaacagggcguggaauaguuuggagguugaagacuacggcuucgguguguuuaccacgaacauuuggcugaagcuccgugagaaacaggacguguucugugauucuaagcugaugagcgcugccaucaaagacaaucgggcaguacacgccgauaugggguauuggauagaauccgcuuuaaacgacacauggaagauggagaaggccucauucauugaggucaaaagcugccacuggccuaagucucauacccugugguccaauggagugcuugaaagugagaugaucaucccaaaaaacuuugcaggccccguuagccagcacaacuaccgaccugguuaucauacucaaaccgcuggcccauggcacuuggggaagcucgaaauggauuucgacuuuugugagggaacaacuguggucgugaccgaagauugcggcaauagagggcccucucugaggacaacgaccgccuccggaaaacuaauuacugaguggugcugucgcucaugcacacugccgccucuccgguacagaggcgaggacgguuguugguacgggauggaaaucaggccacugaaggagaaggaagagaaccuuguuaauaguuuggugaccgcgggacauggccagauugauaacuucagccuggguguauuaggcauggcccucuuucuggaagagaugcuucgcacucgaauagggacaaaacacgcuauccuguuggucgcagugucguucgugacccucauuacgggaaauauguccuuucgggaccugggccgugucaugguuauggugggggccacuaugaccgaugacaucggaaugggcguaacauaucuagcucugcucgccgcauucaaggugagacccaccuuugcggccggucugcuuuugaggaaacugacuucuaaggaguuaaugauggcuacaauugggaucgcccuccugagccagucaaccauaccugaaacaauccuugagcugacugaugcacuagcucucggaaugaugguccugaaaauugugcgcaacauggaaaaguaccaauuggccguuaccaucauggcaauuaguugcgugcccaaugccgucauccugcagaacgcuuggaagguguccuguacgauauuagcggccguuucugugagcccacuccugcuuacauccucacagcagaaagcagacuggauuccucuggcuuugaccaucaagggccucaaucccacugccaucuuccugaccacacuaagccggacuaguaaaaagagaucuuggccacugaacgaggccauuauggcugucggcaugguauccauacuugcaagcucgcuccugaaaaaugacaucccgaugaccgggccuuugguggccggaggucuguuaacgguuugcuaugugcucacaggcaggucagcggaucuggaacuugagcgagcugccgacgucaagugggaggaucaagcagaaauuucugggaguucccccauccugagcauuaucauaucugaggacggaagcauguccaucaaaaacgaagaggaggaacagaccuugacuauucucauccgcacaggccugcuagugauuucagguguauuuccagugaguauccccauaaccgccgcugcaugguaccugugggaggucaagaagcagcgggccgggguucuuugggaugugccuagcccacccccuguggaaaaagcggagcucgaagacggagcuuauagaauuaagcagaggggcauccugggcuacucucaaaucggggccggagucuauaaagaggguacuuuccacacaauguggcaugugacccguggcgcaguuuugaugcaccgcgggaagcggauugagccguccugggccgauguaaaaaaggacuuaaucucauacggaggcgguuggaagcuggaaggggaguggaaagaaggagaggaagugcagguccucgcucuggagccaggcaagaaucccagagccgugcagacgaaaccuggcauauuuaagacuaacaccgggacaauuggagcaguuagucuugauuucagcccagguaccuccggcucucccaucguggacaggaaagggaaggucgugggacuguacggcaaugguguagucacacgaucgggggcuuaugugagcgccauugcgcagacugagaagucaaucgaagauaacccugagauagaagacgauauuuuccggaaaaagcgcuugaccaucauggaccuacauccgggagccggcaaaacgaagagauaccugcccgcaaucguuagggaggcuauuaaacggggccuccgaacacugauccuugccccaacuagaguggucgcugcagaaauggaggaggccuuacgcgggcugccuauuagguaucaaacccccgccauaaagacagaacacaccggacgugagaucguggaccucaugugucaugcuacuuuuaccaugcgguugcuguccccaguuagagugccuaacuacaaucucauuaucauggaugaagcgcacuucacagaccccgcaaguaucgccgcuagggguuauauuucuacgcgcgucgagaugggcgaggccgcagggauauuuaugacugccaccccaccgggaagccgagauccuuucccccaguccaacgcuccaaucauggacgaagagagagaaauucccgagcggucauggaauucuggccacgaaugggugacagauuuuaaggguaaaaccguaugguucgugccuagcaucaaggcggggaacgacauugccgcaugccugaggaaaaauggaaagaaaguuauccagcuuagucgcaagacuuuugauuccgaguacgucaagacacgugcuaacgacugggauuucguggugaccacggacauaagcgagaugggcgccaauuuuaaagcagaaagagucaucgauccacggagguguaugaagcccguaauucugacugacggcgaggaacgcgugaucuuggccgggccuaugccgguuacacauucuucagcugcccaacgaagaggacggauugguaggaacccaaaaaaugagaacgaccaguauaucuacaugggcgaaccccuagagaaugaugaggacugcgcgcacuggaaggaagcaaaaaugcugcucgauaacauaaauaccccugaggggauuauccccuccauguucgaaccagagcgcgaaaagguggacgccauugauggagaguacagauuaaggggcgaggcucggaaaaccuuugucgaccugaugcgucgcggugaucuuccuguguggcuggccuauaagguugcugcagaagggaucaacuacgccgaccgaaagugguguuucgauggcauaaaaaauaaccagauccucgaggaaaacauggagguggagauuuggacuaaggaaggagagagaaaaaaguugaaacccagguggcuggacgcucggaucuauagugauccacucgcccugaaggaauucaaggaguuugcagcgggccgcaaaagccuuacacuaaaucugauuaccgaaauggggagauugccuacauucaugacucagaaggccaggaacgcuuuagacaaucuggccguccuccauacggcagaggcuggaggucgggccuacaaccacgcacugucggagcuuccggaaacccuggagacacucuugcugcuaacucugcucgccaccgugacaggcgggaucuuucuuuuccugaugucuggaaaaggcauagguaagaugaccuuagggaugugcugcauuaucacugcuuccaucuugcugugguaugcgcaaauucagccccacuggaucgccgcaagcauaauucucgaauuuuuccugaucguacuucugauuccagagccugaaaaacagcgaacgccccaggauaaucaacucaccuacgugguuaucgcuauauugacagucguggccgccacuauggcaaacgagaugggcuuucuggagaagaccaagaaagacuuaggacuaggcucaaucacaacccaggaaagugagucuaauauucuggacaucgaucucagaccagcuuccgccuggacucuuuaugcgguggcuacaacguucgucaccccuaugcugcgccauagcauugaaaacucaaguguuaaugugagcuugacugccaucgcaaaccaggccacaguacugauggggcucggaaaggguuggccccuguccaaaauggacauuggcgugccgcuucucgcuaucggguguuacucucaggucaauccaauaacccugaccgcagccuugcuguuacuaguggcgcacuacgcuauuaucggaccuggccugcaagccaaggcaacaagggaggcccagaaacgggcugccgcagguaucaugaagaaccccacuguugaugggauuacggugauagaccucgaaccaauccccuaugauccuaaguuugagaaacagcuuggccaggucaugcuguugauucugugcguaacccaagugcucaugaugcguacaacuugggcucugugugaggcccuuaccuuagcgacaggaccgaucagcacccugugggaaggcaaucccgggagauucuggaacacuacgauugccguuuccauggcaaauaucuuuaggggaucauaccucgcuggcgccgguuugcuguucucuauaaugaagaacacaaccaguacucgccgggggaccggaaauaucggcgagacacuaggugaaaaauggaagucgcgacugaacgcacucggcaaaagcgaguuucagauuuauaagaaauccgggauccaggagguggacagaacucuugcuaaggaaggaauuaagaggggcgagaccgaucaucacgccgucucucgcgggucagccaaacugcggugguucguggaaagaaacauggucacaccagagggaaaggugguugacuugggcugcggucgugggggauggagcuacuauuguggcggucugaaaaaugugagggaaguaaagggccucacgaaagggggaccuggccaugaggagcccaucccuauguccaccuacggguggaaccuggugcgguuacaaaguggagucgauguuuucuuuacuccacccgaaaagugcgacacacuucugugugauauaggcgagucuagcccuaauccaaccauugaagcgggucgcacucuccgagugcuaaaccuggucgagaauugguugaacaauaacacacaguucugcaucaaggugcugaaucccuauaugccgucaguaaucgaaaaaauggaggcucuccagagacaguacgggggagcacuugugaggaacccucugucccggaauaguacccacgagauguacuggguuagcaacgccacgggcaauauugugucuuccgucaacaugauaucacgcauguugaucaauagauuuaccaugaagcacaaaaaggcuacauaugaaccagacguggaucugggcagcgggacuaggaacauuggaaucgagucggaaauucccaaccucgacaucauagguaaacgaaucgagaagauuaagcaagaacaugagaucucuuggcacuacgaccaggaucauccuuauaaaaccugggccuaccacggcaguuaugagacaaagcagacuggguccgcaagcucaauggucaauggagugguucgguuacugaccaaaccaugggacguagugcccauggucacacagauggccaugaccgauacuacgccguucggccaacagcguguguuuaaggaaaaaguugacacaagaacccaggagccuaaggaagguacuaagaaacuuaugaagauuaccgcugaguggcuguggaaagagcuagggaagaaaaagacaccccgcauguguacgagggaagaguucaccaaaaaggugcgguccaacgcggcccucggagcaaucuuuacugaugaaaauaaguggaaaucugcuagagaggccgucgaagacggccgcuucugggagcugguggauagggagcgaaacuugcaccuggaaggcaagugcgagacauguguauacaauaugauggggaaacgggaaaagaaacucggagaguuugguaaggcaaagggcagcagagccauuugguauauguggcuuggggcuagguuccuggaauuugaggccuuaggauuccugaacgaggaccauugguuuagucgcggcaauuccuugagcgguguggaaggggagggacuccaccgucugggcuacauacuacgggauguuggcaaaaaggaagggggagcgauguacgcagacgauaccgccgguugggacacuagaaucacacuugaggaccugaaaaacgaagagauggucaccaaucauaugaagggcgagcacaaaaagcucgcugaagccauuuucaagcugacauaucagaacaaaguggugaggguccaacgcccaacuccucgagggaccguuauggauaucaucucucggagagaccagaggggaucaggccagguggguacguacggguugaauaccuucacaaacauggaggcacaacugauucgccagauggaaggagagggcauauuuaagaguauccagcaucucacugcuaccgaggaaauugccguacagaauuggcuugcuagagugggccgggagaggcugucccguauggccaucagcggggaugacugcgucgugaaacccauugaugaccgauucgcaucugcguuaacagcccugaacgauaugggaaagguucgcaaagacauccaacagugggaaccaucgagagguuggaaugauuggacucaggugcccuuuugcucacaccacuuccaugaguuggucaugaaggacggccgggugcucguaguuccuuguaggaaccaggaugaacugauagggcgcgcuagaaucagccaaggagccggcuggucccuaaaggagaccgcaugccuugguaaaaguuaugcucagauguggacgcugauguacuuucaccggagggaccuccgacuggccgcaaacgccauuuguucugcggugccaagccauugggucccgacaucccguaccacuuggucaauccacgcuaagcacgaguggaugacaaccgaagauauguuggccguguggaauagaguguggauucaggagaaccccuggauggaagacaaaacuccugucgagaguugggaagagguuccauauuuagggaagcgcgaggaccaguggugcggaucucugaucggccucaccagccgggcaacaugggccaaaaauauacaaacggcuauuaaccaggugaggucccuuaucggcaaugaagaguacaccgauuauaugcccucaaugaagagauuccgccgggaagaggaagaggccgggguacugugguga

SEQ ID NO: 14489 - RNA, 9876 nt, Artificial Sequence
  derived and/or modified CDS sequence (opt3) from DENV-2__FJ547090__SS-prME
accgcaggcgugauaguaaugcugauucccacggcuauggcuuuccaccucacuacgagaaacggggaaccucauaugauaguuggaaggcaggaaaaggguaaaagccuucuguuuaagaccgaagacggcgugaauaugugcacauugauggccaucgauuuaggggaacugugugaagacacuauuaccuacaaaugcccacuacuccggcaaaacgaaccggaggauaucgacuguuggugcaauuccacaucuaccuggguaacuuauggaacauguaccacgacuggcgagcaccgccgagaaaagcguucaguggcgcuggucccccauguggguauggggcuugagaccagaacagaaacuuggaugaguagcgagggagcuuggaaacacguucagaggauugagaccuggauccugcggcauccuggcuucacaauaauggccgcaaucuuggccuacaccauuggcacgacucacuuucagcgcgcucucaucuucauucugcugacagcaguggccccauccaugaccaugagaugcaucgggauaucuaacagggauuuugucgaaggagugucggguggcucauggguagacauuguucucgagcacgggagcugugugacuacaauggcuaagaauaagcccaccuuagauuucgaacugaucaaaacggaggccaagcagccugcgacccuucggaaauauugcauugaagcaaaguugacaaacacuaccacagagagucgcuguccaacucaaggagagcccucccugaaugaagaacaggacaaacgauuuaucugcaagcauucuauggucgauagaggcugggguaacggguguggacuauucggcaagggcgggaucgugaccugcgccauguuuacaugcaaaaagaauauggaaggaaaagugguccagccugagaaccucgaauacaccauuguuauaacuccacacagcggugaggagcaugcugugggcaaugacacggggaagcacggaaaagaaaucaagauuacaccgcaguccucaaucaccgaggccgaacugacuggcuaugguaccguaacaauggaguguagucccaggaccgggcuugauuucaacgaaauggugcuguugcaaauggaggacaaagcauggcucguccaccggcagugguuucuggauuuaccucugccauggcuccccggcgcugacacucagggaagcaauuggauacagaaggagacacuugugacguucaagaacccucaugccaaaaagcaagacguugugguccugggcucucaggaaggggcgaugcacaccgccuugacuggagcaacagagauucagauguccucagguaaucuacuguuuaccggccaucucaaaugccgucugcgcauggauaaacuucaacugaaagggaugagcuacaguauguguacaggaaaguucaagaucgugaaagaaaucgcugagacucagcacggcaccauuguaaucagaguucaguaugagggugacgggucuccaugcaagauucccuucgaaauaacggauuuggagaaaaggcaugugcucggccggcugaucaccgucaacccgauugugacagaaaaggacuccccugucaacaucgaggccgaacccccauuuggagauagcuacaucauuauaggcguggagccugggcaguuaaaacugaauugguucaagaagggaucgucuaucggucaaauguuugagacuaccaugcgaggcgcuaaacgcauggccauucuaggggacacagcaugggauuucggaucccucggcgguguuuuuacuucaaucgggaaggcccugcaccagguguucggcgcuauuuacggagcggcauuuaguggcguaagcuggaccaugaaaauccuuauaggggucaucauuacguggaucggaaugaacuccagaucuaccagcuugucagugagucugguucucgugggcgucgugacccuguaucuuggugccguagugcaggcugacuccggguguguugucagcuggaagaauaaagaacugaagugcggaucuggcauuuucaucacugauaacgugcacacauggaccgagcaguacaaguuucaacccgaaucaccaaguaaauuggccagcgcaauacagaaggcccaugaggaagguauuuguggcaucagguccgugacucggcucgagaaucugauguggaaacagauuacccccgaguuaaaccacauccugucugaaaaugaggucaagcuaacaauaaugacgggggacaucaaaggaauuaugcaggcuggcaagcgcucgcucagaccucaaccaaccgaacugaaauauagcuggaagacuugggggaaggccaaaaugcuuuccacagagucacauaaccagaccuucuugaucgauggaccggaaacagcagagugccccaauacuaacagggcguggaauagucuggagguugaagacuacggcuuugguguguucaccacgaacauuuggcucaagcugcgugagaaacaggacguguuuugugauucuaaguuaaugagcgcuacaaucaaagacaaucgggccguacacgcagauaugggguauuggauagaauccgcccugaacgacaccuggaagauggagaaggcuucauucauugaggucaaaagcugccacuggccuaagucucauacucuuugguccaauggaguguuggaaagugagaugaucauccccaagaauuucgccggccccguuagccagcacaacuaccgacucgguuaucauacccaaacagcaggcccuuggcaccuggggaagcuagaaauggauuuugacuucugugagggaacuaccguggucgugacagaagauugcggcaauagagggccaucucugaggacgaccacugcuuccggaaaacucauuacagaguggugcugucgcucaugcacccugcccccgcuucgguacagaggcgaggacgguuguugguacgggauggaaaucaggccuuugaaggagaaggaagagaaccugguuaauaguuuagugacugccggacauggccagauugauaacuuuagccucgguguacugggcauggcgcuuuuccuggaagagauguugcgcacacgaauagggaccaaacacgccauccuccuggucgcugugucguuugugacgcuaauuacuggaaauauguccuuccgggaccugggccgugucaugguuauggugggggcaaccaugacagaugacaucggaaugggcguaaccuaucucgcccugcuugcugccuuuaaggugagaccaacuuucgcagcggguuugcuguuaaggaaacucacaucuaaggagcugaugauggccaccauugggaucgcacuucugagccagucaacaauacccgaaacuauccuagagcucaccgaugcccuggcauugggaaugaugguccugaaaauugugcgcaacauggaaaaguaccaauuagcuguuacgaucauggccauuaguugcgugccuaaugcagucauccuccagaacgccuggaagguguccuguacaauacuggcugcgguuucugugagcccccuucuguugaccuccucacagcagaaagccgacuggauuccacucgcacugacuaucaagggccuaaauccuaccgcuaucuuucugacaacucuuagccggaccaguaaaaagagaucuuggccccucaacgaggccauuauggccgucggcaugguauccauacuggcuagcucguugcugaaaaaugacaucccaaugacggggccguuaguggcaggaggucuccugacaguuugcuaugugcuuaccggcaggucagccgaucuggaauuggagcgagcggcugacgucaagugggaggaucaagccgaaauuucugggaguuccccuauccucagcauuacuaucucugaggacggaagcauguccaucaaaaacgaagaggaggaacagacacugaccauccuaauucgcacuggccugcuugugaucucagguguauuccccgugaguauuccaaucacagcagccgcuugguaccucugggaggucaagaagcagcgggcagggguucugugggaugugcccagcccuccacccguggaaaaagccgaguuggaagacggagcguauagaauaaagcagaggggcauuuuaggcuacucucaaaucggggcuggagucuauaaagaggguaccuuucacacgauguggcaugugacucguggcgccguucugaugcaccgcgggaagcggaucgagccuuccugggcagaugucaaaaaggaccucauuucauacggaggcgguuggaagcuggaaggggaguggaaagaaggagaggaagugcagguccuugcccuggagccgggcaagaauccaagagcugugcagaccaaacccggcaucuucaagacaaacaccgggacaauaggagccguuaguuuggauuuuagcccugguacuuccggcucuccaauuguggacaggaaagggaaggucgugggacuauacggcaaugguguagucacccgaucgggggcauaugugagcgcuaucgcccagacggagaagucaauugaagauaaccccgagaucgaagacgauauauuccggaaaaagcgccugacaauuauggaccuccauccuggagcgggcaaaacuaagagauaccugccggccaucguuagggaggcaaucaaacggggccuucgaaccuuaauucuggcucccacaagaguggucgccgcugaaauggaggaggcacuccgcggguugccaaucagguaucaaaccccugccauuaagacugaacacaccggacgugagauaguggaccugaugugucaugccacauucacgaugcggcuccugucccccguuagagugccaaacuacaaucuuaucauuauggaugaagcucacuuuacugacccugcgaguaucgcagccagggguuauaucucuacccgcgucgagaugggcgaggcugccgggauuuucaugacagcaacaccaccaggaagccgagauccguuuccucaguccaacgcccccauaauggacgaagagagagaaaucccagagcggucauggaacucuggccacgaaugggugacugauuucaaggguaaaacaguaugguuugugcccagcauuaaggcugggaacgacaucgcggccugccugaggaaaaauggaaagaaaguuauucaguugagucgcaagaccuucgauuccgaguacgucaagacgcgugcaaacgacugggauuuuguggugacuacagacaucagcgagaugggcgcuaauuucaaagccgaaagagucauagauccucggagguguaugaagccaguaauccuaaccgacggcgaggaacgcgugauucuggcagggcccaugccuguuacccauucuucagccgcucaacgaagaggacggaucgguaggaacccgaaaaaugagaacgaccaguauauuuacaugggcgaaccacucgagaaugaugaggacugcgcccacuggaaggaagcgaaaauguuacuggauaacaucaauacucccgaggggauaauuccuuccauguuugaacccgagcgcgaaaagguggacgcaaucgauggagaguacagacuuaggggcgaggcccggaaaacauucgucgaccugaugcgucgcggugaucucccagugugguuggcuuauaagguugccgcugaagggauuaacuacgcagaccgaaagugguguuuugauggcaucaaaaauaaccagauacuggaggaaaacauggagguggagaucuggaccaaggaaggagagaggaaaaagcucaaaccuagauggcuggacgcccggauuuauagugauccccuugcucuaaaggaguucaaggaguucgccgcaggccgcaaaagccugacauugaauuuaaucacugaaauggggagacugccaacguuuaugacccagaaggcgaggaacgcccucgacaaucuggcuguccuucauacagccgaggcaggaggucgggcuuacaaccacgcccugucggagcucccugaaacuuuggagacccugcuacugcucacacuucuggcaaccgugacuggcgggauuuucuuauuuuugaugucuggaaaaggcaucgguaagaugacgcuggggaugugcugcauaauuaccgccuccauccuccugugguaugcucaaauccagccgcacuggauugcggccagcaucauacuugaguucuuucugauuguacucuugauccccgagccagaaaaacagcgaacaccucaggauaaucaacugacuuacgugguuauugcaaucuuaaccgucguggcugccacaauggccaacgagaugggcuuccuagagaagaccaagaaagaccugggacucggcucaauaacuacacaggaaagugagucuaauauccuugacauugaucugagacccgcauccgcuuggacguuguaugccguggcgaccacuuuugucacaccaaugcugcgccauagcaucgaaaacucaaguguuaaugugagccucaccgcuauugccaaccaggcaaccguacugauggggcuuggaaaggguuggccucucuccaaaauggacaucggcgugccccuguuggccauuggguguuacucucaggucaauccgaucacacugacugcugcauuacuacugcucguggcccacuacgcgauaauuggaccaggccuucaagcuaaggccacgagggaggcacagaaacgggccgcugccgguaucaugaagaacccuaccguugaugggaucacagugauugaccuggaacccauaccauaugaucccaaguucgagaaacaguugggccaggucaugcugcucauccugugcguaacucaagugcuuaugaugcguaccacaugggcauuaugugaggcucugacccucgccacuggaccuauuagcacguugugggaaggcaauccggggagauuuuggaacacaaccaucgcgguuuccauggccaauauuuucaggggaucauaccuggcaggcgcuggucuacuguuuucuaucaugaagaacacuaccaguacacgccgggggacuggaaauauaggcgagacccucggugaaaaauggaagucgcgacuuaacgcccugggcaaaagcgaguuccagaucuauaagaaauccgggauucaggagguggacagaacauuggcaaaggaaggaaucaagaggggcgagacggaucaucacgcugucucucgcgggucagccaaacugcggugguuuguggaaagaaacauggucacccccgagggaaaggugguugaccucggcugcggucgugggggauggagcuacuauuguggcggucugaaaaaugugagggaaguaaagggcuuaacuaaagggggaccaggccaugaggagccuauucccauguccacauacggguggaaccuugugcggcugcaaaguggagucgauguuuucuucaccccuccagaaaagugcgacacucuccuaugugauaucggcgagucuagccccaauccuacaauagaagccggucgcacccugcgaguguugaaccuggucgagaauuggcucaacaauaacacgcaguuuugcauuaaggugcuuaauccauauaugcccucaguaaucgagaaaauggaggcgcugcagagacaguacgggggagcuuuggugaggaacccgcugucccggaauaguacccacgagauguacuggguuagcaacgcaacaggcaauaucgugucuuccgucaacaugauuucacgcaugcucauaaauagauucacuaugaagcacaaaaaggccaccuaugaaccugacguggauuuaggcagcgggacaaggaacaucggaauugagucggaaaucccaaaccuggacauuaucgguaaacgaauagagaagaucaagcaagaacaugagauuucuuggcacuacgaccaggaucaucccuauaaaacuugggcuuaccacggcaguuaugagaccaagcagacaggguccgccagcucaauggucaauggagugguucggcuucugaccaaaccuugggacguagugccaauggucacucagauggcaaugacggauacaacccccuuuggccaacagcguguguucaaggaaaaaguugacacuagaacccaggagccgaaggaagguacaaagaaacuaaugaagaucacggccgaguggcucuggaaagagcuggggaagaaaaagaccccucgcauguguacuagggaagaguuuaccaaaaaggugcgguccaacgcugcguugggagccauuuucaccgaugaaaauaaguggaaaucugcaagagaggcugucgaagacggccgcuuuugggagcugguggauagggagcgaaaccuccaccuugaaggcaagugcgagacuuguguauacaauaugauggggaaacgggaaaagaaacugggagaguucgguaaggccaagggcagcagagcaaucugguauaugugguuaggggccagguuucuggaguucgaggcuuugggauuucucaacgaggaccauugguucagucgcggcaauucccugagcgguguggaaggggagggacuacaccgucuuggcuacauucugcgggauguuggcaaaaaggaagggggagccauguacgcggacgauacagcagguugggacaccagaauaacacucgaggaccugaaaaacgaagagauggucacuaaucauaugaagggcgagcacaaaaaguuggccgaagcuaucuuuaagcugaccuaucagaacaaaguggugaggguccaacgccccacgccacgagggaccguuauggauauuaucucucggagagaccagaggggaucaggccagguggguacauacgggcucaauacuuucaccaacauggaggcccaacuuauccgccagauggaaggagagggcauuuucaagaguauacagcaucugacagcaacugaggaaaucgcuguacagaauugguuagccagagugggccgggagaggcugucccguauggcuauuagcggggaugacugcgucgugaaaccuaucgaugaccgauuugccucugcauugaccgcgcucaacgauaugggaaagguucgcaaagacauucaacagugggaacccucgagagguuggaaugauuggacacaggugccauucugcucacaccacuuucaugagcuggucaugaaggacggccgggugcuaguaguucccuguaggaaccaggaugaacuuaucgggcgcgccagaauaagccaaggagcuggcuggucccugaaggagacagccugccucgguaaaaguuaugcacagauguggacccugauguacuuccaccggagggacuugcgauuagcugccaacgcaaucuguucugccgugccuagccauugggucccaacuucccguacaaccuggucaauucacgcgaagcacgaguggaugacuaccgaagauaugcuggcuguguggaauagaguguggauccaggagaacccguggauggaagacaaaacacccgucgagaguugggaagagguuccuuaucucgggaagcgcgaggaccaguggugcggaucucuuauuggccugacgagccgggccaccugggccaaaaauauccaaacugccauaaaccaggugaggucccuaauuggcaaugaagaguacacagauuauaugccaucaaugaagagauuucgccgggaagaggaagaggcugggguacugugguga

SEQ ID NO: 14490 - RNA, 9876 nt, Artificial Sequence
  derived and/or modified CDS sequence (opt3) from DENV-2__EU482630__SS-prME
accgccggcgugaucgucaugcugauucccacagcuauggcauuccaccucacuacgagaaacggggagccucauaugauaguuggaaggcaggaaaaggguaaaagccuucuguuuaagaccgaggacggcgugaauaugugcacauugauggccaucgauuuaggggaacugugugaggacacuauuaccuacaaaugcccauuccuacggcaaaacgaaccggaggauaucgacuguuggugcaauuccacaucuaccuggguaacuuauggaacauguaccacgacuggcgagcaccgccgagaaaagcguucaguggcgcucgucccccauguggguauggggcuggagaccagaacagaaacuuggaugaguagcgagggagcuuggaaacacguucagaggauugagaccuggauccuucggcauccuggcuuuacaauaauggccgcaauccuggccuacaccauuggcacgacucacuuccagcgcgcuuugaucuuuauucuccugacagcaguggccccauccaugaccaugagaugcaucgggauaucuaacagggauuucgucgaaggagugucggguggcucauggguagacauuguucuggagcacgggagcugugugacuacaauggcuaagaauaagcccacccucgauuuugaauuaaucaaaacggaggccaagcagccugcgacccugcggaaauauugcauugaagcaaagcuuacaaacacuaccacagagagucgcuguccaacucaaggagagcccuccuugaaugaagagcaggacaaacgauucaucugcaagcauucuauggucgauagaggcugggguaacggguguggacuguuuggcaagggcgggaucgugaccugcgccauguucacaugcaaaaagaauauggaaggaaaagugguccagccugagaaccuagaauacaccauuguuauaacuccacacagcggugaggagcaugcugugggcaaugacacggggaagcacggaaaagaaaucaagauuacaccgcaguccucaaucaccgaggccgaacucacuggcuaugguaccguaacaauggaguguagucccaggaccgggcuggauuuuaacgaaauggugcuucugcaaauggaggacaaagcaugguugguccaccggcagugguuccucgaucugccuuuaccauggcugcccggcgcugacacucagggaagcaauuggauacagaaggagacacucgugacguuuaagaacccucaugccaaaaagcaagacguugugguccuuggcucucaggaaggggcgaugcacaccgcccugacuggagcaacagagauucagauguccucagguaauuugcuauucaccggccaucugaaaugccgucuccgcauggauaagcugcaacuuaaagggaugagcuacaguauguguacaggaaaguucaagaucgugaaagaaaucgcugagacucagcacggcaccauuguaaucagaguucaguaugagggugacgggucuccaugcaagauucccuuugaaauaacggaucuggagaaaaggcauguguugggccggcucaucaccgucaacccgauugugacagaaaaggacuccccugucaacaucgaggccgaacccccauucggagauagcuacaucauuauaggcguggagccugggcagcugaaauuaaauugguuuaagaagggaucgucuaucggucaaauguucgagacuaccaugcgaggcgcuaaacgcauggccauucugggggacacagcaugggauuuuggaucccuaggcgguguuuucacuucaaucgggaaggcccuccaccagguguuuggcgcuauuuacggagcggcauucaguggcguaagcuggaccaugaaaauccugauaggggucaucauuacguggaucggaaugaacuccagaucuacaagccuuucagugaguuugguucuggugggcgucgugacccucuaucugggugccguagugcaggcugacuccggguguguugucagcuggaagaauaaagaacuuaagugcggaucuggcauuuuuaucacugauaacgugcacacauggaccgagcaguacaaguuccaacccgaaucaccaaguaaacuggccagcgcaauacagaaggcccaugaggaagguauuuguggcaucagguccgugacucgguuggagaaucucauguggaaacagauuacccccgagcugaaccacaucuuaucugaaaaugaggucaagcugacaauaaugacgggggacaucaaaggaauuaugcaggcuggcaagcgcucgcuaagaccucaaccaaccgaacucaaauauagcuggaagacuugggggaaggccaaaaugcuguccacagagucacauaaccagaccuuucuuaucgauggaccggaaacagcagagugccccaauacuaacagggcguggaauaguuuggagguugaagacuacggcuucgguguguuuaccacgaacauuuggcugaagcuccgugagaaacaggacguguucugugauucuaagcugaugagcgcugccaucaaagacaaucgggcaguacacgccgauaugggguauuggauagaauccgcuuuaaacgacacauggaagauggagaaggccucauucauugaggucaaaagcugccacuggccuaagucucauacccugugguccaauggagugcuugaaagugagaugaucaucccaaaaaacuuugcaggccccguuagccagcacaacuaccgaccugguuaucauacucaaaccgcuggcccauggcacuuggggaagcucgaaauggauuucgacuuuugugagggaacaacuguggucgugaccgaagauugcggcaauagagggcccucucugaggacaacgaccgccuccggaaaacuaauuacugaguggugcugucgcucaugcacacugccgccucuccgguacagaggcgaggacgguuguugguacgggauggaaaucaggccacugaaggagaaggaagagaaccuuguuaauaguuuggugaccgcgggacauggccagauugauaacuucagccuggguguauuaggcauggcccucuuucuggaagagaugcuucgcacucgaauagggacaaaacacgcuauccuguuggucgcagugucguucgugacccucauuacgggaaauauguccuuucgggaccugggccgugucaugguuauggugggggccacuaugaccgaugacaucggaaugggcguaacauaucuagcucugcucgccgcauucaaggugagacccaccuuugcggccggucugcuuuugaggaaacugacuucuaaggaguuaaugauggcuacaauugggaucgcccuccugagccagucaaccauaccugaaacaauccuugagcugacugaugcacuagcucucggaaugaugguccugaaaauugugcgcaacauggaaaaguaccaauuggccguuaccaucauggcaauuaguugcgugcccaaugccgucauccugcagaacgcuuggaagguguccuguacgauauuagcggccguuucugugagcccacuccugcuuacauccucacagcagaaagcagacuggauuccucuggcuuugaccaucaagggccucaaucccacugccaucuuccugaccacacuaagccggacuaguaaaaagagaucuuggccacugaacgaggccauuauggcugucggcaugguauccauacuugcaagcucgcuccugaaaaaugacaucccgaugaccgggccuuugguggccggaggucuguuaacgguuugcuaugugcucacaggcaggucagcggaucuggaacuugagcgagcugccgacgucaagugggaggaucaagcagaaauuucugggaguucccccauccugagcauuaccaucucugaggacggaagcauguccauaaaaaacgaagaggaggaacagacuuugacaauccucauucgcaccggccugcuagugaucucagguguauuuccagugaguauucccaucacugccgcugcaugguaccugugggaggucaagaagcagcgggccgggguucuuugggaugugccuagcccacccccuguggaaaaagcggagcucgaagacggagcuuauagaauaaagcagaggggcauucugggcuacucucaaaucggggccggagucuauaaagaggguacauuccacaccauguggcaugugacgcguggcgcaguuuugaugcaccgcgggaagcggaucgagccguccugggccgauguaaaaaaggacuuaauuucauacggaggcgguuggaagcuggaaggggaguggaaagaaggagaggaagugcagguccucgcucuggagccaggcaagaaucccagagccgugcagacuaaaccuggcaucuuuaagaccaacacagggaccauaggagcaguuagucuugauuucagcccagguacauccggcucucccauuguggacaggaaagggaaggucgugggacuguacggcaaugguguagucacucgaucgggggcuuaugugagcgccaucgcgcagaccgagaagucaauugaagauaacccugagaucgaagacgauauauuccggaaaaagcgcuugacgauuauggaccuacauccgggagccggcaaaacaaagagauaccugcccgcaaucguuagggaggcuaucaaacggggccuccgaacucugauucuugccccaaccagaguggucgcugcagaaauggaggaggccuuacgcgggcugccuaucagguaucaaacacccgccauuaagaccgaacacacuggacgugagauaguggaccucaugugucaugcuaccuuuacaaugcgguugcuguccccaguuagagugccuaacuacaaucucaucauuauggaugaagcgcacuucacggaccccgcaaguaucgccgcuagggguuauaucucuacucgcgucgagaugggcgaggccgcagggauuuuuaugaccgccacaccaccgggaagccgagauccuuucccccaguccaacgcuccaauaauggacgaagagagagaaauccccgagcggucauggaauucuggccacgaaugggugaccgauuuuaaggguaaaacuguaugguucgugccuagcauuaaggcggggaacgacaucgccgcaugccugaggaaaaauggaaagaaaguuauucagcuuagucgcaagacauuugauuccgaguacgucaagacccgugcuaacgacugggauuucguggugacgacugacaucagcgagaugggcgccaauuuuaaagcagaaagagucauagauccacggagguguaugaagcccguaauccugacagacggcgaggaacgcgugauuuuggccgggccuaugccgguuacccauucuucagcugcccaacgaagaggacggaucgguaggaacccaaaaaaugagaacgaccaguauauuuacaugggcgaaccccuagagaaugaugaggacugcgcgcacuggaaggaagcaaaaaugcugcucgauaacaucaauaccccugaggggauaauucccuccauguucgaaccagagcgcgaaaagguggacgccaucgauggagaguacagauuaaggggcgaggcucggaaaacuuuugucgaccugaugcgucgcggugaucuuccuguguggcuggccuauaagguugcugcagaagggauuaacuacgccgaccgaaagugguguuucgauggcaucaaaaauaaccagauacucgaggaaaacauggagguggagaucuggacaaaggaaggagagagaaaaaaguugaaacccagguggcuggacgcucggauuuauagugauccacucgcccugaaggaauucaaggaguuugcagcgggccgcaaaagccuuacccuaaaucugaucacagaaauggggagauugccuacuuucaugacgcagaaggccaggaacgcuuuagacaaucuggccguccuccauaccgcagaggcuggaggucgggccuacaaccacgcacugucggagcuuccggaaacacuggagacucucuugcugcuaacccugcucgccacagugaccggcgggauuuuucuuuuccugaugucuggaaaaggcaucgguaagaugacuuuagggaugugcugcauaauuacggcuuccaucuugcugugguaugcgcaaauccagccccacuggauugccgcaagcaucauacucgaauuuuuccugauuguacuucugaucccagagccugaaaaacagcgaaccccccaggauaaucaacucacauacgugguuauugcuaucuugacugucguggccgccaccauggcaaacgagaugggcuuucuggagaagacaaagaaagacuuaggacuaggcucaauaaccacucaggaaagugagucuaauauccuggacauugaucucagaccagcuuccgccuggacacuuuaugcgguggcuacgaccuucgucacuccuaugcugcgccauagcaucgaaaacucaaguguuaaugugagcuugacagccauugcaaaccaggccaccguacugauggggcucggaaaggguuggccccuguccaaaauggacaucggcgugccgcuucucgcuauuggguguuacucucaggucaauccaaucacccugacagcagccuugcuguuacuaguggcgcacuacgcuauaauuggaccuggccugcaagccaaggcaacuagggaggcccagaaacgggcugccgcagguaucaugaagaaccccacgguugaugggaucaccgugauugaccucgaaccaauacccuaugauccuaaguuugagaaacagcuuggccaggucaugcuguugauccugugcguaacacaagugcucaugaugcguacuaccugggcucugugugaggcccuuacauuagcgaccggaccgauuagcacucugugggaaggcaaucccgggagauucuggaacacgacaaucgccguuuccauggcaaauauuuuuaggggaucauaccucgcuggcgccgguuugcuguucucuaucaugaagaacaccacuaguacccgccgggggacaggaaauauaggcgagacucuaggugaaaaauggaagucgcgacugaacgcacucggcaaaagcgaguuucagaucuauaagaaauccgggauucaggagguggacagaacccuugcuaaggaaggaaucaagaggggcgagacagaucaucacgccgucucucgcgggucagccaaacugcggugguucguggaaagaaacauggucacgccagagggaaaggugguugacuugggcugcggucgugggggauggagcuacuauuguggcggucugaaaaaugugagggaaguaaagggccucaccaaagggggaccuggccaugaggagcccauuccuauguccacuuacggguggaaccuggugcgguuacaaaguggagucgauguuuucuuuacaccacccgaaaagugcgacacccuucugugugauaucggcgagucuagcccuaauccaacuauagaagcgggucgcacacuccgagugcuaaaccuggucgagaauugguugaacaauaacacccaguucugcauuaaggugcugaaucccuauaugccgucaguaaucgaaaaaauggaggcucuccagagacaguacgggggagcacuugugaggaacccucugucccggaauaguacgcacgagauguacuggguuagcaacgccaccggcaauaucgugucuuccgucaacaugauuucacgcauguugauaaauagauuuacaaugaagcacaaaaaggcuacuuaugaaccagacguggaucugggcagcgggaccaggaacaucggaauugagucggaaauccccaaccucgacauuaucgguaaacgaauagagaagaucaagcaagaacaugagauuucuuggcacuacgaccaggaucauccuuauaaaacaugggccuaccacggcaguuaugagacuaagcagaccggguccgcaagcucaauggucaauggagugguucgguuacugacaaaaccaugggacguagugcccauggucacccagauggccaugacugauacgacaccguucggccaacagcguguguuuaaggaaaaaguugacaccagaacucaggagccuaaggaagguaccaagaaacuuaugaagaucacagcugaguggcuguggaaagagcuagggaagaaaaagacgccccgcauguguaccagggaagaguucacuaaaaaggugcgguccaacgcggcccucggagcaauuuuuacagaugaaaauaaguggaaaucugcuagagaggccgucgaagacggccgcuucugggagcugguggauagggagcgaaacuugcaccuggaaggcaagugcgagaccuguguauacaauaugauggggaaacgggaaaagaaacucggagaguuugguaaggcaaagggcagcagagccaucugguauauguggcuuggggcuagguuccuggaauuugaggccuuaggauuccugaacgaggaccauugguuuagucgcggcaauuccuugagcgguguggaaggggagggacuccaccgucugggcuacauucuacgggauguuggcaaaaaggaagggggagcgauguacgcagacgauacugccgguugggacacaagaauaacccuugaggaccugaaaaacgaagagauggucacaaaucauaugaagggcgagcacaaaaagcucgcugaagccaucuucaagcugacuuaucagaacaaaguggugaggguccaacgcccaaccccucgagggacgguuauggauauuaucucucggagagaccagaggggaucaggccagguggguaccuacggguugaauacauucacuaacauggaggcacaacugauccgccagauggaaggagagggcauuuuuaagaguauacagcaucucaccgcuacagaggaaaucgccguacagaauuggcuugcuagagugggccgggagaggcugucccguauggccauuagcggggaugacugcgucgugaaacccaucgaugaccgauucgcaucugcguuaacugcccugaacgauaugggaaagguucgcaaagacauucaacagugggaaccaucgagagguuggaaugauuggacccaggugcccuuuugcucacaccacuuccaugaguuggucaugaaggacggccgggugcucguaguuccuuguaggaaccaggaugaacugaucgggcgcgcuagaauaagccaaggagccggcuggucccuaaaggagacggcaugccuugguaaaaguuaugcucagauguggacacugauguacuuucaccggagggaccuccgacuggccgcaaacgccaucuguucugcggugccaagccauugggucccgaccucccguacuacauggucaauucacgcuaagcacgaguggaugaccacugaagauauguuggccguguggaauagaguguggauccaggagaaccccuggauggaagacaaaaccccugucgagaguugggaagagguuccauauuuagggaagcgcgaggaccaguggugcggaucucugauuggccucacaagccgggcaacgugggccaaaaauauccaaaccgcuauaaaccaggugaggucccuuauuggcaaugaagaguacacugauuauaugcccucaaugaagagauuccgccgggaagaggaagaggccgggguacugugguga

SEQ ID NO: 14491 - RNA, 9876 nt, Artificial Sequence
  derived and/or modified CDS sequence (opt3) from DENV-2__FJ882594__SS-prME
accgccggcgugaucgucaugcugauucccacagcuauggcauuccaccucacuacgagaaacggggagccucauaugauaguuggaaggcaggaaaaggguaaaagccuucuguuuaagaccgaggacggcgugaauaugugcacauugauggccaucgauuuaggggaacugugugaggacacuauuaccuacaaaugcccacuacuccggcaaaacgaaccggaggauaucgacuguuggugcaauuccacaucuaccuggguaacuuauggaacauguaccacgacuggcgagcaccgccgagaaaagcguucaguggcgcuggucccccauguggguauggggcuugagaccagaacagaaacuuggaugaguagcgagggagcuuggaaacacguucagaggauugagaccuggauccugcggcauccuggcuucacaauaauggccgcaaucuuggccuacaccauuggcacgacucacuuucagcgcgcucucaucuucauucugcugacagcaguggccccauccaugaccaugagaugcaucgggauaucuaacagggauuuugucgaaggagugucggguggcucauggguagacauuguucucgagcacgggagcugugugacuacaauggcuaagaauaagcccaccuuagauuucgaacugaucaaaacggaggccaagcagccugcgacccuucggaaauauugcauugaagcaaaguugacaaacacuaccacagagagucgcuguccaacucaaggagagcccucccugaaugaagagcaggacaaacgauuuaucugcaagcauucuauggucgauagaggcugggguaacggguguggacuauucggcaagggcgggaucgugaccugcgccauguuuacaugcaaaaagaauauggaaggaaaagugguccagccugagaaccucgaauacaccauuguuauaacuccacacagcggugaggagcaugcugugggcaaugacacggggaagcacggaaaagaaaucaagauuacaccgcaguccucaaucaccgaggccgaacugacuggcuaugguaccguaacaauggaguguagucccaggaccgggcuugauuucaacgaaauggugcuguugcaaauggaggacaaagcauggcucguccaccggcagugguuucuggauuuaccucugccauggcuccccggcgcugacacucagggaagcaauuggauacagaaggagacacuugugacguucaagaacccucaugccaaaaagcaagacguugugguccugggcucucaggaaggggcgaugcacaccgccuugacuggagcaacagagauucagauguccucagguaaucuacuguuuaccggccaucucaaaugccgucugcgcauggauaagcuucaacugaaagggaugagcuacaguauguguacaggaaaguucaagaucgugaaagaaaucgcugagacucagcacggcaccauuguaaucagaguucaguaugagggugacgggucuccaugcaagauucccuucgaaauaacggauuuggagaaaaggcaugugcucggccggcugaucaccgucaacccgauugugacagaaaaggacuccccugucaacaucgaggccgaacccccauuuggagauagcuacaucauuauaggcguggagccugggcaguuaaaacugaauugguucaagaagggaucgucuaucggucaaauguuugagacuaccaugcgaggcgcuaaacgcauggccauucuaggggacacagcaugggauuucggaucccucggcgguguuuuuacuucaaucgggaaggcccugcaccagguguucggcgcuauuuacggagcggcauuuaguggcguaagcuggaccaugaaaauccuuauaggggucaucauuacguggaucggaaugaacuccagaucuacaagcuugucagugagucugguucucgugggcgucgugacccuguaucuuggugccaugguacaggcugacuccgggugugugguuagcuggaagaauaaagaacugaagugcggaucuggcauuuucaucacugauaacguccacacauggaccgagcaguacaaguuucaacccgaaucaccaaguaaauuggccagcgcaauacagaaggcccaugaggaagguauuuguggcaucagguccgugacucggcucgagaaucugauguggaaacagauuacccccgaguuaaaccacauccugucugaaaaugaggugaagcuaacaauaaugacgggggacauccgcggaauuaugcaggcuggcaaaagaucgcucaggccucaaccaaccgaacugaaguauagcuggaaaacuugggggaaggccaagaugcuuuccacagagucacauaaccagaccuucuugaucgauggaccggaaacagcagagugccccaauacuaaccgugcguggaauagucuggaggucgaagacuacggcuuugguguuuucaccacgaacauuuggcucaaacugcgggagaagcaggacguguuuugugauucuaaauuaaugagcgcugccaucaaggacaaucgagcagugcacgccgauaugggguauuggauagaauccgcucugaacgacacauggaaaauggagaaggccucauucauugagguaaagagcugccacuggccuaaaucucauacccuuugguccaauggagucuuggaaagugagaugaucaucccaaagaacuucgcaggccccgugagccagcacaacuacagaccugguuaucauacucaaaccgcuggcccauggcaccucgggaaacuggaaauggauuuugaccuaugugagggaacaacuguuguggucaccgaagauugcggcaauagggggcccucucugcgcacaacgaccgccuccggaaagcucauuacugaguggugcugucggucaugcacacugccgccucuuagauacaggggcgaggacgguuguugguacgggauggaaauccgcccauugaaagagaaggaagagaaccuggugaauaguuuaguuaccgcgggacauggccagauugauaacuucagccucggugugcugggcauggcccuuuuucuggaagagauguugcgaacucggauagggacaaagcacgcuauccuccugguagcagucucguucgugacccuaauuacgggaaauauguccuuucgugaccugggcagagugauggucaugguuggggccacuaugaccgaugacaucggaaugggcgugacauaucucgcucugcuugccgcauucaaaguaaggcccaccuuugcggccgguuugcuguuacgcaagcucacuucuaaagagcugaugauggcuacaauugggaucgcccuucugagccagucaaccauaccugaaaacauccuagagcucacagaugcacuggcuuugggaaugauggugcugaagauuguccggaauauggaaaaauaccaauuagccgugacuaucauggcaauuaguugcguucccaacgccgugauccuccagaaugcuuggaaggucuccuguaccauacuggcggccgugucuguuagcccacuucuguugacguccucacagcagaaggcagacuggauuccucucgcucugacaaucaaaggccuaaaccccaccgccaucuuccugacuacccuuagcagaacaaguaagaaaaggucuuggccacucaaugaggccauuauggcugugggcauggucuccauacuggcaagcucguugcugaagaacgacaucccgaugacugggccuuuaguagccggaggucuccugaccgugugcuauguucuuacgggccgaucagcggaucuggaauuggagcgcgcugccgacgugaaaugggaggaucaagcagaaauuucugggaguucccccauccucagcauuacaaucucugaggacggaagcauguccauaaagaaugaagaggaggaacagacccugacuauccuaauucggacaggccugcuugucaucucagguguguuuccaguaaguauucccaucaccgccgcugcaugguaccucugggaggugaaaaagcagagagccgggguccugugggauguuccuagcccacccccuguggaaaaggcggaguuggaagacggagcuuauaggauaaaacagcguggcauuuuaggcuacucucaaaucggggccggaguguauaaggaggguacuuuccacacaauguggcaugucacccgcggcgcagugcugaugcaccgggggaaaagaaucgagccguccugggccgauguuaagaaagaccucauuucauacggaggcgguuggaagcuggaaggggaguggaaggaaggagaggaaguacaggugcuugcucuggagccaggcaaaaaccccagggccguccagacgaagccuggcaucuuuaaaacuaauaccgggacaauaggagcagugaguuuggauuucagcccagguaccuccggcucucccauuguugaccgaaaggggaaaguggucggacuauacggcaacggugugguaacacggucgggggcuuaugucagcgccaucgcgcagacugagaagucaauugaagauaacccugagaucgaagacgauauauuucgcaagaaaagacugaccauuauggaccuccauccgggagccggcaagacgaaaagguaccugcccgcaaucgugcgggaggcuaucaagcgaggccuuagaacauuaauucuggccccaacucgcguuguggcugcagaaauggaggaggcccucaggggguugccuauccguuaucaaaccacagccauuaaaaccgaacacacuggacgggagauagucgaccugaugugucaugcuaccuucacaaugagacuccugucccccgugaggguuccaaauuacaaccuuaucauuauggaugaagcgcacuucacggacccugcaaguaucgccgcucgcgguuauaucucuacucgaguggagaugggcgaggccgcagggauuuuuaugaccgccacacccccaggaagcagagauccguucccucaguccaaugcucccauaauggacgaagagcgggaaaucccagagaggucauggaacucuggccacgaaugggucaccgauuuuaaggguaagacugugugguucguacccagcauuaaagcggggaaugacaucgccgcaugccugcgcaagaacggaaaaaaggugauucaguugagucguaaaacauuugauuccgaguacguuaagaccagagcuaaugacugggauuucgucgugacgacugacaucagcgagaugggcgccaacuuuaaggcagaacgggugauagauccuaggcgcuguaugaaaccagucauccuaacagacggcgaggaacgaguaauucuggccgggcccaugccugugacccauucuucagcugcccaaagacggggaaggaucggucgcaauccgaagaacgagaaugaccaguauauuuacaugggcgaaccacucgagaacgaugaggacugcgcgcacuggaaagaagcaaagauguuacuggauaauaucaacacccccgaggggauaauuccuuccauguucgaacccgagagagaaaaaguugacgccaucgauggagaguacaggcuucggggcgaggcucguaagacuuuuguggaccugaugcgccgaggugaucucccagucugguuggccuauaaaguggcugcagaagggauuaauuacgccgacagaaagugguguuucgauggcaucaagaacaaccagauacuggaggaaaauauggagguugagaucuggacaaaagaaggagagaggaagaaacucaagccucgguggcuggacgcucgcauuuauagugauccccuugcccuaaaagaauuuaaggaguucgcagcgggcagaaagagccugaccuugaacuuaaucacagaaauggggaggcugccaacuuucaugacgcagaaagcccggaaugcucucgacaaccuggccgugcuucauaccgcagaggcuggaggucgagccuacaaucacgcacugucggagcucccugaaacauuggagacucugcuacugcucacccuucuggccacagucaccggcgggauuuuuuuauucuugaugucuggaaagggcaucgguaaaaugacucuggggaugugcugcauaauuacggcuuccauccuccugugguaugcgcaaauccagccgcacuggauugccgcaagcaucauacuugaauuuuuccugauugugcucuugauccccgagccagaaaagcagagaaccccucaggauaaccaacugacauacguagugauugcuaucuuaacuguugucgccgccaccauggcaaaugagaugggcuuucuagagaaaacaaagaaggaccugggacucggcucaauaaccacucaggaaagugagucuaacauccuugacauugaucugcgccccgcuuccgccuggacauuguaugcgguggcuacgaccuucgugacuccaaugcugaggcauagcaucgaaaauucaagugucaacguuagccucacagccauugcaaaucaggccaccgugcugauggggcuuggaaaagguuggccucucuccaagauggacaucggcguaccccuguuggcuauuggguguuacucucaggugaacccgaucacccugacagcagccuuacuacugcucgucgcgcacuacgcuauaauuggaccaggccuucaagccaaagcaacucgggaggcccagaagcgugcugccgcagguaucaugaaaaauccuacgguggaugggaucaccguuauugaccuggaacccauaccauaugaucccaaguuugagaagcaguugggccaggugaugcugcucauccugugcgucacacaaguacuuaugaugagaacuaccugggcuuuaugugaggcccugacacucgcgaccggaccuauuagcacuuugugggaaggcaacccggggagguucuggaauacgacaaucgccguguccauggcaaacauuuuucgcggaucauaccuggcuggcgccggucuacuguucucuaucaugaaaaauaccacuaacacccggcgagggacaggaaacauaggcgagacucucggugaaaaguggaaaaguagacuuaaugcacugggcaagucggaguuucagaucuauaaaaagagcgggauucaggagguugacaggaccuuggcuaaagaaggaaucaagcgcggcgagacagaucaucacgccgugucccgggggucugccaagcugagaugguucgucgaacguaacauggugacgcccgagggaaaagucguggaccucggcugcgguagggggggauggucauacuauuguggcggucugaagaauguucgggaagugaaaggcuuaaccaaggggggaccaggccaugaggagccuauucccaugagcacuuacggguggaaccuuguacgccugcaauccggaguggaugucuuuuucacaccuccagaaaaaugcgacacccuccuaugugauaucggcgagaguucucccaauccuacuauagaagcgggucgaacacugagaguuuugaaccugguggagaauuggcucaacaauaacacccaguucugcauuaagguccuuaauccauauaugcccagcgugaucgaaaagauggaggcucugcagaggaaauacgggggagcauugguacggaacccgcugucacgcaauuccacgcacgagauguacugggugaguaacgccaccggcaauaucguuagcucugugaacaugauuuccagaaugcucauaaacagguuuacaaugaagcacaaaaaggcuacuuaugaaccugacgucgauuuaggcucagggacccgaaauaucggaauugagagcgaaaucccaaaccuggacauuaucgguaaacggauagagaagaucaagcaggaacaugaggccucguggcacuacgaccaagaucaucccuauaaaacaugggcauaccacggcucuuaugagacuaagcagaccgggagugccuccagcauggugaauggagucgugcgucuucugacaaaaccuugggacguuguaccaauggugacccagauggcuaugacugauacgacacccuucggccagcaaagagucuuuaaggaaaaaguggacacccgcacucaggagccgaaggaagguaccaagaaacuaaugaagauuacagcggaguggcucuggaaagagcuggggaagaaaaagacgccuaggauguguacccgggaagaguucacuaaaaagguuagaucaaacgccgcauugggagcuaucuuuacagaugaaaauaaguggaaauccgcccgcgaggcaguggaagacggcagguucugggagcuggucgaucgagagcggaaccuccaccuugaaggcaagugcgagaccuguguguacaauaugauggggaaaagagaaaagaaacugggagaguuugguagggccaagggcucucgcgcuauuugguauaugugguuaggggcccguuuccuggaauuugaggcguugggauuccucaacgaggaccauugguuuagccggggcaauagucuguccgguguagaaggggagggacuacacagacuuggcuacauccugagggaugugggcaagaaagaagggggagcaauguacgccgacgauacugcugguugggacacacgcauuacccucgaggaccugaagaacgaagagaugguuacaaaucauaugaaaggcgagcacaagaaauuggccgaagcaauauucaagcugacuuaucagaacaaggucgugcgagugcagcggcccaccccaagagggacggucauggauaucauuagcaggcgcgaccaaagaggaucuggccagguugguaccuacgggcucaauacauuuacuaacauggaggcucagcuuauccggcaaauggaaggagagggcaucuucaaaucaauucagcaucugaccgccacagaggaaauagcugugcagaauugguuagccaggguaggccgugagcgacugagucgcauggcaaucuccggggaugacugcguggucaagccuauugaugacagauucgcgagcgccuugacugcucucaacgauaugggaaaagugcggaaggacauccagcaaugggaacccucuagggguuggaacgauuggacccagguuccauuuugcucgcaccacuuccaugagcuggugaugaaagacggccgcguccuagugguacccuguagaaaucaggaugaacuuauugggcgggccaggaucucacagggagcaggcuggagccugaaggagacggcuugccucgguaaguccuaugcccaaauguggacacugauguacuuucaccgacgugacuugagauuagcagccaacgcgauauguagugcuguuccuucucauugggugccaaccagccgcacuacaugguccauccacgccaaacacgaguggaugaccacugaagauaugcuggcagucuggaaucggguguggauucaggagaacccguggauggaagacaagacccccguggagucaugggaagaggucccuuaucucgggaaaagggaggaccaguggugcggaagucuuaucggccugacaucuagagccacgugggcuaagaauauucagaccgccaucaaccaaguucgcagccuaauaggcaaugaagaguacacugauuauaugccauccaugaaacgguucaggcgagaagaggaagaggcaggggugcugugguga

SEQ ID NO: 14492 - RNA, 9876 nt, Artificial Sequence
  derived and/or modified CDS sequence (opt3) from DENV-2__FJ205885__SS-prME
accgccggcgugaucgucaugcugauucccacagcuauggcauuccaccucacuacgagaaacggggagccucauaugauaguuggaaggcaggaaaaggguaaaagccuucuguuuaagaccgaggacggcgugaauaugugcacauugauggccaucgauuuaggggaacugugugaggacacuauuaccuacaaaugcccacuacuccggcaaaacgaaccggaggauaucgacuguuggugcaauuccacaucuaccuggguaacuuauggaacauguaccacgacuggcgagcaccgccgagaaaagcguucaguggcgcuggucccccauguggguauggggcuugagaccagaacagaaacuuggaugaguagcgagggagcuuggaaacacguucagaggauugagaccuggauccugcggcauccuggcuucacaauaauggccgcaaucuuggccuacaccauuggcacgacucacuuucagcgcgcucucaucuucauucugcugacagcaguggccccauccaugaccaugagaugcaucgggauaucuaacagggauuuugucgaaggagugucggguggcucauggguagacauuguucucgagcacgggagcugugugacuacaauggcuaagaauaagcccaccuuagauuucgaacugaucaaaacggaggccaagcagccugcgacccuucggaaauauugcauugaagcaaaguugacaaacacuaccacagagagucgcuguccaacucaaggagagcccucccugaaugaagagcaggacaaacgauuuaucugcaagcauucuauggucgauagaggcugggguaacggguguggacuauucggcaagggcgggaucgugaccugcgccauguuuacaugcaaaaagaauauggaaggaaaagugguccagccugagaaccucgaauacaccauuguuauaacuccacacagcggugaggagcaugcugugggcaaugacacggggaagcacggaaaagaaaucaagauuacaccgcaguccucaaucaccgaggccgaacugacuggcuaugguaccguaacaauggaguguagucccaggaccgggcuugauuucaacgaaauggugcuguugcaaauggaggacaaagcauggcucguccaccggcagugguuucuggauuuaccucugccauggcuccccggcgcugacacucagggaagcaauuggauacagaaggagacacuugugacguucaagaacccucaugccaaaaagcaagacguugugguccugggcucucaggaaggggcgaugcacaccgccuugacuggagcaacagagauucagauguccucagguaaucuacuguuuaccggccaucucaaaugccgucugcgcauggauaagcuucaacugaaagggaugagcuacaguauguguacaggaaaguucaagaucgugaaagaaaucgcugagacucagcacggcaccauuguaaucagaguucaguaugagggugacgggucuccaugcaagauucccuucgaaauaacggauuuggagaaaaggcaugugcucggccggcugaucaccgucaacccgauugugacagaaaaggacuccccugucaacaucgaggccgaacccccauuuggagauagcuacaucauuauaggcguggagccugggcaguuaaaacugaauugguucaagaagggaucgucuaucggucaaauguuugagacuaccaugcgaggcgcuaaacgcauggccauucuaggggacacagcaugggauuucggaucccucggcgguguucugacuucaaucgggaaggcccuucaccagguguuuggcgcuauuuacggagcggcauucaguggcguaagcuggaccaugaaaaucuugauaggggucaucauuacguggaucggaaugaacuccagaucuacaagccugucagugagucucguucuggugggcgucgugacccuuuaucugggugccguagugcaggcugacuccggguguguugucagcuggaagaauaaagaauugaagugcggaucuggcauuuuuaucacugauaacgugcacacauggaccgagcaguacaaguuccaacccgaaucaccaaguaaacucgccagcgcaauacagaaggcccaugaggaagguauuuguggcaucagguccgugacucggcuggagaauuuaauguggaaacagauuacccccgagcugaaccacauccuaucugaaaaugaggucaagcucacaauaaugacgggggacaucaaaggaauuaugcaggcuggcaagcgcucgcugagaccucaaccaaccgaacuuaaauauagcuggaagacuugggggaaggccaaaauguuguccacagagucacauaaccagaccuuucugaucgauggaccggaaacagcagagugccccaauacuaacagggcguggaauagucucgagguugaagacuacggcuucgguguguuuaccacgaacauuuggcugaaguuacgugagaaacaggacguguucugugauucuaagcugaugagcgcugccaucaaagacaaucgggcaguacacgccgauaugggguauuggauagaauccgcucuuaacgacacauggaagauggagaaggccucauuuauugaggucaaaagcugccacuggccuaagucucauaccuugugguccaauggagugcucgaaagugagaugaucaucccaaaaaacuucgcaggccccguuagccagcacaacuaccgaccugguuaucauacucaaaccgcuggcccauggcaccuggggaagcuagaaauggauuucgacuuuugugagggaacaacuguggucgugaccgaagauugcggcaauagagggcccucucugaggacaacgaccgccuccggaaaacucauuacugaguggugcugucgcucaugcacacugccgccucuucgguacagaggcgaggacgguuguugguacgggauggaaaucaggccauugaaggagaaggaagagaaccugguuaauaguuuagugaccgcgggacauggccagauugauaacuucagccucgguguacugggcauggcccuuuuucuggaagagauguugcgcacucgaauagggacaaaacacgcuauccuccuggucgcagugucguucgugacccuaauuacgggaaauauguccuuucgggaccugggccgugucaugguuauggugggggccacuaugaccgaugacaucggaaugggcguaacauaucucgcucugcuugccgcauucaaggugagacccaccuuugcggccgguuugcuguuaaggaaacucacuucuaaggagcugaugauggcuacaauugggaucgcccuucugagccagucaaccauaccugaaacaauccuagagcucacugaugcacuggcuuugggaaugaugguccugaaaauugugcgcaacauggaaaaguaccaauuagccguuaccaucauggcaauuaguugcgugcccaaugccgucauccuccagaacgcuuggaagguguccuguacgauacuggcggccguuucugugagcccacuucuguugacauccucacagcagaaagcagacuggauuccucucgcucugaccaucaagggccuaaaucccacugccaucuuccugaccacacuuagccggacuaguaaaaagagaucuuggccacucaacgaggccauuauggcugucggcaugguauccauacuggcaagcucguugcugaaaaaugacaucccgaugaccgggccuuuaguggccggaggucuccugacgguuugcuaugugcuuacaggcaggucagcggaucuggaauuggagcgagcugccgacgucaagugggaggaucaagcagaaauuucugggaguucccccauccucagcauuaccaucucugaggacggaagcauguccauaaaaaacgaagaggaggaacagacucugacaauccuaauucgcaccggccugcuugugaucucagguguauuuccagugaguauucccaucacugccgcugcaugguaccucugggaggucaagaagcagcgggccgggguucugugggaugugccuagcccacccccuguggaaaaagcggaguuggaagacggagcuuauagaauaaagcagaggggcauuuuaggcuacucucaaaucggggccggagucuauaaagaggguacauuccacaccauguggcaugugacgcguggcgcaguucugaugcaccgcgggaagcggaucgagccguccugggccgauguaaaaaaggaccucauuucauacggaggcgguuggaagcuggaaggggaguggaaagaaggagaggaagugcagguccuugcucuggagccaggcaagaaucccagagccgugcagacuaaaccuggcaucuuuaagaccaacacagggaccauaggagcaguuaguuuggauuucagcccagguacauccggcucucccauuguggacaggaaagggaaggucgugggacuauacggcaaugguguagucacucgaucgggggcuuaugugagcgccaucgcgcagaccgagaagucaauugaagauaacccugagaucgaagacgauauauuucggaaaaagcgccugacgauuauggaccuccauccgggagccggcaaaacaaagagauaccugcccgcaaucguuagggaggcuaucaaacggggccuucgaacuuuaauucuggccccaaccagaguggucgcugcagaaauggaggaggcccuccgcggguugccuaucagguaucaaacacccgccauuaagaccgaacacacuggacgugagauaguggaccugaugugucaugcuaccuucacaaugcggcuccuguccccaguuagagugccuaacuacaaucuuaucauuauggaugaagcgcacuucacggaccccgcaaguaucgccgcuagggguuauaucucuacucgcgucgagaugggcgaggccgcagggauuuuuaugaccgccacaccaccgggaagccgagauccuuucccccaguccaacgcuccaauaauggacgaagagagagaaauccccgagcggucauggaauucuggccacgaaugggugaccgauuuuaaggguaaaacuguaugguucgugccuagcauuaaggcggggaacgacaucgccgcaugccugaggaaaaauggaaagaaaguuauucaguugagucgcaagacauuugauuccgaguacgucaagacccgugcuaacgacugggauuucguggugacgacugacaucagcgagaugggcgccaauuuuaaagcagaaagagucauagauccacggagguguaugaagcccguaauccuaacagacggcgaggaacgcgugauucuggccgggccuaugccgguuacccauucuucagcugcccaacgaagaggacggaucgguaggaacccaaaaaaugagaacgaccaguauauuuacaugggcgaaccccucgagaaugaugaggacugcgcgcacuggaaggaagcaaaaauguuacuggauaacaucaauaccccugaggggauaauucccuccauguucgaaccagagcgcgaaaagguggacgccaucgauggagaguacagacuuaggggcgaggcucggaaaacuuuugucgaccugaugcgucgcggugaucucccugugugguuggccuauaagguugcugcagaagggauuaacuacacagaccgaaagugguguuucgauggcaucaaaaauaaccagauacuggaggaaaacauggagguggagaucuggaccaaggaaggagagagaaaaaagcucaaacccagguggcuggacgcccggauuuauagugauccacuugcucuaaaggaauuuaaggaguucgccgcaggccgcaaaagccugacauugaauuuaaucacugaaauggggagacugccuacguucaugacccagaaggcgaggaacgcccucgacaaucuggcuguccuucauacagccgaggcaggaggucgggcuuacaaccacgcccugucggagcucccggaaacuuuggagacccugcuacugcucacacuucuggcaaccgugacuggcgggauuuuuuuauucuugaugucuggaaaaggcaucgguaagaugacgcuggggaugugcugcauaauuaccgccuccauccuccugugguaugcucaaauccagccccacuggauugcggccagcaucauacuugaauuuuuccugauuguacucuugaucccagagccugaaaaacagcgaacaccccaggauaaucaacugacuuacgugguuauugcaaucuuaaccgucguggcugccacaauggccaacgagaugggcuuucuagagaagaccaagaaagaccugggacucggcucaauaacuacacaggaaagugagucuaauauccuugacauugaucugagaccagcauccgcuuggacguuguaugccguggcgaccacuuucgucacaccuaugcugcgccauagcaucgaaaacucaaguguuaaugugagccucaccgcuauugccaaccaggcaaccguacugauggggcuuggaaaggguuggccccucuccaaaauggacaucggcgugccgcuguuggccauuggguguuacucucaggucaauccaaucacacugacugcugcauuacuacugcucguggcccacuacgcgauaauuggaccuggccuucaagcuaaggccacgagggaggcacagaaacgggccgcugccgguaucaugaagaaccccaccguugaugggaucacagugauugaccuggaaccaauacccuaugauccuaaguuugagaaacaguugggccaggucaugcugcucauccugugcguaacucaagugcuuaugaugcguaccacaugggcauuaugugaggcucugacccucgccacuggaccgauuagcacguugugggaaggcaaucccgggagauucuggaacacaaccaucgcgguuuccauggccaauauuuuuaggggaucauaccuggcaggcgcuggucuacuguucucuaucaugaagaacacuaccaguacacgccgggggacuggaaauauaggcgagacccucggugaaaaauggaagucgcgacuuaacgcccugggcaaaagcgaguuucagaucuauaagaaauccgggauucaggagguggacagaacauuggcaaaggaaggaaucaagaggggcgagacggaucaucacgcugucucucgcgggucagccaaacugcggugguucguggaaagaaacauggucaccccagagggaaaggugguugaccucggcugcggucgugggggauggagcuacuauuguggcggucugaaaaaugugagggaaguaaagggcuuaacuaaagggggaccuggccaugaggagcccauuccuauguccacauacggguggaaccuugugcggcugcaaaguggagucgauguuuuuuucaccccacccgaaaagugcgacacucuccuaugugauaucggcgagucuagcccuaauccaacaauagaagccggucgcacccugcgaguguugaaccuggucgagaauuggcucaacaauaacacgcaguucugcauuaaggugcuuaaucccuauaugccgucaguaaucgaaaaaauggaggcgcugcagagacaguacgggggagcuuuggugaggaacccucugucccggaauaguacccacgagauguacuggguuagcaacgcaacaggcaauaucgugucuuccgucaacaugauuucacgcaugcucauaaauagauuuacuaugaagcacaaaaaggccaccuaugaaccagacguggauuuaggcagcgggacaaggaacaucggaauugagucggaaauccccaaccuggacauuaucgguaaacgaauagagaagaucaagcaagaacaugagauuucuuggcacuacgaccaggaucauccuuauaaaacuugggcuuaccacggcaguuaugagaccaagcagacaggguccgccagcucaauggucaauggagugguucggcuucugaccaaaccaugggacguagugcccauggucacucagauggcaaugacggauacaaccccguucggccaacagcguguguuuaaggaaaaaguugacacuagaacccaggagccuaaggaagguacaaagaaacuaaugaagaucacggccgaguggcucuggaaagagcuggggaagaaaaagaccccccgcauguguacuagggaagaguucacacggaaagugagauccaacgcugcguugggagccauuuuuaccgaugaaaauaaguggaagucugcacgcgaggcugucgaagacggcagguucugggagcugguggaucgagagcggaaccuccaccuugaaggcaaaugcgagacuuguguauacaauaugauggggaagagagaaaaaaagcugggagaguuugguaaagccaagggcagcagggcaaucugguauaugugguuaggggcccgcuuccuggaauuugaggcuuugggauuccucaacgaggaccauugguuuagucguggcaauucccugagcgguguggaaggggagggacuacaccggcuuggcuacauucugagagauguuggcaagaaagaagggggagccauguacgcggacgauacagcagguugggacaccaggauaacacucgaggaccugaagaacgaagagauggucacuaaucauaugaaaggcgagcacaagaaauuggccgaagcuaucuucaagcugaccuaucagaacaagguggugcgcguccaacgaccaacgccucgggggaccguuauggauauuaucucuagaagggaccagcgcggaucaggccagguggguacauacgggcucaauacuuuuaccaacauggaggcccaacuuaucagacagauggaaggagagggcauuuucaaaaguauacagcaucugacagcaacugaggaaaucgcuguacagaauugguuagcccgggugggcagggagcgucugucccgaauggcuauuagcggggaugacugcgucgugaagcccaucgaugaccgcuucgccucugcauugaccgcgcucaacgauaugggaaaaguuagaaaggacauucaacagugggaaccaucgcgggguuggaaugauuggacgcaggugcccuuuugcucacaccacuuccaugagcuggucaugaaagacggcagggugcuaguaguuccuugucgcaaccaggaugaacuuaucgggagagcccggauaagccaaggagcuggcuggucccugaaggagacagccugccucgguaagaguuaugcacagauguggacccugauguacuuucacaggcgagacuugcguuuagcugccaacgcaaucuguucugccgugccaagccauugggucccgacuuccagaacaaccuggucaauucacgcgaaacacgaguggaugacuaccgaagauaugcuggcuguguggaaucgcguguggauccaggagaaccccuggauggaagacaagacaccugucgagaguugggaagagguuccauaucucgggaaacgggaggaccaguggugcggaucucuuauuggccugacgagcagggccaccugggcaaagaauauccaaacugccauaaaccaggugagaucccuaauuggcaaugaagaguacacagauuauaugcccucaaugaaacgcuuccggagggaagaggaagaggcugggguacugugguga

SEQ ID NO: 14493 - RNA, 9876 nt, Artificial Sequence
  derived and/or modified CDS sequence (opt3) from DENV-2__FJ744743__SS-prME
accgcaggcgugauaguaaugcugauucccaccgcuauggcauuccaccucacuacgcgaaacggggagccucauaugauaguuggaaggcaggaaaaggguaaaagccuucuguuuaagaccgaggacggcgugaauaugugcacauugauggcaaucgauuuaggggaacugugugaggacacuauuaccuacaaaugcccacuacuccggcaaaacgaaccggaggauaucgacuguuggugcaauuccacaucuaccuggguaacuuauggaacauguaccacgacuggcgagcaccgccgagaaaagcguucaguggcgcuggucccccauguggguauggggcuugagaccaggacagaaacuuggaugaguagcgagggagcuuggaaacacguucagaggauugagaccuggauccugcggcauccuggcuucacaauaauggccgcaaucuuggccuacaccauuggcacgacucacuuucagcgcgcucucaucuucauucugcugacagcaguggccccauccaugaccaugaggugcaucgggauaucuaacagggauuuugucgaaggagugucggguggcucauggguagacauuguucucgagcacgggagcugugugacuacaauggcuaagaauaagcccaccuuagauuucgaacugaucaaaacggaggccaagcagccugcgacccuucggaaauauugcauugaagcaaaguugacaaacacuaccacagagagucgcuguccaacucaaggagagcccucccugaaugaagaacaggacaaacgauuuaucugcaagcauucuauggucgauagaggcugggguaacggguguggacuauucggcaagggcgggaucgugaccugcgccauguuuacaugcaaaaagaauauggaaggaaaagugguccagccugagaaccucgaauacaccauuguuauaacuccacacagcggugaggagcaugcugugggcaaugacacggggaagcacggaaaagaaaucaagauuacaccgcaguccucaaucaccgaggccgaacugacuggcuaugguaccguaacaauggaguguagucccaggaccgggcuugauuucaacgaaauggugcuguugcaaauggaggacaaagcauggcucguccaccggcagugguuucuggauuuaccucugccauggcuccccggcgcugacacucagggaagcaauuggauacagaaggagacacuugugacguucaagaacccucaugccaaaaagcaagacguugugguccugggcucucaggaaggggcgaugcacaccgccuugacuggagcaacagagauucagauguccucagguaaucuacuguuuaccggccaucucaaaugccgucugcgcauggauaaacuucaacugaaagggaugagcuacaguauguguacaggaaaguucaagaucgugaaagaaaucgcugagacucagcacggcaccauuguaaucagaguucaguaugagggugacgggucuccaugcaagauucccuucgaaauaacggauuuggagaaaaggcaugugcucggccggcugaucaccgucaacccgauugugacaggaaaggacuccccugucaacaucgaagccgagcccccauuuggcgauagcuacaucauuauagggguggaaccuggacaguuaaaacugaauugguucaagaaggguucgucuaucggccaaauguuugagacuaccaugcgaggggcuaaacgcauggccauucuaggagacacagcaugggauuucggcucccucggugggguuuuuacuucaaucggcaaggcccugcaccagguguucggagcuauuuacggcgcggcauuuagugggguaagcuggaccaugaaaauccuuauaggagucaucauuacguggaucggcaugaacuccagaucuacuagcuugucagugagucugguucucgugggugucgugacccuguaucuuggggccguagugcaggcugacuccggauguguugucagcuggaagaauaaagagcugaagugcggcucugguauuuucaucacugauaacgugcacacauggaccgaacaguacaaguuucaacccgagucaccaaguaaauuggccagcgcaauacagaaggcccaugaagagggcauuugugggaucagguccgugacucggcucgaaaaucugauguggaaacagauuacccccgaguuaaaccacauccugucugagaaugaagucaagcuaacaauaaugacgggagacaucaaaggcauuaugcaggcugggaagcgcucgcucuggccucaaccaaccgagcugaaauauagcuggaagacuuggggaaaggccaaaaugcuuuccacagaaucacauaaccagaccuucuugaucgauggcccggagacagcagaaugccccaauacuaacagagcguggaauagucuggagguugaggacuacgguuuugggguguucaccacgaacauuuggcucaagcugagggaaaaacaggacguguuuugugauucuaaguuaaugagcgcugccaucaaagacaaucgugcaguacacgccgauaugggauauuggauagaguccgcucugaacgacacauggaagauggaaaaggccucauucauugaggucaaaagcugccacuggccuaagucucauacccuuugguccaauggcguguuggagagugaaaugaucauccccaagaauuucgcaggucccguuagccagcacaacuaccggccuggcuaucauacucaaaccgcugggccauggcaccucggaaagcuggagauggauuuugacuucugugaaggcacaacuguggucgugaccgaggauugcgggaaucgaggacccucucuaagaacaacgaccgccuccggcaaacugauuacugaauggugcuguaggucaugcacacucccgccucugcgcuaccggggugaggacggguguugguacggaauggagaucagaccacuuaaggaaaaggaggaaaacuugguuaauagucuggugaccgcgggccauggucagauugauaacuuuagcuuaggcguacucgggauggcccuguuccuugaggaaaugcugaggacucgcauaggaacaaaacacgcuaucuugcucgucgcagugucguuugugacccugauuacgggcaauauguccuuccgagaccuagggcgggucaugguuauggugggagccacuaugaccgaugacaucggcauggguguaacauaucuggcucuccuggccgcauuuaaggugcgucccaccuucgcggccgggcuuuugcugagaaaauuaacuucuaaggagcucaugauggcuacaauuggaaucgcccugcuuagccagucaaccauaccugagacaauccuggaacuaacugaugcacucgcucugggcaugauggucuugaaaauugugaggaacauggagaaguaccaacuggccguuaccaucauggcaauuaguugcgugcccaaugccgucaucuuacagaacgcuuggaagguguccuguacgauacucgcggccguuucugugagcccacugcuucugacauccucacagcagaaagcagacuggauuccuuuggcucucaccaucaagggccugaaucccacugccaucuuucuaaccacacugagccgcacaaguaaaaagcggucuuggccacuuaacgaagccauuauggcugucgggaugguauccauacucgcaagcucgcuguugaaaaaugacaucccgaugaccggaccucugguggccgguggcuuacucacgguuugcuaugugcugacagggagaucagcggaucuugagcuggaaagggcugccgacgucaagugggaggaucaagcagagauuucuggaaguucccccaucuugagcauuaccaucucugaagacggcagcauguccaucaaaaacgaggaagaggagcagacucucacaauccugauucgaaccggucuacuggugaucucagggguauucccagugaguauucccaucacugccgcugcaugguaccuuugggaagucaagaagcagcgcgccggaguucucugggaugugccuagcccacccccuguggagaaagcggaacuggaggacggcgcuuaucggauaaagcagagaggcauuuugggguacucucaaaucggagccggugucuauaaagaaggcacauuucacaccauguggcaugugacgagaggggcaguuuuaaugcaccguggaaagcgcaucgagccguccugggccgaugucaaaaaggaccugauuucauacggcgguggguggaagcucgagggagaauggaaagagggcgaagaggugcagguccuggcucuugaaccaggcaagaauccccgggccgugcagacuaaaccugggaucuucaagaccaacacaggaaccauaggugcaguuagucuggauuuuagcccaggcacauccgggucucccauuguggacagaaaaggaaaggucgugggcuuguacgguaaugggguagucacuaggucgggagcuuaugugagcgccaucgcgcagaccgagaagucaauugaggauaacccugaaaucgaggacgauauauuccggaaaaagagacuaacgauuauggaccugcauccgggcgccggcaaaacaaagcgcuaccuccccgcaaucguuagagaagcuaucaaaagggggcugcggacucuuauuuuagccccaacccgaguggucgcugcagagauggaagaggcccugagaggacucccuauccgcuaucaaacacccgccauuaagaccgagcacacugguagggaaauaguggacuugaugugucaugcuaccuucacaaugcgucugcucuccccaguucgggugccuaacuacaaucugaucauuauggaugaggcgcacuuuacggaccccgcaaguaucgccgcuagaggcuauaucucuacuagggucgaaaugggggaggccgcaggaauuuucaugaccgccacaccaccgggcagccgcgauccuuuuccccaguccaacgcuccaauaauggacgaggaacgagagauccccgaaagaucauggaacucuggucacgagugggugaccgauuucaaggggaaaacuguaugguuugugccuagcauuaaggcgggaaacgacaucgccgcaugccuucggaaaaauggcaagaaaguuauucagcugaguaggaagacauucgauuccgaauacgucaagacccgcgcuaacgacugggauuuuguggugacgacugacaucagcgagaugggcgccaauuucaaagcagagcgugucauagauccaagacgguguaugaagcccguaaucuugacagacggggaagagagggugauucuagccggaccuaugccgguuacccauucuucagcugcccaacgccgagguagaaucggccggaaccccaaaaaugaaaacgaccaguauauuuacaugggggagccccuggaaaaugaugaggacugcgcgcacuggaaggaggcaaaaaugcucuuagauaacaucaauaccccugaaggaauaauucccuccauguuugagccagaaagggagaagguggacgccaucgauggcgaauaccgccugagaggugaggcuaggaaaacuuucgucgaccuuaugcggcguggggaucugccuguguggcucgccuauaagguugcugcagagggcauuaacuacgccgaccgcaagugguguuuugauggaaucaaaaauaaccagauauuggaagagaacauggaaguggagaucuggacaaaggagggcgaacgaaagaaacugaaacccagauggcucgacgcuaggauuuauagugauccacuggcccuuaaggaguucaaggaguucgcagcggggcggaaaagccuaacccugaauuugaucacagagaugggacgcuuaccuacuuuuaugacgcagaaggccagaaacgcucuggacaaucucgccguccugcauaccgcagaagcugguggcagggccuacaaccacgcacuuucggagcugccggagacacucgaaacuuugcugcuacugacccuccuugccacagugaccgggggaauuuuccuguuuuuaaugucuggcaaagguaucgggaagaugacuuugggcaugugcugcauaauuacggcuuccauccugcucugguaugcgcaaauccagccccacuggauugccgcaagcaucauacuggaguucuuucuuauuguacugcucaucccagaaccugagaaacagcggacaccacaggauaaucaauugacauacgugguuauugcuauccugacugucguggccgccaccauggcaaacgaaaugggauucuuagagaagacaaagaaagaccuaggccuggggucagugaccacucaggagagugaaucuaauauacucgacaucgaucuucgaccagcuuccgccuggacacuguaugcggucgcuacgaccuuuguuacuccuauguugagacauagcauugagaacucaagugugaauguaagccugacagccaucgcaaaccaggccaccgugcucaugggacuggguaagggcuggccccuuuccaaaauggacauuggggucccgcuccuggcuaucggauguuacucucaggugaauccaauuaccuugacagcaacucuguuacgcuucguugcccaauacgcgaucauaggcccuggucuacaggcuaaggccacgagggaagcacagaaacgggccgcugccgggauuaugaagaaccccaccguggauggcaucacagucaucgaccuggagccaauucccuaugauccuaaguuugaaaaacagcucggacaaguaaugcuucugauauugugcgugacucagguucugaugaugcguaccacaugggcacucugugaggcucugacccuugccacuggcccgaucagcacguuaugggaggggaaucccggaagauucuggaacacaaccauugcgguguccauggccaauaucuuuaggggcucauaccuggccggugcugggcucuuguucucuauuaugaagaacacuaccaguacacgccggggaacuggcaauaucggugaaacccugggcgagaaauggaagucgcgacuaaacgcccuggggaaaagcgaauuucagauauauaagaaauccggaauccaagaggucgacagaacacucgcaaaggagggcauuaagagaggggaaacggaucaccaugcugugucucgcggaucagccaaacuucggugguucgucgagagaaacauggugaccccagaaggcaagguuguggaccuggguugcgggcguggaggcuggagcuacuauugugguggcuugaaaaauguaagggaggugaaggggcugacuaaaggaggcccugggcacgaagaaccaaucccuauguccacauacggauggaaccucguccggcugcagaguggcguugauguguucuuuaccccacccgagaagugcgacacuuuacuuugugauauuggugaaucuagcccuaauccaacaaucgaggccgggcgcacccugcgaguccucaaccuaguggaaaauuggcugaacaauaacacgcaguucugcauaaagguauugaaucccuauaugccgucagugauugagaaaauggaagcgcugcagagacaauacggaggcgcucucguuaggaacccucuuucccggaauaguacccaugagauguacugggugagcaacgcaacaggcaauaucgucucuuccgugaacaugaucucacgcaugcugauuaauagauuuacuaugaagcacaaaaaggccaccuaugagccagacgucgauuuggggagcggaacaaggaacauagguaucgaaucggagauucccaaccuggacaucauuggcaaacgaaucgaaaagauaaagcaggagcacgaaaucucuuggcauuacgaccaggaucacccuuauaaaacuugggcuuaccaugggaguuaugagaccaagcagacaggauccgccagcucaauggugaauggcguuguacggcucuuaaccaaaccaugggacgugguccccauggugacucaaauggcaaugacggauacaaccccguucggucagcagcguguuuuuaaggagaaaguggacacuagaacccaggaaccuaaggaggggacaaagaaacugaugaagauuacggccgaauggcuuuggaaagagcugggaaagaaaaagacaccccgcauguguacuagggaggaguucaccaaaaagguccgguccaacgcugcgcuaggcgccaucuuuaccgaugagaauaaguggaaaucugcaagagaagcuguggaggacggccgcuucugggaacucguagauagggagcgaaaccugcacuuggaggggaagugcgaaacuuguguguacaauaugaugggaaaacgggagaagaaacugggugaauuuggcaaggccaaggggagcagagcaauuugguauauguggcucggagccagguuccuugaguuugaagcucugggcuucuuaaacgaggaccacugguuuagucgcgguaauucccugagcgggguugagggagaaggcuugcaucgucucggcuacauccugcgggaugucgggaaaaaggagggaggugccauguacgcggacgauacagcaggcugggacaccagaauuacacuagaagaccuuaaaaacgaggaaauggugacuaaucacaugaagggggagcauaaaaagcuggccgaggcuauauucaagcucaccuaucaaaacaaaguggucaggguucagcgcccaacgccucgaggaaccgugauggauaucauuucucggagagaccagaggggcucaggucaaguagggacauacggacugaauacuuucaccaacauggaagcccaguugauccgccagauggagggcgaaggcaucuuuaagaguauucagcaccugacagcaauagaggagaucgcugugcaaaauuggcucgccagagucgggcgggaaaggcuuucccguauggcuauuagcggagaugacugcgugguuaaacccaucgaugaccgauucgccucugcacugacugcguuaaacgauauggguaaggugcgcaaagacauucagcagugggagccaucgagaggcuggaaugauuggacccagguccccuuuugcucacaucacuuccacgaacuggugaugaaggacgggcggguauugguugugccuuguaggaaccaagaugagcucaucggacgcgccagaauaagccagggcgcugguuggucccugaaggaaacggccugccuagggaaaaguuaugcacagauguggacacuuauguacuuucaucggagggaccugcgacucgcugccaacgcaaucuguucugccgucccaagccacugggugccgaccucccguacuacauggucaauucaugcgaagcacgaguggaugaccacugaggauaugcuggcuguguggaauagagucuggauccaggaaaaccccuggauggaggacaaaaccccuguugaaaguugggaggaagugccauauuugggaaagcgcgaggaccaauggugcggcucuuuaauuggccugacaagccgggccacgugggccaaaaauauccagaccgccauaaaccagguaaggucccucauugggaaugaggaauacacugauuauaugcccucaaugaagagauuccgccgggaggaagaggaagcuggagugcuuugguga

SEQ ID NO: 14494 - RNA, 9876 nt, Artificial Sequence
  derived and/or modified CDS sequence (opt3) from DENV-2__JN819424__SS-prME
accgcaggcgugaucgucaugcugauucccaccgcuauggcauuccaccucacuacgagaaacggggagccucauaugauaguuggaaggcaggaaaaggguaagagccuucuguuuaagaccgaggacggcgugaauaugugcacauugauggccaucgauuuaggggaacugugugaggacacuauuaccuacaagugcccacuacuccggcaaaacgaaccggaggauaucgacuguuggugcaauuccacaucuaccugggugacuuauggaacauguaccacgacuggcgagcaccgccgagaaaagcguucaguggcgcuggucccccauguggguauggggcuugagaccaggacagaaacuuggaugaguagcgagggagcuuggaagcacguucagaggauugagaccuggauccugcggcauccuggcuucacaauaauggccgcaaucuuggccuacaccauuggcacgacucacuuucagcgcgcucucaucuucauucugcugacagcaguggccccauccaugaccaugagaugcaucgggauaucuaacagggauuuugucgaaggagugucggguggcucauggguagacauuguucucgagcacgggagcugugugacuacaauggcuaagaauaagcccaccuuagauuucgaacugaucaaaacggaggccaagcagccugcgacccuucggaaauauugcauugaagcaaaguugacaaacacuaccacagagagucgcuguccaacucaaggagagcccucccugaaugaggaacaggacaaacgauuuaucugcaagcauucuauggucgauagaggcugggguaacggguguggacuauucggcaagggcgggaucgugaccugcgccauguuuacaugcaaaaagaauauggaaggaaaagugguccagccugagaaccucgaauacaccauuguuauaacuccacacagcggugaggagcaugcugugggcaaugacacggggaagcacggaaaagaaaucaagauuacaccgcaguccucaaucaccgaggccgaacugacuggcuaugguaccguaacaauggaguguagucccaggaccgggcuugauuucaacgaaauggugcuguugcaaauggaggacaaagcauggcucguccaccggcagugguuucuggauuuaccucugccauggcuccccggcgcugacacucagggaagcaauuggauacagaaggagacacuugugacguucaagaacccucaugccaaaaagcaagacguugugguccugggcucucaggaaggggcgaugcacaccgccuugacuggagcaacagagauucagauguccucagguaaucuacuguuuaccggccaucucaaaugccgucugcgcauggauaaacuucaacugaaagggaugagcuacaguauguguacaggaaaguucaagaucgugaaagaaaucgcugagacucagcacggcaccauuguaaucagaguucaguaugagggugacgggucuccaugcaagauucccuucgaaauaacggauuuggagaaaaggcaugugcucggccggcugaucaccgucaacccgauugugacagaaaaggacuccccugucaacaucgaggccgaacccccauuuggagauagcuacaucauuauaggcguggagccugggcaguuaaaacugaauugguucaagaagggaucgucuaucggucaaauguuugagacuaccaugcgaggcgcuaaacgcauggccauucuaggggacacagcaugggauuucggaucccucggcgguguuuuuacuucaaucgggaaggcccugcaccagguguucggcgcuauuuacggagcggcauuuaguggcguaagcuggaccaugaaaauccuuauaggggucaucauuacguggaucggaaugaacuccagaucuaccagcuugucagugagucugguucucgugggcgucgugacacuguaucuuggugccguagugcaggcugacuccggguguguugucagcuggaagaauaaagaacugaagugcggaucuggcauuuucaucacugauaacgugcacacauggaccgagcaguacaaguuucaacccgaaucaccaaguaaauuggccagcgcaauacagaaggcccaugaggaagguauuuguggcaucagguccgugacucggcucgagaaucugauguggaaacagauuacccccgaguuaaaccacauccugucugaaaaugaggucaagcuaacaauaaugacgggggacaucaaaggaauuaugcaggcuggcaagcgcucgcucagaccucaaccaaccgaacugaaauauagcuggaagacuugggggaaggccaaaaugcuuuccacagagucacauaaccagaccuucuugaucgauggaccggaaacagcagagugccccaauacuaacagggcguggaauagucuggagguugaagacuacggcuuugguguguucaccacgaacauuuggcucaagcugcgugagaaacaggacguguuuugugauucuaaguuaaugagcgcuuccucaaucgacaaucgggccguacacgcagauaugggguauuggauggaaagcgccccuucugacuccugcaaaauggagaaggcuaguuucauagaggauaagagcuguuacuggccaaacucucagcaccugugguccaauggaguccuugaaucagagaugauuuuccccaaaaacuuugccggcccugugagucaacauaucuaucgaccagguuaccacacacagaccgcaggccccugcaacuuggggaagcucgaaauggacuucgauuuuugcgagggaacuaccguuguggucacagaagacuguggcaauagagggccgagccugaggacuaccacagcuucgggaaaacuaaucacggaguggugcugucgcuccugcacccugccuccacuccgguacagaggcgaggaugguuguugguaugggauggaaauuaggccccugaaggagaaagaagagaaccuuguaaauucuuugguuacugccggacauggccagaucgacaacuucagccuggguguguuaggcauggcgcucuuucuggaagagaugcuucgcacacgaauugggaccaagcacgccauacuguugguagcugucucauucgugacucucaucacaggaaauaugaguuuucgggaucugggccgugugauggucaugguuggggcaaccaugacggacgauauuggaaugggcgugacuuaccuagcccugcucgcugccuucaagguaagaccuaccuuugcagcgggucugcuuuugaggaaacugacauccaaggaguuaaugauggccaccaucgggauugcucuccugucucaaagcacuauccccgaaacaauacuugagcugaccgacgcccuagcacucggaaugauggugcugaaaaucguccgcaacauggaaaaguaucaguuggcugugacaauuauggccaucuccugcguuccaaaugcagugauucugcagaacgccuggaaagucucauguacuaucuuagcugcggugagcguuaguccucuccugcuuaccucuucccagcaaaaggccgacuggauaccccuggcauugacgauuaagggccucaauccaacagcuaucuuccugaccacucuaagccggaccucgaaaaagagaucauggccgcugaacgaggccaucauggccgugggcauggucucuauucuugcuaguucccuccugaaaaaugauauaccuaugacagggcccuugguagcaggaggucuguuaacugugugcuacguucucaccggcaggagcgccgaccuggaacuugagcgagcggcugaugugaagugggaggaccaggccgaaaucucugggagcuccccaauucugucaaucacgauuagugaggauggaagcaugucuaucaaaaacgaagaggaggaacagacauugaccauacucauccgcacuggccugcuagucauuuccgguguguuucccguaucaaucccuauuacagcagccgcuugguaucugugggaggugaagaaacagcgggcagggguccuuugggacguuccaagucccccuccgguggaaaaggccgagcucgaagauggagcguacagaaucaagcaaaggggcauacugggcuauagccagauuggggcuggaguguacaaagaggguaccuuccauacuauguggcacgucacacguggcgccguguugaugcaccgcgggaagcggaucgagccauccugggcagacguuaaaaaggauuuaaucucuuacggaggcgguuggaaacuggaaggggaguggaaggaaggagaggaaguacaggugcucgcccuggagcccggcaagaauccuagagcuguccagaccaaaccaggcauuuuuaagacgaacacugggaccaucggagccgugucgcuugacuucagccccgguacaucaggcuccccuauaguugauaggaaagggaagguggucggacuguauggcaauggugugguaacccgaaguggggcauacgucucugcuauugcccaaacagagaaaagcaucgaagacaacccggagauugaagaugacaucuuccggaagaagcgcuugacuauaauggaccuacaucccggagcgggcaaaaccaagagauaucugccagccauugugagggaggcaaucaaacggggccuccgaacgcugauccuugcuccuacaagaguuguggccgcugaaauggaggaggcauuacgcgggcugcccauuagguaccagacuccagccaucaagaccgaacacacaggacgugagauugucgaucucaugugucaugccaccuuuacuaugcgguugcuguccccugugagaguucccaacuauaaucucauaaucauggacgaagcucacuucaccgauccagcgucaauugcagccagggguuacaucucuacacgcguggagaugggcgaggcugccgggaucuuuaugacggcaacuccgccuggaagccgagaccccuucccacagaguaacgcccccauuauggaugaagagagagaaauaccugagcgguccuggaauagcggccaugaaugggucaccgacuuuaaagguaagacagugugguucguaccaucuaucaaggcugggaacgauauugcggccugccugaggaaaaauggaaagaaagugauccaacuuucacgcaagaccuuugacuccgaguauguuaaaacucgugcaaacgauugggacuucgucgugacaaccgauauuagugagaugggcgcuaauuuuaaggccgaaagagugaucgacccccggagguguaugaagccugucauacugacggacggcgaggaacgcguaaucuuggcagggccgaugccagugacucacagcucggccgcucagcgaagaggacggauugguaggaaccccaaaaaugagaacgaucaguacaucuacaugggcgaaccucuagagaaugacgaggauugcgcccacuggaaggaagcgaaaaugcugcucgacaacauuaauacacccgaggggaucauaccaucuauguucgaaccugagcgcgaaaagguugaggcaauugauggagaguauagauuaaggggcgaagcccggaaaaccuuuguggaccugaugcgucgcggugaucuucccguccgacuggcuuacaagguggccgcugaggggaucaacuaugcagacagaaaauggugcuucgauggcauuaaaaauucccagauccucgaagagaacauggagguugaaauauggaccaaggagggagaaaggaaaaaguugaaaccacgguggcuggacgcccgcaucuacagcgauccucucgcucugaaggaguucaaagaauuugccgcaggcagaaagucacuuacucuaaaccugauuacagagauggggagguugccgaccuucaugacacaaaaggcgcggaaugccuuagacaaccuggcugugcuccauacugccgaggcaggaggucgagcuuauaaucacgcccugagugaacuucccgagacgcuggaaacccucuugcugcuaacacugcucgcaacugucaccggcgggaucuuucuuuuccugaugucuggaaaaggcauugguaagaugacauuagggauguguugcaucauaaccgccuccauuuugcugugguacgcucagauccagccacauuggaucgcggccagcauuauccucgaguuuuuccugauagugcuucugauuccugaacccgagaaacagagaacuccacaagauaaccagcucacguauguagugaucgcaauuuugaccguugucgcugccacaauggccaaugagaugggcuuucuggaaaagacuaaaaaggacuuaggacuaggcucaaucaccacacaggagagugaaagcaacauacuggacaucgaucuccgcccugcauccgcuuggacccuuuacgccguggcgacuacauucgugacgcccaugcugaggcacucuauugagaauagcuccgucaacguuucauugaccgcuaucgccaaucaggcaacugugcugauggggcucggaaaggguuggccgcugucuaaaauggacauuggcguaccacuucucgccaucggguguuacagucaagugaacccuauuacacugaccgcugcauugcugcuauuagucgcccacuaugcgaucauaggacccggccugcaggcuaaggccacccgggaagcacagaaacgugccgcugccgguauuaugaagaauccaacaguggaugggaucacuguuaucgaccucgagcccauuccuuacgauccgaaauuugagaagcagcuuggccaagugaugcuguugauacugugcgucacgcagguacucaugaugagaaccacaugggcacugugugaagcucuuacuuuagccaccggacccaucucgacacugugggagggcaacccagggagguucuggaauaccacuauugcggugagcauggccaacaucuuucgcggauccuaucucgcaggcgcugguuugcuguucucuauuaugaagaauacgacaucaacccggcgagggacuggaaacaucggcgaaacccuaggugagaaauggaaaagcagacugaaugcccucggcaaauccgaguuucagauauacaagaaaagugggauccaagaaguugacaggacacuugcaaaggagggaauuaaacgcggcgaaacugaucaucacgcugugucucgggggagcgccaagcugagaugguucgucgagcguaacauggugaccccugaaggaaaggucguggacuugggcugcgguagagggggauggucauauuacuguggcggucugaaaaacguucgggaggugaagggccucacaaaagggggacccggccaugaggaaccuaucccaauguccacguauggguggaaucugguacgcuuacagaguggaguggaugucuucuuuacacccccugagaagugcgacacucuucugugugauauuggcgaaagcucuccaaaccccacaaucgaggccggucgaacccucagaguucuaaaucugguggaaaacugguugaauaacaauacucaguucugcauaaaaguccugaacccguacaugccuuccgugauugagaagauggaggcgcuccagaggcaauacgggggagcucuuguacggaauccacugucacgcaacagcacacacgaaauguauugggugucgaaugcaaccggcaacaucguuucuagugugaauaugaucuccagaauguugauuaacagguuuacgaugaagcauaaaaaggccaccuacgagcccgacgucgaucugggcagcgggacacgaaauauaggaaucgaaucagagauuccuaaccucgacaucauugguaaacggaucgaaaagauaaaacaggagcacgagaucuccuggcacuaugaccaggaucauccauacaagacuugggcuuaucacggcucuuacgaaaccaagcagacagggagcgccaguuccauggugaacggagucgugcguuuacugacuaaacccugggacguuguaccgauggugacccaaauggcaaugacagauaccacuccuuucggccagcagagagucuuuaaggagaaaguggacacgcgcacacaggaacccaaggaggguaccaagaaacuuaugaaaauuacugccgaguggcuguggaaagaacuagggaagaaaaagaccccaaggauguguacacgggaggaguucacgaaaaagguuagaagcaaugcugcgcucggagccaucuuuaccgaugagaacaaauggaagucugcacgcgaagcuguggaggacggcagguucugggagcuggucgaucgagaacggaauuugcaucuggagggcaagugcgaaacuugcguguauaacaugauggggaaaagagagaagaaacucggagaauuugguaaggccaaaggcucaagggcaauuugguacauguggcuuggggcccgcuuccuggaguuugaggcuuuaggauuccugaaugaagaccacugguuuagucguggcaacuccuugagcgguguagagggggaaggacuccaccggcugggcuacauccuaagagaugugggcaagaaggaagggggagccauguaugcggacgauacagcagguugggacaccaggauuacucuugaagaccugaaaaaugaggagaugguuacaaaccauaugaagggcgaacacaaaaagcucgccgaggcuauauucaaacugaccuaccaaaauaaggucgugcgcgugcagcgaccuacaccccgggggacugucauggauaucauuucuagaagggaccagcgcggaucgggccaaguugguaccuauggguugaacacguucaccaauauggaagcccagcugaucagacagauggagggagagggcaucuuuaagucaauucagcaucucacagcaacugaagagauagcugugcaaaacuggcuugcccggguaggcagggaacgucugagccgaauggcuaucuccggggaugacuguguggucaaaccaauugaugaccgcuucgccagugcauuaaccgcgcugaaugauaugggaaaggugagaaaagacauccagcagugggagcccucucgggguuggaacgauuggacacagguuccuuuuugcagccaccauuuccacgaauuggugaugaaggacggcaggguccucgugguaccaugucgcaaucaagaugagcugauugggagagcccggaucucccagggagcuggcuggucacuaaaagagacugccugccuugguaagaguuacgcacagauguggacccugauguauuuucacaggcgagaccuccgucuggcugccaacgcaauauguucugccguuccgagccauugggugcccacguccagaacaaccuggucaauccacgcgaagcaugaauggaugacuacagaggauauguuggcugucuggaaccgcguguggauucaggaaaauccuuggauggaggacaaaaccccaguggaaagcugggaggagguccccuacuuagggaagcgggaagaccaauggugcggaucucugaucggccucacuuccagggccaccugggccaagaacauucagacagccaucaaucagguuagaagucuuauaggcaacgaggaauauacggauuacaugccuagcaugaagcgcuuccggagggaggaagaggaggcuggggugcugugguga

SEQ ID NO: 14495 - RNA, 9876 nt, Artificial Sequence
  derived and/or modified CDS sequence (opt3) from DENV-2__FJ744741__SS-prME
accgccggcgugaucgucaugcugauucccacagcuauggcauuccaccucacuacgagaaacggggagccucauaugauaguuggaaggcaggaaaaggguaaaagccuucuguuuaagaccgaggacggcgugaauaugugcacauugauggccaucgauuuaggggaacugugugaggacacuauuaccuacaaaugcccacuacuccggcaaaacgaaccggaggauaucgacuguuggugcaauuccacaucuaccuggguaacuuauggaacauguaccacgacuggcgagcaccgccgagaaaagcguucaguggcgcuggucccccauguggguauggggcuugagaccagaacagaaacuuggaugaguagcgagggagcuuggaaacacguucagaggauugagaccuggauccugcggcauccuggcuucacaauaauggccgcaaucuuggccuacaccauuggcacgacucacuuucagcgcgcucucaucuucauucugcugacagcaguggccccauccaugaccaugagaugcaucgggauaucuaacagggauuuugucgaaggagugucggguggcucauggguagacauuguucucgagcacgggagcugugugacuacaauggcuaagaauaagcccaccuuagauuucgaacugaucaaaacggaggccaagcagccugcgacccuucggaaauauugcauugaagcaaaguugacaaacacuaccacagagagucgcuguccaacucaaggagagcccucccugaaugaagagcaggacaaacgauuuaucugcaagcauucuauggucgauagaggcugggguaacggguguggacuauucggcaagggcgggaucgugaccugcgccauguuuacaugcaaaaagaauauggaaggaaaagugguccagccugagaaccucgaauacaccauuguuauaacuccacacagcggugaggagcaugcugugggcaaugacacggggaagcacggaaaagaaaucaagauuacaccgcaguccucaaucaccgaggccgaacugacuggcuaugguaccguaacaauggaguguagucccaggaccgggcuugauuucaacgaaauggugcuguugcaaauggaggacaaagcauggcucguccaccggcagugguuucuggauuuaccucugccauggcuccccggcgcugacacucagggaagcaauuggauacagaaggagacacuugugacguucaagaacccucaugccaaaaagcaagacguugugguccugggcucucaggaaggggcgaugcacaccgccuugacuggagcaacagagauucagauguccucagguaaucuacuguuuaccggccaucucaaaugccgucugcgcauggauaagcuucaacugaaagggaugagcuacaguauguguacaggaaaguucaagaucgugaaagaaaucgcugagacucagcacggcaccauuguaaucagaguucaguaugagggugacgggucuccaugcaagauucccuucgaaauaacggauuuggagaaaaggcaugugcucggccggcugaucaccgucaacccgauugugacagaaaaggacuccccugucaacaucgaggccgaacccccauuuggagauagcuacaucauuauaggcguggagccugggcaguuaaaacugaauugguucaagaagggaucgucuaucggucaaauguuugagacuaccaugcgaggcgcuaaacgcauggccauucuaggggacacagcaugggauuucggaucccucggcgguguuuuuacuucaaucgggaaggcccugcaccagguguucggcgcuauuuacggagcggcauuuaguggcguaagcuggaccaugaaaauccuuauaggggucaucauuacguggaucggaaugaacuccagaucuacaagcuugucagugagucugguucucgugggcgucgugacccuguaucuuggugccaugguacaggcugacuccgggugugugguuagcuggaagaauaaagaacugaagugcggaucuggcauuuucaucacugauaacguccacacauggaccgagcaguacaaguuucaacccgaaucaccaaguaaauuggccagcgcaauacagaaggcccaugaggaagguauuuguggcaucagguccgugacucggcucgagaaucugauguggaaacagauuacccccgaguuaaaccacauccugucugaaaaugaggugaagcuaacaauaaugacgggggacauccgcggaauuaugcaggcuggcaaaagaucgcucaggccucaaccaaccgaacugaaguauagcuggaaaacuugggggaaggccaagaugcuuuccacagagucacauaaccagaccuucuugaucgauggaccggaaacagcagagugccccaauacuaaccgugcguggaauagucuggaggucgaagacuacggcuuugguguuuucaccacgaacauuuggcucaaacugcgggagaagcaggacguguuuugugauucuaaauuaaugagcgcugccaucaaggacaaucgagcagugcacgccgauaugggguauuggauagaauccgcucugaacgacacauggaaaauggagaaggccucauucauugagguaaagagcugccacuggccuaaaucucauacccuuugguccaauggagucuuggaaagugagaugaucaucccaaagaacuucgcaggccccgugagccagcacaacuacagaccugguuaucauacucaaaccgcuggcccauggcaccucgggaaacuggaaauggauuuugaccuaugugagggaacaacuguuguggucaccgaagauugcggcaauagggggcccucucugcgcacaacgaccgccuccggaaagcucauuacugaguggugcugucggucaugcacacugccgccucuuagauacaggggcgaggacgguuguugguacgggauggaaauccgcccauugaaagagaaggaagagaaccuggugaauaguuuaguuaccgcgggacauggccagauugauaacuucagccucggugugcugggcauggcccuuuuucuggaagagauguugcgaacucggauagggacaaagcacgcuauccuccugguagcagucucguucgugacccuaauuacgggaaauauguccuuucgugaccugggcagagugauggucaugguuggggccacuaugaccgaugacaucggaaugggcgugacauaucucgcucugcuugccgcauucaaaguaaggcccaccuuugcggccgguuugcuguuacgcaagcucacuucuaaagagcugaugauggcuacaauugggaucgcccuucugagccagucaaccauaccugaaacaauccuagagcucacugaugcacuggcuuugggaaugauggugcugaagauuguccggaacauggaaaaauaccaauuagccgugaccaucauggcaauuaguugcguucccaaugccgugauccuccagaacgcuuggagagucuccuguacgauacuggcggccgugucuguuagcccacuucuguugacauccucacagcagaaggcagacuggauuccucucgcucugaccaucaagggccuaaaucccacugccaucuuccugaccacacuuagcaggacuaguaaaaagcgaucuuggccacucaacgaggccauuauggcugugggcauggucuccauacuggcaagcucguugcugaaaaaugacaucccgaugaccgggccuuuaguagccggaggucuccugacggugugcuauguucuuacaggccgcucagcggaucuggaauuggagcgggcugccgacgugaagugggaggaucaagcagaaauuucugggaguucccccauccucagcauuaccaucucugaggacggaagcauguccauaaaaaacgaagaggaggaacagacucugacaauccuaauuagaaccggccugcuugucaucucagguguguuuccaguaaguauucccaucacugccgcugcaugguaccucugggaggugaagaaacagagggccgggguccugugggauguuccuagcccacccccuguggaaaaggcggaguuggaagacggagcuuaucguauaaagcagcgcggcauuuuaggcuacucucaaaucggggccggaguguauaaagaggguacauuccacaccauguggcaugucacgcggggcgcagugcugaugcacagagggaagaggaucgagccguccugggccgauguuaaaaaggaccucauuucauacggaggcgguuggaaacuggaaggggaguggaaggaaggagaggaaguacaggugcuugcucuggagccaggcaagaauccccgagccguccagacuaaaccuggcaucuuuaagaccaacacagggaccauaggagcagugaguuuggauuucagcccagguacauccggcucucccauuguugaccggaaagggaagguggucggacuauacggcaauggugugguaacucgcucgggggcuuaugucagcgccaucgcgcagaccgagaaaucaauugaagauaacccugagaucgaagacgauauauuuagaaagaagaggcugacgauuauggaccuccauccgggagccggcaaaacaaagcgguaccugcccgcaaucgugcgagaggcuaucaaaagaggccuucgcacuuuaauucuggccccaaccaggguuguggcugcagaaauggaggaggcccuccguggguugccuauccgguaucaaacaaccgccauuaagacugaacacaccggaagagagauagucgaccugaugugucaugcuacauucacgaugaggcuccugucccccgugcgcguuccaaacuacaaucuuaucauuauggaugaagcgcacuucacugacccugcaaguaucgccgcucgagguuauaucucuaccagaguggagaugggcgaggccgcagggauuuuuaugacagccacccccccaggaagccgggauccguucccucaguccaacgcucccauaauggacgaagagagggaaaucccagagcgcucauggaauucuggccacgaaugggucacugauuuuaaagguaagacagugugguucguacccagcauuaaggcggggaacgacaucgccgcaugccugcguaaaaauggaaagaaagugauucaguugaguagaaagaccuuugauuccgaguacguuaaaacgcgggcuaacgacugggauuucgucgugacuacagacaucagcgagaugggcgccaauuuuaaggcagaaagggugauagauccucgccgauguaugaagccagucauccuaaccgacggcgaggaaagaguaauucuggccgggcccaugccugugacccauucuucagcugcccaacggaggggacgcaucgguagaaacccgaaaaaugagaacgaccaguauauuuacaugggcgaaccacucgagaaugaugaggacugcgcgcacuggaaggaagcaaaaauguuacuggauaacaucaauacucccgaggggauaauuccuuccauguucgaacccgagagggaaaagguugacgccaucgauggagaguaccggcuucguggcgaggcucgcaaaacauuuguggaccugaugcgaagaggugaucucccagucugguuggccuauaagguggcugcagaagggauuaacuacgccgacaggaaaugguguuucgauggcaucaagaauaaccagauacuggaggaaaacauggagguugagaucuggaccaaggaaggagagcggaaaaagcucaaaccucgcuggcuggacgcuagaauuuauagugauccccuugcccuaaaggaauuuaaagaguucgcagcgggcaggaagagccugacauugaauuuaaucacugaaauggggcggcugccaacguucaugacccagaaggcccgaaacgcucucgacaaucuggccgugcuucauacagcagaggcuggagguagagccuacaaccacgcacugucggagcucccugaaacuuuggagacccugcuacugcucacacuucuggccaccgucacuggcgggauuuuuuuauucuugaugucuggaaaaggcaucgguaagaugacgcuggggaugugcugcauaauuaccgcuuccauccuccugugguaugcgcaaauccagccgcacuggauugccgcaagcaucauacuugaauuuuuccugauugugcucuugauccccgagccagaaaaacagcgcacaccucaggauaaucaacugacuuacguagugauugcuaucuuaaccguugucgccgccacaauggcaaacgagaugggcuuucuagagaagaccaaaaaggaccugggacucggcucaauaacuacacaggaaagugagucuaauauccuugacauugaucugaggcccgcuuccgccuggacguuguaugcgguggcuaccacuuucgugacaccaaugcugcggcauagcaucgaaaacucaagugucaauguuagccucaccgccauugcaaaccaggccaccgugcugauggggcuuggaaaggguuggccucucuccaaaauggacaucggcguaccccuguuggcuauuggguguuacucucaggugaauccgaucacacugacugcagccuuacuacugcucgucgcgcacuacgcuauaauuggaccaggccuucaagccaaggcaacgcgugaggcccagaaaagagcugccgcagguaucaugaagaacccuaccguggaugggaucacaguuauugaccuggaacccauaccauaugaucccaaauuugagaagcaguugggccaggugaugcugcucauccugugcgucacucaaguacuuaugaugaggaccacaugggcuuuaugugaggcccugacccucgcgacuggaccuauuagcacguugugggaaggcaauccggggcgcuucuggaacacaaccaucgccguguccauggcaaauauuuuucggggaucauaccuggcuggcgccggucuacuguucucuaucaugaagaacacuaccaauacacgaagagggacuggaaacauaggcgagacccucggugaaaaauggaagaguaggcuuaacgcacugggcaaaucggaguuucagaucuauaagaaaagcgggauucaggagguugaccgcacauuggcuaaggaaggaaucaaacggggcgagacggaucaucacgccguguccagagggucugccaagcugcguugguucgucgaaaggaauauggugacccccgagggaaaggucguggaccucggcugcggucgggggggauggucauacuauuguggcggucugaaaaacguucgcgaagugaagggcuuaacuaaagggggaccaggccaugaggagccuauucccaugagcacauacggguggaaucuuguacgacugcaauccggaguggaugucuuuuucaccccuccagaaaagugcgacacucuccuaugugauaucggcgagaguucucccaacccuacaauagaagcggguagaacccugaggguuuugaaucugguggagaacuggcucaauaacaauacgcaguucugcauuaaaguccuuaacccauauaugcccagcgugaucgaaaagauggaggcucugcagcggaaguacgggggagcauugguacgcaauccgcugucaagaaacuccacccacgagauguacugggugaguaaugccacaggcaacaucguuagcucugugaauaugauuuccaggaugcucauaaaccgauuuacuaugaaacacaagaaagcuaccuaugaaccugacgucgauuuaggcucagggacacggaacaucggaauugagagcgaaaucccaaaucuggacauuaucgguaagcguauagagaaaaucaagcaggaacaugagacuucguggcacuacgaccaagaucaucccuauaagaccugggccuaccacggcucuuaugagacaaaacagaccgggagugcauccagcauggugaacggagucgugagacuucugacuaagccuugggacguuguaccaauggugacgcagauggccaugacagauaccacucccuucggccagcaacgcgucuuuaaagaaaagguggacaccaggacacaggagccgaaagaagguacgaagaagcuaaugaaaauuaccgcugaguggcucuggaaggagcuggggaaaaagaaaacuccucggauguguacaagagaagaguucacccgcaagguuaggucaaaugcggccuugggagcaaucuuuacugaugaaaacaaauggaaguccgcucgagaggccguggaagacggccgguucugggagcuggucgauagagagaggaaucuccaccuugaaggcaagugcgagacauguguguacaacaugauggggaaacgcgaaaagaaacugggagaguuugguaaggcaaaaggcucucgugccauuugguauaugugguuaggggcucgguuccuggaauuugaggccuugggauuccucaaugaggaccauugguuuagcagaggcaacagucuguccgguguagaaggggagggacuacacaggcuuggcuacauccugcgcgaugugggcaagaaggaagggggagcgauguacgcagacgauaccgccgguugggacacacgaauuacucucgaggaccugaaaaaugaagagaugguuaccaaccauaugaagggcgagcacaaaaaguuggcugaagccauauucaaacugacguaucagaauaaggucgugcgggugcagagacccaccccaagggggacagucauggauaucauuagccgcagagaccaacggggaucuggccagguugguacuuacgggcucaacaccuuuacaaauauggaggcacagcuuaucaggcaaauggaaggagagggcaucuucaagucaauucagcaucugacugcuaccgaggaaauagccgugcagaacugguuagcucguguaggccgagagcgccugaguagaauggccaucuccggggaugacugcguggucaaaccuauugaugaccgguucgcaagcgcguugacggcccucaaugauaugggaaaggugaggaaagacauccagcaaugggaacccucucgcgguuggaacgauuggacacagguuccauuuugcucgcaccacuuccaugagcuggugaugaaggacggcagaguccuagugguacccugucggaaccaggaugaacuuauugggagggcucgaaucucacagggagccggcuggagccugaaagagaccgcaugccucgguaaguccuaugcucaaauguggacucugauguacuuucaccguagagacuugcgcuuagccgcaaaugccauauguagugcgguuccuucucauugggugccaacaagccggaccacuugguccauccacgcuaagcacgaguggaugaccacagaagauaugcuggccgucuggaacaggguguggauucaggagaauccguggauggaagacaaaacgcccguggagucaugggaagaggucccuuaucucgggaagagagaggaccaguggugcggaagucuuaucggccugaccucucgcgcaacuugggccaaaaacauucagacagcuaucaaucaaguucggagccuaauaggcaacgaagaguacaccgauuauaugccauccaugaagagguuccgaagagaagaggaagaggccggggugcugugguga

SEQ ID NO: 14496 - RNA, 9876 nt, Artificial Sequence
  derived and/or modified CDS sequence (opt3) from DENV-2__FJ744703__SS-prME
accgccggcgugaucgucaugcugauucccacagcuauggcauuccaccucacuacgagaaacggggagccucauaugauaguuggaaggcaggaaaaggguaaaagccuucuguuuaagaccgaggacggcgugaauaugugcacauugauggccaucgauuuaggggaacugugugaggacacuauuaccuacaaaugcccacuacuccggcaaaacgaaccggaggauaucgacuguuggugcaauuccacaucuaccuggguaacuuauggaacauguaccacgacuggcgagcaccgccgagaaaagcguucaguggcgcuggucccccauguggguauggggcuugagaccagaacagaaacuuggaugaguagcgagggagcuuggaaacacguucagaggauugagaccuggauccugcggcauccuggcuucacaauaauggccgcaaucuuggccuacaccauuggcacgacucacuuucagcgcgcucucaucuucauucugcugacagcaguggccccauccaugaccaugagaugcaucgggauaucuaacagggauuuugucgaaggagugucggguggcucauggguagacauuguucucgagcacgggagcugugugacuacaauggcuaagaauaagcccaccuuagauuucgaacugaucaaaacggaggccaagcagccugcgacccuucggaaauauugcauugaagcaaaguugacaaacacuaccacagagagucgcuguccaacucaaggagagcccucccugaaugaagagcaggacaaacgauuuaucugcaagcauucuauggucgauagaggcugggguaacggguguggacuauucggcaagggcgggaucgugaccugcgccauguuuacaugcaaaaagaauauggaaggaaaagugguccagccugagaaccucgaauacaccauuguuauaacuccacacagcggugaggagcaugcugugggcaaugacacggggaagcacggaaaagaaaucaagauuacaccgcaguccucaaucaccgaggccgaacugacuggcuaugguaccguaacaauggaguguagucccaggaccgggcuugauuucaacgaaauggugcuguugcaaauggaggacaaagcauggcucguccaccggcagugguuucuggauuuaccucugccauggcuccccggcgcugacacucagggaagcaauuggauacagaaggagacacuugugacguucaagaacccucaugccaaaaagcaagacguugugguccugggcucucaggaaggggcgaugcacaccgccuugacuggagcaacagagauucagauguccucagguaaucuacuguuuaccggccaucucaaaugccgucugcgcacagauaagcuucaacugaaagggaugagcuacaguauguguacuggaaaguucaagaucgugaaagaaaucgcugagacccagcacggcacgauuguaaucagaguucaguaugagggugacgggucuccaugcaagauucccuucgaaauaaccgauuuggagaaaaggcaugugcucggccggcugaucacagucaacccgauugugacugaaaaggacuccccugucaacaucgaggccgaacccccauuuggagauagcuacaucauuauaggcguggagccugggcaguuaaaacugaauugguucaagaagggaucgucuaucggucaaauguuugagaccacaaugcgaggcgcuaaacgcauggccauucuaggggacacugcaugggauuucggaucccucggcgguguuuuuaccucaaucgggaaggcccugcaccagguguucggcgcuauuuacggagcggcauuuaguggcguaagcuggacgaugaaaauccuuauaggggucaucauuacauggaucggaaugaacuccagaucuaccagcuugucagugagucugguucucgugggcgucgugacucuguaucuuggugccguagugcaggcugacuccggguguguugucagcuggaagaauaaagaacugaagugcggaucuggcauuuucaucacagauaacgugcacaccuggacugagcaguacaaguuucaacccgaaucaccaaguaaauuggccagcgcaauacagaaggcccaugaggaagguauuuguggcaucagguccgugacccggcucgagaaucugauguggaaacagauuacacccgaguuaaaccacaucccuucugaaaaugaggucaagcugacgauaaugaccggggacaucaaaggaauuaugcaggcuggcaagcgcucgcuaagaccacaaccgacugaacucaaauauagcuggaagacaugggggaaggccaaaaugcuguccaccgagucacauaaccagacauuccuuaucgauggacccgaaacugcagagugcccuaauaccaacagggcguggaauaguuuggagguugaagacuacggcuuugguguguucacgacaaacauuuggcugaagcuccgugagaaacaggacguguuuugugauucuaagcugaugagcgcugccaucaaagacaaucgggcaguacacgccgauaugggguauuggauagaauccgcuuuaaacgacaccuggaagauggagaaggccucauucauugaggucaaaagcugccacuggccaaagucucauacucugugguccaauggagugcuugaaagugagaugaucauccccaaaaacuucgcaggcccuguuagccagcacaacuaccgaccagguuaucauacccaaacagcuggccccuggcacuuggggaagcucgaaauggauuuugacuucugugagggaacuaccguggucgugacagaagauugcggcaauagagggccgucucugaggacgaccacugccuccggaaaacuaauuacagaguggugcugucgcucaugcacccugccuccacuccgguacagaggcgaggacgguuguugguacgggauggaaaucaggccccugaaggagaaggaagagaaccuuguuaauaguuuggugacugcgggacauggccagauugauaacuuuagccuggguguauuaggcauggcccucuuccuggaagagaugcuucgcacacgaauagggaccaaacacgcuauccuguuggucgcagugucguuugugacgcucauuacuggaaauauguccuuccgggaccugggccgugucaugguuauggugggggccaccaugacagaugacaucggaaugggcguaaccuaucuagcucugcucgccgcauuuaaggugagaccuacuuucgcggccggucugcuuuugaggaaacugacaucuaaggaguuaaugauggcuaccauugggaucgcccuccugagccagucaacaauacccgaaacuauccuugagcugaccgaugcacuagcucucggaaugaugguccugaaaauugugcgcaacauggaaaaguaccaauuggccguuacgaucauggcaauuaguugcgugccaaaugccgucauccugcagaacgcuuggaagguguccuguacaauauuagcggccguuucugugagcccucuccugcuuaccuccucacagcagaaagcagacuggauuccccuggcuuugacuaucaagggccucaauccaaccgccaucuuucugacaacucuaagccggaccaguaaaaagagaucuuggccgcugaacgaggccauuauggcugucggcaugguauccauacuugcaagcucgcuccugaaaaaugacaucccuaugacggggcccuugguggccggaggucuguuaacaguuugcuaugugcucaccggcaggucagcggaucuggaacuugagcgagcugccgacgucaagugggaggaucaagcagaaauuucugggaguuccccaauccugagcauuacuaucucugaggacggaagcauguccauaaaaaacgaagaggaggaacagacauugaccauccucauucgcacuggccugcuagugaucucagguguauuccccgugaguauuccuaucacagccgcugcaugguaccugugggaggucaagaagcagcgggccgggguucuuugggaugugccaagccccccuccgguggaaaaagcggagcucgaagacggagcuuauagaauaaagcagaggggcauucugggcuacucucaaaucggggccggagucuauaaagaggguaccuuucacacgauguggcaugugacucguggcgcaguuuugaugcaccgcgggaagcggaucgagccauccugggccgauguaaaaaaggacuuaauuucauacggaggcgguuggaagcuggaaggggaguggaaagaaggagaggaagugcagguccucgcucuggagcccggcaagaauccuagagccgugcagaccaaaccaggcaucuucaagacaaacaccgggacaauaggagcaguuagucuugauuuuagccccgguacuuccggcucuccuauuguggacaggaaagggaaggucgugggacuguacggcaaugguguagucacccgaucgggggcuuaugugagcgccaucgcgcagacggagaagucaauugaagauaacccggagaucgaagacgauauauuccggaaaaagcgcuugacaauuauggaccuacaucccggagccggcaaaacuaagagauaccugccagcaaucguuagggaggcuaucaaacggggccuccgaacccugauucuugccccuacaagaguggucgcugcagaaauggaggaggccuuacgcgggcugcccaucagguaucaaaccccagccauuaagacugaacacaccggacgugagauaguggaccucaugugucaugcuacauucacgaugcgguugcuguccccuguuagagugcccaacuacaaucucaucauuauggaugaagcgcacuuuacugacccagcaaguaucgccgcuagggguuauaucucuacccgcgucgagaugggcgaggccgcagggauuuucaugacagccaccccgccuggaagccgagaucccuuuccacaguccaacgcucccauaauggacgaagagagagaaaucccugagcggucauggaauucuggccacgaaugggugacugauuucaaggguaaaacaguaugguuugugccaagcauuaaggcggggaacgacaucgccgcaugccugaggaaaaauggaaagaaaguuauucagcuuagucgcaagaccuucgauuccgaguacgucaagacgcgugcuaacgacugggauuuuguggugacuacagacaucagcgagaugggcgccaauuucaaagcagaaagagucauagauccccggagguguaugaagccuguaauccugaccgacggcgaggaacgcgugauuuuggccgggccgaugccaguuacccauucuucagcugcccaacgaagaggacggaucgguaggaaccccaaaaaugagaacgaccaguauauuuacaugggcgaaccucuagagaaugaugaggacugcgcgcacuggaaggaagcaaaaaugcugcucgauaacaucaauacucccgaggggauaauuccauccauguuugaaccugagcgcgaaaagguggacgccaucgauggagaguacagauuaaggggcgaggcucggaaaacauucgucgaccugaugcgucgcggugaucuucccguguggcuggccuauaagguugcugcagaagggauuaacuacgccgaccgaaagugguguuuugauggcaucaaaaauaaccagauacucgaggaaaacauggagguggagaucuggaccaaggaaggagagagaaaaaaguugaaaccaagguggcuggacgcucggauuuauagugauccucucgcccugaaggaauucaaggaguucgcagcgggccgcaaaagccuuacacuaaaucugaucacugaaauggggagauugccgacguuuaugacccagaaggccaggaacgcuuuagacaaucuggccguccuccauacagcagaggcuggaggucgggccuacaaccacgcacugucggagcuucccgaaacucuggagacccucuugcugcuaacacugcucgccaccgugacuggcgggauuuuccuuuuucugaugucuggaaaaggcaucgguaagaugacguuagggaugugcugcauaauuaccgcuuccaucuugcugugguaugcgcaaauccagccacacuggauugccgcaagcaucauacucgaauucuuucugauuguacuucugaucccugagcccgaaaaacagcgaacaccacaggauaaucaacucacuuacgugguuauugcuaucuugaccgucguggccgccacaauggcaaacgagaugggcuuccuggagaagaccaagaaagacuuaggacuaggcucaauaacuacacaggaaagugagucuaauauccuggacauugaucucagaccugcuuccgccuggacgcuuuaugcgguggcuaccacuuuugucacacccaugcugcgccauagcaucgaaaacucaaguguuaaugugagcuugaccgccauugcaaaccaggccaccguacugauggggcucggaaaggguuggccgcuguccaaaauggacaucggcgugccacuucucgcuauuggguguuacucucaggucaauccuaucacacugacugcagccuugcuguuacuaguggcgcacuacgcuauaauuggacccggccugcaagccaaggcaacgagggaggcccagaaacgggcugccgcagguaucaugaagaacccaaccguugaugggaucacagugauugaccucgaacccauaccuuaugauccgaaguucgagaaacagcuuggccaggucaugcuguugauccugugcguaacucaagugcucaugaugcguaccacaugggcucugugugaggcccuuaccuuagcgacuggacccauuagcacgcugugggaaggcaauccagggagauuuuggaacacaaccaucgccguuuccauggcaaauauuuucaggggaucauaccucgcuggcgccgguuugcuguuuucuaucaugaagaacacuaccaguacacgccgggggacuggaaauauaggcgagacccuaggugaaaaauggaagucgcgacugaacgcacucggcaaaagcgaguuccagaucuauaagaaauccgggauucaggagguggacagaacacuugcuaaggaaggaaucaagaggggcgagacggaucaucacgccgucucucgcgggucagccaaacugcggugguuuguggaaagaaacauggucaccccugagggaaaggugguugacuugggcugcggucgugggggauggagcuacuauuguggcggucugaaaaaugugagggaaguaaagggccucacuaaagggggacccggccaugaggagccuauuccaauguccacauacggguggaaccuggugcgguuacaaaguggagucgauguuuucuucacccccccugaaaagugcgacacucuucugugugauaucggcgagucuagcccaaaucccacaauagaagcgggucgcacccuccgagugcuaaaccuggucgagaauugguugaacaauaacacgcaguuuugcauuaaggugcugaauccguauaugccuucaguaaucgaaaaaauggaggcucuccagagacaguacgggggagcacuugugaggaacccacugucccggaauaguacccacgagauguacuggguuagcaacgccacaggcaauaucgugucuuccgucaacaugauuucacgcauguugauaaauagauucacuaugaagcacaaaaaggcuaccuaugaacccgacguggaucugggcagcgggacaaggaacaucggaauugagucggaaaucccuaaccucgacauuaucgguaaacgaauagagaagaucaagcaagaacaugagauuucuuggcacuacgaccaggaucauccauauaaaacuugggccuaccacggcaguuaugagaccaagcagacaggguccgcaagcucaauggucaauggagugguucgguuacugaccaaacccugggacguagugccgauggucacucagauggccaugacggauacaaccccuuuuggccaacagcguguguucaaggaaaaaguugacacuagaacccaggagcccaaggaagguacaaagaaacuuaugaagaucacggcugaguggcuguggaaagagcuagggaagaaaaagaccccacgcauguguacuagggaagaguuuacaaaaaaggugcgguccaacgcggcccucggagcaauuuucaccgaugaaaauaaguggaaaucugcuagagaggccgucgaagacggccgcuuuugggagcugguggauagggagcgaaacuugcaccuggaaggcaagugcgagacuuguguauacaauaugauggggaaacgggaaaagaaacucggagaguucgguagagcaaagggcagcagggccaucugguauauguggcuuggggcucgcuuucuggaauucgaggccuuaggauuucugaacgaggaccauugguucagucguggcaauuccuugagcgguguggaaggggagggacuccaccggcugggcuacauucuaagagauguuggcaagaaagaagggggagcgauguacgcagacgauacagccgguugggacaccaggauaacacuugaggaccugaagaacgaagagauggucacuaaucauaugaaaggcgagcacaagaaacucgcugaagccaucuuuaagcugaccuaucagaacaagguggugcgcguccaacgaccuacgccccgggggaccguuauggauauuaucucuagaagggaccagcgcggaucaggccagguggguacauacggguugaauacuuucaccaacauggaggcacaacugaucagacagauggaaggagagggcauuuucaaaaguauacagcaucucacagcuacugaggaaaucgccguacagaauuggcuugcucgggugggcagggagcgucugucccgaauggccauuagcggggaugacugcgucgugaagccaaucgaugaccgcuuugcaucugcguuaaccgcccugaacgauaugggaaaaguuagaaaggacauucaacagugggaacccucgcgggguuggaaugauuggacgcaggugccuuucugcucacaccacuuucaugaguuggucaugaaagacggcagggugcucguaguuccaugucgcaaccaggaugaacugaucgggagagcucggauaagccaaggagccggcuggucccuaaaggagacagcaugccuugguaagaguuaugcucagauguggacccugauguacuuccacaggcgagaccuccgucuggccgcaaacgccaucuguucugcggugccgagccauuggguccccacuuccagaacaaccuggucaauucacgcuaaacacgaguggaugacuaccgaagauauguuggccguguggaaucgcguguggauccaggagaacccuuggauggaagacaagacaccagucgagaguugggaagagguucccuauuuagggaaacgggaggaccaguggugcggaucucugauuggccucacgagcagggcaaccugggccaagaauauccaaacugcuauaaaccaggugagaucccuuauuggcaaugaagaguacacagauuauaugccuucaaugaaacgcuuucggagggaagaggaagaggccgggguacugugguga

SEQ ID NO: 14497 - RNA, 9876 nt, Artificial Sequence
  derived and/or modified CDS sequence (opt3) from DENV-2__FJ850067__SS-prME
accgccggcgugaucgucaugcugauucccacagcuauggcauuccaccucacuacgagaaacggggagccucauaugauaguuggaaggcaggaaaaggguaaaagccuucuguuuaagaccgaggacggcgugaauaugugcacauugauggccaucgauuuaggggaacugugugaggacacuauuaccuacaaaugcccacuacuccggcaaaacgaaccggaggauaucgacuguuggugcaauuccacaucuaccuggguaacuuauggaacauguaccacgacuggcgagcaccgccgagaaaagcguucaguggcgcuggucccccauguggguauggggcuugagaccagaacagaaacuuggaugaguagcgagggagcuuggaaacacguucagaggauugagaccuggauccugcggcauccuggcuucacaauaauggccgcaaucuuggccuacaccauuggcacgacucacuuucagcgcgcucucaucuucauucugcugacagcaguggccccauccaugaccaugagaugcaucgggauaucuaacagggauuuugucgaaggagugucggguggcucauggguagacauuguucucgagcacgggagcugugugacuacaauggcuaagaauaagcccaccuuagauuucgaacugaucaaaacggaggccaagcagccugcgacccuucggaaauauugcauugaagcaaaguugacaaacacuaccacagagagucgcuguccaacucaaggagagcccucccugaaugaagagcaggacaaacgauuuaucugcaagcauucuauggucgauagaggcugggguaacggguguggacuauucggcaagggcgggaucgugaccugcgccauguuuacaugcaaaaagaauauggaaggaaaagugguccagccugagaaccucgaauacaccauuguuauaacuccacacagcggugaggagcaugcugugggcaaugacacggggaagcacggaaaagaaaucaagauuacaccgcaguccucaaucaccgaggccgaacugacuggcuaugguaccguaacaauggaguguagucccaggaccgggcuugauuucaacgaaauggugcuguugcaaauggaggacaaagcauggcucguccaccggcagugguuucuggauuuaccucugccauggcuccccggcgcugacacucagggaagcaauuggauacagaaggagacacuugugacguucaagaacccucaugccaaaaagcaagacguugugguccugggcucucaggaaggggcgaugcacaccgccuugacuggagcaacagagauucagauguccucagguaaucuacuguuuaccggccaucucaaaugccgucugcgcauggauaagcuucaacugaaagggaugagcuacaguauguguacaggaaaguucaagaucgugaaagaaaucgcugagacucagcacggcaccauuguaaucagaguucaguaugagggugacgggucuccaugcaagauucccuucgaaauaacggauuuggagaaaaggcaugugcucggccggcugaucaccgucaacccgauugugacagaaaaggacuccccugucaacaucgaggccgaacccccauuuggagauagcuacaucauuauaggcguggagccugggcaguuaaaacugaauugguucaagaagggaucgucuaucggucaaauguuugagacuaccaugcgaggcgcuaaacgcauggccauucuaggggacacagcaugggauuucggaucccucggcgguguuuuuacuucaaucgggaaggcccugcaccagguguucggcgcuauuuacggagcggcauuuaguggcguaagcuggaccaugaaaauccuuauaggggucaucauuacguggaucggaaugaacuccagaucuacaagcuugucagugagucugguucucgugggcgucgugacccuguaucuuggugccaugguacaggcugacuccgggugugugguuagcuggaagaauaaagaacugaagugcggaucuggcauuuucaucacugauaacguccacacauggaccgagcaguacaaguuucaacccgaaucaccaaguaaauuggccagcgcaauacagaaggcccaugaggaagguauuuguggcaucagguccgugacucggcucgagaaucugauguggaaacagauuacccccgaguuaaaccacauccugucugaaaaugaggugaagcuaacaauaaugacgggggacauccgcggaauuaugcaggcuggcaaaagaucgcucaggccucaaccaaccgaacugaaguauagcuggaaaacuugggggaaggccaagaugcuuuccacagagucacauaaccagaccuucuugaucgauggaccggaaacagcagagugccccaauacuaaccgugcguggaauagucuggaggucgaagacuacggcuuugguguuuucaccacgaacauuuggcucaaacugcgggagaagcaggacguguuuugugauucuaaauuaaugagcgcugccaucaaggacaaucgagcagugcacgccgauaugggguauuggauagaauccgcucugaacgacacauggaaaauggagaaggccucauucauugagguaaagagcugccacuggccuaaaucucauacccuuugguccaauggagucuuggaaagugagaugaucaucccaaagaacuucgcaggccccgugagccagcacaacuacagaccugguuaucauacucaaaccgcuggcccauggcaccucgggaaacuggaaauggauuuugaccuaugugagggaacaacuguuguggucaccgaagauugcggcaauagggggcccucucugcgcacaacgaccgccuccggaaagcucauuacugaguggugcugucggucaugcacacugccgccucuuagauacaggggcgaggacgguuguugguacgggauggaaauccgcccauugaaagagaaggaagagaaccuggugaauaguuuaguuaccgcgggacauggccagauugauaacuucagccucggugugcugggcauggcccuuuuucuggaagagauguugcgaacucggauagggacaaagcacgcuauccuccugguagcagucucguucgugacccuaauuacgggaaauauguccuuucgugaccugggcagagugauggucaugguuggggccacuaugaccgaugacaucggaaugggcgugacauaucucgcucugcuugccgcauucaaaguaaggcccaccuuugcggccgguuugcuguuacgcaagcucacuucuaaagagcugaugauggcuacaauugggaucgcccuucugagccagucaaccauaccugaaacaauccuagagcucacugaugcacuggcuuugggaaugauggugcugaagauuguccggaacauggaaaaauaccaauuagccgugaccaucauggcaauuaguugcguucccaaugccgugauccuccagaacgcuuggaaggucuccuguacgauacuggcggccgugucuguuagcccacuucuguugacauccucacagcagaaggcagacuggauuccucucgcucugaccaucaaaggccuaaaucccacugccaucuuccugaccacacuuagcagaacuaguaagaaaaggucuuggccacucaacgaggccauuauggcugugggcauggucuccauacuggcaagcucguugcugaagaaugacaucccgaugaccgggccuuuaguagccggaggucuccugacggugugcuauguucuuacaggccgaucagcggaucuggaauuggagcgcgcugccgacgugaaaugggaggaucaagcagaaauuucugggaguucccccauccucagcauuaccaucucugaggacggaagcauguccauaaagaacgaagaggaggaacagacucugacaauccuaauucggaccggccugcuugucaucucagguguguuuccaguaaguauucccaucacugccgcugcaugguaccucugggaggugaaaaagcagagagccgggguccugugggauguuccuagcccacccccuguggaaaaggcggaguuggaagacggagcuuauaggauaaaacagcguggcauuuuaggcuacucucaaaucggggccggaguguauaaggaggguacauuccacaccauguggcaugucacgcgcggcgcagugcugaugcaccgggggaaaagaaucgagccguccugggccgauguuaagaaagaccucauuucauacggaggcgguuggaagcuggaaggggaguggaaggaaggagaggaaguacaggugcuugcucuggagccaggcaaaaaucccagggccguccagacuaagccuggcaucuuuaaaaccaacacagggaccauaggagcagugaguuuggauuucagcccagguacauccggcucucccauuguugaccgaaaggggaaaguggucggacuauacggcaauggugugguaacucggucgggggcuuaugucagcgccaucgcgcagaccgagaagucaauugaagauaacccugagaucgaagacgauauauuucgcaagaaaagacugacgauuauggaccuccauccgggagccggcaagacaaaaagguaccugcccgcaaucgugcgggaggcuaucaagcgaggccuuagaacuuuaauucuggccccaacccgcguuguggcugcagaaauggaggaggcccucaggggguugccuauccguuaucaaacaaccgccauuaaaacugaacacaccggacgggagauagucgaccugaugugucaugcuacauucacgaugagacuccugucccccgugaggguuccaaacuacaaucuuaucauuauggaugaagcgcacuucacugacccugcaaguaucgccgcucgcgguuauaucucuacccgaguggagaugggcgaggccgcagggauuuuuaugacagccacccccccaggaagcagagauccguucccucaguccaacgcucccauaauggacgaagagcgggaaaucccagagaggucauggaauucuggccacgaaugggucacugauuuuaaggguaagacagugugguucguacccagcauuaaagcggggaacgacaucgccgcaugccugcgcaagaauggaaaaaaggugauucaguugagucguaaaaccuuugauuccgaguacguuaagacgagagcuaacgacugggauuucgucgugacuacagacaucagcgagaugggcgccaauuuuaaggcagaacgggugauagauccuaggcgcuguaugaaaccagucauccuaaccgacggcgaggaacgaguaauucuggccgggcccaugccugugacccauucuucagcugcccaaagacggggaaggaucggucgcaacccgaagaaugagaacgaccaguauauuuacaugggcgaaccacucgagaaugaugaggacugcgcgcacuggaaagaagcaaagauguuacuggauaacaucaauacucccgaggggauaauuccuuccauguucgaacccgagagagaaaaaguugacgccaucgauggagaguacaggcuucggggcgaggcucguaagacauuuguggaccugaugcgccgaggugaucucccagucugguuggccuauaaaguggcugcagaagggauuaacuacgccgacagaaagugguguuucgauggcaucaagaauaaccagauacuggaggaaaacauggagguugagaucuggaccaaagaaggagagaggaagaaacucaagccucgguggcuggacgcucgcauuuauagugauccccuugcccuaaaagaauuuaaggaguucgcagcgggcagaaagagccugacauugaauuuaaucacugaaauggggaggcugccaacguucaugacccagaaagcccggaacgcucucgacaaucuggccgugcuucauacagcagaggcuggaggucgagccuacaaccacgcacugucggagcucccugaaacuuuggagacccugcuacugcucacacuucuggccaccgucacuggcgggauuuuuuuauucuugaugucuggaaagggcaucgguaaaaugacgcuggggaugugcugcauaauuaccgcuuccauccuccugugguaugcgcaaauccagccgcacuggauugccgcaagcaucauacuugaauuuuuccugauugugcucuugauccccgagccagaaaagcagagaacaccucaggauaaucaacugacuuacguagugauugcuaucuuaaccguugucgccgccacaauggcaaacgagaugggcuuucuagagaaaaccaagaaggaccugggacucggcucaauaacuacacaggaaagugagucuaauauccuugacauugaucugcgccccgcuuccgccuggacguuguaugcgguggcuaccacucuggugacaccaaugcucaggcauagcaucgaaaacucaagugucaauguuagccugaccgccauugcaaaccaggccaccgugcuuauggggcucggaaaagguuggccucuguccaagauggacaucggcguacccuugcuggcuauuggguguuacucucaggugaauccgaucacauuaacugcagcccuacugcuccuugucgcgcacuacgcuauaauuggaccaggccugcaagccaaagcaacgcgggaggcccagaagcgugcugccgcagguaucaugaaaaacccuaccguggaugggaucacaguuauugacuuggaacccauaccauaugaucccaaguucgagaagcagcugggccaggugaugcuccugauccuuugcgucacucaaguauuaaugaugagaaccacaugggcucugugugaggcccucaccuuggcgacuggaccuauuagcacgcugugggaaggcaauccggggagguuuuggaacacaaccaucgccguguccauggcaaauauuuuccgcggaucauaccuagcuggcgccggucugcucuuuucuaucaugaaaaacacuaccaauacacggcgagggacuggaaccauaggcgagacacuuggugaaaaguggaaaaguagacugaacgcauugggcaagucggaguuccagaucuauaaaaagagcgggauucaggagguugacaggacgcuggcuaaagaaggaaucaagcgcggcgagaccgaucaucacgccgugucccgggggucugccaagcucagaugguuugucgaacguaacauggugacucccgagggaaaagucguggaccugggcugcgguagggggggauggucauacuauuguggcgguuuaaagaauguucgggaagugaaaggccuuacaaaggggggaccaggccaugaggagccuauucccaugagcaccuacggguggaaccugguacgccuccaauccggaguggaugucuucuuuacuccuccagaaaaaugcgagacacuacugugugacaucggcgaaaguucucccaauccuaccauagaggcgggucgaacguugagaguucugaaccucguggaaaauuggcuuaacaauaacacccaguucugcauuaagguccugaauccauauaugcccagcgugaucgagaagauggaggcuuugcagaggaaauacgggggagcacugguacggaacccgcucucacgcaauuccacacacgaaauguacugggugaguaacgccacuggcaauaucguuagcucugugaacaugauuuccagaauguuaauaaauagguucaccaugaagcacaaaaaggcuacauaugagccugaugucgaccugggcucagggacucgaaacaucggaauugaaagcgagaucccaaaccuugauauuaucgguaaacggauagaaaagaucaagcaggagcaugagaccucguggcacuacgaccaagaccaucccuauaaaacaugggccuaccacggcucuuaugaaaccaagcagacugggagugcauccagcauggugaauggagucgugcgucugcuaacgaaaccuugggauguuguaccaauggugacacagauggccaugaccgacacuacccccuuuggccagcaaagagucuucaaggagaaaguggauacacgcacgcaggaaccgaaggaggguaccaagaaacucaugaagauuacugcugaguggcuguggaaagaauuggggaagaaaaagacaccuaggauguguacccgggaggaauuuacuagaaaaguucgcucaaacgcggcccugggagcaaucuucacagacgagaauaaguggaaguccgcuagggaagccguggaggauggccgauuuugggagcucgucgaccgggaaagaaaccuucaccuggagggcaaaugcgaaaccuguguguacaauaugauggggaagagggagaaaaaguuaggagaauucgguaaagcaaagggcucucgcgccauuugguauauguggcugggggcucguuuuuuggaguucgaggcccucggauuucugaacgaagaucauugguucagccggggcaauagucuauccgguguagagggggaaggacuucacagacugggcuacauccucagggacgugggcaagaaagaggggggagcgauguacgcagaugacacagccgguugggauacucgcauuacccuggaagacuugaagaacgaggagaugguuacgaaucauaugaaaggcgaacacaagaaacuggcugaggccauauuuaagcucaccuaucagaacaaggucgugcgagugcagcggcccacaccaagagggacugucauggacaucauuagcaggcgcgaucaaagaggaucuggccagguugguaccuacgggcuuaauacauucacuaacauggaagcacagcugauccggcaaauggagggagagggcaucuuuaaaucaauucagcauuuaaccgcuacggaagagauagccgugcagaauuggcuggcuaggguaggccgugaacgauugagucgcauggccaucuccggggacgauugcguggucaagccuauugacgauagauucgcaagcgcgcucacagcccugaacgacaugggaaaaauccggaaggauauucagcaaugggagcccucuagggguuggaaugacuggacccaggugccauucugcucgcaccacuuucaugaacuaguuaugaaagauggccgcgugcuugucgugcccuguagaaaccaggacgagcugaucgggcgggcuaggauaucacagggagccggcuggagccucaaggagacugcaugccuggguaaguccuaugcucaaauguggacauugauguacuuccaccgacgugauuuaagacuggccgcaaacgccaucuguagugcgguaccuucucauuggguuccaaccagccgcacuaccugguccauucacgcuaaacacgaauggaugacaacggaggacaugcucgccguguggaaucgggucuggauccaggaaaacccguggauggaggauaagacccccguggaaucaugggaggaggugccuuaucuugggaaaagggaagaccaguggugcggaagucugauuggccuaacuucuagagcaacaugggccaagaauauccagaccgcuauaaaccaaguccgcagccugauuggcaaugaggaauacacugacuauaugccauccaugaaacgguuuaggcgagaggaagaggaggccgggguucucugguga

SEQ ID NO: 14498 - RNA, 9876 nt, Artificial Sequence
  derived and/or modified CDS sequence (opt3) from DENV-2__FJ850060__SS-prME
accgccggcgugaucgucaugcugauucccacagcuauggcauuccaccucacuacgagaaacggggagccucauaugauaguuggaaggcaggaaaaggguaaaagccuucuguuuaagaccgaggacggcgugaauaugugcacauugauggccaucgauuuaggggaacugugugaggacacuauuaccuacaaaugcccacuacuccggcaaaacgaaccggaggauaucgacuguuggugcaauuccacaucuaccuggguaacuuauggaacauguaccacgacuggcgagcaccgccgagaaaagcguucaguggcgcuggucccccauguggguauggggcuugagaccagaacagaaacuuggaugaguagcgagggagcuuggaaacacguucagaggauugagaccuggauccugcggcauccuggcuucacaauaauggccgcaaucuuggccuacaccauuggcacgacucacuuucagcgcgcucucaucuucauucugcugacagcaguggccccauccaugaccaugagaugcaucgggauaucuaacagggauuuugucgaaggagugucggguggcucauggguagacauuguucucgagcacgggagcugugugacuacaauggcuaagaauaagcccaccuuagauuucgaacugaucaaaacggaggccaagcagccugcgacccuucggaaauauugcauugaagcaaaguugacaaacacuaccacagagagucgcuguccaacucaaggagagcccucccugaaugaagagcaggacaaacgauuuaucugcaagcauucuauggucgauagaggcugggguaacggguguggacuauucggcaagggcgggaucgugaccugcgccauguuuacaugcaaaaagaauauggaaggaaaagugguccagccugagaaccucgaauacaccauuguuauaacuccacacagcggugaggagcaugcugugggcaaugacacggggaagcacggaaaagaaaucaagauuacaccgcaguccucaaucaccgaggccgaacugacuggcuaugguaccguaacaauggaguguagucccaggaccgggcuugauuucaacgaaauggugcuguugcaaauggaggacaaagcauggcucguccaccggcagugguuucuggauuuaccucugccauggcuccccggcgcugacacucagggaagcaauuggauacagaaggagacacuugugacguucaagaacccucaugccaaaaagcaagacguugugguccugggcucucaggaaggggcgaugcacaccgccuugacuggagcaacagagauucagauguccucagguaaucuacuguuuaccggccaucucaaaugccgucugcgcauggauaagcuucaacugaaagggaugagcuacaguauguguacaggaaaguucaagaucgugaaagaaaucgcugagacucagcacggcaccauuguaaucagaguucaguaugagggugacgggucuccaugcaagauucccuucgaaauaacggauuuggagaaaaggcaugugcucggccggcugaucaccgucaacccgauugugacagaaaaggacuccccugucaacaucgaggccgaacccccauuuggagauagcuacaucauuauaggcguggagccugggcaguuaaaacugaauugguucaagaagggaucgucuaucggucaaauguuugagacuaccaugcgaggcgcuaaacgcauggccauucuaggggacacagcaugggauuucggaucccucggcgguguuuuuacuucaaucgggaaggcccugcaccagguguucggcgcuauuuacggagcggcauuuaguggcguaagcuggaccaugaaaauccuuauaggggucaucauuacguggaucggaaugaacuccagaucuacaagcuugucagugagucugguucucgugggcgucgugacccuguaucuuggugccaugguacaggcugacuccgggugugugguuagcuggaagaauaaagaacugaagugcggaucuggcauuuucaucacugauaacguccacacauggaccgagcaguacaaguuucaacccgaaucaccaaguaaauuggccagcgcaauacagaaggcccaugaggaagguauuuguggcaucagguccgugacucggcucgagaaucugauguggaaacagauuacccccgaguuaaaccacauccugucugaaaaugaggugaagcuaacaauaaugacgggggacaucaaaggaauuaugcaggcuggcaagcgcucgcucagaccucaaccaaccgaacugaaauauagcuggaagacuugggggaaggccaaaaugcuuuccacagagucacauaaccagaccuucuugaucgauggaccggaaacagcagagugccccaauacuaacagggcguggaauagucuggaggucgaagacuacggcuuugguguuuucaccacgaacauuuggcucaagcugcgugagaaacaggacguguuuugugauucuaaguuaaugagcgcugccaucaaagacaaucgggcagugcacgccgauaugggguauuggauagaauccgcucugaacgacacauggaagauggagaaggccucauucauugagguaaaaagcugccacuggccuaagucucauacccuuugguccaauggagucuuggaaagugagaugaucaucccaaaaaacuucgcaggccccgugagccagcacaacuaccgaccugguuaucauacucaaaccgcuggcccauggcaccucgggaagcuggaaauggauuuugaccuaugugagggaacaacuguuguggucaccgaagauugcggcaauagagggcccucucugaggacaacgaccgccuccggaaaacucauuacugaguggugcugucgcucaugcacacugccgccucuucgguacagaggcgaggacgguuguugguacgggauggaaaucaggccauugaaggagaaggaagagaaccuggugaauaguuuaguuaccgcgggacauggccagauugauaacuucagccucggugugcugggcauggcccuuuuucuggaagagauguugcgcacucgaauagggacaaaacacgcuauccuccugguagcagucucguucgugacccuaauuacgggaaauauguccuuucgggaccugggccgugugauggucaugguuggggccacuaugaccgaugacaucggaaugggcgugacauaucucgcucugcuugccgcauucaagauuagacccaccuuugcggccgguuugcuguuaaggaaacucacuucuaaggagcugaugauggcuacaaucgggauagcccuucugagccagucaaccaucccugaaacaauucuagagcucacugaugcacuggcuuugggaaugaugguacugaaaaucgugcgcaacauggaaaaguaccaauuagccgucaccauuauggcaaucaguugcgugcccaaugccguuauacuccagaacgcuuggaagguguccugugcgauucuggccgcagucucugugagcccacuucuguugacguccucacagcagaaagcugacuggaucccucucgcccugacaaucaagggccuaaaucccaccgccauuuuccugacuacccuuagccggacaaguaaaaagagaucuuggccacucaacgaggcuguuauggcagugggcauggucuccauacuggccagcucguugcugaaaaaugacaucccgaugacugggccuuuaguagcgggaggucuccugaccgugugcuauguucuuacgggcaggucagcugaucuggaauuggagcgagccgcagacgugaagugggaggaucaagccgaaauuucugggaguucccccauccucagcauuacaaucucugaggacggaagcauguccauaaaaaacgaagaggaggaacagacccugacuauccuaauucgcacaggccugcuugucaucucagguguguuuccaguaaguauucccaucaccgcugcagccugguaccucugggaggugaagaagcagcgggcggggguccugugggauguuccuagcccacccccuguggaaaaagcugaguuggaagacggagccuauagaauaaagcagaggggcauuuuaggcuacucucaaaucggggcaggaguguauaaagaggguacuuuccacacaauguggcaugucacccguggcgccgugcugaugcaccgcgggaagcggaucgagccguccugggcugauguuaaaaaggaccucauuucauacggaggcgguuggaagcuggaaggggaguggaaagaaggagaggaaguacaggugcuugcccuggagccaggcaagaaucccagagcaguccagacgaaaccuggcaucuuuaagacuaacaccgggacaauaggagcugugaguuuggauuucagcccagguaccuccggcucucccauuguugacaggaaagggaagguggucggacuauacggcaauggugugguaacacgaucgggggccuaugucagcgcgaucgcccagacugagaagucaauugaagauaacccugagaucgaagacgauauauuucggaaaaagcgccugaccauuauggaccuccauccgggagcaggcaaaacgaagagauaccugcccgcuaucgugagggaggccaucaaacggggccuucgaacauuaauucuggcuccaacuagaguuguggcagccgaaauggaggaggcccuccgcggguugccuaucagguaucaaacccccgcuauuaagacagaacacaccggacgugagauagucgaccugaugugucaugcgacuuucaccaugcggcuccuguccccagugagaguuccuaacuacaaucuuaucauuauggaugaagcacacuucacagaccccgccaguaucgcugccagggguuauaucucuacgcgcguggagaugggcgaggcagccgggauuuuuaugacugcuaccccaccgggaagccgagauccuuucccccaguccaacgcgccaauaauggacgaagagagagaaauccccgagcggucauggaauucuggccacgaaugggucacagauuuuaaggguaaaaccgugugguucguaccuagcauuaaggccgggaacgacaucgcagcuugccugaggaaaaauggaaagaaagugauucaguugagucgcaagacuuuugauuccgaguacguuaagacacgugccaacgacugggauuucgucgugaccacggacaucagcgagaugggcgcaaauuuuaaagccgaaagagugauagauccacggagguguaugaagcccgucauccuaacugacggcgaggaacgcguaauucuggcugggccuaugccggugacacauucuucagccgcgcaacgaagaggacggaucgguaggaacccaaaaaaugagaacgaccaguauauuuacaugggcgaaccccucgagaaugaugaggacugcgcacacuggaaggaagccaaaauguuacuggauaacaucaauaccccugaggggauaauucccuccauguucgaaccagagcgcgaaaagguugacgcuaucgauggagaguacagacuuaggggcgaggcccggaaaaccuuuguggaccugaugcgucgcggugaucucccugucugguuggcuuauaagguggcagccgaagggauuaacuacgcugaccgaaagugguguuucgauggcaucagaaauaaccagauacuggaggaaaacauggagguugagaucuggacuaaagaaggagagaggaagaaacucaagccccgguggcuggacgcccgcauuuauagugauccacuugcacuaaaagaauuuaaggaguucgcggccggcagaaagagccugacauugaauuuaaucaccgaaauggggaaacugccuacauucaugacucagaaggcuaggaacgcccucgacaaucuggcagugcuucauacggcugaggccggaggucgggcauacaaccacgcccugucggagcucccggaaaccuuggagacacugcuacugcucacucuucuggcuaccgucacaggcgggauuuuuuuauucuugaugucuggaaaaggcaucgguaagaugacccuggggaugugcugcauaauuacugcguccauccuccugugguaugcccaaauccagccccacuggauugcagcuagcaucauacuugaauuuuuccugauugugcucuugaucccagagccugaaaaacagcgaacgccccaggauaaucaacugaccuacguagugauugccaucuuaacaguugucgccgcaacuauggcuaacgagaugggcuuucuagagaagaccaagaaagaccugggacucggcucaauaacaacccaggaaagugagucuaauauccuugacauugaucugagaccagccuccgcguggacuuuguaugcuguggccacaacguucgugaccccuaugcugcgccauagcaucgaaaacucaagugucaauguuagccucacugcaauugccaaccaggcuacagugcugauggggcuuggaaaggguuggccccucuccaaaauggacaucggcguaccgcuguuggcaauuggguguuacucucaggugaauccaaucacccugaccgccgcguuacuacugcucgucgcucacuacgccauaauuggaccuggccuucaagcaaaggccacaagggaggcucagaaacgggccgcagcugguaucaugaagaaccccacuguggaugggaucacgguuauugaccuggaaccaauacccuaugauccuaaguuugagaaacaguugggccaggugaugcugcucauccugugcgucacccaaguacuuaugaugcguacaacuugggccuuaugugaggcgcugacccucgccacaggaccgauuagcaccuugugggaaggcaaucccgggagauucuggaacacuacgaucgcaguguccauggcuaauauuuuuaggggaucauaccuggccggcgcaggucuacuguucucuaucaugaagaacacaaccaauacucgccgggggaccggaaacauaggcgagacacucggugaaaaauggaagagucgacuuaacgcucugggcaaaucggaguuucagaucuauaagaaaagcgggauucaggagguugacagaacuuuggccaaggaaggaaucaagaggggcgagaccgaucaucacgccgugucccgcgggucugcgaaacugcggugguucgucgaaagaaauauggugacaccagagggaaaggucguggaccucggcugcggucgugggggauggucauacuauuguggcggucugaaaaacguuagggaagugaagggcuuaacgaaagggggaccuggccaugaggagcccauuccuaugagcaccuacggguggaaucuuguacggcugcaauccggaguggaugucuuuuucacuccacccgaaaagugcgacacacuccuaugugauaucggcgagaguucuccuaacccaaccauagaagcuggucgcacucugcgaguuuugaaucugguggagaacuggcucaauaacaauacacaguucugcauuaagguccuuaaccccuauaugccgagcgugaucgaaaaaauggaggcacugcagagaaaguacgggggagccuugguaaggaauccucugucacggaacuccacccacgagauguacugggugaguaaugcuacgggcaacaucguuagcucugugaauaugauuucccgcaugcucauaaacagauuuaccaugaaacacaagaaagccacauaugaaccagacgucgauuuaggcucagggacuaggaacaucggaauugagagcgaaauccccaaucuggacauuaucgguaagcgaauagagaagaucaaacaggaacaugagaccucguggcacuacgaccaagaucauccuuauaagacaugggcauaccacggcucuuaugagacuaaacagaccgggagugccuccagcauggugaacggagucgugcggcuucugacaaagccaugggacguuguacccauggugacccagauggcuaugacugauacgacaccguucggccagcaacgugucuuuaaagaaaagguggacaccagaacucaggagccuaaggaagguaccaaaaagcuaaugaaaauuacagcggaguggcucuggaaggagcuggggaaaaagaaaacgccccgcauguguaccagggaagaguucacucggaagguuagaucaaaugccgcauugggagcuaucuuuacagaugaaaacaaguggaaauccgcccgcgaggcaguggaagacggcagguucugggagcuggucgaucgagagcggaaucuccaccuugaaggcaagugcgagaccuguguguacaacaugauggggaaaagagaaaagaaacugggagaguuugguaaggccaagggcucuagggcuauuugguauaugugguuaggggcccgcuuccuggaauuugaggcguugggauuccucaaugaggaccauugguuuagccguggcaacagucuguccgguguagaaggggagggacuacaccggcuuggcuacauccugagagaugugggcaaaaaggaagggggagcaauguacgccgacgauacugcugguugggacacaaggauuacccucgaggaccugaaaaaugaagagaugguuacaaaccauaugaagggcgagcacaaaaaguuggccgaagcaauauucaagcugacuuaucagaauaaagucgugcgcgugcagcgaccaaccccucgggggacggucauggauaucauuagcagaagggaccaacgcggaucuggccagguugguaccuacgggcucaacacauuuacuaauauggaggcucagcuuaucagacaaauggaaggagagggcaucuucaagucaauucagcaucugaccgccacagaggaaauagcugugcagaacugguuagcccggguaggcagggagcgucugagucgaauggcaaucuccggggaugacugcguggucaaacccauugaugaccgcuucgcgagcgccuugacugcucucaaugauaugggaaaggugagaaaagacauccagcaaugggaaccaucucgggguuggaacgauuggacccagguucccuuuugcucgcaccacuuccaugagcuggugaugaaggacggcaggguccuagugguaccuugucgcaaccaggaugaacuuauugggagagcccggaucucacagggagcaggcuggagccugaaggagacggcuugccucgguaaauccuaugcccaaauguggacacugauguacuuucacaggcgagacuugcguuuagcagccaaugcgauauguagugcuguuccaccgcauugggugcccaccucuagaacuacauggagcauccacgccaagcacgaguggaugaccacugaagauaugcuggcagucuggaaccgcguguggauucaggggaauccuuggauggaggacaaaaccccaguggaauccugggaggaaguccccuaucucggaaagcgggaggaccaguggugcggcucacuuaucggccugacaaguagggccacgugggcuaaaaacauucagaccgccaucaaucaaguuagaucucuaauagggaacgaggaauacacugauuauaugccuagcaugaagcgcuuccggagggaggaagaggaagcaggagugcugugguga

SEQ ID NO: 14499 - RNA, 9876 nt, Artificial Sequence
  derived and/or modified CDS sequence (opt3) from DENV-2__FJ850061__SS-prME
accgccggcgugaucauuaugcugauacccacagcuauggcauuccaccucacuacgcggaacggggagccucauaugaucgucggaaggcaggaaaaggguaaaagccuucuguuuaagaccgaggacggcguuaauaugugcacauugauggccauugauuuaggggaacugugugaggacacuaucaccuacaaaugcccacuacuccggcaaaacgaaccggaggauauugacuguuggugcaauuccacaucuaccugggugacuuauggaacauguaccacgacuggcgagcaccgccgagaaaagcguucaguugcgcuggugccccaugucgguauggggcuugagaccagaacagaaacuuggaugaguagcgagggagcuuggaaacacgugcagaggaucgagaccuggauacugcggcauccuggcuucacaaucauggccgcaauuuuggccuacaccaucggcacgacucacuuucagcgcgcucucauuuucauccugcugacagcaguugccccauccaugaccaugagaugcauagggauuucuaacagggauuuuguggaaggagucucggguggcucauggguggacaucguccucgagcacgggagcuguguuacuacaauggcuaagaauaagcccaccuuagauuucgaacugauuaaaacggaggccaagcagccugcgacccuucggaaauauugcaucgaagcaaaguugacaaacacuaccacagagagucgcuguccaacucaaggagagcccucccugaaugaggaacaggacaaacgauuuaucugcaagcauucuaugguggauagaggcugggguaacggguguggacuauucggcaagggcgggauuguaaccugcgccauguuuacaugcaaaaagaauauggaaggaaaaguggugcagccugagaaccucgaauacaccauagucaucacuccacacagcggugaggagcaugcuguuggcaaugacacggggaagcacggaaaagaaauuaagaucacaccgcaguccucaauaaccgaggccgaacugacuggcuaugguaccgugacaauggaguguagucccaggaccgggcuugauuucaacgaaaugguacuguugcaaauggaggacaaagcauggcucgugcaccggcagugguuucuggauuuaccucugccauggcuccccggcgcugacacucagggaagcaauuggauucagaaggagacacuugucacguucaagaacccucaugccaaaaagcaagacgugguugugcugggcucucaggaaggggcgaugcacaccgccuugacuggagcaacagagauccagauguccucagguaaucuacuguuuaccggccaucucaaaugccgucugcgcauggauaaacuucaacugaaagggaugagcuacaguauguguacaggaaaguucaagaucgucaaagaaauugcugagacucagcacggcaccaucgugauuagaguacaguaugagggugacgggucuccaugcaagauacccuucgaaaucacggauuuggagaaaaggcauguucucggccggcugauuaccgugaacccgaucgucacagaaaaggacuccccugugaacaucgaggccgaacccccauuuggagauagcuacauuauaaucggcgucgagccugggcaguuaaaacugaauugguucaagaagggaucgucuauuggucaaauguuugcuacuaccaugcgaggcgccaaacgcauggcaauccuaggggacacagccugggauuucggaucccucggcgguguguuuacuucaauugggaaggcucugcaccagguuuucggcgcgaucuacggagcagccuuuaguggcgugagcuggaccaugaaaauacuuaucgggguaauuaucacguggauuggaaugaacuccagaucuacuagcuugucagucagucuggugcucguuggcguggucacccuguaucuuggugcuauggugcaggccgacuccggguguguagugagcuggaagaauaaagagcugaagugcggaucuggcaucuucauaacugauaacguucacacauggaccgaacaguacaaguuucaacccgagucaccaaguaaauuggcaagcgccauucagaaggcucaugaagaggguaucuguggcauuagguccgucacucggcucgaaaaucugauguggaaacagaucacccccgaguuaaaccacauacugucugagaaugaagugaagcuaacaaucaugacgggggacauuaaaggaaucaugcaggccggcaagcgcucgcucagaccucaaccaaccgagcugaaauauagcuggaagacuugggggaaggcaaaaaugcuuuccacagaaucacauaaccagaccuucuugauugauggaccggagacagcggaaugccccaauacuaacagggcuuggaauagucuggagguggaggacuacggcuuuggugucuucaccacgaacaucuggcucaagcugcgugaaaaacaggacguauuuugugauucuaaguuaaugagcgccgcaauaaaagacaaucgggccgugcacgcugauaugggguauuggauugaguccgcccugaacgacacauggaagauggaaaaggcaucauucaucgaggugaaaagcugccacuggccuaagucucauacccuuugguccaauggaguauuggagagugaaaugaucauucccaagaauuucgcuggccccgucagccagcacaacuaccgaccugguuaucauacucaaaccgccggcccauggcaccucgggaagcuggagauggauuuugaccuaugugaaggaacaacugugguugugaccgaggauugcggcaauagagggcccucucugaggacaacgaccgcguccggaaaacucaucacugaauggugcugucgcucaugcacacugccgccucuucgguacagaggcgaggacgguuguugguacgggauggagauuaggccauugaaggaaaaggaggaaaaccuggucaauaguuuagugaccgccggacauggccagauagauaacuucagccucgguguucugggcauggcucuuuuucuggaggaaauguugcgcacucgaaucgggacaaaacacgcaauucuccugguggccguaucguucgucacccuaaucacgggaaauauguccuuucgggaccugggccgugugauggugauggucggggcuacuaugaccgaugacauuggaaugggcguuacauaucucgcccugcuugcagcguucaaggugagacccaccuuugccgcugguuugcuguuaaggaaacucacuucuaaggagcugaugauggccacaaucgggauagcacuucugagccagucaaccaucccugagacaauucuagaacucacugaugcucuggccuugggaaugaugguacugaaaaucgugcgcaacauggagaaguaccaauuagcagucaccauuauggccaucaguugcgugcccaaugcuguuauacuccagaacgcguggaagguguccuguacgauucuggccgcagucucugugagcccacuucuguugacauccucacagcagaaagcugacuggaucccucucgcccugaccaucaagggccuaaaucccacugccauuuuccugaccacacuuagccggacaaguaaaaagagaucuuggccacucaacgaagcuauaauggcaguuggcaugguguccauccuggccagcucguugcugaaaaaugacauuccgaugaccgggccuuuagucgcgggaggucuccugacgguaugcuaugugcuuacaggcaggucagcugaucuggaguuggaacgagccgcagacguuaagugggaggaucaagccgagaucucugggaguucccccauucucagcaucaccauaucugaagacggaagcauguccaucaaaaacgaggaagaggagcagacucugacaauucuaauccgcaccggccugcuugugauuucaggugucuuuccagugaguauccccauaacugcugcagccugguaccucugggaaguaaagaagcagcgggcgggggugcugugggaugucccuagcccacccccuguugagaaagcugaauuggaggacggagccuauagaauuaagcagaggggcaucuuaggcuacucucaaaucggggcaggaguguauaaagaagguacauuccacaccauguggcaugugacgcguggcgccguccugaugcaccgcgggaagcggauugagccguccugggcugaugugaaaaaggaccucaucucauacggaggcgguuggaagcuggagggggaauggaaagagggagaagagguucagguacuugcccuggaaccaggcaagaaucccagagcagugcagacuaaaccuggcauauuuaagaccaacacagggaccauuggagcugucaguuuggauuucagcccagguacauccggcucucccaucguggacaggaaagggaagguugugggacuauacggcaauggugucgugacucgaucgggggccuauguaagcgcgauugcccagaccgagaagucaaucgaggauaacccugaaauagaggacgauauuuuucggaaaaagcgccugacgaucauggaccuccauccgggagcaggcaaaacaaagagauaccugcccgcuaucgucagggaagccauuaaacggggccuucgaacuuuaauccuggcuccaaccagagugguugcagccgagauggaagaggcccuccgcggguugccuauuagguaucaaacacccgcuauaaagaccgagcacacuggacgugaaaucguggaccugaugugucaugcgaccuucacaaugcggcuccuguccccagucagagugccuaacuacaaucuuauuaucauggaugaggcacacuucacggaccccgccaguaucgcugccagggguuauauuucuacucgcguugaaaugggcgaggcagccgggauauuuaugaccgcuacaccaccgggaagccgagauccuuucccccaguccaacgcgccaaucauggacgaggaaagagagauucccgaacggucauggaacucuggccacgagugggugaccgauuuuaaggguaaaacugucugguucgugccuagcaucaaggccgggaacgacauugcagcuugccugaggaaaaauggaaagaaaguaauccaguugagucgcaagacauuugauuccgaauacgugaagacccgugccaacgacugggauuucguugucacgacugacauaagcgagaugggcgcaaauuuuaaagccgagagagugaucgauccacggagguguaugaagcccgugauucuaacagacggcgaagaacgcgucauccuggcugggccuaugccgguaacccauucuucagccgcgcaacgaagaggacggauugguaggaaccccaagaaugaaaacgaccaguauaucuacaugggcgagccccucgaaaaugaugaggacugcgcacacuggaaggaggccaaaauguuacuggauaacauaaauaccccugaagggauuauccccuccauguucgagccagaacgcgagaagguggacgcuauugauggagaauacagacuuaggggcgaggcccggaaaacuuuuguugaccugaugcgucgcggugaucucccugugugguuggcuuauaaggucgcagccgaggggaucaacuacgcugaccgaaagugguguuucgauggcaucaagaauaaccagauccuggaagagaacauggaaguggagauuuggacaaaggagggagaaaggaaaaagcucaaacccagauggcuggacgcccggaucuauagugauccacuugcacuaaaggaguuuaaggaguucgcggccggccgcaaaagccugaccuugaauuuaauuacagagauggggagacugccuacuuucaugacgcagaaggcuaggaacgcccucgacaaucuggcaguucuucauaccgcugaagccggaggucgggcauacaaccacgcccugucggagcucccggagacauuggaaacucugcuacugcucacccuucuggcuacagugaccggcgggaucuuuuuauucuugaugucuggaaaaggcauagguaagaugacucuggggaugugcugcauuaucacggcguccauccuccugugguaugcccaaauucagccccacuggaucgcagcuagcauaauucuugaguuuuuccugaucguccucuugauuccagaaccugagaaacagcgaaccccacaggauaaucaacugacauacgugguaaucgccauauuaacugugguugccgcaaccauggcuaacgaaaugggcuuucuagagaagacaaagaaagaccugggacucggcucaaucaccacucaggagagugaaucuaauauucuugacaucgaucugagaccagccuccgcguggacauuguaugcugucgccacgaccuucgugacuccuaugcugcgccauagcauugagaacucaagugugaaugucagccucacagcaaucgccaaccaggcuaccguucugauggggcuuggaaaggguuggccccucuccaaaauggacauuggcgugccgcuguuggcaaucggguguuacucucagguaaagccaauaaccuuuacagccgcgcuguuacuacugguggcucacuacgccauuaucggaccuggccuccaagcaaaagcccccagggaagcucagaagcgggccgcagcugguaucaugaagaauccaacugucgaugggauuacggugauagaccuugagcccaucccuuaugauccgaaauucgaaaagcagcugggccagguuauguugcugauucucugcgugacccaaguccugaugaugcguacaacuugggcccuuugugaggcguuaacccuggccacaggacccaucagcacccucugggagggcaacccagggagauuuuggaauacuacgauugcaguauccauggcuaacaucuucaggggaucauacuuggccggcgcaggucugcuauuuucuauaaugaaaaauacaaccaacacucgccgggggaccggaaauaucggcgaaacacugggugagaaguggaaaagucgacucaacgcucuuggcaagucggaguuccagauuuauaaaaagagcgggauccaggagguggacagaacucuggccaaggagggaauuaaaaggggcgaaaccgaucaucacgccguuucccgcgggucugcgaaguugcggugguuuguggagagaaacauggucacaccugaaggaaaaguggucgaccugggcugcggucgugggggauggucauacuauuguggcggucucaagaaugugagggagguuaaaggccugacgaaagggggacccggccaugaagaaccuaucccaaugagcaccuacggguggaacuuagugcggcuucaauccggaguagauguguucuucacucccccugagaagugcgacacacugcucugugauauaggcgaaaguucuccaaaucccaccauugaggcuggucgcacucuacgaguccugaacuugguugaaaauuggcugaacaauaacacacaguuuugcaucaaagugcucaauccguauaugccuagcgucaucgagaagauggaagcacuucagagaaaauacgggggagcccuggugaggaacccauugucaagaaauuccacccacgagauguacuggguaaguaacgcuacgggcaauauugugagcucuguuaacaugauaucccgcaugcugaucaauagauucaccaugaagcacaaaaaggccacauaugagcccgacguggaucucggcucagggacuaggaacauuggaaucgaaagcgaggucccuaacuuagacauuaucgguaagcgaauagagaaaauaaagcaggaacaugaaaccucguggcacuacgaccaagaucauccauauaaaacaugggcauaccacggcucuuaugagacuaagcagaccgggagugccuccagcauggugaauggagucgugcggcugcuuacaaaacccugggacguuguaccgauggugacccagauggcuaugacugauacgacaccuuuuggccagcaacgugucuucaaggagaagguggacaccagaacucaggaacccaaagaggguaccaagaaacugaugaagauuacagcggaauggcuauggaaagagcucgggaagaaaaagacgccacgcauguguaccagggaggaauuuacucggaagguuagaucaaacgccgcacugggagcuaucuucacagaugagaauaaauggaaguccgcccgcgaagcaguggaggacggcagguuuugggaauuggucgaucgagagcggaaccugcaccucgagggcaaaugcgaaaccuguguguacaauaugauggggaagagagagaagaaacuuggagaguucgguaaagccaaaggcucuagggcuauuugguauauguggcugggggcccgcuuuuuagaguucgaagcgcugggauuuuugaacgaggaccauugguucagccguggcaauagucucuccgguguagagggggaaggacugcaccggcuaggcuacauccuuagagaugugggcaagaaagaagggggagcaauguacgccgacgauacugcugguugggacacaaggauuacccuggaagaccucaagaacgaggaaaugguuacaaaucauaugaaaggcgagcacaagaagcuggccgaggcaauauuuaaauugacuuaucagaacaaggucgugcgcgugcagcgaccuaccccacgggggacggucauggauaucauuagcagaagggaccaacgcggaucuggccagguugguaccuacgggcugaauacauucacuaacauggaagcucagcucaucagacaaauggagggagaaggcaucuucaaaucaauucagcaucuuaccgccacagaggagauagcugugcagaauuggcuggcccggguaggcagggaacguuuaagucgaauggcaaucuccggggaugacugcguggucaagccaauugaugaccgcuuugcgagcgcccugacugcuuugaacgauaugggaaaagugagaaaggacauccagcaaugggagcccucucgggguuggaaugauuggacccagguuccuuucugcucgcaccacuuucaugaacucgugaugaaggacggcaggguccuggugguaccaugucgcaaccaggaugagcuaauugggagagcccggaucucacagggagcaggcuggagccuuaaagaaacggcuugccuggguaaguccuaugcccaaauguggacacucauguacuuccacaggcgagaccugcguuuggcagccaacgcgauauguagugcuguuccgccccauugggugccuaccucuagaacuacauggagcauccacgccaaacacgaguggaugaccacugaggauauguuagcagucuggaaucgcguguggauucaggaaaacccauggauggaggacaagacccccguggaauccugggaggaagucccuuaucuggggaaacgggaggaccaguggugcggaucacucaucggccuuacaaguagggccacgugggcuaagaauauucagaccgccaucaaccaaguuagaucucugauaggcaaugaggaauacacugauuauaugccaagcaugaagcgcuuucggagggaggaagaggaagcaggggugcuaugguga

SEQ ID NO: 14500 - RNA, 9876 nt, Artificial Sequence
  derived and/or modified CDS sequence (opt3) from DENV-2__FJ744709__SS-prME
accgccggagugaucgucaugcugauucccacggcuauggcauuccaccucacuacgcggaauggggaaccucauaugauaguuggaagacaggaaaaggguaaaagccuucuguuuaagaccgaagacggcgugaauaugugcacauugauggccaucgauuuaggggaacugugugaggacacuauuaccuacaaaugcccacuacuccggcaaaacgaaccggaggauaucgacuguuggugcaauuccacaucuaccugggugacuuauggaacauguaccacgacuggcgagcaccgccgagaaaagcguucaguggcgcuggucccccauguggguauggggcuugagaccagaacagaaacuuggaugaguagcgagggagcuuggaaacacguucagaggauugagaccuggauccugcggcauccuggcuucacaauaauggccgcaguguuggccuacaccaucggcacgacucacuuucagaaggcucucauuuucauccugcugacagcagucgccccauccaugaccaugcgcugcauugggaucucuaacagagauuuuguggaaggaguaucggguggcucauggguugacauagugcucgagcacgggagcugugucacuacaauggcuaagaauaaacccaccuuagauuucgaacugauuaagacggaggccaaacagccugcgacccuuaggaaguauugcaucgaagcaaaauugacaaacacuaccacagagagucgguguccaacucaaggagagcccucccugaaugaagaacaggacaagcgcuuuauuugcaagcauucuaugguggaucgaggcugggguaacggguguggacuauucggcaaaggcgggaucgugaccugcgccauguuuacaugcaagaaaaauauggaaggaaaggucguucagccugagaaccucgaauacaccaucgugauuacuccacacagcggugaggagcaugcuguaggcaaugacacggggaaacacggaaaggaaauaaaaaucacaccgcaguccucaauuaccgaggccgaacugacuggcuaugguaccgugacaauggaguguagucccagaaccgggcuugauuucaacgaaaugguccuguugcaaauggaggacaaggcauggcucgugcacaggcagugguuucuggauuuaccucugccauggcuccccggcgcugacacucagggaagcaauuggauccagaaggagacacuuguuacguucaaaaacccucaugccaagaaacaagacguggucgugcugggcucucaggaaggggcgaugcacaccgccuugacuggagcaacagagauacagauguccucagguaaucuacuguuuaccggccaucucaagugccggcugcguauggauaaacuucaacugaaggggaugagcuacaguauguguacaggaaaguucaaaauuguaaaggaaaucgcugagacucagcacggcaccaucguuauucgcgugcaguaugagggugacgggucuccaugcaaaauccccuucgaaauuacggauuuggagaagagacauguccucggcaggcugauaaccgugaacccgaucgucacagaaaaagacuccccugugaacauugaggccgaacccccauuuggagauagcuacaucaucauuggcguugagccugggcaguuaaagcugaauugguucaagaaaggaucgucuauaggucaaauguuugagacuaccaugcggggcgcuaagcgaauggccauccuaggggacacagcaugggauuucggaucccucggcgguguguuuacuucaauugggaaagcccugcaccagguauucggcgcuaucuacggagcggcauuuaguggcgucagcuggaccaugaagauucuuaucggggugauaaucacguggauuggaaugaacucccgcucuacuagcuugucaguuagucuggugcucgucggcgugguaacccuguaucuuggugccgugguucaggcugacuccgggugugucgugagcuggaaaaauaaggaacugaagugcggaucuggcaucuucauuacugauaacgugcacacauggaccgagcaguacaaauuucaacccgaaucaccaaguaaguuggccagcgcaauccagaaagcccaugaggaagguauauguggcauuagauccgucacuaggcucgagaaucugauguggaagcagaucacccccgaguuaaaccacauucugucugaaaaugagguuaaacuaacaaucaugacgggggacauaaagggaaucaugcaggcuggcaaacggucgcuccgcccucaaccaaccgaacugaaguauagcuggaagacuugggggaaagccaagaugcuuuccacagagucacauaaccagaccuucuugauugauggaccggaaacagcagagugccccaauacuaacagagcguggaauagucuggagguggaagacuacggcuuugguguguucaccacgaacaucuggcucaaacugagggagaagcaggacguauuuugugauucuaaauuaaugagcgcugccauuaaggacaaucgugcaguccacgccgauaugggguauuggaucgaauccgcucugaacgacacauggaagauggagaaagccucauucauagagguaaagagcugccacuggccuaaaucucauacccuuugguccaauggaguuuuggaaagugagaugauuaucccaaagaacuucgcaggccccgugagccagcacaacuaccggccugguuaucauacucaaaccgcuggcccauggcaccucgggaaacuggaaauggauuuugacuucugugagggaacaacugucgugguuaccgaagauugcggcaaucgagggcccucucuaagaacaacgaccgccuccggaaagcugaucacugaguggugcuguaggucaugcacacucccgccucugcgcuaccggggcgaggacgguuguugguacgggauggaaauuagaccacuuaaggagaaagaagagaacuuggugaauagucugguaaccgcgggacauggccagaucgauaacuuuagcuuagguguccucggcauggcccuguuccuugaagagaugcugaggacucgcauugggacaaagcacgcuauauugcucguggcagugucguuugucacccugaucacgggaaauauguccuuccgagaccuaggccggguuauggugaugguaggggccacuaugaccgaugacauuggaaugggcgugacauaucuggcucuccuggccgcauuuaaaguccgucccaccuucgcggccggucuuuugcugagaaaguuaacuucuaaagagcucaugauggcuacaaucgggauugcccugcuuagccagucaaccaucccugaaacaauacuggagcuaacugaugcacucgcucugggaaugaugguguugaagaucguuaggaacauggaaaaguaccaacuggccgugaccauuauggcaaucaguugcguccccaaugccgugauuuuacagaacgcuuggaaaguuuccuguacgauccucgcggccgugucugucagcccacugcuucugacauccucacagcagaaggcagacuggauaccuuuggcucucaccauuaaaggccugaaucccacugccaucuuucuaaccacacugagccgcacaaguaagaaacggucuuggccacuuaacgaggccaucauggcuguaggcaugguguccauucucgcaagcucgcuguugaagaaugacauaccgaugaccgggccucugguugccggagguuuacucacggugugcuauguccugacaggcagaucagcggaucuugaacuggagagggcugccgacgugaaaugggaggaucaagcagaaaucucugggaguucccccauuuugagcaucaccauuucugaggacggaagcauguccaucaagaacgaagaggaggaacagacucucacaauacugauccgaaccggccuacugguaauuucagguaucuucccagugaguauucccaucacugccgcugcaugguaccuuugggaggucaagaaacagcgcgccgggguucucugggaugugccuagcccacccccuguggaaaaggcggagcuggaagacggagcuuaucggauaaaacagagaggcauuuugggcuacucucaaaucggggccggagucuauaaggaggguacauuucacaccauguggcaugugacgaggggcgcaguuuuaaugcaccgugggaaacgcaucgagccguccugggccgauguaaagaaggaccugauuucauacggaggcgguuggaaacucgaaggggaguggaaggaaggagaggaagugcagguccuggcucuugagccaggcaaaaauccccgggccgugcagacuaagccuggcaucuucaaaaccaacacagggaccauaggagcaguuagucuggauuuuagcccagguacauccggcucucccauuguggacagaaaggggaaggucgugggauuguacggcaaugguguagucacuaggucgggggcuuaugugagcgccaucgcgcagaccgagaaaucaauugaagauaacccugagaucgaagacgauauauuccgaaagaaacggcuaacgauuauggaccugcauccgggagccggcaagacaaaacgcuaccuccccgcaaucguuagagaggcuaucaagaggggccugcggacucuuauuuuagccccaacccgaguggucgcugcagaaauggaggaggcccugagagggcucccuauccgcuaucaaacacccgccauuaagaccgaacacacuggaagggagauaguggacuugaugugucaugcuaccuucacaaugcgucugcucuccccaguucgggugccuaacuacaaucugaucauuauggaugaagcgcacuuuacggaccccgcaaguaucgccgcuagagguuauaucucuacuagggucgagaugggcgaggccgcagggauuuucaugaccgccacaccaccgggaagccgcgauccuuuuccccaguccaacgcuccaauaauggacgaagaacgagaaauccccgagagaucauggaacucuggccacgaaugggugaccgauuucaaagguaagacuguaugguuugugccuagcauuaaagcggggaacgacaucgccgcaugccuucggaagaauggcaagaagguuauucagcugaguaggaagacauucgauuccgaguacgucaaaacccgcgcuaacgacugggauuuuguggugacgacugacaucagcgagaugggcgccaauuucaaggcagaacgugucauagauccaagacgguguaugaaacccguaaucuugacagacggcgaggaaagggugauucuagccgggccuaugccgguuacccauucuucagcugcccaacgccgaggaagaaucggucggaacccaaagaaugagaacgaccaguauauuuacaugggcgaaccccuggagaaugaugaggacugcgcgcacuggaaagaagcaaagaugcucuuagauaacaucaauaccccugaggggauaauucccuccauguuugaaccagagagggaaaaaguggacgccaucgauggagaguaccgccugagaggcgaggcuaggaagacuuucgucgaccuuaugcggcguggugaucugccuguguggcucgccuauaagguugcugcagaagggauuaacuacacagaccgcaaaugguguuuugauggcaucaagaauaaccagauauuggaggaaaacauggagguggagaucuggaccaaagaaggagagcgaaagaaacugaagcccagauggcucgacgccaggauuuauagugauccacuggcucuuaaggaguucaaagaguucgccgcaggcagaaagagccuaacacugaauuugaucacugaaauggggcgcuuaccuacguuuaugacccagaaagcgagaaacgcccuggacaaucucgcuguccugcauacagccgaggcaggagguagggcuuacaaccacgcccuuucggagcugccggaaacucucgagaccuugcugcuacugacacuccuugcaaccgugacuggcgggauuuuccuguuuuuaaugucuggaaagggcaucgguaaaaugacguuggggaugugcugcauaauuaccgccuccauccugcucugguaugcucaaauccagccccacuggauugcggccagcaucauacuggaguucuuucuuauuguacugcucaucccagagccugaaaagcagcggacaccccaggauaaucaauugacuuacgugguuauugcaauccugaccgucguggcugccacaauggccaacgagaugggcuucuuagagaagaccaaaaaggaccuaggacugggcucaauaacuacacaggaaagugagucuaauauccucgacauugaucuucgaccagcauccgcuuggacgcuguaugccguggcgaccacuuuugucacaccuauguugagacauagcaucgaaaacucaaguguuaaugugagccugaccgcuauugccaaccaggcaaccguacucauggggcugggaaaagguuggccccuuuccaagauggacaucggcgugccgcuccuggccauuggguguuacucucaggucaauccaaucacauugacugcugcacuguuacuacugguggcccacuacgcgauaauuggaccuggccuccaagcuaaagccacgcgcgaggcacagaagagggccgcugccgguaucaugaagaaccccaccguugaugggaucacagugauugaccuugaaccaauacccuaugauccuaaauucgagaagcagcugggccaggucauguugcugauccucugcguaacucaagugcugaugaugcggaccacaugggcacuuugugaggcuuuaacccuggccacuggaccgauuagcacgcucugggaaggcaaucccgggcguuuuuggaacacaaccaucgcgguuuccauggccaauauuuucagaggaucauacuuggcaggcgcuggucugcuauuuucuaucaugaaaaacacuaccaguacaaggcgcgggacuggaaauauaggcgagacccugggugaaaaguggaaaucgcggcucaacgcccuuggcaagagcgaguuccagaucuauaaaaaguccgggauucaggagguggaccgaacacuggcaaaggaaggaaucaaaagaggcgagacggaucaucacgcugucucuagggggucagccaaguugcgcugguuuguggaacggaacauggucaccccagagggaaaagugguugaccugggcugcgguagagggggauggagcuacuauuguggcggucucaagaaugugcgugaaguaaaaggccugacuaaagggggaccuggccaugaggagcccauuccuauguccacauacggguggaacuuagugaggcuucaaaguggagucgauguuuucuucaccccacccgaaaagugcgacacucugcucugugauaucggcgagucuagcccuaauccaacaauagaagccggucggacccuacgcgugcugaacuuggucgagaauuggcugaacaauaacacgcaguuuugcauuaaagugcucaaucccuauaugccgucaguaaucgaaaagauggaggcgcuucagcgacaguacgggggagcucuggugagaaacccuuuguccaggaauaguacccacgagauguacuggguuagcaacgcaacaggcaauaucgugucuuccgucaacaugauuucacggaugcugauaaaucgcuucacuaugaaacacaagaaagccaccuaugaaccagacguggaucucggcagcgggacaagaaacaucggaauugagucggaaauccccaacuuagacauuaucgguaagaggauagagaagaucaaacaagaacaugagauuucuuggcacuacgaccaggaucauccuuauaagacuugggcuuaccacggcaguuaugagaccaaacagacaggguccgccagcucaauggucaauggagugguucgacugcuuaccaagccaugggacguagugcccauggucacucagauggcaaugacggauacaaccccguuuggccaacagcggguguucaaagaaaagguugacacucguacccaggagccuaaggaagguaccaagaagcugaugaaaaucacggccgaguggcuauggaaggagcucgggaggaaaaagacaccccgcauguguacuagggaagaguuuacacggaaagugagauccaacgcugcgcugggagccauuuucaccgaugaaaauaaguggaagucugcacgcgaggcugucgaagacggcagguuuugggaguugguggaucgagagcggaaccugcaccucgaaggcaaaugcgagacuuguguauacaauaugauggggaagagagagaagaaacuuggagaguucgguaaagccaaaggcagcagggcaaucugguauauguggcugggggcccgcuuuuuagaguucgaggcucugggauuuuugaacgaggaccauugguucagucgugaaaauucccucagcggcguggagggugaagggcugcaccggcuaggauacauucuuagagauguuggcaagaaagagggcggggccauguacgcggacgauacagcaggaugggacaccaggauaacacuggaagaccucaagaacgaggagauggucacuaaucauaugaaaggugaacacaagaaacuggccgaggcuaucuuuaaguugaccuaucagaacaagguggugcgcguccaacgaccaacgccucggggcaccguuauggauauuaucucuagaagggaccagcgcgggucaggacaggugggcacauacggucugaauacuuucaccaacauggaagcccaacucaucagacagauggagggggagggaauuuucaaaaguauacagcaucuuacagcaacugaagagaucgcuguacagaauuggcuggcccgggugggcagggaacguuuaucccgaauggcuauuagcggcgaugacugcgucgugaagcccaucgaugaccgcuuugccucugcacugaccgcguugaacgauauggggaaaguuagaaaggacauucaacagugggagccaucgcggggauggaaugauuggacacaggugcccuucugcucacaccacuuucaugaacucgucaugaaagacgguagggugcugguaguuccuugucgcaaccaggaugagcuaaucggcagagcccggauaagccaaggggcuggauggucccuuaaggagacagccugccugggcaagaguuaugcacagauguggacccucauguacuuccacaggcgagaccugcguuuggcugccaacgcaaucuguucugccgugccaagccauugggucccgacuuccagaacaaccuggucaauucacgcgaaacacgaauggaugacuaccgaggauauguuagcuguguggaaucgcguguggauccaggaaaaccccuggauggaggacaagacaccugucgaaaguugggaggagguuccauaucuggguaaacgggaagaccaguggugcgggucucucauuggacuuacgagcagggccaccugggcaaagaauauccaaacugccauaaaccaggugagaucccugauuggcaaugaggaauacacagauuauaugcccucaaugaaacgcuuucggagggaggaagaggaggcuggcguacuaugguga

SEQ ID NO: 14501 - RNA, 9876 nt, Artificial Sequence
  derived and/or modified CDS sequence (opt3) from DENV-2__FJ744708__SS-prME
accgcaggcgugauaguaaugcugauucccacagcuauggcauuccaccucacuacgagaaacggggaaccucauaugauaguuggaaggcaggaaaaggguaaaagccuucuguuuaagaccgaggacggcgugaauaugugcacauugauggccaucgauuuaggggaacugugugaggacacuauuaccuacaaaugcccacuacuccggcaaaacgaaccggaggauaucgacuguuggugcaauuccacaucuaccuggguaacuuauggaacauguaccacgacuggcgagcaccgccgagaaaagcguucaguggcgcuggucccccauguggguauggggcuugagaccaggacagaaacuuggaugaguagcgagggagcuuggaaacacguucagaggauugagaccuggauccugcggcauccuggcuucacaauaauggccgcaaucuuggccuacaccauuggcacgacucacuuucagcgcgcucucaucuucauucugcugacagcaguggccccauccaugaccaugagaugcaucgggauaucuaacagggauuuugucgaaggagugucggguggcucauggguagacauuguucucgagcacgggagcugugugacuacaauggcuaagaauaagcccaccuuagauuucgaacugaucaaaacggaggccaagcagccugcgacccuucggaaauauugcauugaagcaaaguugacaaacacuaccacagagagucgcuguccaacucaaggagagcccucccugaaugaggaacaggacaaacgauuuaucugcaagcauucuauggucgauagaggcugggguaacggguguggacuauucggcaagggcgggaucgugaccugcgccauguuuacaugcaaaaagaauauggaaggaaaagugguccagccugagaaccucgaauacaccauuguuauaacuccacacagcggugaggagcaugcugugggcaaugacacggggaagcacggaaaagaaaucaagauuacaccgcaguccucaaucaccgaggccgaacugacuggcuaugguaccguaacaauggaguguagucccaggaccgggcuugauuucaacgaaauggugcuguugcaaauggaggacaaagcauggcucguccaccggcagugguuucuggauuuaccucugccauggcuccccggcgcugacacucagggaagcaauuggauacagaaggagacacuugugacguucaagaacccucaugccaaaaagcaagacguugugguccugggcucucaggaaggggcgaugcacaccgccuugacuggagcaacagagauucagauguccucagguaaucuacuguuuaccggccaucucaaaugccgucugcgcauggauaaacuucaacugaaagggaugagcuacaguauguguacaggaaaguucaagaucgugaaagaaaucgcugagacucagcacggcaccauuguaaucagaguucaguaugagggugacgggucuccaugcaagauucccuucgaaauaacggauuuggagaaaaggcaugugcucggccggcugaucaccgucaacccgauugugacagaaaaggacuccccugucaacaucgaggccgaacccccauuuggagauagcuacaucauuauaggcguggagccugggcaguuaaaacugaauugguucaagaagggaucgucuaucggucaaauguuugagacuaccaugcgaggcgcuaaacgcauggccauucuaggggacacagcaugggauuucggaucccucggcgguguuuuuacuucaaucgggaaggcccugcaccagguguucggcgcuauuuacggagcggcauuuaguggcguaagcuggaccaugaaaauccuuauaggggucaucauuacguggaucggaaugaacuccagaucuacuagcuugucagugagucugguucucgugggcgucgugacccuguaucuuggugccguagugcaggcugacuccggguguguugucagcuggaagaauaaagaacugaagugcggaucuggcauuuucaucacugauaacgugcacacauggaccgagcaguacaaguuucaacccgaaucaccaaguaaauuggccagcgcaauacagaaggcccaugaggaagguauuuguggcaucagguccgugacucggcucgagaaucugauguggaaacagauuacccccgaguuaaaccacauccugucugaaaaugaggucaagcuaacaauaaugacgggggacaucaaaggaauuaugcaggcuggcaagcgcucgcucagaccucaaccaaccgaacugaaauauagcuggaagacuugggggaaggccaaaaugcuuuccacagagucacauaaccagaccuucuugaucgauggaccggaaacagcagagugccccaauacuaacagggcguggaauagucuggagguugaagacuacggcuuugguguguucaccacgaacauuuggcucaagcugcgugagaaacaggacguguuuugugauucuaaguuaaugagcgcugccaucaaagacaaucgggcaguacacgccgauaugggguauuggauagaauccgcucugaacgacacauggaagauggagaaggccucauucauugaggucaaaagcugccacuggccuaagucucauacccuuugguccaauggaguguuggaaagugagaugaucauccccaagaauuucgcaggccccguuagccagcacaacuaccgaccugguuaucauacucaaaccgcuggcccauggcaccucgggaagcuggaaauggauuuugacuucugugagggaacaacuguggucgugaccgaagauugcggcaauagagggcccucucuaaggacaacgaccgccuccggaaaacugauuacugaguggugcugucgcucaugcacacucccgccucugcgguacagaggcgaggacgguuguugguacgggauggaaaucaggccacuuaaggagaaggaagagaacuugguuaauagucuggugaccgcgggacauggccagauugauaacuuuagcuuagguguacucggcauggcccuguuccuugaagagaugcugcgcacucgaauagggacaaaacacgcuaucuugcucgucgcagugucguuugugacccugauuacgggaaauauguccuuccgggaccuaggccgugucaugguuauggugggggccacuaugaccgaugacaucggaaugggcguaacauaucuggcucuccuggccgcauuuaaggugagacccaccuucgcggccggucuuuugcugaggaaauuaacuucuaaggagcucaugauggcuacaauugggaucgcccugcuuagccagucaaccauaccugaaacaauccuggagcuaacugaugcacucgcucugggaaugauggucuugaaaauugugcgcaacauggaaaaguaccaacuggccguuaccaucauggcaauuaguugcgugcccaaugccgucaucuuacagaacgcuuggaagguguccuguacgauacucgcggccguuucugugagcccacugcuucugacauccucacagcagaaagcagacuggauuccuuuggcucucaccaucaagggccugaaucccacugccaucuuucuaaccacacugagccggacaaguaaaaagagaucuuggccacuuaacgaggccauuauggcugucggcaugguauccauacucgcaagcucgcuguugaaaaaugacaucccgaugaccgggccucugguggccggagguuuacucacgguuugcuaugugcugacaggcaggucagcggaucuugaacuggagcgagcugccgacgucaagugggaggaucaagcagaaauuucugggaguucccccaucuugagcauuaccaucucugaggacggaagcauguccaucaaaaacgaagaggaggaacagacucucacaauccugauucgcaccggccuacuggugaucucagguguauucccagugaguauucccaucacugccgcugcaugguaccuuugggaggucaagaagcagcgggccgggguucucugggaugugccuagcccacccccuguggaaaaagcggagcuggaagacggagcuuauagaauaaagcagaggggcauuuugggcuacucucaaaucggggccggagucuauaaagaggguacauuucacaccauguggcaugugacgcguggcgcaguuuuaaugcaccgcgggaagcggaucgagccguccugggccgaugucaaaaaggaccugauuucauacggaggcgguuggaagcucgaaggggaguggaaagaaggagaggaagugcagguccuggcucuugagccaggcaagaaucccagagccgugcagacuaaaccuggcaucuucaagaccaacacagggaccauaggagcaguuagucuggauuuuagcccagguacauccggcucucccauuguggacaggaaagggaaggucgugggauuguacggcaaugguguagucacucgaucgggggcuuaugugagcgccaucgcgcagaccgagaagucaauugaagauaacccugagaucgaagacgauauauuccggaaaaagcgccuaacgauuauggaccugcauccgggagccggcaaaacaaagagauaccuccccgcaaucguuagggaggcuaucaaacggggccugcgaacucuuauuuuagccccaaccagaguggucgcugcagaaauggaggaggcccugcgcgggcucccuaucagguaucaaacacccgccauuaagaccgaacacacuggacgugagauaguggacuugaugugucaugcuaccuucacaaugcggcugcucuccccaguuagagugccuaacuacaaucugaucauuauggaugaagcgcacuuuacggaccccgcaaguaucgccgcuagggguuauaucucuacucgcgucgagaugggcgaggccgcagggauuuucaugaccgccacaccaccgggaagccgagauccuuuuccccaguccaacgcuccaauaauggacgaagagagagaaauccccgagcggucauggaacucuggccacgaaugggugaccgauuucaaggguaaaacuguaugguuugugccuagcauuaaggcggggaacgacaucgccgcaugccuuaggaaaaauggaaagaaaguuauucagcugagucgcaagacauucgauuccgaguacgucaagacccgugcuaacgacugggauuuuguggugacgacugacaucagcgagaugggcgccaauuucaaagcagaaagagucauagauccacggagguguaugaagcccguaaucuugacagacggcgaggaacgcgugauucuagccgggccuaugccgguuacccauucuucagcugcccaacgaagaggacggaucgguaggaaccccaaaaaugagaacgaccaguauauuuacaugggcgaaccccuggagaaugaugaggacugcgcgcacuggaaggaagcaaaaaugcucuuagauaacaucaauaccccugaggggauaauucccuccauguuugaaccagagcgcgaaaagguggacgccaucgauggagaguacagacugaggggcgaggcucggaaaacuuucgucgaccuuaugcgucgcggugaucugccuguguggcucgccuauaagguugcugcagaagggauuaacuacgccgaccgaaagugguguuuugauggcaucaaaaauaaccagauauuggaggaaaacauggagguggagaucuggacaaaggaaggagagaggaaaaagcugaaacccagauggcucgacgcucggauuuauagugauccacuggcccuuaaggaguucaaggaguucgcagcgggccgcaaaagccuaacccugaauuugaucacagaaauggggagauuaccuacuuuuaugacgcagaaggccaggaacgcucuggacaaucucgccguccugcauaccgcagaggcuggaggucgggccuacaaccacgcacuuucggagcugccggaaacacucgagacuuugcugcuacugacccuccuugccacagugaccggcgggauuuuccuguuuuuaaugucuggaaaaggcaucgguaagaugacuuuggggaugugcugcauaauuacggcuuccauccugcucugguaugcggaaauccaaccccacuggauugccgcaagcaucauacuggaguucuuucuuauuguacugcucaucccagaaccugagaaacagcgaaccccacaggauaaucaguugacauacgugguuauugcuauccugacugucguggccgccaccauggcaaacgagaugggcuucuuagaaaagacaaagaaagaccuaggacugggcucaauaaccacucaagagagugaaucuaauauccucgacauugaucuuagaccagcuuccgccuggacacuguaugcgguggcuacgaccuuugucacuccuauguugcgccauagcaucgagaacucaaguguuaaugugagccugacagccauugcaaaccaggccaccguacucauggggcugggaaaggguuggccccuuuccaaaauggacaucggcgugccgcuccuggcuauuggguguuacucucaggucaauccaaucaccuugacagcagcccuguuacuacugguggcgcacuacgcuauaauuggaccuggccuccaggccaaggcaacuagggaagcccaaaaacgggcugccgcagguaucaugaagaaccccacgguugaugggaucaccgugauugaccuugagccaauacccuaugauccuaaguucgagaaacagcugggccaggucauguugcugauccucugcguaacacaggugcugaugaugcguacuaccugggcucuuugugaagccuuaacacuggcgaccggaccgauuagcacucucugggagggcaaucccgggagauuuuggaacacgacaaucgccguuuccauggugaauauuuucucaggaucuuacuuggcaggcgcuggucugcaugucccacuaaggaagaacacccugcgcacucggcgagggaccggaaauacaggcgaaacucucggugagaaauggaagaguagacuuaacgcccugggcaaaucggaguuucaaaucuauaagaaaagcgggauacaggaaguggacaggaccuuggcaaaggagggaaucaagcgcggcgaaacagaucaccaugcugucucccgggggucugccaaacugagaugguucguggagcguaacaugguuacgccugaaggaaaggugguagaccucggcugcgguagagggggauggucauacuauuguggcggucugaaaaaugugcgggaggucaagggcuuaaccaaagggggacccggccacgaggaaccuauuccaaugagcacuuacggguggaaccuuguucgccugcaguccggaguggaugucuuuuucacacccccugagaagugcgacacccuccuaugugauaucggcgaaaguucuccaaaucccacuauugaggccggucgaacacugagaguguugaaccugguagaaaauuggcucaacaauaacacccaauucugcaucaaggugcuuaauccguauaugccuagcguuauagagaaaauggaggcgcugcagaggcaguacgggggagcuuuggugcggaacccacugucacgcaauuccacgcacgaaauguacugggucaguaacgcaaccggcaauauugugagcucugucaacaugaucuccagaaugcucaucaauagguuuacaaugaagcauaaaaaggccacuuaugagcccgacguggauuuaggcucagggacccgaaacauuggaauagaaagcgagaucccuaaccuggacauuaucgguaaacggauugaaaagaucaagcaggagcacgagauaucguggcauuacgaccaagaucacccauauaaaacaugggcuuaccacggcucuuaugaaacuaagcagaccgggagugccuccagcaugguuaauggaguagugcgucuucugacaaaacccugggacgucgugccgaugguuacccagauggcaaugacugauacgacaccuuucggccagcaaagaguguuuaaggagaaagucgacacccgcacucaggaacccaaggaggguaccaagaaacuaaugaagaucacagccgaguggcucuggaaagaacuggggaagaaaaagacgccaaggauguguacccgggaggaguucacuaaaaaggugagaucaaacgcugcguugggagccauuuuuacagaugagaauaaguggaaauccgcacgcgaagcuguagaggacggcagguucugggagcugguggaucgagaacggaaccuccaucuugagggcaagugcgaaaccuguguuuacaauaugauggggaaaagagagaagaaacugggagaauuugguaaggccaagggcucuagggcaaucugguauaugugguuaggggcccgcuuccuggaguuugaggcuuugggauuccucaacgaagaccacugguuuagccguggcaauagucuguccggugucgagggggaaggacuacaucggcuuggcuacauucugagagaugugggcaaaaaggaagggggagccauguacgcggacgauacugcagguugggacacaaggaucacccucgaagaccugaaaaacgaggagauggugacaaaucacaugaagggcgaacauaaaaaguuggccgaggcuauuuucaagcugacuuaucagaacaaagucguucgcgugcagcgaccuaccccacgggggacgguaauggauauaaucagcagaagggaccaacgcggaucuggccagguggguaccuacgggcucaauacauuuacuaacauggaagcccagcuuauuagacaaauggagggagagggcaucuucaagucaauccagcaccugaccgcaacagaagagauugcuguccagaauugguuagcccgggugggcagggaacgucugagucgaauggcuauauccggggaugacugcguugugaaaccaaucgaugaccgcuucgccagcgcauugacugcgcucaacgauaugggaaaggucagaaaagacauucagcaaugggagcccucucgggguuggaaugauuggacccaggugccuuuuugcucgcaccauuuccacgaacugguaaugaaggacggcaggguucuaguggucccaugucgcaaccaggaugagcuuaucgggagagcccggauuucacagggagcuggcuggagccugaaggagacggccugccucgguaaauccuaugcacaaauguggacacugauguacuuucauaggcgagacuugcguuuagcugccaacgcaaucuguagugccgugccgucucacugggugcccaccagcagaacuacaugguccauacacgcgaagcaugaauggaugaccacugaggauaugcuggcugucuggaaucgcguuuggauccaggaaaacccuuggauggaggacaaaaccccaguggaaucaugggaggagguacccuaucucgggaagcgggaagaccaguggugcggaagucuuauuggccugacaucuagggccacgugggccaaaaauauccagaccgccauuaaccaagugagaagccuaaucggcaaugaggaauacacugauuauaugccuuccaugaagcgcuuccggagggaggaagaggaggcugggguccugugguga

SEQ ID NO: 14502 - RNA, 9876 nt, Artificial Sequence
  derived and/or modified CDS sequence (opt3) from DENV-2__FJ810418__SS-prME
accgccggcgugaucgucaugcugauucccacagcuauggcauuccaccucacuacgagaaacggggagccucauaugauaguuggaaggcaggaaaaggguaaaagccuucuguuuaagaccgaggacggcgugaauaugugcacauugauggccaucgauuuaggggaacugugugaggacacuauuaccuacaaaugcccacuacuccggcaaaacgaaccggaggauaucgacuguuggugcaauuccacaucuaccuggguaacuuauggaacauguaccacgacuggcgagcaccgccgagaaaagcguucaguggcgcuggucccccauguggguauggggcuugagaccagaacagaaacuuggaugaguagcgagggagcuuggaaacacguucagaggauugagaccuggauccugcggcauccuggcuucacaauaauggccgcaaucuuggccuacaccauuggcacgacucacuuucagcgcgcucucaucuucauucugcugacagcaguggccccauccaugaccaugagaugcaucgggauaucuaacagggauuuugucgaaggagugucggguggcucauggguagacauuguucucgagcacgggagcugugugacuacaauggcuaagaauaagcccaccuuagauuucgaacugaucaaaacggaggccaagcagccugcgacccuucggaaauauugcauugaagcaaaguugacaaacacuaccacagagagucgcuguccaacucaaggagagcccucccugaaugaagagcaggacaaacgauuuaucugcaagcauucuauggucgauagaggcugggguaacggguguggacuauucggcaagggcgggaucgugaccugcgccauguuuacaugcaaaaagaauauggaaggaaaagugguccagccugagaaccucgaauacaccauuguuauaacuccacacagcggugaggagcaugcugugggcaaugacacggggaagcacggaaaagaaaucaagauuacaccgcaguccucaaucaccgaggccgaacugacuggcuaugguaccguaacaauggaguguagucccaggaccgggcuugauuucaacgaaauggugcuguugcaaauggaggacaaagcauggcucguccaccggcagugguuucuggauuuaccucugccauggcuccccggcgcugacacucagggaagcaauuggauacagaaggagacacuugugacguucaagaacccucaugccaaaaagcaagacguugugguccugggcucucaggaaggggcgaugcacaccgccuugacuggagcaacagagauucagauguccucagguaaucuacuguuuaccggccaucucaaaugccgucugcgcauggauaagcuucaacugaaagggaugagcuacaguauguguacaggaaaguucaagaucgugaaagaaaucgcugagacucagcacggcaccauuguaaucagaguucaguaugagggugacgggucuccaugcaagauucccuucgaaauaacggauuuggagaaaaggcaugugcucggccggcugaucaccgucaacccgauugugacagaaaaggacuccccugucaacaucgaggccgaacccccauuuggagauagcuacaucauuauaggcguggagccugggcaguuaaaacugaauugguucaagaagggaucgucuaucggucaaauguuuaaaacuaccaugcgaggcgcuaagcgcauggccauucuaggggacacagcaugggauuucggaucccucggcgguguuuuuacuucaaucgggaaagcccugcaccagguguucggcgcuauuuacggagcggcauuuaguggcguaagcuggaccaugaagauccuuauaggggucgugaucacguggauuggaaugaacuccagaucuacaagcuugucaguuagucuggugcucgucggcgugguaacccuguaucuuggugccgugguucaggcugacuccgggugugucgugagcuggaaaaauaaggagcugaagugcggaucuggcaucuucauuacugauaacgugcacacauggaccgaacaguacaaauuucaacccgagucaccaaguaaguuggccagcgcaauccagaaagcccaugaagaggguauauguggcauuagguccgucacucggcucgaaaaucugauguggaagcagaucacccccgaguuaaaccacauucugucugagaaugaaguuaaacuaacaaucaugacgggggacauaaagggaaucaugcaggcuggcaaacgcucgcucagaccucaaccaaccgagcugaaguauagcuggaagacuugggggaaagccaagaugcuuuccacagaaucacauaaccagaccuucuugauugauggaccggagacagcagaaugccccaauacuaacagggcguggaauagucuggagguggaggacuacggcuuugguguguucaccacgaacaucuggcucaaacugcgugaaaagcaggacguauuuugugauucuaaauuaaugagcgcugccauuaaggacaaucgggcaguccacgccgauaugggguauuggaucgaguccgcucugaacgacacauggaagauggaaaaagccucauucauagaggugaagagcugccacuggccuaaaucucauacccuuugguccaauggaguuuuggagagugaaauggugauuccaaagaacuucgcaggccccgucagccagcacaacuaccgaccugguuaucauacucaaaccgcuggcccauggcaccucgggaaacuggagauggauuuugacuucugugaaggaacaacugugguugugaccgaggauugcggcaauagagggcccucucuaaggacaacgaccgccuccggaaagcugaucacugaauggugcugucgcucaugcacacucccgccucugcgguacagaggcgaggacgguuguugguacgggauggagaucaggccacuuaaggaaaaagaggaaaacuugguaaauagucuggucaccgcgggacauggccagauugauaacuuuagcuuaggugugcucggcauggcccuguuccuugaggaaaugcugcgcacucgaaucgggacaaagcacgcuauuuugcucguggcagucucguuuguuacccugauaacgggaaauauguccuuccgggaccuaggccgugugaugguaauggugggggccacuaugaccgaugacaucggaaugggcgucacauaucuggcucuccuggccgcauuuaaagugagacccaccuucgcggccggucuuuugcugaggaaguuaacuucuaaagagcucaugauggcuacaauugggaucgcccugcuuagccagucaaccauuccugagacaauccuggaacuaacugaugcacucgcucugggaaugaugguuuugaagauagugcgcaacauggagaaguaccaacuggccgucaccaucauggcaauuaguugcgugcccaaugccguuaucuuacagaacgcuuggaaaguguccuguacgauucucgcggccgucucuguaagcccacugcuucugacauccucacagcagaaggcagacuggaucccuuuggcucucaccauaaaaggccugaaucccacugccauuuuucuaaccacacugagccggacuaguaagaaaagaucuuggccacuuaacgaagccaucauggcugugggcaugguuuccauccucgcaagcucgcuguugaagaaugacauuccgaugaccgggccucugguggccggagguuuacucacggucugcuaugugcugacaggcaggucagcggaucuugagcuggaacgagcugccgacguaaaaugggaggaucaagcagagauaucugggaguucccccaucuugagcauuaccaucucugaagacggaagcauguccauuaagaacgaggaagaggagcagacucucacaauccugauacgcaccggccuacuggugaucucaggugucuucccaguuaguauucccaucacugccgcugcaugguaccuuugggaagugaagaaacagcgggccggggugcucugggaugucccuagcccacccccuguggagaaggcggaacuggaggacggagcuuauagaauuaaacagaggggcaucuugggcuacucucaaauaggggccggaguuuauaaggaagguacauuucacaccauguggcauguaacgcguggcgcaguguuaaugcaccgcgggaaacggauugagccguccugggccgaugucaagaaggaccugaucucauacggaggcgguuggaaacucgagggggaauggaaggagggagaagaggugcagguucuggcucuugaaccaggcaaaaaucccagagccgugcagacuaagccuggcaucuucaaaaccaacacagggaccauuggagcagucagucuggauuuuagcccagguacauccggcucucccaucguggacaggaaggggaagguagucggauuguacggcaauggugugguuacucgaucgggggcuuaugugagcgccauagcgcagaccgagaaaucaauugaggauaacccugaaaucgaggacgauauuuuccggaagaaacgccuaacgaucauggaccugcauccgggagccggcaagacaaaaagauaccuccccgcaauagucagggaagcuauuaagcggggccugcgaacucuuaucuuagccccaaccagagugguugcugcagagauggaagaggcccugcgcgggcucccuaucagguaucaaacacccgccauuaagaccgagcacacuggacgugaaaucguggacuugaugugucaugcuaccuucacaaugcggcugcucuccccagucagagugccuaacuacaaucugauuauaauggaugaggcgcacuuuacggaccccgcaaguaucgccgcuagggguuauauuucuacucgcguagaaaugggcgaggccgcagggaucuucaugaccgccacaccaccgggaagccgagauccuuuuccccaguccaacgcuccaaucauggacgaggaaagagagauucccgaacggucauggaauucuggccacgagugggugaccgauuucaaagguaagacuguuugguuugucccuagcauaaaagcggggaacgacaucgccgcaugccuuaggaagaauggaaaaaaggugauucagcugagucgcaagacauucgauuccgaauacgugaaaacccgugcuaacgacugggauuuugucguaacgacugacaucagcgagaugggcgccaauuucaaggcagagagagugauugauccacggagguguaugaaacccguuaucuugacagacggcgaagagcgcgugauacuagccgggccuaugccggucacccauucuucagcugcccaacgaagaggacggaucgguaggaacccaaagaaugaaaacgaccaguauauuuacaugggcgagccccuggaaaaugaugaggacugcgcgcacuggaaagaggcaaagaugcucuuagauaacaucaauaccccugaagggauuauccccuccauguuugagccagaacgcgagaaaguggacgccauagauggagaauacagacugaggggcgaggcucggaagacuuucguugaccuuaugcgucgcggugaucugccuguguggcucgccuauaaggucgcugcagaggggauuaacuacgccgaccgaaaaugguguuuugauggcaucaagaauaaccagauuuuggaagagaacauggaaguggagaucuggacaaaagagggagaaagaaagaaacugaagcccagguggcucgacgcucggauauauagugauccacuggcccuuaaggaguucaaagaauucgcagcgggccgcaagagccuaacccugaauuugaucacagagauggggagauuaccuacuuuuaugacgcagaaagccaggaacgcucuggacaaucucgccguacugcauaccgcagaagcuggaggucgggccuacaaccacgcacuuucggagcugccggagacacucgaaacuuugcugcuacugacccuccuugccacagugaccggcgggauuuuccuguuuuuaaugucuggaaagggcaucgguaaaaugacuuuggggaugugcugcauuaucacggcuuccauacugcucugguaugcgcaaauucagccccacuggaucgccgcaagcaucauucuggaguucuuucuuaucguucugcucauaccagaaccugagaagcagcgaaccccccaggauaaucaauugacauacgucgugauugcuauccugacuguggucgccgccaccauggcaaacgaaaugggcuucuuagagaagacaaaaaaggaccuaggacugggcucaauuaccacucaggagagugaaucuaauauccucgacauagaucuuagaccagcuuccgccuggacacuguaugcgguugcuacgaccuuugugacuccuauguugcgccauagcaucgagaacucaaguguaaaugugagccugacagccauugcaaaccaggccaccguccucauggggcugggaaaagguuggccccuuuccaagauggacaucggcgugccgcuccuggcuauuggguguuacucucagguuaauccaaucaccuugacagcagcccuguuacuacugguggcgcacuacgcuauuaucggaccuggccuccaagccaaagcaacuagggaagcccagaagcgggcugccgcagguauaaugaagaaccccacggucgaugggauuaccguaaucgaccuugagccaauccccuaugauccuaaauucgaaaagcagcugggccaggugauguugcugauucucugcguuacacaagugcugaugaugcguacuaccugggcucuuugugaggccuuaacacuggcgaccggaccgauaagcacucucugggagggcaaucccgggagauuuuggaacacgacaaucgccgucuccauggcaaauauuuucaggggaucauacuuggcuggcgccggucugcuauuuucuaucaugaaaaacaccacuaguacccgccgggggacaggaaauauuggcgaaacucugggugagaaguggaaaucgcgacucaacgcacuuggcaagagcgaauuccagaucuauaaaaaguccgggauacaggagguggacagaacccuggcuaaggagggaaucaaaaggggcgaaacagaucaucacgccgucucucgcgggucagccaaguugcggugguuuguggagagaaacaugguuacgccagaaggaaaagugguagaccugggcugcggucgugggggauggagcuacuauuguggcggucucaagaaugugagggaggucaaaggccugaccaaggggggaccuggccaugaagagcccauuccuauguccacuuacggguggaacuuaguucggcuucaaaguggaguggaugucuucuucacaccacccgagaagugcgacacccugcucugugauaucggcgaaucuagcccuaauccaacuauugaggcgggucgcacacuacgagugcugaacuugguagaaaauuggcugaacaauaacacccaguuuugcaucaaagugcucaaucccuauaugccgucaguuauagagaagauggaagcucuucagagacaguacgggggagcacuggugaggaacccuuugucccggaauaguacgcacgagauguacugggucagcaacgccaccggcaauauugugucuuccgucaacaugaucucacgcaugcugaucaauagauucacaaugaaacacaagaaagcuacuuaugagccagacguggaucucggcagcgggaccaggaacauuggaauagaaucggagauccccaacuuagacauuaucgguaagcgaauugaaaagaucaaacaagagcaugaaauaucuuggcacuacgaccaggaucauccuuauaagacaugggccuaccacggcaguuaugagacuaaacagaccggguccgcaagcucaaugguuaauggaguagugcggcugcuuacaaagccaugggacgucgugcccaugguuacccagauggccaugacugauacgacaccguuuggccaacagcguguguucaaagagaaggucgacaccagaacucaggaaccuaaggaggguaccaaaaagcugaugaaaaucacagcugaauggcuauggaaggagcucgggaaaaagaaaacgccccgcauguguaccaggguggaguuuacuaagaagguacgguccaacgcggcccugggagcaauuuucacagaugaaaauaaauggaagucugcuagagaggccguggaagacggccgcuuuugggaguugguugauagggaacgaaaccugcaccucgagggcaaaugcgagaccugugucuacaauaugauggggaagcgggaaaaaaagcuuggagaguucgguaaggcaaaaggcagcagagccaucugguauauguggcugggggcuagguuuuuagaauucgaggcccugggauuuuugaacgaagaccauugguucagucgcggcaauucccucagcgguguggagggggagggacugcaccgucuaggcuacauucuucgggaugugggcaagaaagaagggggagcgauguacgcagacgauacugccgguugggacacaagaaucacccuggaggaccucaagaacgaagagauggucacaaaucauaugaaaggcgaacacaagaagcuggcugaggccauuuuuaaauugacuuaucagaacaagguugugaggguacaacgcccaaccccucgagggacggugauggauauaaucucucggagagaccagaggggaucaggccaggucgguaccuacgggcugaauacauucacuaacauggaggcacaacucauucgccagauggaaggagagggcaucuucaaaaguauccagcaucuuaccgcuacagaagagauugccgugcagaauuggcuggcuagaguuggccgggagagguuaucccguauggccauaagcggggaugacugcguggucaagcccaucgaugaccgauuugcaucugcgcugacugccuugaacgauaugggaaaagugcgcaaggacauucaacagugggaaccaucgagagguuggaaugauuggacccagguacccuucugcucacaccacuuucaugagcucguuaugaaggacggccgggugcuggucgugccuuguaggaaccaggaugaacuaaucgggcgcgcuagaauuagccaaggagccggcuggucccuuaaagagacggcaugccuggguaagaguuaugcucagauguggacacucauguacuuccaccggagggaccugcgauuggccgcaaacgccaucuguucugcggugccaagccauugggucccgaccucccguacuacauggucaauacacgcuaaacacgaauggaugaccacugaggauauguuagccguuuggaauagaguguggauccaggagaaccccuggauggaagacaagaccccuguagagaguugggaagaggugccauaucuggggaaacgcgaagaccaguggugcggaucucucauuggccuuacaagccgggcaacgugggccaagaauauccaaaccgcuauuaaccaggucaggucccugaucggcaaugaggaguacacugauuauaugcccucaaugaagagauuucgccgggaagaggaagaggccggggugcuaugguga

SEQ ID NO: 14503 - RNA, 9876 nt, Artificial Sequence
  derived and/or modified CDS sequence (opt3) from DENV-2__FJ639835__SS-prME
accgccggcgugaucgucaugcugauuccaacagcuauggcuuuccaccucacuacgagaaacggggaaccucauaugauaguuggaaggcaggaaaaggguaaaagccuucuguuuaagaccgaagacggcgugaauaugugcacauugauggccaucgauuuaggggaacugugugaagacacuauuaccuacaaaugcccacuacuccggcaaaacgaaccggaagauaucgacuguuggugcaauuccacaucuaccuggguaacuuauggaacauguaccacgacuggcgagcaccgccgagaaaagcguucaguggcgcuggucccccauguggguauggggcuugagaccagaacagaaacuuggaugaguagcgagggagcuuggaaacacguucagaggauugagaccuggauccugcggcauccuggcuucacaauaauggccgcaaucuuggccuacaccauuggcacgacucacuuucagcgcgcucucaucuucauucugcugacagcaguggccccauccaugaccaugagaugcaucgggauaucuaacagggauuuugucgaaggagugucggguggcucauggguagacauuguucucgagcacgggagcugugugacuacaauggcuaagaauaagcccaccuuagauuucgaacugaucaaaacggaggccaagcagccugcgacccuucggaaauauugcauugaagcaaaguugacaaacacuaccacagagagucgcuguccaacucaaggagagcccucccugaaugaagaacaggacaaacgauuuaucugcaagcauucuauggucgauagaggcugggguaacggguguggacuauucggcaagggcgggaucgugaccugcgccauguuuacaugcaaaaagaauauggaaggaaaagugguccagccugagaaccucgaauacaccauuguuauaacuccacacagcggugaggagcaugcugugggcaaugacacggggaagcacggaaaagaaaucaagauuacaccgcaguccucaaucaccgaggccgaacugacuggcuaugguaccguaacaauggaguguagucccaggaccgggcuugauuucaacgaaauggugcuguugcaaauggaggacaaagcauggcucguccaccggcagugguuucuggauuuaccucugccauggcuccccggcgcugacacucagggaagcaauuggauacagaaggagacacuugugacguucaagaacccucaugccaaaaagcaagacguugugguccugggcucucaggaaggggcgaugcacaccgccuugacuggagcaacagagauucagauguccucagguaaucuacuguuuaccggccaucucaaaugccgucugcgcauggauaaacuucaacugaaagggaugagcuacaguauguguacaggaaaguucaagaucgugaaagaaaucgcugagacucagcacggcaccauuguaaucagaguucaguaugagggugacgggucuccaugcaagauucccuucgaaauaacggauuuggagaaaaggcaugugcucggccggcugaucaccgucaacccgauugugacagaaaaggacuccccugucaacaucgaggccgaacccccauuuggagauagcuacaucauuauaggcguggagccugggcaguuaaaacugaauugguucaagaagggaucgucuaucggucaaauguuugagacuaccaugcgaggcgcuaaacgcauggccauucuaggggacacagcaugggauuucggaucccucggcgguguuuuuacuucaaucgggaaggcccugcaccagguguucggcgcuauuuacggagcggcauuuaguggcguaagcuggaccaugaaaauccuuauaggggucaucauuacguggaucggaaugaacuccagaucuacuagcuugucagugagucugguucucgugggcgucgugacccuguaucuuggugccguagugcaggcugacuccggguguguugucagcuggaagaauaaagaacugaagugcggaucuggcauuuucaucacugauaacgugcacacauggaccgagcaguacaaguuucaacccgaaucaccaaguaaauuggccagcgcaauacagaaggcccaugaggaagguauuuguggcaucagguccgugacucggcucgagaaucugauguggaaacagauuacccccgaguuaaaccacauccugucugaaaaugaggucaagcuaacaauaaugacgggggacaucaaaggaauuaugcaggcuggcaagcgcucgcucagaccucaaccaaccgaacugaaauauagcuggaagacuugggggaaggccaaaaugcuuuccacagagucacauaaccagaccuucuugaucgauggaccggaaacagcagagugccccaauacuaacagggcguggaauagucuggagguugaagacuacggcuuugguguguucaccacgaacauuuggcucaagcugcgugagaaacaggacguguuuugugauucuaaguuaaugagcgcugccaucaaagacaaucgggcaguacacgccgauaugggguauuggauagaauccgcucugaacgacacauggaagauggagaaggccucauucauugaggucaaaagcugccacuggccuaagucucauacccuuugguccaauggaguguuggaaagugagaugguuauccccaagaauuucgcaggccccgugagccagcacaacuaccgaccugguuaucauacucaaaccgcuggcccauggcaccucgggaagcuggaaauggauuuugacuucugugagggaacaacugucgugguuaccgaagauugcggcaauagagggcccucucuaaggacaacgaccgccuccggaaaacugaucacugaguggugcugucgcucaugcacacucccgccucugcgguacagaggcgaggacgguuguugguacgggauggaaauuaggccacuuaaggagaaggaagagaacuuggugaauagucugguaaccgcgggacauggccagaucgauaacuuuagcuuagguguccucggcauggcccuguuccuugaagagaugcugcgcacucgaauugggacaaaacacgcuauauugcucguggcagugucguuugucacccugaucacgggaaauauguccuuccgggaccuaggccguguuauggugaugguaggggccacuaugaccgaugacauuggaaugggcgugacauaucuggcucuccuggccgcauuuaaggucagacccaccuucgcggccggucuuuugcugaggaaauuaacuucuaaggagcucaugauggcuacaaucgggauugcccugcuuagccagucaaccaucccugaaacaauacuggagcuaacugaugcacucgcucugggaaugaugguguugaaaaucguucgcaacauggaaaaguaccaacuggccgugaccauuauggcaaucaguugcguccccaaugccgugauuuuacagaacgcuuggaagguuuccuguacgauccucgcggccgugucugucagcccacugcuucugacauccucacagcagaaagcagacuggauaccuuuggcucucaccauuaagggccugaaucccacugccaucuuucuaaccacacugagccggacaaguaaaaagagaucuuggccacuuaacgaggccaucauggcuguaggcaugguguccauucucgcaagcucgcuguugaaaaaugacauaccgaugaccgggccucugguugccggagguuuacucacggugugcuauguccugacaggcaggucagcggaucuugaacuggagcgagcugccgacgugaagugggaggaucaagcagaaaucucugggaguucccccauuuugagcaucaccauuucugaggacggaagcauguccaucaaaaacgaagaggaggaacagacucucacaauacugauccgcaccggccuacugguaauuucagguguguucccagucaguauccccauuacugccgcugcaugguaccuuugggagguuaagaagcagcgggccggggugcucugggaugugccuagcccacccccugucgaaaaagcggagcuggaagacggagcuuauagaaucaagcagaggggcauauugggcuacucucaaauuggggccggaguguauaaagaggguacauuucacaccauguggcauguuacgcguggcgcaguauuaaugcaccgcgggaagcggaucgagccguccugggccgaugugaaaaaggaccugaucucauacggaggcgguuggaagcucgaaggggaguggaaagaaggagaggaaguccaggugcuggcucuugagccaggcaagaaucccagagccguucagacuaaaccuggcauuuucaagaccaacacagggaccaucggagcagugagucuggauuuuagcccagguacauccggcucucccauagucgacaggaaagggaaggugguaggauuguacggcaauggugucgugacucgaucgggggcuuauguuagcgccauugcgcagaccgagaagucaaucgaagauaacccugagauugaagacgauaucuuccggaaaaagcgccuaacgauaauggaccugcauccgggagccggcaaaacaaagagauaccuccccgcaauugugagggaggcuaucaaacggggccugcgaacucuuaucuuagccccaaccagagucguggcugcagaaauggaggaggcccugcgcgggcucccuauuagguaucaaacacccgccaucaagaccgaacacacuggacgugagauuguugacuugaugugucaugcuaccuucacaaugcggcugcucuccccagugagagucccuaacuacaaucugauaaucauggaugaagcgcacuuuacggaccccgcaaguauugccgcuagggguuauaucucuacucgcguggagaugggcgaggccgcagggaucuucaugaccgccacaccaccgggaagccgagauccuuuuccccaguccaacgcuccaauuauggacgaagagagagaaauacccgagcggucauggaacucuggccacgaauggguaaccgauuucaaggguaaaacugugugguuuguuccuagcaucaaggcggggaacgacauugccgcaugccuuaggaaaaauggaaagaaagucauccagcugagucgcaagacauucgauuccgaguacgugaagacccgugcuaacgacugggauuuuguggucacgacugacauuagcgagaugggcgccaauuucaaagcagaaagaguaaucgauccacggagguguaugaagcccgugauauugacagacggcgaggaacgcguuauccuagccgggccuaugccggugacccauucuucagcugcccaacgaagaggacggauugguaggaaccccaagaaugagaacgaccaguauaucuacaugggcgaaccccuggagaaugaugaggacugcgcgcacuggaaggaagcaaaaaugcucuuagauaacauuaauaccccugaggggaucauacccuccauguuugaaccagagcgcgaaaaggucgacgccauugauggagaguacagacugaggggcgaggcucggaaaacuuucguggaccuuaugcgucgcggugaucugccuguuuggcucgccuauaagguggcugcagaagggaucaacuacgccgaccgaaagugguguuuugauggcauuaaaaauaaccagaucuuggaggaaaacauggaggucgagauauggacaaaggaaggagagaggaaaaagcugaaacccagauggcucgacgcucggaucuauagugauccacuggcccuuaaggaguucaaggaguucgcagcgggccgcaaaagccuaacccugaauuugauuacagaaauggggagauuaccuacuuuuaugacgcagaaggccaggaacgcucuggacaaucucgccgugcugcauaccgcagaggcuggaggucgggccuacaaccacgcacuuucggagcugccggaaacacucgagacuuugcugcuacugacccuccuugccacaguaaccggcgggaucuuccuguuuuuaaugucuggaaaauccauuggcaagaugacuuuggguaugugcugcaucauaacggcuagcauucugcucuggcacgcgcaaauccagccccauuggaucgccgcaucaauuauccuggaguucuuucuuauagugcugcucauuccagagccugaaaaacagcgaaccccacaggauaaucaauugacauauguugucaucgcuauucugacugugguggccgccaccauggcaaacgagaugggguucuuagagaagacaaagaaagaccuaggccugggaaguaucaccacucaggaaucugaguccaauauacucgacaucgaucuuagaccagcuagcgccuggacacuguacgcggucgcuacgaccuuuguuacuccuauguugcgccacucaauugaaaacaguagcgugaauguaucccugacagccaucgcaaaccaggccaccgugcucaugggccuggggaagggauggccccuuucuaaaauggacauuggugucccgcuccuggcuaucggcuguuauagccaggugaauccaauuaccuugacagcagcccuguuacuacugguugcgcauuacgcuaucauagggccuggacuccaagccaaggcaacuagggaggcccagaaacgggcugccgcaggcauuaugaagaaccccacgguggaugguaucaccgucaucgaccuugaaccaauucccuacgauccuaaguucgagaaacagcuggggcagguaauguugcugauacucugcgugacacaaguucugaugaugcguacuaccugggcucuuugugaggccuuaacacuggcgaccggcccgaucuccacucucugggaaggaaaucccggcagauuuuggaacacgacaauugccgugucaauggcaaauaucuucagggggucuuauuuggcuggagccggccugcuauuuaguauuaugaagaacaccacuucgacccgccgggguacagggaauaucggagagacucugggcgaaaaauggaaaagccgacucaacgcacuugguaaauccgaguuccagauauacaagaaaucuggcauccaggaggucgacagaacccuggcuaaggaagggauuaagaggggagagacagaucaccaugccgugucacgcggcagcgccaaauugcggugguuugucgaaagaaacauggugacgccagaggggaagguuguggaccugggaugcggccguggugggugguccuauuacuguggaggccucaaaaauguaagggaagugaagggucugaccaaaggcgggccuggacacgaggagcccaucccuaugaguacuuauggcuggaacuuaguccggcuucaaucugggguugauguguucuucacaccacccgaaaagugcgacacccugcucugugauauuggagagagcucaccuaauccaacuaucgaagcgggccgcacacuacgaguccugaacuugguggagaauuggcugaacaauaacacccaguuuugcauaaagguacucaaucccuacaugccguccgugauugagaagauggaggcacuucagagacaguaugguggggcacugguuaggaacccuuugagucggaauagcacgcacgagauguacugggugucuaacgccaccggaaauaucgucuccucagugaacaugaucagccgcaugcugauuaauagauucacaaugaagcauaaaaaggcuacuuacgaaccagacgucgaucucggcucgggcaccaggaacauagggaucgagaacgaaauucccaauuuagacaucauuggaaaacgaaucgagaagauaaagcaagaacacgagaucucuuggcauuaugaccaggaucacccuuacaaaacaugggccuaucacgguaguuacgagacuaagcagaccggcuccgcaagcucaauggugaacgggguuguacggcugcuuacaaaaccaugggacgugguccccauggugacccagauggccaugacugauacgacaccguuuggacaacagcguguuuucaaggaaaaaguggacaccagaacucaggagccuaaggaaggcaccaagaaacugaugaagauuacagcugaguggcuauggaaagagcucgguaagaaaaagacgccccgcauguguaccagggaagaguuuacucggaaagucagauccaaugcggcccugggggcaaucuucacagaugaaaacaaguggaagucugcucgcgaggccguggaagacggaagguuuugggaguugguagaucgagagcggaaucugcaucucgaaggcaaaugcgagaccuguguguauaacaugaugggcaagagagagaagaaacuuggggaguucggaaaagcaaaagguagcagggccauuugguacauguggcugggcgcucgcuuuuuagaguucgaggcccugggguuuuugaaugaggaccacugguucagucguggaaacucccucagcggcguugaaggugaggggcugcaucggcuaggauauauccuuagagaugucggcaagaaagaaggcggggcgauguacgcagacgauacugccggaugggacacaaggauuacccuggaggaccucaagaaugaagagauggugacaaaccacaugaaaggugagcauaagaaacuggcugaagccauauuuaaguugacuuaccagaauaaggugguccgcguucaacgaccaaccccucggggcacggugauggauaucauuucuagaagggaccagcgcgggucaggacagguaggcaccuauggucugaacacauucacuaauauggaggcacaacucaucagacagauggaaggggagggaaucuucaaaaguauucagcaccuuaccgcuacagaggaaauagccgugcagaacuggcuggcucgggucggcagggagcguuuaucccgaauggccaucagcggcgaugacugcgugguuaagcccauugaugaccgcuuugcaucugcgcugacugccuugaaugauauggggaaagugagaaaggacauccaacagugggaaccaucgcggggauggaacgauuggacccagguccccuucugcucacaccauuuucacgagcucgugaugaaagacgguaggguacugguugugccuugucgcaaccaggaugaacuaauuggcagagcucggaucagccaaggggccggauggucccuuaaggagacggcaugccugggcaagaguuacgcucagauguggacacucauguauuuccauaggcgagaccugcguuuggccgcaaaugccauauguucugcggucccaagccacugggugccgaccuccagaacuacauggucaauccacgcuaaacaugaguggaugaccacugaagauauguuagccguguggaaccgcgucuggauucaggagaaucccuggauggaagacaagaccccuguugagaguugggaagaggugccauaccuggguaaacgggaggaccaguggugcgggucucucaucggacuuacaagcagggcaacgugggccaagaacauucaaaccgcuaucaaucagguaagaucccugauaggcaacgaagaguauacugauuacaugcccucaaugaaacgcuuucggagggaagaggaagaggccggcgugcuaugguga

SEQ ID NO: 14504 - RNA, 9876 nt, Artificial Sequence
  derived and/or modified CDS sequence (opt3) from DENV-2__FJ850050__SS-prME
acagcaggcgugaucguaaugcugauucccacagcuauggcauuccaccucacuacgaggaacggggaaccucauaugauaguuggaaggcaggaaaaggguaagagccuucuguuuaagaccgaggacggcgugaauaugugcacauugauggcaaucgauuuaggggaacugugugaggacacuauuaccuacaaaugcccacuacuccggcaaaacgaaccggaggauaucgacuguuggugcaauuccacaucuaccuggguaacuuauggaacauguaccacgacuggcgagcaccgccgagaaaagcguucaguggcgcuggucccccauguggguauggggcuugagaccagaacagaaacuuggaugaguagcgagggagcuuggaaacacguucagaggauugagaccuggauccugcggcauccuggcuucacaauaauggcagcaaucuuggcauacaccauuggcacgacucacuuucagcgcgcucucaucuucauucugcugacagcaguggccccauccaugaccaugagaugcaucgggauaucuaacagggauuuugucgaaggagugucggguggcucauggguagacauuguucucgagcacgggagcugugugacuacaauggcuaagaauaagcccaccuuagauuucgaacugaucaaaacggaggccaagcagccugcgacccuucggaaauauugcauugaagcaaaguugacaaacacuaccacagagagucgcuguccaacucaaggagagcccucccugaaugaagaacaggacaaacgauuuaucugcaagcauucuauggucgauagaggcugggguaacggguguggacuauucggcaagggcgggaucgugaccugcgccauguuuacaugcaaaaagaauauggaaggaaaagugguccagccugagaaccucgaauacaccauuguuauaacuccacacagcggugaggagcaugcugugggcaaugacacggggaagcacggaaaagaaaucaagauuacaccgcaguccucaaucaccgaggccgaacugacuggcuaugguaccguaacaauggaguguagucccaggaccgggcuugauuucaacgaaauggugcuguugcaaauggaggacaaagcauggcucguccaccggcagugguuucuggauuuaccucugccauggcuccccggcgcugacacucagggaagcaauuggauacagaaggagacacuugugacguucaagaacccucaugccaaaaagcaagacguugugguccugggcucucaggaaggggcgaugcacaccgccuugacuggagguacagagauucagauguccucaggcaaucuacuguuuaccgggcaucucaaaugccgucugcgcauggauaaacuucaacugaaaggaaugagcuacaguauguguacaggcaaguucaagaucgugaaagaaaucgcagagacucagcacgguaccauuguaaucagaguucaguaugagggggacggcucuccaugcaagauucccuucgaaauaacggauuuggagaaaaggcaugugcucggacggcugaucaccgucaacccgauugugacagaaaaggacuccccugucaacaucgaggcugaacccccauuuggcgauagcuacaucauuauagggguggagccuggacaguuaaaacugaauugguucaagaaggguucgucuaucggccaaauguuugagacuaccaugcgaggggccaaacgcauggcuauucuaggagacacagccugggauuucggcucccucggugggguuuuuacuucaaucggcaaggcacugcaccagguguucggagccauuuacggcgcugcguuuagugggguaagcuggaccaugaaaauccuuauaggagucaucauuacguggaucggcaugaacuccagaucuaccagcuugucagugagucugguucucgugggugucgugacccuguaucuuggggcaguagugcaggccgacuccggauguguugucagcuggaagaauaaagaacugaagugcggcucugguauuuucaucacugauaacgugcacacauggaccgagcaguacaaguuucaacccgaaucaccaaguaaauuggcuagcgccauacagaaggcacaugaggaaggcauuugugggaucagguccgugacucggcucgagaaucugauguggaaacagauuacccccgaguuaaaccacauccugucugaaaaugaggucaagcuaacaauaaugacgggagacaucaaaggcauuaugcaggccgggaagcgcucgcucagaccucaaccaaccgaacugaaauauagcuggaagacuuggggaaaggcuaaaaugcuuuccacagagucacauaaccagaccuucuugaucgauggcccggaaacagccgagugccccaauacuaacagggcauggaauagucuggagguugaagacuacgguuuugggguguucaccacgaacauuuggcucaagcugcgugagaaacaggacguguuuugugauucuaaguuaaugagcgcggcuaucaaauauaaucgggccguacacgcagacaugggauacuggauagaauccgccccuugcgauucaugggagaugcagaaggcuagcuucauugaggucaucucuugucacuggccaaagucccugacacuuuggaguaacggcguguuggaaagcgagaugaucauucccaaaaauuucgccgguccuguuucucaacauaacuaucgaccaggcuaccacacccagacugcagggcccuggcaucucggaaagcuggaaauggacuuugauuucugcgagggcaccacaguggucgugacugaagacugcgggaacagaggaccgucccuaaggaccacaacggcuucaggcaaacugaucaccgagugguguugccgcaguuguacucucccuccacugcgguacagaggugaggaugggugcugguauggaauggaaauuaggccccuuaaggagaaagaagagaauuugguuaacagccuggugacagccggccacggucagauagacaauuuuucguuaggcguacucgggauggcgcuguuccuugaagagaugcugcgcacccgaaucggaacuaagcaugccauuuugcucgucgcuguguccuuugugacacugaucaccggcaacaugucuuuccgggaucuagggcgugucaugguuauggugggagcaacgaugacugacgauauuggcauggguguaaccuaccuggcccuccuggcugccuuuaaggugagaccuacauucgcagcggggcuuuugcugaggaaauuaaccagcaaggagcucaugauggccacuaucggaauagcucugcuuucacaaaguacaauccccgaaaccauucuggagcuaacagacgcccucgcacugggcaugauggucuugaaaaucgugcgcaauauggaaaaguaucagcuggcuguuacuauuauggccaucuccugugugccaaacgcagucauauuacagaaugccuggaaagugucuugcaccauucucgcugcgguuagcguguccccucugcuucugacgucaagccagcaaaaggccgauuggauccccuuggcacucacaaucaagggccugaacccaaccgcuauuuuucuaacuacccugagucggacaucuaaaaagagauccuggccgcuuaaugaggccauaauggccgucgggaugguaagcauccucgcuucgucacuguugaaaaacgacauuccuaugacuggaccccugguggccgguggcuuacucaccguuuguuacgugcugacggggaggucugccgaccuugaacuggagcgagcggcugaugucaagugggaggaccaggccgaaaucaguggauccagcccaauuuugucuaucacaauaagcgaggauggcuccaugucaaucaaaaaugaagaggaggaacagacccucacuauucugauccgcacaggucuacuggugauuagugggguauuccccgugagcaucccuauaaccgcagccgcuugguaucuuugggaggucaagaaacagcgggcaggaguucucugggacgugccaucucccccuccgguggaaaaggccgagcuggaagauggcgcguacagaauuaagcaaaggggcaucuugggguauucccagaucggagcuggugucuacaaagagggcacuuuucacacaauguggcacgugacccguggggccguuuuaaugcaucgcggaaagcggauugagccaucaugggcagacgucaagaaggaucugaucaguuacggcgguggguggaaacucgaaggagaguggaaggaaggcgaggaagugcagguccuggcccuugagcccggcaagaacccuagagcugugcagacgaaaccagggauauucaagacuaauaccggaacaauuggugccguuagccuggacuuuucccccggcaccucugggucgccuaucguggauaggaaaggaaaggucgugggcuuguaugguaacgggguagucacacgaagcggagcauacgugucagcuauugcccaaacugagaaauccaucgaagacaauccggagauagaagaugacauuuuccggaagaagcgccuaaccaucauggaucugcaccccggcgcgggcaaaacgaagagauaucucccagccaucguuagggaggcaauuaaacgggggcugcgaacacuuaucuuagcuccuacuagaguggucgccgcugaaauggaggaggcacugcgcggacuccccauuagguaccagaccccagccauaaagacagaacauaccggucgugagaucguggacuugaugugccacgccacuuucaccaugcggcugcucaguccuguuagagugcccaacuauaaccugauuaucauggacgaagcucauuuuacagauccagcgucuaucgcagccaggggcuacauuagcacgcgcgucgagaugggggaggcugccggaauauucaugacugcaaccccgccuggcucccgagaccccuuuccacagucaaaugcccccaucauggaugaagagagagaaauuccugagcggucuuggaacagcggucacgaaugggugacagacuucaaagggaagaccguaugguuugugccaaguaucaaggcuggaaaugauauugcggccugucuuaggaaaaacggcaagaaaguuauccaacugucccgcaagacuuucgacagcgaguaugucaaaacacgugcaaaugauugggacuuuguggugaccacggauauaucugagaugggcgcuaacuucaaggccgaaagagucaucgacccccggaggugcaugaagccuguaauuuugacugauggggaggaacgcgugauccuagcaggaccgaugccaguuacacacucauccgccgcucagcgaagaggucggauuggcaggaaucccaaaaacgagaaugaccaguacaucuacaugggggaaccucuggagaacgacgaggauugugcccauuggaaggaagcgaaaaugcucuuagacaauauaaacacccccgagggaauuaucccaaguauguuugaaccugagcgcgaaaagguggaugcaauugacggcgaguauagacugaggggugaggcccggaaaaccuucgucgaucuuaugcgucgcggggaccugcccguguggcucgcuuacaagguugccgcugaaggcaucaauuaugcagaucgaaaauggugcuuugacggaauaaagaacaaucagaucuuggaggaaaacaugcaagagcagauuuggacuaaggagggcgaaaggaaaaagcugaaaccaagauggcucgaugcccggaucuacagcgacccucuggcucuuaaggaguucaaagaguucgccgcagggcgcaagucgcuaacacugaacuugauuaccgagaugggaagauuaccgacauuuaugacucagaaggcgaggaaugcccuggauaaccucgcugugcugcacacggccgaagccgguggccgggcuuauaaucaugcccuuucugagcugcccgagacccucgaaacauugcugcuacugacucuccuugcaaccgucacagggggaaucuuccuguuuuuaauguccggcaaagguauagggaagaugaccuugggcaugugcuguauuaucacugccagcauccugcucugguacgcucagauucaaccacacuggaucgcggccucaauaauucuggaguucuuucuuaucgugcugcucauuccugaacccgagaaacagcgaacgccacaggacaaccaguugaccuauguagugaucgcaauacugacaguugucgcugccacuauggccaaugaaaugggauucuuagagaagaccaaaaaggaucuaggccuggggaguaucacaacccaagagucugaauccaacauucucgacaucgaccuuagaccugcaagcgcuuggacucuguacgccguggcgacaacguuugugacccccauguugcgccacucaauugagaauaguagcgucaacguuucccugacugcuaucgccaaucaggcaacagugcucaugggacuggguaagggcuggccgcuuucuaaaauggauauugggguaccacuccuggccaucggaugcuacagccaggugaacccuauaaccuugaccgcugcacuguuacuacuggucgcccauuaugcgauuaucggccccggucuccaggcuaaggccacaagggaagcacaaaaacgggccgcugccgggaucaugaagaauccaacuguggacggcauuacgguuauagaucuugagcccaucccuuacgacccgaaauucgaaaagcagcugggacaggugauguugcugauucucugugucacccaaguacugaugaugcguacaacuugggcacuuugcgaggcuuuaacccuggccacaggccccaucuccacccucugggaggggaacccaggaagauuuuggaauacuacgauugcggugucaauggccaacaucuucaggggcucuuauuuggccggugcugggcugcuauuuaguauaaugaagaauacaaccucgacucgccggggaaccggcaacaucggugaaacacugggcgagaaauggaaaagccgacucaaugcccuugggaaauccgaguuccagauuuacaagaaaucuggaauccaggagguugauagaacucuggcaaaggagggcauuaaaagaggggaaaccgaccaccaugcugugucacgcggaagcgccaaguugcggugguuugucgagagaaacauggugacaccugaaggcaaggucguggaucuggguugugggcguggaggcugguccuauuacugcgguggccucaaaaacguuagggaggugaaggggcugacgaaaggaggccccgggcacgaagaaccuaucccaaugaguaccuauggauggaauuuaguacggcuucagucuggcguggacgucuucuucacucccccugagaagugugauacacugcucugcgacauaggugaaagcucaccaaaccccaccauugaggccgggcgcacucuacgaguucugaauuugguggaaaacuggcugaauaacaauacacaauuuuguaucaaaguccucaacccguacaugccuuccgugaucgagaagauggaagcgcuucagagacaguacggaggcgcucugguaaggaauccauugagucggaacagcacccaugagauguauugggugucuaaugcaacgggcaacauuguuuccucagugaauaugauaagccgcaugcugaucaacagauucaccaugaagcacaaaaaggccacauacgagcccgaugucgaccucgggucgggaacuaggaauauugguaucgaaucugagauuccuaacuuagauaucauaggcaaacgaaucgaaaagauuaaacaggagcacgaaaucaguuggcauuaugaccaagaccacccauacaagaccugggcuuaucauggguccuacgagacaaagcagacuggaagcgccucauccauggugaacggcgucgugcggcugcuuaccaaacccugggauguuguaccgauggugacacagauggcaaugaccgacacuacgccuuuuggucagcaacgugucuucaaggagaaaguggauacaagaacccaggaacccaaggaggggacuaaaaagcugaugaagauuaccgccgaauggcuauggaaagagcucggaaagaaaaagacaccacgcaugugcacgagggaggaauuuaccaaaaagguucggucuaaugcugcgcugggcgccaucuucacugacgagaacaaauggaaaagcgcaagagaagcuguggaggauggccgcuuuugggaauuggucgacagggagcgaaaucugcaccucgaggggaagugugaaacaugcguguauaacaugaugggaaaacgggagaagaaacuuggugaguucggcaaggccaaagggaguagagcaauuugguacauguggcugggagccagguuuuuagaguucgaagcucugggcuuuuugaaugaggaucacugguucucccgcgguaacagccucucugggguagagggagaaggccugcaucgucuaggcuacauacuucgggacguggggaagaaggagggaggugccauguaugcggaugacaccgcaggcugggauacuagaaucacacuggaagaccucaaaaaugaggaaaugguuaccaaccacaugaagggggagcauaaaaagcuggccgaggcuauuuuuaaauugacauaccagaauaaggucgugagggugcaacgcccuacuccccgaggaaccgucauggacaucaucucacggagagaucagaggggcaguggucagguugggacguauggacugaacaccuucacaaauauggaagcccagcucauucgccaaauggagggcgaaggcauauucaaguccauccagcaccuuacugcaaccgaggagauugcugugcagaacuggcuggccagaguagggcgggaaagguuaagccguauggcuaucucuggagacgauugcguggucaaaccaauugacgaucgauuugccucggcacugacagcguugaaugacauggguaaggugcgcaaagauauccagcaaugggagcccucaagaggcuggaacgacuggacucagguuccuuucuguagccaucacuuucacgaacucgugaugaaggaugggcggguccuggugguaccaugcaggaaucaggacgagcuaauaggacgcgccagaaucucccagggcgcugguuggagucuuaaagaaaccgccugucuggggaagucuuacgcacaaauguggacgcucauguauuuccaucggagggaucugcgauuggcugccaacgcaauuugcagcgccguuccgucccacugggugcccacaucacguaccacuuggaguauccaugcgaagcacgaguggaugacaaccgaggacauguuagcugucuggaacagaguguggauucaggaaaauccuuggauggaggauaaaacuccaguggaaucuugggaggaaguccccuaccugggaaagcgcgaggaccagugguguggcagccucaucggccuuaccucccgggccacaugggccaagaacauacagacggccauuaaucaaguuaggucacugaucgggaacgaggaauauaccgacuacaugccuagcaugaagagauuucgccgggaggaagaggaagcuggagugcuaugguga

SEQ ID NO: 14505 - RNA, 9876 nt, Artificial Sequence
  derived and/or modified CDS sequence (opt3) from DENV-2__FJ639837__SS-prME
accgccggcgugaucgucaugcugauucccacagcuauggcauuccaccucacuacgagaaacggggaaccucauaugauaguuggaaggcaggaaaaggguaagagccuucuguuuaagaccgaagacggcgugaauaugugcacauugauggccaucgauuuaggggaacugugugaggacacuauuaccuacaaaugcccacuacuccggcaaaacgaaccggaggauaucgacuguuggugcaauuccacaucuaccuggguaacuuauggaacauguaccacgacuggcgagcaccgccgagaaaagcguucaguggcgcuggucccccauguggguauggggcuugagaccagaacagaaacuuggaugaguagcgagggagcuuggaaacacguucagaggauugagaccuggauccugcggcauccuggcuucacaauaauggccgcaaucuuggccuacaccauuggcacgacucacuuucagcgcgcucucaucuucauucugcugacagcaguggccccauccaugaccaugagaugcaucgggauaucuaacagggauuuugucgaaggagugucggguggcucauggguagacauuguucucgagcacgggagcugugugacuacaauggcuaagaauaagcccaccuuagauuucgaacugaucaaaacggaggccaagcagccugcgacccuucggaaauauugcauugaagcaaaguugacaaacacuaccacagagagucgcuguccaacucaaggagagcccucccugaaugaagaacaggacaaacgauuuaucugcaagcauucuauggucgauagaggcugggguaacggguguggacuauucggcaagggcgggaucgugaccugcgccauguuuacaugcaaaaagaauauggaaggaaaagugguccagccugagaaccucgaauacaccauuguuauaacuccacacagcggugaggagcaugcugugggcaaugacacggggaagcacggaaaagaaaucaagauuacaccgcaguccucaaucaccgaggccgaacugacuggcuaugguaccguaacaauggaguguagucccaggaccgggcuugauuucaacgaaauggugcuguugcaaauggaggacaaagcauggcucguccaccggcagugguuucuggauuuaccucugccauggcuccccggcgcugacacucagggaagcaauuggauacagaaggagacacuugugacguucaagaacccucaugccaaaaagcaagacguugugguccugggcucucaggaaggggcgaugcacaccgccuugacuggagcaacagagauucagauguccucagguaaucuacuguuuaccggccaucucaaaugccgucugcgcauggauaaacuucaacugaaagggaugagcuacaguauguguacaggaaaguucaagaucgugaaagaaaucgcugagacucagcacggcaccauuguaaucagaguucaguaugagggugacgggucuccaugcaagauucccuucgaaauaacggauuuggagaaaaggcaugugcucggccggcugaucaccgucaacccgauugugacagaaaaggacuccccugucaacaucgaggccgaacccccauuuggagauagcuacaucauuauaggcguggagccugggcaguuaaaacugaauugguucaagaagggaucgucuaucggucaaauguuugagacuaccaugcgaggcgcuaaacgcauggccauucuaggggacacagcaugggauuucggaucccucggcgguguuuuuacuucaaucgggaaggcccugcaccagguguucggcgcuauuuacggagcggcauuuaguggcguaagcuggaccaugaaaauccuuauaggggucaucauuacguggaucggaaugaacuccagaucuacuagcuugucagugagucugguucucgugggcgucgugacccuguaucuuggugccguagugcaggcugacuccggguguguugucagcuggaagaauaaagaacugaagugcggaucuggcauuuucaucacugauaacgugcacacauggaccgagcaguacaaguuucaacccgaaucaccaaguaaauuggccagcgcaauacagaaggcccaugaggaagguauuuguggcaucagguccgugacucggcucgagaaucugauguggaaacagauuacccccgaguuaaaccacauccugucugaaaaugaggucaagcuaacaauaaugacgggggacaucaaaggaauuaugcaggcuggcaagcgcucgcucagaccucaaccaaccgaacugaaauauagcuggaagacuugggggaaggccaaaaugcuuuccacagagucacauaaccagaccuucuugaucgauggaccggaaacagcagagugccccaauacuaacagggcguggaauagucuggagguugaagacuacggcuuugguguguucaccacgaacauuuggcucaagcugcgugagaaacaggacguguuuugugauucuaaguuaaugagcgcugccaucaaagacaaucgggcaguacacgccgauaugggguauuggauagaauccgcucugaacgacacauggaagauggagaaggccucauucauugaggucaaaagcugccacuggccuaagucucauacccuuugguccaauggaguguuggaaagugagaugguuauccccaagaauuucgcaggccccgugagccagcacaacuaccgaccugguuaucauacucaaaccgcuggcccauggcaccucgggaagcuggaaauggauuuugacuucugugagggaacaacugucgugguuaccgaagauugcggcaauagagggcccucucuaaggacaacgaccgccuccggaaaacugaucacugaguggugcugucgcucaugcacacucccgccucugcgguacagaggcgaggacgguuguugguacgggauggaaauuaggccacuuaaggagaaggaagagaacuuggugaauagucugguaaccgcgggacauggccagaucgauaacuuuagcuuagguguccucggcauggcccuguuccuugaagagaugcugcgcacucgaauugggacaaaacacgcuauauugcucguggcagugucguuugucacccugaucacgggaaauauguccuuccgggaccuaggccguguuauggugaugguaggggccacuaugaccgaugacauuggaaugggcgugacauaucuggcucuccuggccgcauuuaaggucagacccaccuucgcggccggucuuuugcugaggaaauuaacuucuaaggagcucaugauggcuacaaucgggauugcccugcuuagccagucaaccaucccugaaacaauacuggagcuaacugaugcacucgcucugggaaugaugguguugaaaaucguucgcaacauggaaaaguaccaacuggccgugaccauuauggcaaucaguugcguccccaaugccgugauuuuacagaacgcuuggaagguuuccuguacgauccucgcggccgugucugucagcccacugcuucugacauccucacagcagaaagcagacuggauaccuuuggcucucaccauuaagggccugaaucccacugccaucuuucuaaccacacugagccggacaaguaaaaagagaucuuggccacuuaacgaggccaucauggcuguaggcaugguguccauucucgcaagcucgcuguugaaaaaugacauaccgaugaccgggccucugguugccggagguuuacucacggugugcuauguccugacaggcaggucagcggaucuugaacuggagcgagcugccgacgugaagugggaggaucaagcagaaaucucugggaguucccccauuuugagcaucaccauuucugaggacggaagcauguccaucaaaaacgaagaggaggaacagacucucacaauacugauccgcaccggccuacugguaauuucagguguguucccagucaguauccccauuacugccgcugcaugguaccuuugggagguuaagaagcagcgggccggggugcucugggaugugccuagcccacccccugucgaaaaagcggagcuggaagacggagcuuauagaaucaagcagaggggcauauugggcuacucucaaauuggggccggaguguauaaagaggguacauuucacaccauguggcauguuacgcguggcgcaguauuaaugcaccgcgggaagcggaucgagccguccugggccgaugugaaaaaggaccugaucucauacggaggcgguuggaagcucgaaggggaguggaaagaaggagaggaaguccaggugcuggcucuugagccaggcaagaaucccagagccguucagacuaaaccuggcauuuucaagaccaacacagggaccaucggagcagugagucuggauuuuagcccagguacauccggcucucccauagucgacaggaaagggaaggugguaggauuguacggcaauggugucgugacucgaucgggggcuuauguuagcgccauugcgcagaccgagaagucaaucgaagauaacccugagauugaagacgauaucuuccggaaaaagcgccuaacgauaauggaccugcauccgggagccggcaaaacaaagagauaccuccccgcaauugugagggaggcuaucaaacggggccugcgaacucuuaucuuagccccaaccagagucguggcugcagaaauggaggaggcccugcgcgggcucccuauuagguaucaaacacccgccaucaagaccgaacacacuggacgugagauuguugacuugaugugucaugcuaccuucacaaugcggcugcucuccccagugagagucccuaacuacaaucugauaaucauggaugaagcgcacuuuacggaccccgcaaguauugccgcuagggguuauaucucuacucgcguggagaugggcgaggccgcagggaucuucaugaccgccacaccaccgggaagccgagauccuuuuccccaguccaacgcuccaauuauggacgaagagagagaaauacccgagcggucauggaacucuggccacgaauggguaaccgauuucaaggguaaaacugugugguuuguuccuagcaucaaggcggggaacgacauugccgcaugccuuaggaaaaauggaaagaaagucauccagcugagucgcaagacauucgauuccgaguacgugaagacccgugcuaacgacugggauuuuguggucacgacugacauuagcgagaugggcgccaauuucaaagcagaaagaguaaucgauccacggagguguaugaagcccgugauauugacagacggcgaggaacgcguuauccuagccgggccuaugccggugacccauucuucagcugcccaacgaagaggacggauugguaggaaccccaagaaugagaacgaccaguauaucuacaugggcgaaccccuggagaaugaugaggacugcgcgcacuggaaggaagcaaaaaugcucuuagauaacauuaauaccccugaggggaucauacccuccauguuugaaccagagcgcgaaaaggucgacgccauugauggagaguacagacugaggggcgaggcucggaaaacuuucguggaccuuaugcgucgcggugaucugccuguuuggcucgccuauaagguggcugcagaagggaucaacuacgccgaccgaaagugguguuuugauggcauuaaaaauaaccagaucuuggaggaaaacauggaggucgagauauggacaaaggaaggagagaggaaaaagcugaaacccagauggcucgacgcucggaucuauagugauccacuggcccuuaaggaguucaaggaguucgcagcgggccgcaaaagccuaacccugaauuugauuacagaaauggggagauuaccuacuuuuaugacgcagaaggccaggaacgcucuggacaaucucgccgugcugcauaccgcagaggcuggaggucgggccuacaaccacgcacuuucggagcugccggaaacacucgagacuuugcugcuacugacccuccuugccacaguaaccggcgggaucuuccuguuuuuaaugucuggaaaauccauuggcaagaugacuuuggguaugugcugcaucauaacggcuagcauucugcucuggcacgcgcaaauccagccccauuggaucgccgcaucaauuauccuggaguucuuucuuauagugcugcucauuccagagccugaaaaacagcgaaccccacaggauaaucaauugacauauguugucaucgcuauucugacugugguggccgccaccauggcaaacgagaugggguucuuagagaagacaaagaaagaccuaggccugggaaguaucaccacucaggaaucugaguccaauauacucgacaucgaucuuagaccagcuagcgccuggacacuguacgcggucgcuacgaccuuuguuacuccuauguugcgccacucaauugaaaacaguagcgugaauguaucccugacagccaucgcaaaccaggccaccgugcucaugggccuggggaagggauggccccuuucuaaaauggacauuggugucccgcuccuggcuaucggcuguuauagccaggugaauccaauuaccuugacagcagcccuguuacuacugguugcgcauuacgcuaucauagggccuggacuccaagccaaggcaacuagggaggcccagaaacgggcugccgcaggcauuaugaagaaccccacgguggaugguaucaccgucaucgaccuugcuccaauucccuacgauccuaaguucgaaaaacagcuggggcagguaauguugcugauacucugcgugacacaaguucugaugaugcguacuaccugggcccuuugugaggcguuaacacuggccaccggcccgaucuccacucucugggagggaaaucccggcagauuuuggaacacgacaauugcagugucaauggcuaauaucuucagggggucuuauuuggccggagcaggccugcuauuuaguauuaugaagaacaccacuucgacccgccgggguacagggaauaucggagaaacucugggcgagaaauggaaaagccgacucaacgcucuugguaaauccgaguuccagauauacaagaaaucuggcauccaggaggucgacagaacccuggccaaggaggggauuaagaggggagaaacagaucaccaugccgugucacgcggcagcgcgaaauugcggugguuugucgagagaaacauggugacgccagaagggaagguuguggaccugggaugcggccguggugggugguccuauuacuguggaggccucaaaaauguaagggaggugaagggucugaccaaaggcgggccuggacacgaagaaccaaucccuaugaguacuuauggcuggaacuuaguccggcuucaaucugggguugauguguucuucacaccacccgagaagugcgacacccugcucugugauauuggagaaagcucaccuaauccaacuaucgaggcuggccgcacacuacgaguccugaacuugguggaaaauuggcugaacaauaacacccaguuuugcauaaagguacucaaucccuacaugccguccgugauugagaaaauggaagcacuucagagacaguaugguggggcccugguuaggaacccuuugagucggaauagcacgcacgagauguacugggugucuaacgcuaccggaaauaucgucuccucagugaacaugaucagccgcaugcugauuaauagauucacaaugaagcauaaaaaggccacuuacgagccagacgucgaucucggcucgggcaccaggaacauagggaucgaaaacgagauucccaauuuagacaucauuggaaaacgaaucgaaaagauaaagcaagagcacgaaaucucuuggcauuaugaccaggaucacccuuacaaaacaugggcauaucacgguaguuacgagacuaagcagaccggcuccgccagcucaauggugaacgggguuguacggcugcuuacaaaaccaugggacgugguccccauggugacccagauggcuaugacugauacgacaccguuuggacaacagcguguuuucaaggagaaaguggacaccagaacucaggaaccuaaggagggcaccaagaaacugaugaagauuacagcggaauggcuauggaaagagcucgguaagaaaaagacgccccgcauguguaccagggaggaauuuacucggaaagucagauccaaugccgcacugggggcuaucuucacagaugagaacaaguggaagucugcccgcgaagcaguggaggacggaagguuuugggaauugguagaucgagagcggaaucugcaucucgagggcaaaugcgaaaccuguguguauaacaugaugggcaagagagagaagaaacuuggggaguucggaaaagccaaagguagcagggcuauuugguacauguggcugggcgcccgcuuuuuagaguucgaagcgcugggguuuuugaaugaggaccacugguucagucguggaaacucccucagcggcguugagggugaagggcugcaucggcuaggauauauccuuagagaugucgcaaagaaagagggcggcgccauguacgcugacgauacugccgggugggacacaaggauuacccuggaagaccucaagaaugaggaaauggugacaaaccacaugaaaggagagcauaagaaacuggcagaggcuauauuuaaguugacuuaccagaauaaggugguccgcguucaacgaccaaccccucgggguacggugauggauaucauuucuagaagggaccagcgcggcucagggcagguaggaaccuauggccugaacacauucacuaauauggaagcccaacucaucagacagauggagggugaagggaucuucaaaaguauucagcaccuuaccgcuacagaggagauagccgugcagaacuggcuggcacgggucggaagggaacguuuaucccgaauggcgaucagcggcgaugacugcgugguuaagcccauugaugaccgcuuugccucugcucugacugccuugaaugauaugggcaaagugagaaaggacauccaacagugggagccaucgcggggguggaacgauuggacccagguccccuucugcucacaccauuuucacgaacucgugaugaaagacggaaggguacugguugugccuugucgcaaccaggaugagcuaauugguagagcacggaucagccaaggcgcuggguggucccuuaaggaaacggccugccugggaaagaguuacgcacagauguggacacucauguauuuccauaggcgagaccugcguuuggccgcgaaugcuauauguucugccgucccaagccacugggugccgaccuccagaacuacauggucaauccacgcaaaacaugaguggaugaccacugaggauauguuagccguguggaaccgcgucuggauucaggaaaaucccuggauggaggacaagaccccuguugaaaguugggaggaagugccauaccugggcaaacgggaggaccaguggugcgguucucucaucgggcuuacaagcagggcuacgugggccaagaacauucaaaccgcaaucaaucagguaagaucccugauaggaaacgaggaauauacugauuacaugcccucaaugaaacgcuuucggagggaggaagaggaagcuggcgugcuaugguga

SEQ ID NO: 14506 - RNA, 9876 nt, Artificial Sequence
  derived and/or modified CDS sequence (opt3) from DENV-2__FJ744706__SS-prME
accgccggagugauaguaaugcugauucccacugcuauggcuuuccaccucacuacgaggaacggggagccucauaugauaguugggaggcaggaaaaggguaaaagccuucuguuuaagaccgaggacggcgugaauaugugcacauugauggccaucgauuuaggggaacugugugaggacacuauuaccuacaaaugcccacuacuccggcaaaacgaaccggaggauaucgacuguuggugcaauuccacaucuaccuggguaacuuauggaacauguaccacgacuggcgagcaccgccgagaaaagcguucaguggcgcuggucccccauguggguauggggcuugagaccagaacagaaacuuggaugaguagcgagggagcuuggaaacacguucagaggauugagaccuggauccugcggcauccuggcuucacaauaauggccgcaaucuuggccuacaccauuggcacgacucacuuucagcgcgcucucaucuucauucugcugacagcaguggccccauccaugaccaugagaugcaucgggauaucuaacagggauuuugucgaaggagugucggguggcucauggguagacauuguucucgagcacgggagcugugugacuacaauggcuaagaauaagcccaccuuagauuucgaacugaucaaaacggaggccaagcagccugcgacccuucggaaauauugcauugaagcaaaguugacaaacacuaccacagagagucgcuguccaacucaaggagagcccucccugaaugaagaacaggacaaacgauuuaucugcaagcauucuauggucgauagaggcugggguaacggguguggacuauucggcaagggcgggaucgugaccugcgccauguuuacaugcaaaaagaauauggaaggaaaagugguccagccugagaaccucgaauacaccauuguuauaacuccacacagcggugaggagcaugcugugggcaaugacacggggaagcacggaaaagaaaucaagauuacaccgcaguccucaaucaccgaggccgaacugacuggcuaugguaccguaacaauggaguguagucccaggaccgggcuugauuucaacgaaauggugcuguugcaaauggaggacaaagcauggcucguccaccggcagugguuucuggauuuaccucugccauggcuccccggcgcugacacucagggaagcaauuggauacagaaggagacacuugugacguucaagaacccucaugccaaaaagcaagacguugugguccugggcucucaggaaggggcgaugcacaccgccuugacuggagcaacagagauucagauguccucagguaaucuacuguuuaccggccaucucaaaugccgucugcgcauggauaaacuucaacugaaagggaugagcuacaguauguguacaggaaaguucaagaucgugaaagaaaucgcugagacucagcacggcaccauuguaaucagaguucaguaugagggugacgggucuccaugcaagauucccuucgaaauaacggauuuggagaaaaggcaugugcucggccggcugaucaccgucaacccgauugugacagaaaaggacuccccugucaacaucgaggccgaacccccauuuggagauagcuacaucauuauaggcguggagccugggcaguuaaaacugaauugguucaagaagggaucgucuaucggucaaauguuugagacuaccaugcgaggcgcuaaacgcauggccauucuaggggacacagcaugggauuucggaucccucggcgguguuuuuacuucaaucgggaaggcccugcaccagguguucggcgcuauuuacggagcggcauuuaguggcguaagcuggaccaugaaaauccuuauaggggucaucauuacguggaucggaaugaacuccagaucuacuagcuugucagugagucugguucucgugggcgucgugacccuguaucuuggugccguagugcaggcugacuccggguguguugucagcuggaagaauaaagaacugaagugcggaucuggcauuuucaucacugauaacgugcacacauggaccgagcaguacaaguuucaacccgaaucaccaaguaaauuggccagcgcaauacagaaggcccaugaggaagguauuuguggcaucagguccgugacucggcucgagaaucugauguggaaacagauuacccccgaguuaaaccacauccugucugaaaaugaggucaagcuaacaauaaugacgggggacaucaaaggaauuaugcaggcuggcaagcgcucgcucagaccucaaccaaccgaacugaaauauagcuggaagacuugggggaaggccaaaaugcuuuccacaggaucacauaaccagaccuucuugaucgauggcccggagacagcagaaugccccaauacuaacagggcguggaauagucuggagguugaggacuacgguuuugggguguucaccacgaacauuuggcucaagcugcgugaaaaacaggacguguuuugugauucuaaguuaaugagcgcugccaucaaagacaaucgggcaguacacgccgauaugggauauuggauagaguccgcucugaacgacacauggaagauggaaaaggccucauucauugaggucaaaagcugccacuggccuaagucucauacccuuugguccaauggcguguuggagagugaaaugaucauccccaagaauuucgcaggucccguuagccagcacaacuaccgaccuggcuaucauacucaaaccgcugggccauggcaccucggaaagcuggagauggauuuugacuucugugaaggcacaacuguggucgugaccgaggauugcgggaauagaggacccucucuaaggacaacgaccgccuccggcaaacugauuacugaauggugcugucgcucaugcacacucccgccucugcgguacagaggugaggacggguguugguacggaauggagaucaggccacuuaaggaaaaggaggaaaacuugguuaauagucuggugaccgcgggccauggucagauugauaacuuuagcuuaggcguacucgggauggcccuguuccuugaggaaaugcugcgcacucgaauaggaacaaaacacgcuaucuugcucgucgcagugucguuugugacccugauuacgggcaauauguccuuccgggaccuagggcgugucaugguuauggugggagccacuaugaccgaugacaucggcauggguguaacauaucuggcucuccuggccgcauuuaaggugagacccaccuucgcggccgggcuuuugcugaggaaauuaacuucuaaggagcucaugauggcuacaauuggaaucgcccugcuuagccagucaaccauaccugagacaauccuggaacuaacugaugcacucgcucugggcaugauggucuugaaaauugugcgcaacauggagaaguaccaacuggccguuaccaucauggcaauuaguugcgugcccaaugccgucaucuuacagaacgcuuggaagguguccuguacgauacucgcggccguuucugugagcccacugcuucugacauccucacagcagaaagcagacuggauuccuuuggcucucaccaucaagggccugaaucccacugccaucuuucuaaccacacugagccggacaaguaaaaagagaucuuggccacuuaacgaagccauuauggcugucgggaugguauccauacucgcaagcucgcuguugaaaaaugacaucccgaugaccggaccucugguggccgguggcuuacucacgguuugcuaugugcugacagggaggucagcggaucuugagcuggaacgagcugccgacgucaagugggaggaucaagcagagauuucuggaaguucccccaucuugagcauuaccaucucugaagacggcagcauguccaucaaaaacgaggaagaggagcagacucucacaauccugauucgcaccggucuacuggugaucucagggguauucccagugaguauucccaucacugccgcugcaugguaccuuugggaagucaagaagcagcgggccggaguucucugggaugugccuagcccacccccuguggagaaagcggaacuggaggacggcgcuuauagaauaaagcagaggggcauuuugggguacucucaaaucggagccggugucuauaaagaaggcacauuucacaccauguggcaugugacgcguggggcaguuuuaaugcaccgcggaaagcggaucgagccguccugggccgaugucaaaaaggaccugauuucauacggcgguggguggaagcucgagggagaauggaaagagggcgaagaggugcagguccuggcucuugaaccaggcaagaaucccagagccgugcagacuaaaccugggaucuucaagaccaacacaggaaccauaggugcaguuagucuggauuuuagcccaggcacauccgggucucccauuguggacaggaaaggaaaggucgugggcuuguacgguaaugggguagucacucgaucgggagcuuaugugagcgccaucgcgcagaccgagaagucaauugaggauaacccugaaaucgaggacgauauauuccggaaaaagcgccuaacgauuauggaccugcauccgggcgccggcaaaacaaagagauaccuccccgcaaucguuagggaagcuaucaaacgggggcugcgaacucuuauuuuagccccaaccagaguggucgcugcagagauggaagaggcccugcgcggacucccuaucagguaucaaacacccgccauuaagaccgagcacacuggucgugaaauaguggacuugaugugucaugcuaccuucacaaugcggcugcucuccccaguuagagugccuaacuacaaucugaucauuauggaugaggcgcacuuuacggaccccgcaaguaucgccgcuaggggcuauaucucuacucgcgucgaaaugggggaggccgcaggaauuuucaugaccgccacaccaccgggcagccgagauccuuuuccccaguccaacgcuccaauaauggacgaggaaagagagauccccgaacggucauggaacucuggucacgagugggugaccgauuucaaggggaaaacuguaugguuugugccuagcauuaaggcgggaaacgacaucgccgcaugccuuaggaaaaauggcaagaaaguuauucagcugagucgcaagacauucgauuccgaauacgucaagacccgugcuaacgacugggauuuuguggugacgacugacaucagcgagaugggcgccaauuucaaagcagagagagucauagauccacggagguguaugaagcccguaaucuugacagacggggaagaacgcgugauucuagccggaccuaugccgguuacccauucuucagcugcccaacgaagaggucggaucggcaggaaccccaaaaaugaaaacgaccaguauauuuacaugggggagccccuggaaaaugaugaggacugcgcgcacuggaaggaggcaaaaaugcucuuagauaacaucaauaccccugaaggaauaauucccuccauguuugagccagaacgcgagaagguggacgccaucgauggcgaauacagacugaggggugaggcucggaaaacuuucgucgaccuuaugcgucgcggggaucugccuguguggcucgccuauaagguugcugcagagggcauuaacuacgccgaccgaaagugguguuuugauggaaucaaaaauaaccagauauuggaagagaacauggaaguggagaucuggacaaaggagggcgaaaggaaaaagcugaaacccagauggcucgacgcucggauuuauagugauccacuggcccuuaaggaguucaaggaguucgcagcggggcgcaaaagccuaacccugaauuugaucacagagaugggaagauuaccuacuuuuaugacgcagaaggccaggaacgcucuggacaaucucgccguccugcauaccgcagaagcugguggccgggccuacaaccacgcacuuucggagcugccggagacacucgaaacuuugcugcuacugacccuccuugccacagugaccgggggaauuuuccuguuuuuaaugucuggcaaagguaucgggaagaugacuuugggcaugugcugcauaauuacggcuuccauccugcucugguaugcgcaaauccagccccacuggauugccgcaagcaucauacuggaguucuuucuuauuguacugcucaucccagaaccugagaaacagcgaaccccacaggauaaucaauugacauacgugguuauugcuauccugacugucguggccgccaccauggcaaacgaaaugggauucuuagagaagacaaagaaagaccuaggccuggggucaauaaccacucaggagagugaaucuaauauccucgacauugaucuuagaccagcuuccgccuggacacuguaugcgguggcuacgaccuuugucacuccuauguugcgccauagcaucgagaacucaaguguuaaugugagccugacagccauugcaaaccaggccaccguacucaugggacuggguaagggcuggccccuuuccaaaauggacaucggggugccgcuccuggcuauuggauguuacucucaggucaauccaaucaccuugacagcagcccuguuacuacugguggcgcacuacgcuauaauuggcccuggucuccaagccaaggcaacuagggaagcccagaaacgggcugccgcagggaucaugaagaaccccacgguugauggcaucaccgugauugaccuugagccaauacccuaugauccuaaguucgaaaaacagcugggacaggucauguugcugauccucugcguaacacaagugcugaugaugcguacuaccugggcucuuugugaggccuuaacacuggcgaccggcccgauuagcacucucugggaggggaaucccggaagauuuuggaacacgacaaucgccguuuccauggcaaauauuuucaggggcucauacuuggcuggugccgggcugcuauuuucuaucaugaagaacaccacaaguacccgccggggaacaggcaauauaggugaaacucugggcgagaaauggaagucgcgacucaacgcacuugggaaaagcgaguuccagaucuauaagaaauccgguauucaggagguggacagaacccuggcuaaggagggcaucaagagaggggaaacagaucaucacgccgucucucgcggaucagccaaauugcggugguuuguggagagaaacauggucacgccagaaggcaaggugguugaccuggguugcgggcguggaggcuggagcuacuauugugguggccucaaaaaugugagggagguaaaggggcugaccaaaggaggcccugggcaugaagaaccaauuccuauguccacuuacggauggaacuuagugcggcuucaaaguggcgucgauguuuucuucacaccacccgagaagugcgacacccugcucugugauaucggugaaucuagcccuaauccaacuauagaggcggggcgcacacuacgagugcugaacuuggucgaaaauuggcugaacaauaacacccaguuuugcauuaaggugcucaaucccuauaugccgucaguaaucgagaaaauggaagcacuucagagacaguacggaggcgcacuggugaggaacccuuugucccggaauaguacgcacgagauguacuggguuagcaacgccaccggcaauaucgugucuuccgucaacaugauuucacgcaugcugauaaauagauucacaaugaagcacaaaaaggcuacuuaugagccagacguggaucucgggagcggaaccaggaacaucgguauugaaucggagauccccaacuuagacauuaucggcaaacgaauagaaaagaucaagcaagagcaugaaauuucuuggcacuacgaccaggaucauccuuauaaaacaugggccuaccacgggaguuaugagacuaagcagaccggauccgcaagcucaauggucaauggcgugguucggcugcuuacaaaaccaugggacguagugcccauggucacccagauggccaugacugauacgacaccguuuggucaacagcguguguucaaggagaaaguugacaccagaacucaggaaccuaaggaggggaccaagaaacugaugaagaucacagcugaauggcuauggaaagagcucggaaagaaaaagacgccccgcauguguaccagggaggaauuuacuaaaaaggugcggggcaacgcggcccugggcgcaauuuucacagaugagaauaaguggaaauccgcuagagaagccgucgaggacgggcgcuuuugggaauugguggauagggagcgaaaccugcaccucgagggaaagugcgaaaccuguguauacaauaugauggguaaacgggagaagaaacuuggcgaguucgggaaggcaaagggaucuagagccaucugguauauguggcugggcgcuagguuuuuagaguucgaagcccugggauuuuugaacgaggaccauugguucagccgcgggaauagucucuccggaguggagggcgaaggccugcaccgucuaggguacauucuucgggauguuggcaaaaaggaggguggcgcgauguacgcagacgauacugccgggugggacacaagaauaacccuggaagaccucaaaaacgaggaaauggucacaaaucauaugaagggagagcacaaaaagcuggcugaggccaucuuuaaguugacuuaucagaacaaaguggugaggguccaacgcccaaccccucgaggcacgguuauggauauuaucagccggagagaccagagggguucuggacaggugggaaccuacggccugaauacauucacuaacauggaagcacaacucauccgccagauggagggcgaagggauuuucaagucaauacagcaucuuaccgcuacagaggagaucgccguacagaauuggcuggcuagagugggacgggaaagguuaagucguauggccauuuccggugaugacugcgucgugaaacccaucgaugaccgauuugcaagcgcgcugacugccuugaacgauaugggcaagguucgcaaagacauucaacagugggagccaucuagaggguggaaugauuggacccaggugcccuucugcucgcaccacuuucaugaacucgucaugaaggacggacgggugcugguaguuccuuguaggaaccaggaugagcuaaucggccgcgcuagaauaucacaaggugccggguggagccuuaaggaaacggcaugccugggaaaauccuaugcucagauguggacacucauguacuuccaccggagggaccugcgauuggccgcaaacgccaucuguagugcggugccaucucauugggucccgaccagccguacuacaugguccauucacgcuaagcacgaguggaugaccacugaggauauguuagccguguggaauagaguguggauccaggaaaaccccuggauggaggacaaaaccccugucgaaucaugggaggaaguuccauaucugggcaagcgcgaggaccaguggugcggcagucucauugggcuuacaucucgggcaacgugggccaaaaauauccaaaccgcuauaaaccaggugaggagccugauuggaaaugaggaauacacugauuauaugcccuccaugaagagauuucgccgggaggaagaggaagccgguguacuaugguga

SEQ ID NO: 14507 - RNA, 9876 nt, Artificial Sequence
  derived and/or modified CDS sequence (opt3) from DENV-2__FJ744707__SS-prME
accgccggcgugauaguaaugcugauuccaacugcuauggcuuuccaccucacuacgagaaacggggaaccucauaugauaguuggaaggcaggaaaaggguaaaagccuucuguuuaagaccgaagacggcgugaauaugugcacauugauggccaucgauuuaggggaacugugugaagacacuauuaccuacaaaugcccacuacuccggcaaaacgaaccggaggauaucgacuguuggugcaauuccacaucuaccuggguaacuuauggaacauguaccacgacuggcgagcaccgccgagaaaagcguucaguggcgcuggucccccauguggguauggggcuugagaccagaacagaaacuuggaugaguagcgagggagcuuggaaacacguucagaggauugagaccuggauccugcggcauccuggcuucacaauaauggccgcaaucuuggccuacaccauuggcacgacucacuuucagcgcgcucucaucuucauucugcugacagcaguggccccauccaugaccaugagaugcaucgggauaucuaacagggauuuugucgaaggagugucggguggcucauggguagacauuguucucgagcacgggagcugugugacuacaauggcuaagaauaagcccaccuuagauuucgaacugaucaaaacggaggccaagcagccugcgacccuucggaaauauugcauugaagcaaaguugacaaacacuaccacagagagucgcuguccaacucaaggagagcccucccugaaugaagaacaggacaaacgauuuaucugcaagcauucuauggucgauagaggcugggguaacggguguggacuauucggcaagggcgggaucgugaccugcgccauguuuacaugcaaaaagaauauggaaggaaaagugguccagccugagaaccucgaauacaccauuguuauaacuccacacagcggugaggagcaugcugugggcaaugacacggggaagcacggaaaagaaaucaagauuacaccgcaguccucaaucaccgaggccgaacugacuggcuaugguaccguaacaauggaguguagucccaggaccgggcuugauuucaacgaaauggugcuguugcaaauggaggacaaagcauggcucguccaccggcagugguuucuggauuuaccucugccauggcuccccggcgcugacacucagggaagcaauuggauacagaaggagacacuugugacguucaagaacccucaugccaaaaagcaagacguugugguccugggcucucaggaaggggcgaugcacaccgccuugacuggagcaacagagauucagauguccucagguaaucuacuguuuaccggccaucucaaaugccgucugcgcauggauaaacuucaacugaaagggaugagcuacaguauguguacaggaaaguucaagaucgugaaagaaaucgcugagacucagcacggcaccauuguaaucagaguucaguaugagggugacgggucuccaugcaagauucccuucgaaauaacggauuuggagaaaaggcaugugcucggccggcugaucaccgucaacccgauugugacagaaaaggacuccccugucaacaucgaggccgaacccccauuuggagauagcuacaucauuauaggcguggagccugggcaguuaaaacugaauugguucaagaagggaucgucuaucggucaaauguuugagacuaccaugcgaggcgcuaaacgcauggccauucuaggggacacagcaugggauuucggaucccucggcgguguuuuuacuucaaucgggaaggcccugcaccagguguucggcgcuauuuacggagcggcauuuaguggcguaagcuggaccaugaaaauccuuauaggggucaucauuacguggaucggaaugaacuccagaucuacuagcuugucagugagucugguucucgugggcgucgugacccuguaucuuggugccguagugcaggcugacuccggguguguugucagcuggaagaauaaagaacugaagugcggaucuggcauuuucaucacugauaacgugcacacauggaccgagcaguacaaguuucaacccgaaucaccaaguaaauuggccagcgcaauacagaaggcccaugaggaagguauuuguggcaucagguccgugacucggcucgagaaucugauguggaaacagauuacccccgaguuaaaccacauccugucugaaaaugaggucaagcuaacaauaaugacgggggacaucaaaggaauuaugcaggcuggcaagcgcucgcucagaccucaaccaaccgaacugaaauauagcuggaagacuugggggaaggccaaaaugcuuuccacagagucacauaaccagaccuucuugaucgauggaccggaaacagcagagugccccaauacuaacagggcguggaauagucuggagguugaagacuacggcuuugguguguucaccacgaacauuuggcucaagcugcgugagaaacaggacguguuuugugauucuaaguuaaugagcgcugccaucaaagacaaucgggcaguacacgccgauaugggguauuggauagaauccgcucugaacgacacauggaagauggagaaggccucauucauugaggucaaaagcugccacuggccuaagucucauacccuuugguccaauggaguguuggaaagugagaugaucauccccaagaauuucgcaggccccguuagccagcacaacuaccgaccugguuaucauacucaaaccgcuggcccauggcaccucgggaagcuggaaauggauuuugacuucugugagggaacaacuguggucgugaccgaagauugcggcaauagagggcccucucuaaggacaacgaccgccuccggaaaacugauuacugaguggugcugucgcucaugcacacucccgccucugcgguacagaggcgaggacgguuguugguacgggauggaaaucaggccacuuaaggagaaggaagagaacuugguuaauagucuggugaccgcgggacauggccagauugauaacuuuagcuuagguguacucggcauggcccuguuccuugaagagaugcugcgcacucgaauagggacaaaacacgcuaucuugcucgucgcagugucguuugugacccugauuacgggaaauauguccuuccgggaccuaggccgugucaugguuauggugggggccacuaugaccgaugacaucggaaugggcguaacauaucuggcucuccuggccgcauuuaaggugagacccaccuucgcggccggucuuuugcugaggaaauuaacuucuaaggagcucaugauggcuacaauugggaucgcccugcuuagccagucaaccauaccugaaacaauccuggagcuaacugaugcacucgcucugggaaugauggucuugaaaauugugcgcaacauggaaaaguaccaacuggccguuaccaucauggcaauuaguugcgugcccaaugccgucaucuuacagaacgcuuggaagguguccuguacgauacucgcggccguuucugugagcccacugcuucugacauccucacagcagaaagcagacuggauuccuuuggcucucaccaucaagggccugaaucccacugccaucuuucuaaccacacugagccggacaaguaaaaagagaucuuggccacuuaacgaggccauuauggcugucggcaugguauccauacucgcaagcucgcuguugaaaaaugacaucccgaugaccgggccucugguggccggagguuuacucacgguuugcuaugugcugacaggcaggucagcggaucuugaacuggagcgagcugccgacgucaagugggaggaucaagcagaaauuucugggaguucccccaucuugagcauuaccaucucugaggacggaagcauguccaucaaaaacgaagaggaggaacagacucucacaauccugauucgcaccggccuacuggugaucucagguguauucccagugaguauucccaucacugccgcugcaugguaccuuugggaggucaagaagcagcgggccgggguucucugggaugugccuagcccacccccuguggaaaaagcggagcuggaagacggagcuuauagaauaaagcagaggggcauuuugggcuacucucaaaucggggccggagucuauaaagaggguacauuucacaccauguggcaugugacgcguggcgcaguuuuaaugcaccgcgggaagcggaucgagccguccugggccgaugucaaaaaggaccugauuucauacggaggcgguuggaagcucgaaggggaguggaaagaaggagaggaagugcagguccuggcucuugagccaggcaagaaucccagagccgugcagacuaaaccuggcaucuucaagaccaacacagggaccauaggagcaguuagucuggauuuuagcccagguacauccggcucucccauuguggacaggaaagggaaggucgugggauuguacggcaaugguguagucacucgaucgggggcuuaugugagcgccaucgcgcagaccgagaagucaauugaagauaacccugagaucgaagacgauauauuccggaaaaagcgccuaacgauuauggaccugcauccgggagccggcaaaacaaagagauaccuccccgcaaucguuagggaggcuaucaaacggggccugcgaacucuuauuuuagccccaaccagaguggucgcugcagaaauggaggaggcccugcgcgggcucccuaucagguaucaaacacccgccauuaagaccgaacacacuggacgugagauaguggacuugaugugucaugcuaccuucacaaugcggcugcucuccccaguuagagugccuaacuacaaucugaucauuauggaugaagcgcacuuuacggaccccgcaaguaucgccgcuagggguuauaucucuacucgcgucgagaugggcgaggccgcagggauuuucaugaccgccacaccaccgggaagccgagauccuuuuccccaguccaacgcuccaauaauggacgaagagagagaaauccccgagcggucauggaacucuggccacgaaugggugaccgauuucaaggguaaaacuguaugguuugugccuagcauuaaggcggggaacgacaucgccgcaugccuuaggaaaaauggaaagaaaguuauucagcugagucgcaagacauucgauuccgaguacgucaagacccgugcuaacgacugggauuuuguggugacgacugacaucagcgagaugggcgccaauuucaaagcagaaagagucauagauccacggagguguaugaagcccguaaucuugacagacggcgaggaacgcgugauucuagccgggccuaugccgguuacccauucuucagcugcccaacgaagaggacggaucgguaggaaccccaaaaaugagaacgaccaguauauuuacaugggcgaaccccuggagaaugaugaggacugcgcgcacuggaaggaagcaaaaaugcucuuagauaacaucaauaccccugaggggauaauucccuccauguuugaaccagagcgcgaaaagguggacgccaucgauggagaguacagacugaggggcgaggcucggaaaacuuucgucgaccuuaugcgucgcggugaucugccuguguggcucgccuauaagguugcugcagaagggauuaacuacgccgaccgaaagugguguuuugauggcaucaaaaauaaccagauauuggaggaaaacauggagguggagaucuggacaaaggaaggagagaggaaaaagcugaaacccagauggcucgacgcucggauuuauagugauccacuggcccuuaaggaguucaaggaguucgcagcgggccgcaaaagccuaacccugaauuugaucacagaaauggggagauuaccuacuuuuaugacgcagaaggccaggaacgcucuggacaaucucgccguccugcauaccgcagaggcuggaggucgggccuacaaccacgcacuuucggagcugccggaaacacucgagacuuugcugcuacugacccuccuugccacagugaccggcgggauuuuccuguuuuuaaugucuggaaaaggcaucgguaagaugacuuuggggaugugcugcauaauuacggcuuccauccugcucugguaugcgcaaauccagccccacuggauugccgcaagcaucauacuggaguucuuucuuauuguacugcucaucccagagccugaaaaacagcgaaccccacaggauaaucaauugacauacgugguuauugcuauccugacugucguggccgccaccauggcaaacgagaugggcuucuuagagaagacaaagaaagaccuaggacugggcucaauaaccacucaggaaagugagucuaauauccucgacauugaucuuagaccagcuuccgccuggacacuguaugcgguggcuacgaccuuugucacuccuauguugcgccauagcaucgaaaacucaaguguuaaugugagccugacagccauugcaaaccaggccaccguacucauggggcugggaaaggguuggccccuuuccaaaauggacaucggcgugccgcuccuggcuauuggguguuacucucaggucaauccaaucaccuugacagcagcccuguuacuacugguggcgcacuacgcuauaauuggaccuggccuccaagccaaggcaacuagggaggcccagaaacgggcugccgcagguaucaugaagaaccccacgguugaugggaucaccgugauugaccuugaaccaauacccuaugauccuaaguucgagaaacagcugggccaggucauguugcugauccucugcguaacacaagugcugaugaugcguacuaccugggcucuuugugaggccuuaacacuggcgaccggaccgauuagcacucucugggaaggcaaucccgggagauuuuggaacacgacaaucgccguuuccauggcaaauauuuucaggggaucauacuuggcuggcgccggucugcuauuuucuaucaugaagaacaccacaaguacccgccgggggacaggaaauauaggcgagacucugggugaaaaauggaagucgcgacucaacgcacuuggcaaaagcgaguuccagaucuauaagaaauccgggauucaggagguggacagaacccuggcuaaggaaggaaucaagaggggcgagacagaucaucacgccgucucucgcgggucagccaaauugcggugguuuguggaaagaaacauggucacgccagagggaaaggugguugaccugggcugcggucgugggggauggagcuacuauuguggcggucucaaaaaugugagggaaguaaagggccugaccaaagggggaccuggccaugaggagcccauuccuauguccacuuacggguggaacuuagugcggcuucaaaguggagucgauguuuucuucacaccacccgaaaagugcgacacccugcucugugauaucggcgagucuagcccuaauccaacuauagaagcgggucgcacacuacgagugcugaacuuggucgagaauuggcugaacaauaacacccaguuuugcauuaaggugcucaaucccuauaugccgucaguaaucgagaaaauggaggcacuucagagacaguacgggggagcacuggugaggaacccuuugucccggaauaguacgcacgagauguacuggguuagcaacgccaccggcaauaucgugucuuccgucaacaugauuucacgcaugcugauaaauagauucacaaugaagcacaaaaaggcuacuuaugaaccagacguggaucucggcagcgggaccaggaacaucggaauugagucggaaauccccaacuuagacauuaucgguaaacgaauagagaagaucaagcaagaacaugagauuucuuggcacuacgaccaggaucauccuuauaaaacaugggccuaccacggcaguuaugagacuaagcagaccggguccgcaagcucaauggucaauggagugguucggcugcuuacaaaaccaugggacguagugcccauggucacccagauggccaugacugauacgacaccguuuggccaacagcguguguucaaggaaaaaguugacaccagaacucaggagccuaaggaagguaccaagaaacugaugaagaucacagcugaguggcuauggaaagagcucgggaagaaaaagacgccccgcauguguaccagggaagaguuuacuaaaaaggugcgguccaacgcggcccugggagcaauuuucacagaugaaaauaaguggaaaucugcuagagaggccgucgaagacggccgcuuuugggaguugguggauagggagcgaaaccugcaccucgaaggcaagugcgagaccuguguauacaauaugauggggaaacgggaaaagaaacuuggagaguucgguaaggcaaagggcagcagagccaucugguauauguggcugggggcuagguuuuuagaguucgaggcccugggauuuuugaacgaggaccauugguucagucgcggcaauucccucagcgguguggaaggggagggacugcaccgucuaggcuacauucuucgggauguuggcaaaaaggaagggggagcgauguacgcagacgauacugccgguugggacacaagaauaacccuggaggaccucaaaaacgaagagauggucacaaaucauaugaagggcgagcacaaaaagcuggcugaagccaucuuuaaguugacuuaucagaacaaaguggugaggguccaacgcccaaccccucgagggacgguuauggauauuaucucucggagagaccagaggggaucaggccagguggguaccuacgggcugaauacauucacuaacauggaggcacaacucauccgccagauggaaggagagggcauuuucaagaguauacagcaucuuaccgcuacagaggaaaucgccguacagaauuggcuggcuagagugggccgggagagguuaucccguauggccauuagcggggaugacugcgucgugaaacccaucgaugaccgauuugcaucugcgcugacugccuugaacgauaugggaaagguucgcaaagacauucaacagugggaaccaucgagagguuggaaugauuggacccaggugcccuucugcucacaccacuuucaugagcucgucaugaaggacggccgggugcugguagcuccuuguaggaaccaggaugaacuaaucgggcgcgccagaauaagccaaggagcaggcuggucccuuaaggagacggcuugccuggguaaaaguuaugcccagauguggacacucauguacuuccaccggagggaccugcgauuggcagccaacgcgaucuguucugcuguuccaagccauugggugccgaccucccguacuacauggucaauucacgccaagcacgaguggaugaccacugaagauauguuagcagucuggaauagaguguggauccaggagaaccccuggauggaagacaaaaccccuguggagaguugggaagaggucccauaucuggggaagcgcgaggaccaguggugcggaucucucauuggccuuacaagccgggccacgugggcuaaaaauauccaaaccgccauaaaccagguuaggucccugauuggcaaugaagaguacacugauuauaugcccucaaugaagagauuucgccgggaagaggaagaggcaggggugcuaugguga

SEQ ID NO: 14508 - RNA, 9876 nt, Artificial Sequence
  derived and/or modified CDS sequence (opt3) from DENV-2__FJ744704__SS-prME
accgccggagugaucgucaugcugauucccaccgcuauggcauuccaccucacuacgagaaauggggagccucauaugauaguuggaaggcaggaaaaggguaaaagccuucuguuuaagaccgaggacggcgugaauaugugcacauugauggccaucgauuuaggggaacugugugaggacacuauuaccuacaaaugcccacuacuccggcaaaacgaaccggaggauaucgacuguuggugcaauuccacaucuaccuggguaacuuauggaacauguaccacgacuggcgagcaccgccgagaaaagcguucaguggcgcuggucccccauguggguauggggcuugagaccaggacagaaacuuggaugaguagcgagggagcuuggaaacacguucagaggauugagaccuggauccugcggcauccuggcuucacaauaauggccgcaaucuuggccuacaccauuggcacgacucacuuucagcgcgcucucaucuucauucugcugacagcaguggccccauccaugaccaugagaugcaucgggauaucuaacagggauuuugucgaaggagugucggguggcucauggguagacauuguucucgagcacgggagcugugugacuacaauggcuaagaauaagcccaccuuagauuucgaacugaucaaaacggaggccaagcagccugcgacccuucggaaauauugcauugaagcaaaguugacaaacacuaccacagagagucgcuguccaacucaaggagagcccucccugaaugaggaacaggacaaacgauuuaucugcaagcauucuauggucgauagaggcugggguaacggguguggacuauucggcaagggcgggaucgugaccugcgccauguuuacaugcaaaaagaauauggaaggaaaagugguccagccugagaaccucgaauacaccauuguuauaacuccacacagcggugaggagcaugcugugggcaaugacacggggaagcacggaaaagaaaucaagauuacaccgcaguccucaaucaccgaggccgaacugacuggcuaugguaccguaacaauggaguguagucccaggaccgggcuugauuucaacgaaauggugcuguugcaaauggaggacaaagcauggcucguccaccggcagugguuucuggauuuaccucugccauggcuccccggcgcugacacucagggaagcaauuggauacagaaggagacacuugugacguucaagaacccucaugccaaaaagcaagacguugugguccugggcucucaggaaggggcgaugcacaccgccuugacuggagcaacagagauucagauguccucagguaaucuacuguuuaccggccaucucaaaugccgucugcgcauggauaaacuucaacugaaagggaugagcuacaguauguguacaggaaaguucaagaucgugaaagaaaucgcugagacucagcacggcaccauuguaaucagaguucaguaugagggugacgggucuccaugcaagauucccuucgaaauaacggauuuggagaaaaggcaugugcucggccggcugaucaccgucaacccgauugugacagaaaaggacuccccugucaacaucgaggccgaacccccauuuggagauagcuacaucauuauaggcguggagccugggcaguuaaaacugaauugguucaagaagggaucgucuaucggucaaauguuugagacuaccaugcgaggcgcuaaacgcauggccauucuaggggacacagcaugggauuucggaucccucggcgguguuuuuacuucaaucgggaaggcccugcaccagguguucggcgcuauuuacggagcggcauuuaguggcguaagcuggaccaugaaaauccuuauaggggucaucauuacguggaucggaaugaacuccagaucuacuagcuugucagugagucugguucucgugggcgucgugacccuguaucuuggugccaugguacaggcugacuccgggugugugguuagcuggaagaauaaagaacugaagugcggaucuggcauuuucaucacugauaacguccacacauggaccgagcaguacaaguuucaacccgaaucaccaaguaaauuggccagcgcaauacagaaggcccaugaggaagguauuuguggcaucagguccgugacucggcucgagaaucugauguggaaacagauuacccccgaguuaaaccacauccugucugaaaaugaggugaagcuaacaauaaugacgggggacauccgcggaauuaugcaggcuggcaaaagaucgcucaggccucaaccaaccgaacugaaguauagcuggaaaacuugggggaaggccaagaugcuuuccacagagucacauaaccagaccuucuugaucgauggaccggaaacagcagagugccccaauacuaaccgugcguggaauagucuggaggucgaagacuacggcuuugguguuuucaccacgaacauuuggcucaaacugcgggagaagcaggacguguuuugugauucuaaauuaaugagcgcugccaucaaggacaaucgagcagugcacgccgauaugggguauuggauagaauccgcucugaacgacacauggaaaauggagaaggccucauucauugagguaaagagcugccacuggccuaaaucucauacccuuugguccaauggagucuuggaaagugagaugaucaucccaaagaacuucgcaggccccgugagccagcacaacuacagaccugguuaucauacucaaaccgcuggcccauggcaccucgggaaacuggaaauggauuuugaccuaugugagggaacaacuguuguggucaccgaagauugcggcaauagggggcccucucugcgcacaacgaccgccuccggaaagcucauuacugaguggugcugucggucaugcacacugccgccucuuagauacaggggcgaggacgguuguugguacgggauggaaauccgcccauugaaagagaaggaagagaaccuggugaauaguuuaguuaccgcgggacauggccagauugauaacuucagccucggugugcugggcauggcccuuuuucuggaagagauguugcgaacucggauagggacaaagcacgcuauccuccugguagcagucucguucgugacccuaauuacgggaaauauguccuuucgugaccugggcagagugauggucaugguuggggccacuaugaccgaugacaucggaaugggcgugacauaucucgcucugcuugccgcauucaaaguaaggcccaccuuugcggccgguuugcuguuacgcaagcucacuucuaaagagcugaugauggcuacaauugggaucgcccuucugagccagucaaccauaccugaaacaauccuagagcucacugaugcacuggcuuugggaaugauggugcugaagauuguccggaacauggaaaaauaccaauuagccgugaccaucauggcaauuaguugcguucccaaugccgugauccuccagaacgcuuggaaggucuccuguacgauacuggcggccgugucuguuagcccacuucuguugacauccucacagcagaaggcagacuggauuccucucgcucugaccaucaaaggccuaaaucccacugccaucuuccugaccacacuuagcagaacaaguaagaaaaggucuuggccacucaacgaggccauuauggcugugggcauggucuccauacuggcaagcucguugcugaagaaugacaucccgaugaccgggccuuuaguagccggaggucuccugacggugugcuauguucuuacaggccgaucagcggaucuggaauuggagcgcgcugccgacgugaaaugggaggaucaagcagaaauuucugggaguucccccauccucagcauuaccaucucugaggacggaagcauguccauaaagaacgaagaggaggaacagacucugacaauccuaauucggaccggccugcuugucaucucagguguguuuccaguaaguauucccaucacugccgcugcaugguaccucugggaggugaaaaagcagagagccgggguccugugggauguuccuagcccacccccuguggaaaaggcggaguuggaagacggagcuuauaggauaaaacagcguggcauuuuaggcuacucucaaaucggggccggaguguauaaggaggguacauuccacaccauguggcaugucacgcgcggcgcagugcugaugcaccgggggaaaagaaucgagccguccugggccgauguuaagaaagaccucauuucauacggaggcgguuggaagcuggaaggggaguggaaggaaggagaggaaguacaggugcuugcucuggagccaggcaaaaaucccagggccguccagacuaagccuggcauguuuaaaaccaacacagggaccaucggagcagugaguuuggauuucagcccagguacauccggcucucccauaguugaccgaaaggggaaaguggucggacuauacggcaauggugugguaacucggucgggggcuuaugucagcgccauugcgcagaccgagaagucaaucgaagauaacccugagauugaagacgauaucuuucgcaagaaaagacugacgauaauggaccuccauccgggagccggcaagacaaaaagguaccugcccgcaauugugcgggaggcuaucaagcgaggccuuagaacuuuaauccuggccccaacccgcguuguggcugcagaaauggaggaggcccucaggggguugccuauucguuaucaaacacccgccaucaaaaccgaacacacuggacgggagauugucgaccugaugugucaugcuaccuucacaaugagacuccuguccccagugaggguuccuaacuacaaucuuauaaucauggaugaagcgcacuucacggaccccgcaaguauugccgcucgcgguuauaucucuacucgaguggagaugggcgaggccgcagggaucuuuaugaccgccacaccaccgggaagcagagauccuuucccccaguccaacgcuccaauuauggacgaagaacgggaaauacccgagaggucauggaacucuggccacgaaugggucaccgauuuuaaggguaagacugugugguucguaccuagcaucaaagcggggaacgacauugccgcaugccugcgcaagaauggcaagaaggugauccaguugagucguaaaacauuugauuccgaguacguuaagaccagagcuaacgacugggauuucgucgugacgacugacauuagcgagaugggcgccaauuuuaaggcagaacgggugaucgauccaaggcgcuguaugaaacccgucauacuaacagacggcgaggaacgaguaauccuggccgggccuaugccggugacccauucuucagcugcccaaagacggggaaggauuggucgcaacccaaagaaugagaacgaccaguauaucuacaugggcgaaccccucgagaaugaugaggacugcgcgcacuggaaagaagcaaagauguuacuggauaacauuaauaccccugaggggaucauacccuccauguucgaaccagagagagaaaaaguugacgccauugauggagaguacaggcuucggggcgaggcucguaagacuuuuguggaccugaugcgccgaggugaucucccugucugguuggccuauaaaguggcugcagaagggaucaacuacgccgacagaaagugguguuucgauggcauuaagaauaaccagauccuggaggaaaacauggagguugagauauggacaaaagaaggagagaggaagaaacucaagccccgguggcuggacgcucgcaucuauagugauccacuugcccuaaaagaauuuaaggaguucgcagcgggcagaaagagccugaccuugaauuuaauuacagaaauggggaggcugccuacuuucaugacgcagaaagcccggaacgcucucgacaaucuggccgugcuucauaccgcagaggcuggaggucgagccuacaaccacgcacugucggagcucccggaaacauuggagacucugcuacugcucacccuucuggccacagucaccggcgggaucuuuuuauucuugaugucuggaaagggcauugguaaaaugacucuggggaugugcugcaucauaacggcuuccauucuccugugguaugcgcaaauccagccccacuggaucgccgcaagcauuauccuugaauuuuuccugauagugcucuugauuccagagccugaaaagcagagaacaccccaggauaaucaacugacauacguagugaucgcuauuuuaacuguugucgccgccaccauggcaaacgagaugggcuuucuagagaaaacaaagaaggaccugggacucggcucaaucaccacucaggaaagugagucuaauauacuugacaucgaucugcgcccagcuuccgccuggacauuguaugcgguggcuacgaccuucgugacuccuaugcugaggcauagcauugaaaacucaagugucaauguuagccucacagccaucgcaaaccaggccaccgugcugauggggcuuggaaaagguuggccccucuccaagauggacauuggcguaccgcuguuggcuaucggguguuacucucaggugaauccaauuacccugacagcagccuuacuacugcucgucgcgcacuacgcuaucauaggaccuggccuucaagccaaagcaacucgggaggcccagaagcgugcugccgcagguauuaugaaaaaccccacgguggaugggaucaccguuaucgaccuggaaccaauucccuaugauccuaaguuugagaagcaguugggccaggugaugcugcucauacugugcgucacacaaguacuuaugaugagaacuaccugggcuuuaugugaggcccugacacucgcgaccggaccgaucagcacuuugugggaaggcaaucccgggagguucuggaacacgacaauugccguguccauggcaaauaucuuucgcggaucauaccuggcuggcgccggucuacuguucucuauuaugaaaaacaccacuaauacccggcgagggacaggaaacaucggcgagacucucggugaaaaguggaaaaguagacuuaacgcacugggcaagucggaguuucagauauauaaaaagagcgggauccaggagguugacaggaccuuggcuaaagaaggaauuaagcgcggcgagacagaucaucacgccgugucccgggggucugccaagcugagaugguucgucgaacguaauauggugacgccagagggaaaagucguggaccucggcugcgguagagggggauggucauacuauuguggcggucugaagaacguucgggaagugaaaggcuuaaccaaagggggaccuggccaugaggagcccaucccuaugagcacuuacggguggaaucuuguacgccugcaauccggaguggaugucuuuuucacaccacccgaaaaaugcgacacccuccuaugugauauuggcgagaguucuccuaacccaacuaucgaagcgggucgaacacugagaguuuugaaucugguggagaacuggcucaauaacaauacccaguucugcauaaagguccuuaaccccuauaugccgagcgugauugaaaagauggaggcucugcagaggaaauacgggggagcauugguacggaauccucugucacgcaacuccacgcacgagauguacugggugaguaaugccaccggcaacaucguuagcucugugaauaugaucuccagaaugcucauuaacagguuuacaaugaagcacaaaaaggcuacuuaugaaccagacgucgauuuaggcucagggacccgaaacauaggaaucgagagcgaaauucccaaucuggacaucauugguaaacggaucgagaagauaaagcaggaacaugagacaucguggcacuacgaccaagaucauccuuauaaaacuugggccuaccacggcucuuaugagaccaagcagacagggagugcauccagcauggugaacggagucgugcgucuucugaccaaaccaugggacguuguacccauggugacucagauggccaugacggauacaaccccguucggccagcaaagagucuuuaaggaaaaaguggacacucgcacccaggagccuaaggaagguacaaagaaacuaaugaagaucacggcugaguggcucuggaaagagcuggggaagaaaaagacccccaggauuuguacucgggaagaguucacaagaaaaguucgcucaaaugcggccuugggagcaaucuuuaccgaugaaaacaaguggaaguccgcuagggaggccguggaagacggccgauucugggagcuggucgaucgggagagaaaucuccaccuugaaggcaaaugcgagacuuguguguacaacaugauggggaagagggagaagaagcugggagaguuugguaaagcaaagggcucucgcgccauuugguauaugugguuaggggcucguuuccuggaauuugaggccuugggauuccucaaugaggaccauugguuuagccgggaaaacagucuguccggcguagagggugaagggcuacacagacuuggauacauccugagggaugugggcaagaaagagggcggggcgauguacgcagacgauacagccggaugggacacccgcauuacacucgaagaccugaagaaugaggagaugguuacuaaccauaugaaaggugaacacaagaaauuggcugaggccauauucaagcugaccuaucagaauaaggucgugcgagugcagcggccaacgccuagaggcaccgucauggauaucauuagcaggcgcgaccaaagagggucuggacagguuggcacauacggucucaacacuuuuaccaauauggaagcacagcuuauccggcaaauggagggggagggaaucuucaaaucaauucagcaucugacagcuacugaagagauagccgugcagaacugguuagcuaggguaggccgugaacgacugagucgcauggccaucuccggcgaugacugcguggucaagcccauugaugacagauucgcaagcgcguugaccgcccucaaugauauggggaaagugcggaaggacauccagcaaugggagccaucuaggggauggaacgauuggacgcagguucccuuuugcucgcaccacuuccaugaacuggugaugaaagacggucgcguccuagugguaccuuguagaaaccaggaugagcuuauuggccgggcuaggaucucacagggggccggauggagccugaaggagacagcaugccucggcaaguccuaugcucaaauguggacccugauguacuuucaccgacgugacuugagauuagccgcaaaugccauauguagugcgguuccaccgcauugggugcccacuucucgcacaaccuggagcauccacgcuaaacacgaauggaugacuaccgaggauaugcuggccgucuggaaccggguguggauucaggaaaauccuuggauggaggacaagacaccaguggaauccugggaggagguccccuaucucgguaaaagggaagaccaguggugcgggucacuuaucggacugacgaguagagcaaccugggccaagaacauucagacugcuaucaaucaaguucgcucucuaauaggcaacgaggaauacacagauuauaugccuagcaugaaacgguucaggcgagaggaagaggaggccggcgugcugugguga

SEQ ID NO: 14509 - RNA, 9876 nt, Artificial Sequence
  derived and/or modified CDS sequence (opt3) from DENV-2__FJ744745__SS-prME
accgccggcgugauagucaugcugauuccaacagcuauggcauuccaccucacuacgagaaacggggagccucauaugauaguuggaaggcaggaaaaggguaaaagccuucuguuuaagaccgaggacggcgugaauaugugcacauugauggccaucgauuuaggggaacugugugaggacacuauuaccuacaaaugcccacuacuccggcaaaacgaaccggaggauaucgacuguuggugcaauuccacaucuaccuggguaacuuauggaacauguaccacgacuggcgagcaccgccgagaaaagcguucaguggcgcuggucccccauguggguauggggcuugagaccagaacagaaacuuggaugaguagcgagggagcuuggaaacacguucagaggauugagaccuggauccugcggcauccuggcuucacaauuauggccgcaaucuuggccuacaccauuggcacgacucacuuucagcgcgcucucaucuucauucugcugacagcaguggccccauccaugaccaugagaugcaucgggauaucuaacagggauuuugucgaaggagugucggguggcucauggguagacauuguucucgagcacgggagcugugugacuacaauggcuaagaauaagcccaccuuagauuucgaacugaucaaaacggaggccaagcagccugcgacccuucggaaauauugcauugaagcaaaguugacaaacacuaccacagagagucgcuguccaacucaaggagagcccucccugaaugaagaacaggacaaacgauuuaucugcaagcauucuauggucgauagaggcugggguaacggguguggacuauucggcaagggcgggaucgugaccugcgccauguuuacaugcaaaaagaauauggaaggaaaagugguccagccugagaaccucgaauacaccauuguuauaacuccacacagcggugaggagcaugcugugggcaaugacacggggaagcacggaaaagaaaucaagauuacaccgcaguccucaaucaccgaggccgaacugacuggcuaugguaccguaacaauggaguguagucccaggaccgggcuugauuucaacgaaauggugcuguugcaaauggaggacaaagcauggcucguccaccggcagugguuucuggauuuaccucugccauggcuccccggcgcugacacucagggaagcaauuggauacagaaggagacacuugugacguucaagaacccucaugccaaaaagcaagacguugugguccugggcucucaggaaggggcgaugcacaccgccuugacuggagcaacagagauucagauguccucagguaaucuacuguuuaccggccaucucaaaugccgucugaagauggauaaacuucaacugaaggggaugagcuacaguauguguacaggaaaguucaaaaucgugaaggaaaucgcugagacucagcacggcaccauuguaauccgcguucaguaugagggugacgggucuccaugcaaaauucccuucgaaauaacggauuuggagaagagacaugugcucggcaggcugaucaccgucaacccgauugugacagaaaaagacuccccugucaacaucgaggccgaacccccauuuggagauagcuacaucauuauaggcguggagccugggcaguuaaagcugaauugguucaagaaaggaucgucuaucggucaaauguuugagacuaccaugcggggcgcuaagcgaauggccauucuaggggacacagcaugggauuucggaucccucggcgguguuuuuacuucaaucgggaaagcccugcaccagguguucggcgcuauuuacggagcggcauuuaguggcguaagcuggaccaugaagauccuuauaggggucaucauuacguggaucggaaugaacucccgcucuacuagcuugucagugagucugguucucgugggcgucgugacccuguaucuuggugccaugguacaggcugacuccgggugugugguuagcuggaaaaauaaggaacugaagugcggaucuggcauuuucaucacugauaacguccacacauggaccgagcaguacaaauuucaacccgaaucaccaaguaaguuggccagcgcaauacagaaagcccaugaggaagguauuuguggcaucagauccgugacuaggcucgagaaucugauguggaagcagauuacccccgaguuaaaccacauccugucugaaaaugaggugaaacuaacaauaaugacgggggacauccggggaauuaugcaggcuggcaagcgcucgcucagaccucaaccaaccgaacugaaauauagcuggaagacuugggggaaggccaaaaugcuuuccacagagucacauaaccagaccuucuugaucgauggaccggaaacagcagagugccccaauacuaacagggcguggaauagucuggaggucgaagacuacggcuuugguguuuucaccacgaacauuuggcucaagcugcgugagaaacaggacguguuuugugauucuaaguuaaugagcgcugccaucaaagacaaucgggcagugcacgccgauaugggguauuggauagaauccgcucugaacgacacauggaagauggagaaggccucauucauugagguaaaaagcugccacuggccuaagucucauacccuuugguccaauggagucuuggaaagugagaugaucauccccaaaaauuucgcaggccccgugagccagcacaacuaccgaccugguuaucauacucaaaccgcuggcccauggcaccucgggaagcuggaaauggauuuugaccuaugugagggaacaacuguuguggucaccgaagauugcggcaauagagggcccucucugaggacaacgaccgccuccggaaaacucauuacugaguggugcugucgcucaugcacacugccgccucuucgguacagaggcgaggacgguuguugguacgggauggaaaucaggccauugaaggagaaggaagagaaccuggugaauaguuuaguuaccgcgggacauggccagauugauaacuucagccucggugugcugggcauggcccuuuuucuggaagagauguugcgcacucgaauagggacaaaacacgcuauccuccugguagcagucucguucgugacccuaauuacgggaaauauguccuuucgggaccugggccgugugauggucaugguuggggccacuaugaccgaugacaucggaaugggcgugacauaucucgcucugcuugccgcauucaagguaagacccaccuuugcggccgguuugcuguuaaggaaacucacuucuaaggagcugaugauggcuacaauugggaucgcccuucugagccagucaaccauaccugaaacaauccuagagcucacugaugcacuggcuuugggaaugauggugcugaaaauuguccgcaacauggaaaaguaccaauuagccgugaccaucauggcaauuaguugcguucccaaugccgugauccuccagaacgcuuggaaggucuccuguacgauacuggcggccgugucuguuagcccacuucuguugacauccucacagcagaaagcagacuggauuccucucgcucugaccaucaagggccuaaaucccacugccaucuuccugaccacacuuagccggacaaguaaaaagagaucuuggccacucaacgaggccauuauggcugugggcauggucuccauacuggcaagcucguugcugaaaaaugacaucccgaugaccgggccuuuaguagccggaggucuccugacggugugcuauguucuuacaggcaggucagcggaucuggaauuggagcgagcugccgacgugaagugggaggaucaagcagaaauuucugggaguucccccauccucagcauuaccaucucugaggacggaagcauguccaucaaaaacgaagaggaggaacagacucugacaauccuaauucgcaccggccugcuugucaucucagguguguuuccaguaaguauucccaucacugccgcugcaugguaccucugggaggugaagaagcagcgggccgggguccugugggauguuccuagcccacccccuguggaaaaagcggaguuggaagacggagcuuauagaauaaagcagaggggcauuuuaggcuacucucaaaucggggccggaguguauaaagaggguacauuccacaccauguggcaugucacgcguggcgcagugcugaugcaccgcgggaagcggaucgagccguccugggccgauguuaaaaaggaccucauuucauacggaggcgguuggaagcuggaaggggaguggaaagaaggagaggaaguacaggugcuugcucuggagccaggcaagaaucccagagccguccagacuaaaccuggcaucuuuaagaccaacacagggaccauaggagcagugaguuuggauuucagcccagguacauccggcucucccauuguugacaggaaagggaagguggucggacuauacggcaauggugugguaacucgaucgggggcuuaugucagcgccaucgcgcagaccgagaagucaauugaagauaacccugagaucgaagacgauauauuucggaaaaagcgccugacgauuauggaccuccauccgggagccggcaaaacaaagagauaccugcccgcaaucgugagggaggcuaucaaacggggccuucgaacuuuaauucuggccccaaccagaguuguggcugcagaaauggaggaggcccuccgcggguugccuaucagguaucaaacacccgccauuaagaccgaacacacuggacgugagauagucgaccugaugugucaugcuaccuucacaaugcggcuccuguccccagugagaguuccuaacuacaaucuuaucauuauggaugaagcgcacuucacggaccccgcaaguaucgccgcuagggguuauaucucuacucgcguggagaugggcgaggccgcagggauuuuuaugaccgccacaccaccgggaagccgagauccuuucccccaguccaacgcuccaauaauggacgaagagagagaaauccccgagcggucauggaacucuggccacgaaugggucaccgauuuuaaggguaaaacugugugguucguaccuagcauuaaggcggggaacgacaucgccgcaugccugaggaaaaauggaaagaaagugauucaguugagucgcaagacauuugauuccgaguacguuaagacccgugcuaacgacugggauuucgucgugacgacugacaucagcgagaugggcgccaauuuuaaagcagaaagagugauagauccacggagguguaugaagcccgucauccuaacagacggcgaggaacgcguaauucuggccgggccuaugccggugacccauucuucagcugcccaacgaagaggacggaucgguaggaaccccaaaaaugagaacgaccaguauauuuacaugggcgaaccccucgagaaugaugaggacugcgcgcacuggaaggaagcaaaaauguuacuggauaacaucaauaccccugaggggauaauucccuccauguucgaaccagagcgcgaaaagguugacgccaucgauggagaguacagacuuaggggcgaggcucggaaaacuuuuguggaccugaugcgucgcggugaucucccugucugguuggccuauaagguggcugcagaagggauuaacuacgccgaccgaaagugguguuucgauggcaucaaaaauaaccagauacuggaggaaaacauggagguugagaucuggacaaaggaaggagagaggaaaaagcucaaacccagauggcuggacgcucggauuuauagugauccacuugcccuaaaggaauuuaaggaguucgcagcgggccgcaaaagccugaccuugaauuuaaucacagaaauggggagacugccuacuuucaugacgcagaaggccaggaacgcucucgacaaucuggccgugcuucauaccgcagaggcuggaggucgggccuacaaccacgcacugucggagcucccggaaacauuggagacucugcuacugcucacccuucuggccacagucaccggcgggauauuuuuauucuugaugucuggaaaaggcaucgguaagaugacucuggggaugugcugcauaauuacggcuuccacccuccugugguaugcgcaaauccagccccacuggaucgccgcaagcauuauccuugaauuuuuccugauagugcucuugauuccagagccugaaaaacagcgaacaccccaggauaaucaacugacuuacguagugaucgcuauuuuaaccguugucgccgccacaauggcaaacgagaugggcuuucuagagaagaccaagaaagaccugggacucggcucaaucacuacacaggaaagugagucuaauauacuugacaucgaucugagaccagcuuccgccuggacguuguaugcgguggcuaccacuuucgugacaccuaugcugcgccauagcauugaaaacucaagugucaauguuagccucaccgccaucgcaaaccaggccaccgugcugauggggcuuggaaaggguuggccccucuccaaaauggacauuggcguaccgcuguuggcuaucggguguuacucucaggugaauccaauuacacugacugcagccuuacuacugcucgucgcgcacuacgcuaucauaggaccuggccuucaagccaaggcaacgagggaggcccagaaacgggcugccgcagguauuaugaagaaccccaccguggaugggaucacaguuaucgaccuggaaccaauucccuaugauccuaaguuugagaaacaguugggccaggugaugcugcucauacugugcgucacucaaguacuuaugaugcguaccacaugggcuuuaugugaggcccugacccucgcgacuggaccgaucagcacguugugggaaggcaaucccgggagauucuggaacacaaccauugccguguccauggcaaauaucuuuaggggaucauaccuggcuggcgccggucuacuguucucuauuaugaagaacacuaccaauacacgccgggggacuggaaacaucggcgagacccucggugaaaaauggaagagucgacuuaacgcacugggcaaaucggaguuucagauauauaagaaaagcgggauccaggagguugacagaacauuggcuaaggaaggaauuaagaggggcgagacggaucaucacgccgugucccgcgggucugccaaacugcggugguucgucgaaagaaauauggugaccccagagggaaaggucguggaccucggcugcggucgugggggauggucauacuauuguggcggucugaaaaacguuagggaagugaagggcuuaacuaaagggggaccuggccaugaggagcccaucccuaugagcacauacggguggaaucuuguacggcugcaauccggaguggaugucuuuuucaccccacccgaaaagugcgacacucuccuaugugauauuggcgagaguucuccuaacccaacaaucgaagcgggucgcacccugcgaguuuugaaucugguggagaacuggcucaauaacaauacgcaguucugcauaaagguccuuaaccccuauaugccgagcgugauugagaaaauggaggcucugcagagaaaguacgggggagcauugguaaggaauccucugucacggaacuccacccacgagauguacugggugaguaaugccagcggcaacaucguuucuuccgugaauaugaucucacgcaugcucauuaacagauuuacaaugaaacacaagaaagcuacuuaugaaccagacgucgauuuaggcagcgggaccaggaacauaggaaucgagucggaaauucccaaucuggacaucauugguaagcgaaucgagaagauaaaacaggaacaugagacaucuuggcacuacgaccaagaucauccuuauaagacuugggccuaccacggcaguuaugagaccaaacagacaggguccgcaagcucaauggugaacggagucgugcggcuucugaccaagccaugggacguuguacccauggugacucagauggccaugacggauacaaccccguucggccagcaacgugucuuuaaagaaaagguggacacuagaacccaggagccuaaggaagguacgaaaaagcuaaugaaaaucacagcugaguggcucuggaaggagcuggggaaaaagaaaaccccacgcauguguacuagggaagaguucacacggaagguuagauccaaugcggccuugggagcaauuuuuaccgaugaaaacaaguggaaaucugcucgcgaggccguggaagacagcagguucugggagcuggucgaucgagagcggaaucuccaccuugaaggcaagugcgagacuuguguguacaacaugaugggcaaaagagaaaagaaacugggggaguuuggaaaggcaaaggguaguagggccaucugguauaugugguuaggcgcucgcuuccuggaauuugaggccuugggguuccucaaugaggaccauugguuuucccguggaaacagccugucuggcguagaaggugaggggcuacaccggcuuggauacauucugagagaugugggcaaaaaggaaggcggggcgauguacgcagacgauacagccggaugggacaccaggaucacacucgaggaccugaaaaaugaagagaugguuacuaaccauaugaagggugagcacaaaaaguuggcugaagccauuuucaagcugaccuaucagaauaaagucgugcgcgugcagcgaccaacgccucggggcaccgucauggauauaaucucaagaagggaccaacgcgggaguggacagguuggcacauacggucucaacacuuuuaccaauauggaggcacagcuuauuagacaaauggaaggggagggaaucuucaaguccauccagcaucugacagcuacugaggaaauugccgugcagaacugguuagcucggguaggcagggagcgucugagccgaauggccauaucuggcgaugacugcguggucaaacccaucgaugaccgcuucgcaucggcguugaccgcccucaaugauauggggaaggugagaaaagacauucagcaaugggaaccaucacggggauggaacgauuggacgcagguucccuuuugcagccaccacuuccaugagcuggugaugaaggacgguaggguccuagugguaccuugucgcaaccaggaugaacuuaucggcagagcucggauuucccagggggccggauggagucugaaggagacagcaugccucggcaaaucuuaugcucaaauguggacccugauguacuuucacaggcgagacuugcguuuagccgcaaaugccaucuguagcgcgguuccaccgcauugggugcccacuuccagaacaaccuggucaauacacgcuaagcacgaguggaugacuaccgaagauaugcuggccgucuggaaccgcguguggauccaggagaauccuuggauggaagacaaaacaccaguggagaguugggaagagguccccuaucucgguaagcgggaggaccaguggugcgggucucuuauuggacugacgagcagggcaaccugggccaaaaacauccagacugcuauuaaucaaguuagaucccuaaucggcaacgaagaguacacagauuauaugccuucaaugaagcgcuuccggagggaagaggaagaggccggcgugcugugguga

SEQ ID NO: 14510 - RNA, 9876 nt, Artificial Sequence
  derived and/or modified CDS sequence (opt3) from DENV-2__FJ744705__SS-prME
accgccggagugaucgucaugcugauucccaccgcuauggcauuccaccucacuacgagaaauggggagccucauaugauaguugggaggcaggaaaaggguaaaagccuucuguuuaagaccgaggacggcgugaauaugugcacauugauggccaucgauuuaggggaacugugugaggacacuauuaccuacaaaugcccacuacuccggcaaaacgaaccggaggauaucgacuguuggugcaauuccacaucuaccuggguaacuuauggaacauguaccacgacuggcgagcaccgccgagaaaagcguucaguggcgcuggucccccauguggguauggggcuugagaccagaacagaaacuuggaugaguagcgagggagcuuggaaacacguucagaggauugagaccuggauccugcggcauccuggcuucacaauaauggccgcaaucuuggccuacaccauuggcacgacucacuuucagcgcgcucucaucuucauucugcugacagcaguggccccauccaugaccaugagaugcaucgggauaucuaacagggauuuugucgaaggagugucggguggcucauggguagacauuguucucgagcacgggagcugugugacuacaauggcuaagaauaagcccaccuuagauuucgaacugaucaaaacggaggccaagcagccugcgacccuucggaaauauugcauugaagcaaaguugacaaacacuaccacagagagucgcuguccaacucaaggagagcccucccugaaugaggaacaggacaaacgauuuaucugcaagcauucuauggucgauagaggcugggguaacggguguggacuauucggcaagggcgggaucgugaccugcgccauguuuacaugcaaaaagaauauggaaggaaaagugguccagccugagaaccucgaauacaccauuguuauaacuccacacagcggugaggagcaugcugugggcaaugacacggggaagcacggaaaagaaaucaagauuacaccgcaguccucaaucaccgaggccgaacugacuggcuaugguaccguaacaauggaguguagucccaggaccgggcuugauuucaacgaaauggugcuguugcaaauggaggacaaagcauggcucguccaccggcagugguuucuggauuuaccucugccauggcuccccggcgcugacacucagggaagcaauuggauacagaaggagacacuugugacguucaagaacccucaugccaaaaagcaagacguugugguccugggcucucaggaaggggcgaugcacaccgccuugacuggagcaacagagauucagauguccucagguaaucuacuguuuaccggccaucucaaaugccgucugcgcauggauaaacuucaacugaaagggaugagcuacaguauguguacaggaaaguucaagaucgugaaagaaaucgcugagacucagcacggcaccauuguaaucagaguucaguaugagggugacgauucuccaugcaagauucccuucgaaauaacggacuuggagaaaaggcaugugcucgggcggcugaucaccgucaacccgauugugacagaaaaggauuccccugucaacaucgaggccgaacccccauuuggcgacagcuacaucauuauaggaguggagccuggccaguuaaaacugaauugguucaagaaggggucgucuaucggacaaauguuugagacuaccaugcgaggugcuaaacgcauggccauucuaggcgauacagcaugggacuucgggucccucggaggcguuuuuacuucaaucgguaaggcccugcaccagguguucggggcuauuuacggcgcggcauuuaguggaguaagcuggaccaugaaaauccuuauaggcgucaucauuacguggaucgggaugaacuccagaucuacuagcuugucagugagucugguucucgugggagucgugacccuguaucuuggcgccaugguacaggcugauuccgguuguauugugagcuggaagaauaaagaacugaagugcgggucuggaaucuucauaacugacaacguucacacauggaccgagcaguacaaguuucaacccgaaucaccaaguaaauuggccagcgcaauucagaaggcccaugaggaaggcaucugugguauuagguccgucacucggcucgagaaucugauguggaaacagaucacccccgaguuaaaccacauacugucugaaaaugaggugaagcuaacaaucaugacgggcgauauucgcgggaucaugcaggcuggaaaaagaucgcucaggccucaaccaaccgaacugaaguauagcuggaaaacuuggggcaaggccaagaugcuuuccacagagucacauaaccagaccuucuugauugacgggccggaaacaguggagugccccaauacuaaccgugcauggaauagucuggaggucgaagacuacggauuuggcguuuucaccacgaacaucuggcucaaacugcgggagaagcaggauguguuuugugacucuaaauuaaugagcgcggcuauaaaggauaaucgagccgugcacgcagacauggguuauuggauugaauccgcccugaacgauacauggaaaauggagaaggcuucauucaucgagguaaagagcugccacuggccuaaaucucauacccuuugguccaauggggucuuggaaagugagaugaucauuccaaagaacuucgccggacccgugagccagcacaacuacagaccuggcuaucauacucaaaccgcagguccauggcaccucggcaaacuggaaauggacuuugaucuaugugaggggacaacuguuguggucaccgaagacugcggaaauaggggccccucucugcgcacaacgaccgcuuccgggaagcucaucacugaguggugcugucggucaugcacacugccgccucuuagauacaggggagaggauggcuguugguacgguauggaaauucgcccauugaaagagaaggaagagaaccuggugaauaguuuaguuaccgccgggcauggacagauagacaacuucagccucggcgugcuggguauggcgcuuuuucuggaagagauguugcgaacucggaucggcacaaagcacgccauucuccugguagcugucucguucgugacccuaaucacggggaauauguccuuucgugaucugggaagagugauggucaugguuggcgcaacuaugaccgacgauauugggaugggagugacauaucucgcccugcuugcugccuucaaaguaaggcccaccuuugcagcgggcuugcuguuacgcaagcucacuucuaaagagcugaugauggccacaaucgguauagcacuucugagccagucaaccaucccugaaacaauucuagagcucacugacgcccuggcauuggggaugauggugcugaagaucguccggaacauggaaaaauaccaauuagcugugaccauuauggccaucaguugcguucccaaugcagugauacuccagaacgccuggaaggucuccuguacgauucuggcugcggugucuguuagcccacuucuguugacauccucacagcagaaggccgacuggaucccucucgcacugaccaucaaaggacuaaaucccacugcuauuuuccugaccacacuuagcagaacaaguaagaaaaggucuuggccacucaacgaggccauaauggccgugggcauggucuccauccuggcuagcucguugcugaagaaugauauuccgaugaccggcccuuuaguagcagggggacuccugacggugugcuauguucuuacaggucgaucagccgaccuggaauuggagcgcgcggcugaugugaaaugggaggaccaagccgaaaucucuggcaguucccccauucucagcaucaccauaucugaggaugggagcauguccaucaagaacgaagaggaggaacagacucugacaauucuaauccggaccggacugcuugucauuucaggcguguuuccaguaaguauccccauaacugcagccgcuugguaccucugggaggugaaaaagcagagagcugguguccugugggacguuccuagcccacccccuguggaaaaggccgaguuggaagauggggcguauaggauuaaacagcguggaaucuuaggcuacucucaaaucggcgcugggguguauaaggagggaacauuccacaccauguggcaugucacgcgcggugccgugcugaugcaccggggcaaaagaauugagccguccugggcagacguuaagaaagaucucaucucauacgggggaggcuggaagcuggaaggugaguggaaggaaggggaggaaguacaggugcuugcccuggagccaggcaagaaucccagggcuguccagacuaagccuggcauauuuaaaaccaacacaggcaccauuggggccgugaguuuggacuucagcccaggaacauccgguucucccaucguugaucgaaagggcaaaguggucgggcuauacggaaauggcgugguaacucggucgggugcauaugucagcgcuauugcccagaccgagaagucaaucgaagacaacccugagauagaagaugacauuuuucgcaagaaaagacugacgaucauggaccuccauccgggggcgggaaagacaaaaagguaccugcccgccaucgugcgggaggcaauuaagcgaggccuuagaacuuuaauccuggcuccaacccgcguuguggccgcugaaauggaggaggcacucaggggcuugccuauucguuaucaaacacccgccauaaaaaccgaacacacugggcgggagaucgucgaucugaugugucaugccaccuucacaaugagacuccuguccccagugaggguuccuaacuacaaucuuauuaucauggacgaagcucacuucacggaucccgcgaguaucgcagcccgcggauauauuucuacucgaguggagaugggugaggcugccggcauauuuaugaccgcaacaccaccggggagcagagacccuuucccccaguccaacgccccaaucauggaugaagaacgggaaauucccgagaggucauggaacucuggacacgaaugggucaccgacuuuaagggcaagacugugugguucguaccuagcaucaaagcugguaacgauauugcggccugccugcgcaagaaugggaaaaaggugauccaguugagucguaaaacauuugacuccgaguacguuaagaccagagcaaacgauugggacuucgucgugacgacugauauaagcgagaugggagcuaauuuuaaggccgaacgggugaucgacccaaggcgcuguaugaaacccgucauucuaacagacggcgaggaacgaguaauccuggcaggcccuaugccggugacccauucuucagccgcucaaagacgggggaggauuggacgcaacccaaagaaugagaacgaucaguauaucuacaugggugaaccccucgagaaugacgaggauugcgcccacuggaaagaagcgaagauguuacuggacaacauaaauaccccugagggcauuauccccuccauguucgaaccagagagagaaaaaguugaugcaauugacggggaguacaggcuucggggagaggcccguaagacuuuuguggaucugaugcgccgaggcgaccucccugucugguuggcuuauaaaguggccgcugaagguaucaacuacgcagauagaaagugguguuucgacgggauaaagaauaaccagauccuggaggaaaacauggagguugagauuuggacaaaagaaggcgagaggaagaaacucaagccccgguggcuggaugcccgcaucuauagugacccacuugcucuaaaagaauuuaaggaguucgccgcaggaagaaagagccugaccuugaauuuaauuacagaaaugggcaggcugccuacuuucaugacgcagaaagcgcggaacgcccucgauaaucuggcugugcuucauaccgccgaggcagggggacgagcuuacaaccacgcccugucggagcucccggaaacauuggagacucugcuacugcucacccuucuggcaacagucaccgguggcaucuuuuuauucuugaugucugggaagggaauaggcaaaaugacucuggguaugugcugcauuaucacggccuccauccuccugugguaugcucaaauucagccccacuggaucgcggccagcauaauucuugaauuuuuccugaucgugcucuugauuccagagccugaaaagcagagaacaccccaggacaaucaacugacauacguagugaucgcaauauuaacuguugucgcugccaccauggccaacgagaugggguuucuagagaaaacaaagaaggaccugggccucggaucaaucaccacucaggaaagugagucuaauauucuugauaucgaccugcgcccagcauccgcuuggacauuguaugccguggcgacgaccuucgugacuccuaugcugaggcauagcauugaaaacucaagugucaauguuagccucacagcuaucgccaaccaggcaaccgugcugaugggccuugggaaaggauggccccucuccaagauggauauugguguaccgcuguuggccaucggcuguuacucucaggugaauccaauaacccugacagcugcauuacuacugcucgucgcccacuacgcgauuaucgggccuggacuucaagcuaaagccacucgggaggcacagaagcgugccgcugccggcaucaugaaaaaccccacgguggacgguauuaccguuauagaucuggaaccaauccccuaugacccuaaguuugagaagcaguugggacaggugaugcugcucauucugugcgucacacaaguacuuaugaugagaacuaccugggcauuaugugaggcucugacacucgccaccggcccgaucagcacuuugugggaaggaaaucccggcagguucuggaacacgacaauugcgguguccauggccaauaucuuucgcgggucauaccuggcaggagcuggccuacuguucucuauaaugaaaaacaccacuaauacccggcgagguacagggaacaucggagagacucucggcgaaaaguggaaaaguagacuuaacgcccuggguaagucggaguuucagauuuauaaaaagagcggcauccaggagguugauaggaccuuggcaaaagaagggauuaagcgcggagagacagaccaucacgcugugucccggggcucugccaagcugagaugguucgucgaacguaauauggugacgccagaggggaaagucguggaucucggaugcggcagggguggguggucauacuauuguggaggccugaagaacguucgggaagugaaagguuuaaccaagggcgggccuggacaugaggagcccaucccuaugagcacuuacggcuggaaucuuguacgccugcaauccgggguggacgucuuuuucacaccacccgaaaaaugcgauacccuccuaugugacauaggagagaguucuccuaacccaacuauugaagccggccgaacacugagaguuuugaaucugguggagaacuggcucaauaacaauacccaguucugcaucaagguccuuaaccccuauaugccgagcgugaucgaaaagauggaggcgcugcagaggaaauacgguggggcuuugguacggaauccucugucacgcaacuccacgcacgagauguacugggugaguaaugcaaccggaaacauuguuagcucugugaauaugauauccagaaugcucaucaacagguuuacaaugaagcacaaaaaggccacuuaugaaccagaugucgacuuaggcucaggcacccgaaacauugggaucgagagcgaaauucccaaucuggacaucauaggaaaacggaucgagaagauuaagcaggaacaugagacaucguggcacuacgaucaagaccauccuuauaaaacuugggcuuaccacgguucuuaugagaccaagcagacaggcagugccuccagcauggugaacggggucgugcgucuucugaccaaaccaugggauguuguacccauggugacucagauggcaaugacggacacaaccccguucggacagcaaagagucuuuaaggaaaaaguggauacucgcacccaggagccuaaggaaggcacaaagaaacuaaugaagaucacggccgaguggcucuggaaagagcuggguaagaaaaagacccccaggauguguacucgggaagaguucacaagaaaaguucgcucaaaugcugcguugggggccauuuuuaccgacgaaaacaaguggaaguccgcaagggaggcuguggaagauggacgauucugggagcuggucgaccgggagagaaaucuccaccuugaaggcaaaugcgagacuuguguguacaacaugaugggcaagagggagaaaaagcugggggaguuuggaaaagccaaggguucucgcgcaaucugguauaugugguuaggcgcccguuuccuggaauuugaggcuuugggguuccucaaugaggaucauugguuuagccggggaaacagucuguccggcguagaaggugaggggcuacacagacuuggauacauucugagggacgugggcaagaaagaaggcggggccauguacgcggaugacacagcaggaugggacacccgcauaacacucgaggaucugaagaaugaagagaugguuacuaaccauaugaaaggugagcacaagaaauuggccgaagcuaucuucaagcugaccuaucagaauaaggucgugcgagugcagcggccaacgccuagaggcaccgucauggacauuaucagcaggcgcgaucaaagagggucuggacagguuggcacauacggucucaacacuuuuaccaauauggaggcccagcuuauccggcaaauggaaggggagggaauuuucaaaucaauacagcaucugacagcaacugaggaaaucgcugugcagaacugguuagccaggguaggccgugagcgacugagucgcauggcuauuuccggcgacgauugcguggucaagcccaucgacgauagauucgccagcgcauugaccgcgcucaaugacauggggaaagugcggaaggauauucagcaaugggaaccaucuaggggauggaacgacuggacgcagguucccuuuugcucgcaccacuuccaugagcuggugaugaaagauggucgcguccuagugguaccuuguagaaaccaggacgaacuuaucggccgggccaggauaucacagggggcuggauggagccugaaggagacagccugccucggcaaguccuaugcacaaauguggacccugauguacuuucaccgacgugauuugagauuagcugccaaugcaaucuguagugccguuccaccgcauugggugcccacuucucgcacaaccuggagcauucacgcgaaacacgaguggaugacuaccgaagacaugcuggcugucuggaaccggguguggauccaggagaauccuuggauggaagacaagacaccaguggaguccugggaagagguccccuaucucgguaaaagggaggaucaguggugcgggucacuuauuggacugacgaguagagccaccugggcaaagaacauccagacugccauaaaucaaguucgcucucuaauuggcaacgaagaguacacagacuauaugccuagcaugaaacgguucaggcgagaagaggaagaggcuggcgugcugugguga

SEQ ID NO: 14511 - RNA, 9876 nt, Artificial Sequence
  derived and/or modified CDS sequence (opt3) from DENV-2__FJ744744__SS-prME
accgccggcgugauaguaaugcugauuccaacagcuauggcuuuccaccucacuacgcggaacggggagccucauaugauaguuggaaggcaggaaaaggguaaaagccuucuguuuaagaccgaggacggcgugaauaugugcacauugauggccaucgauuuaggggaacugugugaggacacuauuaccuacaaaugcccacuacuccggcaaaacgaaccggaggauaucgacuguuggugcaauuccacaucuaccuggguaacuuauggaacauguaccacgacuggcgagcaccgccgagaaaagcguucaguggcgcuggucccccauguggguauggggcuugagaccagaacagaaacuuggaugaguagcgagggagcuuggaaacacguucagaggauugagaccuggauccugcggcauccuggcuucacaauuauggccgcaaucuuggccuacaccauuggcacgacucacuuucagcgcgcucucaucuucauucugcugacagcaguggccccauccaugaccaugagaugcaucgggauaucuaacagggauuuugucgaaggagugucggguggcucauggguagacauuguucucgagcacgggagcugugugacuacaauggcuaagaauaagcccaccuuagauuucgaacugaucaaaacggaggccaagcagccugcgacccuucggaaauauugcauugaagcaaaguugacaaacacuaccacagagagucgcuguccaacucaaggagagcccucccugaaugaagaacaggacaaacgauuuaucugcaagcauucuauggucgauagaggcugggguaacggguguggacuauucggcaagggcgggaucgugaccugcgccauguuuacaugcaaaaagaauauggaaggaaaagugguccagccugagaaccucgaauacaccauuguuauaacuccacacagcggugaggagcaugcugugggcaaugacacggggaagcacggaaaagaaaucaagauuacaccgcaguccucaaucaccgaggccgaacugacuggcuaugguaccguaacaauggaguguagucccaggaccgggcuugauuucaacgaaauggugcuguugcaaauggaggacaaagcauggcucguccaccggcagugguuucuggauuuaccucugccauggcuccccggcgcugacacucagggaagcaauuggauacagaaggagacacuugugacguucaagaacccucaugccaaaaagcaagacguugugguccugggcucucaggaaggggcgaugcacaccgccuugacuggagcaacagagauucagauguccucagguaaucuacuguuuaccggccaucucaaaugccgucugaagauggauaaacuucaacugaaggggaugagcuacaguauguguacaggaaaguucaaaaucgugaaggaaaucgcugagacucagcacggcaccauuguaauccgcguucaguaugagggugacgggucuccaugcaaaauucccuucgaaauaacggauuuggagaagagacaugugcucggcaggcugaucaccgucaacccgauugugacagaaaaagacuccccugucaacaucgaggccgaacccccauuuggagauagcuacaucauuauaggcguggagccugggcaguuaaagcugaauugguucaagaaaggaucgucuaucggucaaauguuugagacuaccaugcggggcgcuaagcgaauggccauucuaggggacacagcaugggauuucggaucccucggcgguguuuuuacuucaaucgggaaagcccugcaccagguguucggcgcuauuuacggagcggcauuuaguggcguaagcuggaccaugaagauccuuauaggggucaucauuacguggaucggaaugaacucccgcucuacuagcuugucagugagucugguucucgugggcgucgugacccuguaucuuggugccaugguacaggcugacuccgggugugugguuagcuggaaaaauaaggaacugaagugcggaucuggcauuuucaucacugauaacguccacacauggaccgagcaguacaaauuucaacccgaaucaccaaguaaguuggccagcgcaauacagaaagcccaugaggaagguauuuguggcaucagauccgugacuaggcucgagaaucugauguggaagcagauuacccccgaguuaaaccacauccugucugaaaaugaggugaaacuaacaauaaugacgggggacauccggggaauuaugcaggcuggcaagcgcucgcucagaccucaaccaaccgaacugaaauauagcuggaagacuugggggaaggccaaaaugcuuuccacagagucacauaaccagaccuucuugaucgauggaccggaaacagcagagugccccaauacuaacagggcguggaauagucuggaggucgaagacuacggcuuugguguuuucaccacgaacauuuggcucaagcugcgugagaaacaggacguguuuugugauucuaaguuaaugagcgcugccaucaaagacaaucgggcagugcacgccgauaugggguauuggauagaauccgcucugaacgacacauggaagauggagaaggccucauucauugagguaaaaagcugccacuggccuaagucucauacccuuugguccaauggagucuuggaaagugagaugaucauccccaaaaauuucgcaggccccgugagccagcacaacuaccgaccugguuaucauacucaaaccgcuggcccauggcaccucgggaagcuggaaauggauuuugaccuaugugagggaacaacuguuguggucaccgaagauugcggcaauagagggcccucucugaggacaacgaccgccuccggaaaacucauuacugaguggugcugucgcucaugcacacugccgccucuucgguacagaggcgaggacgguuguugguacgggauggaaaucaggccauugaaggagaaggaagagaaccuggugaauaguuuaguuaccgcgggacauggccagauugauaacuucagccucggugugcugggcauggcccuuuuucuggaagagauguugcgcacucgaauagggacaaaacacgcuauccuccugguagcagucucguucgugacccuaauuacgggaaauauguccuuucgggaccugggccgugugauggucaugguuggggccacuaugaccgaugacaucggaaugggcgugacauaucucgcucugcuugccgcauucaagguaagacccaccuuugcgguggguuugcuguuaaggaaacucacuucuaaggagcugaugauggccacaauugggaucgcacuucugagccagucaaccauaccugaaacaauccuagagcucacugaugcccuggcauugggaaugaugguccugaaaauugugcgcaacauggaaaaguaccaauuagcuguuaccaucauggccauuaguugcgugcccaaugcagucauccuccagaacgccuggaagguguccuguacgauacuggcuguugugucugucagcccacuucuguugacauccucacagcagaaagcggacuggauuccucucgcccugaccaucaagggccuaaaucccacugcaaucuuccugaccacacuuagccggacaaguaaaaagagaucuuggccacucaacgaggcuauuauggccguaggcaugguguccauacuggccagcucguugcugaaaaaugacaucccgaugaccgggccuuuaguugcuggaggucuccugacggugugcuauguccuuacaggcaggucagcagaucuggaauuggagcgagccgcggacgugaagugggaggaucaagcugaaauuucugggaguucccccauccucagcauuaccaucucugaggacggaagcauguccaucaaaaacgaagaggaggaacagacucugacaauccuaauucgcaccggccugcuuguaaucucagguguguuuccagucaguauucccaucacugccgcagccugguaccucugggagguuaagaagcagcgggcuggggugcugugggaugugccuagcccacccccugucgaaaaagcagaguuggaagacggagccuauagaauaaagcagaggggcauuuuaggcuacucucaaaucggggcgggaguguauaaagaggguacauuccacaccauguggcauguuacgcguggcgcuguacugaugcaccgcgggaagcggaucgagccguccugggccgaugugaaaaaggaccucauuucauacggaggcgguuggaagcuggaaggggaguggaaagaaggagaggaaguccaggugcuugcacuggagccaggcaagaaucccagagccguucagacuaaaccuggcaucuuuaagaccaacacagggaccauaggagcugugaguuuggauuucagcccagguacauccggcucucccauugucgacaggaaagggaaggugguaggacuauacggcaauggugucgugacucgaucgggggccuauguuagcgcaaucgcucagaccgagaagucaauugaagauaacccugagaucgaagacgauauauuucggaaaaagcgccugacgauuauggaccuccauccgggagccggcaaaacaaagagauaccugcccgcgaucgugagggaggccaucaaacggggccuucgaacuuuaauucuggcaccaaccagagucguggcugccgaaauggaggaggcucuccgcggguugccuaucagguaucaaacacccgcaauuaagaccgaacacacuggacgugagauaguugaccugaugugucaugccaccuucacaaugcggcuccuguccccagugagagucccuaacuacaaucuuaucauuauggaugaagcccacuucacggaccccgcuaguaucgcggcaagggguuauaucucuacucgcguggagaugggcgaggccgcugggauuuuuaugaccgccacaccaccgggaagccgagauccuuucccccaguccaacgcaccaauaauggacgaagagagagaaauccccgagcggucauggaacucuggccacgaauggguaaccgauuuuaaggguaaaacugugugguucguuccuagcauuaaggccgggaacgacaucgcugcgugccugaggaaaaauggaaagaaagucauucaguugagucgcaagacauuugauuccgaguacgugaagacccgugccaacgacugggauuucguggucacgacugacaucagcgagaugggcgcaaauuuuaaagcugaaagaguaauagauccacggagguguaugaagcccgugauccuaacagacggcgaggaacgcguuauucuggccgggccuaugccggugacccauucuucagcagcccaacgaagaggacggaucgguaggaaccccaaaaaugagaacgaccaguauauuuacaugggcgaaccccucgagaaugaugagaacugcgcucacuggaaggaagccaaaauguuacuggacaauaucaacaccccugaggggauaauucccuccauguucgaaccagagcgcgaaaaggucgaugcgaucgacggagaguacagacuuaggggcgaggcacggaaaacuuuuguggaucugaugcgucgcggugaccucccuguuugguuggccuauaagguggcugccgaagggauuaauuacgcugaucgaaagugguguuucgacggcaucaaaaacaaccagauacuggaggaaaauauggaggucgagaucuggacaaaggaaggagagaggaaaaagcucaaacccagauggcuggaugcacggauuuauagugacccacuugcccuaaaggaauuuaaggaguucgcugccggccgcaaaagccugaccuugaacuuaaucacagaaauggggagacugccuacuuucaugacgcagaaggcaaggaaugcgcucgauaaccuggccgugcuucauaccgcugaggccggaggucgggcauacaaucacgcucugucggagcucccggaaacauuggagacucugcuacugcucacccuucuggccacaguaaccggcgggauauuuuuauucuugaugucuggaaaaggcaucgguaagaugacucuggggaugugcugcauaauuacggcauccauccuccugugguaugcccaaauccagccccacuggauugcugcgagcaucauacuugaauuuuuccugauugugcucuugaucccagagccugaaaaacagcgaaccccacaggacaaccaacugacauacguugucauugccaucuuaacugugguggcagcuaccauggccaaugagaugggcuuucuagagaagacaaagaaagaucugggacucggcucaauaaccacucaggaaagugagucuaacauccuugacauugaccugagaccagccuccgcauggacauuguaugcugucgccacgaccuucguuacuccuaugcugcgccauagcaucgaaaauucaagugugaacguaagccucacagcgauugcuaaucaggccaccgugcugauggggcuuggaaaggguuggccccucuccaaaauggauaucggcgucccgcuguuggcaauuggguguuacucucaggugaacccaaucacccugacagccgcuuuacuacugcucguugcacacuacgccauaauuggaccuggccuucaagcgaaggcuacuagggaggcccagaaacgggcagccgcugguaucaugaagaaucccacgguggacgggaucaccgucauugaucuggaaccaauacccuaugacccuaaguuugagaaacaguugggccagguaaugcugcucauccugugcgugacacaaguucuuaugaugcguacuaccugggccuuaugugaggcacugacacucgcuaccggaccgauuagcacuuugugggaaggcaaccccgggagauucuggaauacgacaaucgccguguccauggcgaacauuuuuaggggaucauaccuggccggcgcaggucuacuguucucuaucaugaagaauaccacuaacacccgccgggggacaggaaacauaggcgagacucucggugaaaaauggaagagucgacuuaaugcucugggcaaaucggaguuucagaucuauaagaaaagcgggauucaggaggucgauagaaccuuggccaaggaaggaaucaagaggggcgagacagaccaucacgcagugucccgcgggucugcuaaacugcggugguucgucgaaagaaacauggugacgccagagggaaagguuguggaucucggcugcggucgugggggauggucauacuauuguggcggucugaaaaauguaagggaagugaagggcuuaaccaaagggggaccuggccaugaggagcccauuccuaugagcacuuacggguggaaccuuguccggcugcaauccggaguugacguguuuuucacaccacccgaaaagugcgauacccuccuaugugacaucggcgagaguucuccuaauccaacuauagaagccggucgcacacugcgagucuugaaccugguggagaauuggcucaacaauaacacccaguucugcauuaagguacuuaaucccuauaugccgagcgugaucgagaaaauggaggcccugcagagaaaguacgggggagcguugguuaggaacccucugucaagaaauuccacgcacgagauguacugggugaguaacgcuagcggcaauaucgucucuuccgugaacaugauuucacgcaugcucauaaacagauuuaccaugaaacacaagaaagcaacauaugaaccagaugucgacuuaggcagcgggacuaggaauaucggaauugagucggaaauccccaaccuggauauuaucgguaagcgaauagagaagaucaaacaggaacaugagaccucuuggcacuacgaccaagaccauccuuauaagacaugggccuaccacggcaguuaugagacuaaacagaccggguccgcuagcucaauggugaauggaguuguacggcuucugacaaagccaugggaugugguccccauggugacccagauggccaugacugacacgacaccguucggccagcaacguguuuuuaaagaaaagguggauaccagaacucaggagccuaaggaagguaccaaaaagcuaaugaaaauuacagcagaguggcucuggaaggagcuggggaaaaagaaaacgccccgcauguguaccagggaagaguucacucggaaggucagauccaacgccgcuuugggagcgaucuuuacagacgaaaauaaguggaaaucugcccgcgaggcaguggaagauagcagguucugggagcugguagaccgagagcggaaccuccaccuugaaggcaagugcgagaccuguguguacaauaugaugggcaaaagagaaaagaaacugggggaguuuggaaaggcuaaggguaguagggccauuugguauaugugguuaggcgcacgcuuccuggaauuugaggccuugggguuccucaacgaggaucauugguuuucccguggaaauagccugucuggcguugaaggugaggggcuacaccggcuuggauacauccugagagacgucggcaaaaaggaaggcggggcuauguacgccgaugacacugcgggaugggauacaaggauuacccucgaggaccugaaaaacgaagagauggugacaaaucauaugaagggugagcacaaaaaguuggcagaagccauauucaagcugacuuaucagaacaaagugguccgcguucagcgaccaaccccucggggcacggugauggacaucauuucaagaagggaucaacgcgggaguggacagguaggcaccuacggucucaauacauuuacuaacauggaggcucagcuuaucagacaaauggaaggggagggaaucuucaaguccauucagcaucugaccgccacagaggaaauagcagugcagaauugguuagcucgggucggcagggagcgucugagccgaauggccaucucuggcgacgauugcgugguuaaacccauugacgaucgcuucgcuucggccuugacugcacucaacgacauggggaaggugagaaaagauauccagcaaugggaaccaucacggggauggaacgacuggacccagguccccuuuugcagccaccacuuccaugagcuggugaugaaggaugguaggguccuaguugugccuugucgcaaucaggacgaacuuauuggcagagcgcggaucucccagggggccggauggagucugaaggagacggcuugccucggcaaaucuuaugcccaaauguggacacugauguacuuucacaggcgagauuugcguuuagcagcuaacgccauauguagcgcagucccaccgcauugggugcccaccuccagaacuacauggucaauccacgccaagcacgaguggaugaccacugaagacaugcuggcgguguggaaucgcgucuggauucaggagaacccuuggauggaagauaaaaccccaguugagaguugggaagaggugcccuaucucgguaagcgggaggaccaguggugcgggucucuuaucggacugacaagcagggcuacgugggccaaaaauauucagaccgcaaucaaccaaguaagaucccuaauaggcaaugaagaguacacugacuauaugccuucaaugaagcgcuuccggagggaagaggaagaggccggcgugcugugguga

SEQ ID NO: 14512 - RNA, 9876 nt, Artificial Sequence
  derived and/or modified CDS sequence (opt3) from DENV-2__GQ868646__SS-prME
accgccggcgugaucguaaugcugauucccaccgcuauggcauuccaccucacuacgcguaacggggaaccucauaugauaguuggaaggcaggaaaaggguaaaagccuucuguuuaagaccgaggacggcgugaauaugugcacauugauggccaucgauuuaggggaacugugugaggacacuauuaccuacaaaugcccauuacuccggcaaaacgaaccggaggauaucgacuguuggugcaauuccacaucuaccuggguaacuuauggaacauguaccacgacuggcgagcaccgccgagaaaagcguucaguggcgcuggucccccauguggguauggggcuugagaccaggacagaaacuuggaugaguagcgagggagcuuggaaacacguucagaggauugagaccuggauccugcggcauccuggcuucacaauaauggccgcaaucuuggccuacaccauuggcacgacucacuuucagcgcgcucucaucuucauucugcugacagcaguggccccauccaugaccaugagaugcaucgggauaucuaacagggauuuugucgaaggagugucggguggcucauggguagacauuguucucgagcacgggagcugugugacuacaauggcuaagaauaagcccaccuuagauuucgaacugaucaaaacggaggccaagcagccugcgacccuucggaaauauugcauugaagcaaaguugacaaacacuaccacagagagucgcuguccaacucaaggagagcccucccugaaugaagaacaggacaaacgauuuaucugcaagcauucuauggucgauagaggcugggguaacggguguggauuauucggcaagggcgggaucgugaccugcgccaaauuuacaugcaagaaaaauauggaaggaaaggugguccagccugagaaccucgaauacaccauuguuauaacuccacacagcggugaggagcaugcugugggcaaugacacggggaaacacggaaaggaaaucaaaauuacaccgcaguccucaaucaccgaggccgaacugacuggcuaugguaccguaacaauggaguguagucccaggaccgggcuugauuucaacgaaauggugcuguugcaaauggaggacaaggcauggcucguccaccggcagugguuucuggauuuaccucugccauggcuccccggcgcugacacucagggaagcaauuggauacagaaggagacacuugugacguucaaaaacccucaugccaagaaacaagacguugugguccugggcucucaggaaggggcgaugcacaccgccuugacuggagcaacagagauucagauguccucagguaaucuacuguuuaccggccaucucaagugccgucugcgcauggauaaacuucaacugaaggggaugagcuacaguauguguacaggaaaguucaaaaucgugaaggaaaucgcugagacucagcacggcaccauuguaaucagaguucaguaugagggugacgggucuccaugcaaaauucccuucgaaauaacggauuuggagaagaggcaugugcucggccggcugaucaccgucaacccgauugugacagaaaaagacuccccugucaacaucgaggccgaacccccauuuggagauagcuacaucauuauaggcguggagccugggcaguuaaagcugaauugguucaagaaaggaucgucuaucggucaaauguuugagacuaccaugcgaggcgcuaagcgcauggccauucuaggggacacagcaugggauuucggaucccucggcgguguuuuuacuucaaucgggaaagcccugcaccagguguucggcgcuauuuacggagcggcauuuaguggcguaagcuggaccaugaagauccuuauaggggucaucauuacguggaucggaaugaacuccagaucuacuagcuugucagugagucugguucucgugggcgucgugacccuguaucuuggugccaugguacaggcugacuccgggugugugguuagcuggaaaaauaaggaacugaagugcggaucuggcauuuucaucacugauaacguccacacauggaccgagcaguacaaauuucaacccgaaucaccaaguaaguuggccagcgcaauacagaaagcccaugaggaagguauuuguggcaucagguccgugacucggcucgagaaucugauguggaagcagauuacccccgaguuaaaccacauccugucugaaaaugaggugaaacuaacaauaaugacgggggacauccgcggaauuaugcaggcuggcaagagaucgcucaggccucaaccaaccgaacugaaauauagcuggaagacuugggggaaggccaaaaugcuuuccacagagucacauaaccagaccuucuugaucgauggaccggaaacagcagagugccccaauacuaaccgugcguggaauagucuggaggucgaagacuacggcuuugguguuuucaccacgaacauuuggcucaagcugcgggacaaacaggauguguuuugugacucuaaguuaaugagcgcugccaucaaagauaaucgagcagugcacgccgacaugggguauuggauagaguccgcucugaacgauacauggaagauggaaaaggccucauucauugagguaaaaagcugccacuggccuaagucucauacccuuugguccaauggagucuuggagagugaaaugaucauccccaagaauuucgcaggccccgugagccagcacaacuacagaccugguuaucauacucaaaccgcuggcccauggcaccucgggaagcuggagauggacuuugaucuaugugaaggaacaacuguuguggucaccgaggacugcggcaauagggggcccucucugcgcacaacgaccgccuccggaaaacucauuacugaauggugcugucggucaugcacacugccgccucuuagauacaggggcgaggaugguuguugguacgggauggagauccgcccauugaaggaaaaggaggaaaaccuggugaauaguuuaguuaccgcgggacauggccagauugacaacuucagccucggugugcugggcauggcccuucuguuggaggaaaugcuccgaacucggauagggacaaaacacgcuauccugcuaguagcagucucguuugugacccugauuacgggaaauauguccuuccgugaucucggcagagugauggucaugguuggggccacuaugaccgacgauaucggaaugggcgugacauaucuggcucuuuuggccgcauuuaagguaaggcccaccuucgcggccggucuguuacuccgcaaacugacuucuaaggagcuuaugauggcuacaauugggaucgcccugcuaagccagucaaccauaccugagacaauccucgaacugacugacgcauuggcucugggaaugaugguguuaaaaauuguccggaacauggagaaguaccaacucgccgugaccguuauggcaaucaguugcgugcccaaugccgucauucugcagaacgcuuggaagguguccuguacgauccuugcggccguuucugugagcccacuguugcucacauccucacagcagaaagcagacuggauaccucuggcucuaaccauuaagggccugaaucccacugccaucuuucuuaccacacucagcagaacaaguaaaaagaggucuuggccacugaacgaagccaucauggcugucggcaugguauccauuuuggcaagcucgcugcucaaaaaugauauaccgaugaccgggccucuaguggccggaggucugcuuacgguuugcuaugugcugacaggccgaucagcggacuuggagcucgaacgcgcugccgaugucaagugggaggaccaagcagagaucucugggaguucccccauucugagcaucaccauuucugaagauggaagcauguccaucaaaaacgaggaagaggagcagacucuaacaauacugauccggaccggccuucucgugauuucagguguauucccagugaguauccccauuacugccgcugcaugguaccugugggaagucaagaagcagagagccgggguuuugugggacgugccuagcccacccccuguggagaaagcggaauuagaggauggagcuuauaggaucaagcagcguggcauacugggcuacucucaaauuggggccggagucuauaaagaagguacauuucacaccauguggcaugugacgcgcggcgcaguucucaugcaccgggggaagagaaucgagccguccugggccgacgucaagaaagaucugaucucauacggaggcgguuggaaacuugagggggaauggaaagagggagaagaggugcagguccuggcuuuggaaccaggcaaaaaucccagggccgugcagacuaaaccuggcauuuucaagaccaacacagggaccaucggagcaguuagucuagacuuuagcccagguacauccggcucucccauaguggaucgaaaagggaaggucgugggacuguacggcaaugguguagucacucggucgggggcuuaugugagcgccauugcgcagaccgagaagucaaucgaggacaacccugaaauugaggaugacaucuuccgcaaaaagagacucacgauaauggaccugcauccgggagccggcaaaacaaagagguaccuucccgcaauuguucgggaagcuaucaaacgaggcuuaagaacucugauccucgccccaacccgcguggucgcugcagagauggaagaggccuugagggggcugccuauucguuaucaaacaaccgccaucaagacugagcacaccggacgggaaauuguggaucucaugugucaugcuacauuuacgaugagacugcuuucccccguuagggugccaaacuacaaucugauaaucauggacgaggcgcacuucacugauccugcaaguauugccgcucgcgguuauaucucuacccgagucgaaaugggcgaggccgcagggaucuucaugacagccacaccaccaggaagcagagacccguuuccucaguccaacgcucccauuauggaugaggaacgggagauaccagaaaggucauggaacucuggccacgagugggugacugacuucaaggguaaaacaguaugguuugugcccagcaucaaggcggggaacgauauugccgcaugcuugcgcaaaaauggaaagaaaguuauccagcuaagucguaagaccuucgacuccgaauacgucaagacgagagcuaacgauugggacuuuguggugacuacagauauuagcgagaugggcgccaauuucaaagcagagcgggucaucgacccuaggcgcuguaugaagccaguaauacugaccgacggcgaagaacgagugauccucgccgggcccaugccuguuacccauucuucagcugcccaaagacggggaaggauuggucgcaacccgaaaaaugaaaacgaucaguauaucuacaugggcgagccauuagaaaaugacgaggauugcgcgcacuggaaggaggcaaaaaugcugcuugacaacauuaauacucccgaagggaucauaccuuccauguuugagcccgaaagagagaagguggaugccauugacggagaauacaggcugcggggcgaggcucguaaaacauucgucgaucucaugcgccgaggugacuugccaguguggcuggccuauaagguugcugcagaggggaucaacuacgccgauagaaagugguguuuugacggcauuaaaaauaaccagauccucgaagagaacauggaaguggagauauggaccaaggagggagaaaggaaaaagcugaaaccucgguggcuugaugcucgcaucuauagugacccccuagcccugaaggaguucaaggaauuugcagcgggcagaaagagcuugacauuaaaucugauuacugagauggggaggcucccaacguucaugacccagaaggcccggaacgcucuggauaaucuugccguccugcauacagcagaagcuggaggucgagccuacaaccacgcacucucggaguugccugagacucuggaaacccuacugcuccuuacacuguuagccaccgugacuggcgggaucuucuuguuucugaugucuggaaaaggcauugguaagaugacgcucgggaugugcugcaucauaaccgcuuccauucugcuuugguaugcgcaaauccagccgcacuggaucgccgcaagcauuauccuggaguucuuucucauaguauugcugauucccgaaccagagaaacagagaacaccucaggacaaucaauuaacuuacgugguuaucgcuauucuaaccgucguggccgccacaauggcaaacgaaaugggcuuccuggagaagaccaagaaagaccucggacuuggcucaaucacuacacaggagagugaaucuaauauacuggauaucgacuugcgccccgcuuccgccuggacgcuguaugcgguggcuaccacuuuugucacaccaaugcucaggcauagcauugagaacucaaguguuaaugugagccugaccgccaucgcaaaccaggccaccguacuuauggggcucggaaaggguuggccucuguccaaaauggauauuggcgugcccuugcuggcuaucggguguuacucucaggucaauccgauuacauuaacugcagcccuacugcuccuuguggcgcacuacgcuaucauaggaccaggccugcaagccaaggcaacgcgggaagcccagaaacgugcugccgcagguauuaugaagaacccuaccguugacgggaucacagugaucgauuuggagcccauuccauaugaccccaaguucgaaaaacagcugggccaggucaugcuccugauacuuugcguaacucaaguguuaaugaugagaaccacaugggcucugugugaggcccucaccuuggcgacuggaccuaucagcacgcugugggagggcaauccggggagguuuuggaacacaaccauugccguuuccauggcaaauaucuuccgcggaucauaccuagcuggcgccggucugcucuuuucuauuaugaagaacacuaccaauacacggcgagggacuggaaacaucggcgaaacccuuggugagaaauggaagaguagacugaacgcauugggcaaaucggaguuccagauauauaagaaaagcgggauccaggagguggauaggacacuggcuaaggagggaauuaagcgcggcgaaacggaccaucacgccgucucccgggggucugccaaacucagaugguuuguggagcguaauauggucacccccgaaggaaaggugguugaucugggcugcgguagagggggauggucauacuauuguggcggucuuaaaaacgugcgggagguaaagggccuaacuaaagggggaccaggccaugaagaaccuauccccaugagcacauacggguggaaucuggugcgccuccaauccggagucgacguuuucuuuaccccuccagagaagugcgauacucuacugugugacauuggcgaaaguucucccaacccuacaaucgaggcgggucgaaccuugagagugcugaaucucgucgaaaacuggcuuaauaacaauacgcaguucugcauaaaggugcugaacccauauaugcccagcguaauugagaaaauggaggcuuugcagaggaaguacgggggagcacuggugcggaauccgcucucacgcaacuccacccacgagauguacuggguuaguaaugccacaggcaacaucgugagcucugucaauaugaucuccagaauguuaauuaacagguucacuaugaaacacaagaaagcuaccuaugagccugauguggaccugggcucagggacacgaaacauaggaaucgaaagcgagauuccaaaucuugacaucauugguaagcggaucgaaaagauaaaacaggagcaugaaacuucguggcacuacgaucaagaccaucccuauaagaccugggccuaccacggcucuuaugagacaaaacagaccgggagugcauccagcauggucaacggagugguucgucugcuaacuaagccuugggauguagugccaauggucacgcagauggccaugacagacaccacucccuuuggccagcaaagaguguucaaagagaagguugauacccgcacacaggaaccgaaggaggguacgaaaaagcucaugaaaaucaccgcugaauggcuguggaaggaguuggggaaagagaagacuccuaggauguguacacgggaagaguuuaccagaaaagugcgcucaaaugcggcccugggagcaauuuucacugacgaaaacaaguggaaguccgcuagggaggccgucgaagauggccgauuuugggagcucguggaccgggagagaaaucuucaccuggaaggcaaaugcgagacauguguauacaacaugauggggaagagggagaaaaaguuaggagaguucgguaaagcaaagggcucucgcgccaucugguauauguggcugggggcuagauuuuuggaguucgaggcccucggauuucugaaugaggaucauugguucagccggggcaacagucuauccgguguggaaggggagggacuucacagacugggcuacauucucagggacguuggcaagaaagaagggggagcgauguacgcagaugacaccgccgguugggacacacgcaucacucuggaggauuugaagaaugaagagauggucaccaaccauaugaaaggcgagcacaagaaacuggcugaagccauuuuuaagcucacguaucagaauaagguggugcgaguccagcggcccaccccaagagggacaguuauggacauaaucagcaggcgcgaucaaagaggaucuggccagguggguacuuacgggcuuaacaccuucacaaauauggaggcacagcugauucggcaaauggaaggagagggcaucuuuaaaucaauccagcauuuaacugcuaccgaggaaauugccguacagaacuggcuggcuagggugggccgugagcgauugagucgcauggccauauccggggacgauugcgucgugaagccuaucgacgauagauucgcaagcgcgcucacggcccugaaugacaugggaaaaguucggaaggauauucagcaaugggaacccucuagggguuggaacgacuggacacaggugccauucugcucgcaccacuuucaugagcuagucaugaaagauggccgcgugcuuguaguucccuguagaaaccaggacgaacugaucgggcgggcuaggauuucacagggagccggcuggagccucaaggagaccgcaugccuggguaaguccuaugcucaaauguggacuuugauguacuuccaccgacgugauuuaagacuggccgcaaaugccaucuguagugcggugccuucucauugggucccaacaagccgcaccacuugguccauacacgcuaaacacgaguggaugaccacagaagacaugcucgccguguggaaccggguguggauccaggagaauccguggauggaagacaagacgcccgucgagucaugggaagagguuccuuaucuugggaaaagggaggaucaguggugcggaagucugauuggccuaaccucuagagcaacuugggccaagaacauccagacagcuauuaaucaagugcgcagccugaucggcaacgaagaguacaccgacuauaugccauccaugaaacgguuuaggcgagaagaggaagaggccgggguacucugguga

SEQ ID NO: 14513 - RNA, 9876 nt, Artificial Sequence
  derived and/or modified CDS sequence (opt3) from DENV-2__FJ906961__SS-prME
accgccggagugaucgucaugcugauucccacagcuauggcauuccaccucacuacgagaaauggggagccucauaugauaguuggaaggcaggaaaaggguaaaagccuucuguuuaagaccgaggacggcgugaauaugugcacauugauggccaucgauuuaggggaacugugugaggacacuauuaccuacaaaugcccacuacuccggcaaaaugaaccggaggauaucgacuguuggugcaauuccacaucuaccugggugacuuauggaacauguaccacgacuggcgagcaccgccgagaaaagcguucaguggcgcuggucccccauguggguauggggcuugagaccagaacagaaacuuggaugaguagcgagggagcuuggaaacacguucagaggauugagaccuggauccugcggcauccuggcuucacaauuauggccgcaaucuuggccuacaccauuggcacgacucacuuucagcgcgcucucaucuucauucugcugacagcaguggccccauccaugaccaugagaugcaucgggauaucuaacagggauuuugucgaaggagugucggguggcucauggguagacauuguucucgagcacgggagcugugugacuacaauggcuaagaauaagcccaccuuagauuucgaacugaucaaaacggaggccaagcagccugcgacccuucggaaauauugcauugaagcaaaguugacaaacacuaccacagagagucgcuguccaacucaaggagagcccucccugaaugaggaacaggacaaacgauuuaucugcaagcauucuauggucgauagaggcugggguaacggguguggacuauucggcaagggcgggaucgugaccugcgccauguuuacaugcaaaaagaauauggaaggaaaagugguccagccugagaaccucgaauacaccauuguuauaacuccacacagcggugaggagcaugcugugggcaaugacacggggaagcacggaaaagaaaucaagauuacaccgcaguccucaaucaccgaggccgaacugacuggcuaugguaccguaacaauggaguguagucccaggaccgggcuugauuucaacgaaauggugcuguugcaaauggaggacaaagcauggcucguccaccggcagugguuucuggauuuaccucugccauggcuccccggcgcugacacucagggaagcaauuggauacagaaggagacacuugugacguucaagaacccucaugccaaaaagcaagacguugugguccugggcucucaggaaggggcgaugcacaccgccuugacuggagcaacagagauucagauguccucagguaaucuacuguuuaccggccaucucaaaugccgucugcgcauggauaaacuucaacugaaagggaugagcuacaguauguguacaggaaaguucaagaucgugaaagaaaucgcugagacucagcacggcaccauuguaaucagaguucaguaugagggugacgggucuccaugcaagauucccuucgaaauaacggauuuggagaaaaggcaugugcucggccggcugaucaccgucaacccgauugugacagaaaaggacuccccugucaacaucgaggccgaacccccauuuggagauagcuacaucauuauaggcguggagccugggcaguuaaaacugaauugguucaagaagggaucgucuaucggucaaauguuugagacuaccaugcgaggcgcuaaacgcauggccauucuaggggacacagcaugggauuucggaucccucggcgguguuuuuacuucaaucgggaaggcccugcaccagguguucggcgcuauuuacggagcggcauuuaguggcguaagcuggaccaugaaaauccuuauaggggucaucauuacguggaucggaaugaacuccagaucuaccagcuugucagugagucugguucucgugggcgucgugacccuguaucuuggugccaugguacaggcugacuccgggugugugguuagcuggaagaauaaagaacugaagugcggaucuggcauuuucaucacugauaacguccacacauggaccgagcaguacaaguuucaacccgaaucaccaaguaaauuggccagcgcaauacagaaggcccaugaggaagguauuuguggcaucagguccgugacucggcucgagaaucugauguggaaacagauuacccccgaguuaaaccacauccugucugaaaaugaggugaagcuaacaauaaugacgggggacauccgcggaauuaugcaggcuggcaaaagaucgcucaggccucaaccaaccgaacugaaguauagcuggaaaacuugggggaaggccaagaugcuuuccacagagccgcauaaccagaccuucuugaucgauggacccgaaacagcagagugcccuaauacuaaccgugcguggaacucacuggaggucgaagacuacggcuuugguguuuucaccacgaacauuuggcucaaacugcgggagaagcaggaaguguuuugugacaguaaauuaaugucugcugccaucaaggauaaucgagcagugcacgccgacaugggguauuggauagagagcgcucugaacgauacauggaaaauggagaaggccuccuucauugaaguaaagucaugccacuggccaaaaagccauacccuuuggucuaauggagucuuggaguccgaaaugaucauccccaagaacuucgcaggcccugugagucagcacaacuacagaccagguuaucauacucaaaccgcuggccccuggcaccucgggaaacuggagauggacuuugaucuaugugaaggaacaacuguuguggucaccgaggacugcggcaauagggggccgagccugcgcacaacgaccgccucuggaaagcucauuacugaguggugcugucgguccugcacacugccuccacuuagauacaggggcgaagaugguuguugguacgggauggagauccgccccuugaaagaaaaggaggaaaaccugguaaauucauuaguuaccgcgggacauggccagauugacaacuucagucucggugugcugggcauggcccuuuuucuggaggagauguugcgaacucggauagggacaaagcacgcuauccuccugguagcagucagcuucgugacccuaauuacgggaaauaugucguuucgugaucugggcagagugauggucaugguuggggccacuaugaccgacgauaucggaaugggcgugacauaucucgcucugcuugccgcauucaaaguaaggccuaccuuugcggccgguuugcuguuacgcaagcucacuuccaaagaacugaugauggcuacaauugggaucgcccuucugucucagagcaccauacccgagacaauccuagaacucacugacgcacuggcuuugggaaugauggugcugaagauuguccggaacauggagaaauaccaauuagccgugaccaucauggcaauuucaugcguuccaaaugccgugauccuccagaacgcuuggaaggucaguuguacgauacuggcggccguguccguuucuccucuucuguugacaagcucccagcagaaggcagauuggauuccccucgcucugaccaucaaaggccuaaauccaacugccaucuuccugaccacacuuucaagaacuagcaagaaaaggaguuggccgcucaacgaagccauuauggcugugggcauggucucuauacuggcauccagcuugcugaagaaugacaucccuaugaccgggcccuuaguagccggaggucuccugacggugugcuauguucuuacaggccgaucggcggaccuggaguuggagcgcgcugccgaugugaaaugggaagaccaagcagagauuucagggucuaguccaauccucuccauuaccaucagcgaagauggaucuaugagcauaaagaacgaggaggaagaacagacucugacaauccuaauucggaccggccugcuugucaucuccgguguguuucccguaucaauuccuaucacugccgcugcaugguaccucugggaagugaaaaagcagagagccgggguccugugggacguuccaagucccccuccgguggagaaggcggaauuggaggauggagcuuauaggauaaaacagcguggcauuuuaggcuacagccaaaucggggccggaguguauaaggaggguacauuccacaccauguggcaugucacgcgcggcgcagugcugaugcaccgggggaaaagaaucgaaccaucuugggccgacguuaagaaagaucucauuuccuacggaggcgguuggaagcuggagggggaauggaaggagggagaagagguacaggugcuugcucuggagcccggcaaaaauccuagggccguccagacuaagccaggcaucuuuaaaaccaacacagggaccauaggagcagugucauuggacuucagucccgguacaagcggcuccccuauuguugaucgaaaggggaaaguggucggacuauacggcaauggugugguaacucggucuggggcuuaugucucggccaucgcgcagaccgaaaagagcauugaggacaacccggaaaucgaggaugacauauuucgcaagaaaagacugacgauuauggaucuccaucccggagccggcaagacaaaaagguaccugccagcaaucgugcgggaagcuaucaagcgaggccuuagaacuuuaauucuggccccuacccgcguuguggcugcagagauggaggaagcccucaggggguugcccauccguuaucaaacaaccgccauuaaaacugagcacaccggacgggaaauagucgaccugaugugucaugcuacauucacgaugagacuccugucaccagugaggguuccuaacuacaaucuuaucauuauggacgaggcgcacuucacugaucccgcauccaucgccgcucgcgguuauaucaguacccgaguggagaugggcgaagccgcagggauuuuuaugacagccaccccaccgggaucuagagacccuuucccccagagcaacgcuccaauaauggaugaggaacgggagauccccgaaagguccuggaacucaggccacgagugggucacugacuuuaaggguaagacagugugguucguaccuucuauuaaagcggggaacgauaucgccgcaugccugcgcaagaauggcaagaaggugauucaguugagccguaaaaccuuugacagugaguacguuaagacgagagcuaacgauugggacuucgucgugacuacagauaucuccgaaaugggcgccaauuuuaaggcagagcgggugauagacccaaggcgcuguaugaaacccgucauccuaaccgauggcgaagaacgaguaauucuggccgggccuaugccggugacccauagcucugcugcccaaagacggggaaggaucggucgcaacccaaagaaugaaaacgaccaguauauuuacaugggcgagccccucgagaaugacgaagauugcgcgcacuggaaagaggcaaagauguuacuggacaacaucaauacuccugaagggauaauucccucaauguucgagccagaaagagagaaaguugaugccaucgacggagaguacaggcuucggggcgaagcucguaagacauuuguggaucugaugcgccgaggugaccucccugucugguuggccuauaaaguggcugcagaggggauuaacuacgccgauagaaagugguguuucgacggcaucaagaauaaccagauacuggaagagaacauggagguugaaaucuggaccaaagagggagaaaggaagaaacucaagccccgguggcuggaugcucgcauuuauuccgacccacuugcccuaaaagaguuuaaggaguucgcagcgggcagaaagagucugacauugaauuuaaucacugagauggggaggcugccuacguucaugacccagaaagcccggaacgcucucgauaaucuggccgugcuucauacagcagaggcuggaggucgagccuacaaccacgcacugagcgaacucccggagacuuuggaaacccugcuacugcucacacuucuggccaccgucacuggcgggauauuuuuauucuugaugucgggaaagggcaucgguaaaaugacgcuggggaugugcugcauaauuaccgcuucuauccuccugugguaugcgcaaauccagccccacuggauugccgcauccaucauacuugaguuuuuccugauugugcucuugaucccagaaccugagaagcagagaacaccccaggacaaucaacugacuuacguagugauugcuaucuuaaccguugucgccgccacaauggcaaacgagaugggcuuucuagagaagacaaagaaggaucugggacucggcagcauaacuacacaggagucagaaaguaauauccuugacauugaccugcgcccagcuucugccuggacguuguaugcgguggcuaccacuuucgugacaccuaugcugaggcauuccaucgagaacagcucagucaauguuagucucaccgccauugcaaaccaggccaccgugcugauggggcuuggaaaagguuggccccucagcaagauggauaucggcguaccgcuguuggcuauuggguguuacucccaggugaauccaaucacacugacugcagccuuacuacugcucgucgcgcacuacgcuauaauuggaccuggccuucaagccaaagcaacgcgggaagcccagaagcgugcugccgcagguaucaugaaaaaccccaccguggacgggaucacaguuauugaucuggagccaauacccuaugacccuaaguuugagaagcaguugggccaggugaugcugcucauccugugcgucacucaaguacuuaugaugagaaccacaugggcuuuaugugaagcccugacccucgcgacuggaccgauuucuacguugugggagggcaaucccgggagguucuggaacacaaccaucgccgugagcauggcaaauauuuuucgcggauccuaccuggcuggcgccggucuacuguucucaaucaugaaaaacacuaccaauacacggcgagggacuggaaacauaggcgaaacccucggugagaaguggaaaucuagacuuaacgcacugggcaagagugaguuucagaucuauaaaaagucggggauucaggaaguugauaggacauuggcuaaagagggaaucaagcgcggcgaaacggaccaucacgccgugagccggggguccgccaagcugagaugguucgucgagcguaauauggugaccccagaaggaaaagucguggaucucggcugcgguaggggaggguggucuuacuauuguggcggucugaagaacguucgggaggugaaaggcuuaacuaaagggggaccuggccaugaggaacccauuccuaugucaacauacggguggaaucuuguacgccugcaaagcggaguggacgucuuuuucaccccacccgagaaaugcgauacucuccuaugugacaucggcgaauccaguccuaacccaacaauagaggcgggucgaacccugagaguuuugaaucugguggaaaacuggcucaauaacaauacgcaguucugcauuaagguccuuaaccccuauaugccgucugugaucgagaagauggaggcucugcagaggaaauacgggggagcauugguacggaauccucugagccgcaacucaacccacgaaauguacuggguguccaaugccacaggcaacaucguuaguagcgugaauaugauuucuagaaugcucauaaacagguuuacuaugaagcacaaaaaggcuaccuaugagccagaugucgacuuaggcuccgggacacgaaacaucggaauugaaucagagauccccaaucuggauauuaucgguaaacggauagaaaagaucaagcaggagcaugagacuagcuggcacuacgaccaagaccauccuuauaaaaccugggccuaccacggcucguaugaaacaaagcagaccgggucugcaaguuccauggugaacggagucgugcgucuucugacuaaaccaugggauguuguacccauggugacgcagauggccaugacagacaccacuccguucggccagcaaagagucuuuaaggagaaaguggauacccgcacacaggaaccuaaggaggguacgaagaaacuaaugaagauuaccgcugaguggcucuggaaagaacuggggaagaaaaagacucccaggauguguacacgggaggaguucaccagaaaaguucgcagcaaugcggccuugggagcaaucuuuacugacgagaacaaguggaagucagcuagggaagccguggaggauggccgauucugggagcuggucgaccgggaaagaaaucuccaccuugagggcaaaugcgaaacauguguguacaacaugauggggaagagggagaaaaagcugggagaauuugguaaagcaaagggcucccgcgccauuugguauaugugguuaggggcucguuuccuggaguuugaggccuugggauuccucaaugaagaucauugguuuucucggggcaacagccugagugguguagagggggaaggacuacacagacuuggcuacauccugagggacgugggcaagaaagaagggggagcgauguacgcagaugacaccgccgguugggauacacgcauuacucucgaagaccugaagaaugaggagaugguuaccaaccauaugaaaggcgaacacaagaaauuggcugaggccauauucaagcugacguaucagaauaaggucgugcgagugcagcggccaaccccuagagggacagucauggacaucauuuccaggcgcgaucaaagaggaagcggccagguugguacuuacgggcucaacaccuuuacaaauauggaagcacagcuuauccggcaaauggagggagagggcaucuucaaaucuauucagcaucugacugcuaccgaagagauagccgugcagaacugguuagcuaggguaggccgugaacgacugucacgcauggccaucaguggggacgauugcguggucaagcccauugacgauagauucgcauccgcguugacggcccucaaugacaugggaaaagugcggaaggauauccagcaaugggagccaagcagggguuggaacgacuggacacagguucccuuuugcucucaccacuuccaugaacuggugaugaaagauggccgcguccuagugguaccuuguagaaaccaggacgagcuuauugggcgggcuaggaucucgcagggagccggcuggucacugaaggagaccgcaugccucgguaagagcuaugcucaaauguggacucugauguacuuucaccgacgugauuugagauuagccgcaaaugccauauguuccgcgguuccaagucauugggugccgacaucucgcaccacuuggagcauccacgcuaaacacgaauggaugaccacagaggacaugcuggccgucuggaaccggguguggauucaggaaaaucccuggauggaggauaagacgccuguggaauccugggaggaggucccauaucucgggaaaagggaagaccaguggugcggaucacuuaucggccugaccaguagagcaacuugggccaagaacauucagacagcuaucaaucaaguucgcucucuaauaggcaacgaggaauacaccgacuauaugcccagcaugaaacgguucaggcgagaggaagaggaggccggggugcugugguga

SEQ ID NO: 14514 - RNA, 9876 nt, Artificial Sequence
  derived and/or modified CDS sequence (opt3) from DENV-2__FJ906962__SS-prME
acagccggagugaucguaaugcugauucccacggcuauggcauuccaccucacuacgagaaacggggagccucauaugauaguuggaaggcaggaaaaggguaaaagccuucuguuuaagaccgaggacggcgugaauaugugcacauugauggccaucgauuuaggggaacugugugaggacacuauuaccuacaaaugcccacuacuccggcaaaacgaaccggaggauaucgacuguuggugcaauuccacaucuaccuggguuacuuauggaacauguaccacgacuggcgagcaccgccgagaaaagcguucaguggcgcuggucccccauguggguauggggcuugagaccaggacagaaacuuggaugaguagcgagggagcuuggaaacacguucagaggauugagaccuggauccugcggcauccuggcuucacaauaauggccgcaaucuuggccuacaccauuggcacgacucacuuucagcgcgcucucaucuucauucugcugacagcaguggccccauccaugaccaugagaugcaucgggauaucuaacagggauuuugucgaaggagugucggguggcucauggguggacauuguucucgagcacgggagcugugugacuacaauggcuaagaauaagcccaccuuagauuucgaacugaucaaaacggaggccaagcagccugcgacccuucggaaauauugcauugaagcaaaguugacaaacacuaccacagagagucgcuguccaacucaaggagagcccucccugaaugaggaacaggacaaacgauuuaucugcaagcauucuauggucgauagaggcugggguaacggguguggacuauucggcaagggcgggaucgugaccugcgccauguuuacaugcaaaaagaauauggaaggaaaagugguccagccugagaaccucgaauacaccauuguuauaacuccacacagcggugaggagcaugcugugggcaaugacacggggaagcacggaaaagaaaucaagauuacaccgcaguccucaaucaccgaggccgaacugacuggcuaugguaccguaacaauggaguguagucccaggaccgggcuugauuucaacgaaauggugcuguugcaaauggaggacaaagcauggcucguccaccggcagugguuucuggauuuaccucugccauggcuccccggcgcugacacucagggaagcaauuggauacagaaggagacacuugugacguucaagaacccucaugccaaaaagcaagacguugugguccugggcucucaggaaggggcgaugcacaccgccuugacuggagcaacagagauucagauguccucagguaaucuacuguuuaccggccaucucaaaugccgucugcgcauggauaaacuucaacugaaagggaugagcuacaguauguguacaggaaaguucaagaucgugaaagaaaucgcugagacucagcacggcaccauuguaaucagaguucaguaugagggugacgggucuccaugcaagauucccuucgaaauaacggauuuggagaaaaggcaugugcucggccggcugaucaccgucaacccgauugugacagaaaaggacuccccugucaacaucgaggccgaacccccauuuggagauagcuacaucauuauaggcguggagccugggcaguuaaaacugaauugguucaagaagggaucgucuaucggucaaauguuugagacuaccaugcgaggcgcuaaacgcauggccauucuaggggacacagcaugggauuucggaucccucggcgguguuuuuacuucaaucgggaaggcccugcaccagguguucggcgcuauuuacggagcggcauuuaguggcguaagcuggaccaugaaaauccuuauaggggucaucauuacguggaucggaaugaacuccagaucuaccagcuugucagugagucugguucucgugggcgucgugacccuguaucuuggugccaugguacaggcugacuccgggugugugguuagcuggaagaauaaagaacugaagugcggaucuggcauuuucaucacugauaacguccacacauggaccgagcaguacaaguuucaacccgaaucaccaaguaaauuggccagcgcaauacagaaggcccaugaggaagguauuuguggcaucagguccgugacucggcucgagaaucugauguggaaacagauuacccccgaguuaaaccacauccugucugaaaaugagauaaagcuaacaaucaugacgggggacauucgcggaaucaugcaggcuggcaaaagaucgcucaggccucaaccaaccgaacugaaguauagcuggaaaacuugggggaaggccaagaugcuuuccacagagucacauaaccagaccuucuugauugauggaccggaaacagcagagugccccaauacuaaccgugcguggaauagucuggagguggaagacuacggcuuuggugucuucaccacgaacaucuggcucaaacugcgggagaagcaggacguauuuugugauucuaaauuaaugagcgcugccauaaaggacaaucgagcagugcacgccgauaugggguauuggauugaauccgcucugaacgacacauggaaaauggagaaggccucauucaucgagguaaagagcugccacuggccuaaaucucauacccuuugguccaauggaguauuggaaagugagaugaucauuccaaagaacuucgcaggccccgucagccagcacaacuacagaccugguuaucauacucaaaccgcuggcccauggcaccucgggaaacuggaaauggauuuugaccuaugugagggaacaacugugguugugaccgaagauugcggcaauagggggcccucucugcgcacaacgaccgccuccggaaagcucaucacugaguggugcugucggucaugcacacugccgccucuuagauacaggggcgaggacgguuguugguacgggauggaaauucgcccauugaaagagaaggaagagaaccuggucaauaguuuagugaccgcgggacauggccagauagauaacuucagccucgguguucugggcauggcccuuuuucuggaagagauguugcgaacucggaucgggacaaagcacgcuauucuccugguggcaguaucguucgucacccuaaucacgggaaauauguccuuucgugaccugggcagagugauggugauggucggggccacuaugaccgaugacauuggaaugggcguuacauaucucgcucugcuugccgcauucaaagugaggcccaccuuugcggccgguuugcuguuacgcaagcucacuucuaaagagcugaugauggcuacaaucgggauagcccuucugagccagucaaccaucccugaaaacauucuagagcucacagaugcacuggcuuugggaaugaugguacugaagaucgugcggaauauggaaaaauaccaauuagccgucacuauuauggcaaucaguugcgugcccaacgccguuauacuccagaaugcuuggaagguguccuguaccauucuggcggccgucucugugagcccacuucuguugacguccucacagcagaaggcagacuggaucccucucgcucugacaaucaaaggccuaaaccccaccgccauuuuccugacuacccuuagcagaacaaguaagaaaaggucuuggccacucaaugaggccauaauggcuguuggcaugguguccauccuggcaagcucguugcugaagaacgacauuccgaugacugggccuuuagucgccggaggucuccugaccguaugcuaugugcuuacgggccgaucagcggaucuggaauuggagcgcgcugccgacguuaaaugggaggaucaagcagaaaucucugggaguucccccauucucagcaucacaauaucugaggacggaagcauguccaucaagaaugaagaggaggaacagacccugacuauucuaauccggacaggccugcuugugauuucaggugucuuuccagugaguauccccauaaccgccgcugcaugguaccucugggaggucaagaagcagagagccggggugcugugggaugucccuagcccacccccuguugaaaaggcggaguuggaagacggagcuuauaggauuaaacagcguggcaucuuaggcuacucucaaaucggggccggaguguauaaggaggguacuuuccacacaauguggcaugugacccgcggcgcaguccugaugcaccgggggaaaagaauugagccguccugggccgaugugaagaaagaccucaucucauacggaggcgguuggaagcuggaaggggaguggaaggaaggagaggaaguucagguacuugcucuggagccaggcaaaaaccccagggccgugcagacgaagccuggcauauuuaaaacuaauaccgggacaauuggagcagucaguuuggauuucagcccagguaccuccggcucucccaucguggaccgaaaggggaaaguugugggacuauacggcaacggugucgugacacggucgggggcuuauguaagcgccauugcgcagacugagaagucaaucgaagauaacccugagauagaagacgauauuuuucgcaagaaaagacugaccaucauggaccuccauccgggagccggcaagacgaaaagguaccugcccgcaaucguccgggaggcuauuaagcgaggccuuagaacauuaauccuggccccaacucgcgugguugcugcagaaauggaggaggcccucaggggguugccuauucguuaucaaaccacagccauaaaaaccgaacacacuggacgggagaucguggaccugaugugucaugcuaccuucacaaugagacuccugucccccgucagggugccaaauuacaaccuuauuaucauggaugaagcgcacuucacggacccugcaaguaucgccgcucgcgguuauauuucuacucgaguugagaugggcgaggccgcagggauauuuaugaccgccacacccccaggaagcagagauccguucccucaguccaaugcucccaucauggacgaagaacgggaaauuccagagaggucauggaacucuggccacgaaugggugaccgauuuuaaggguaagacugucugguucgugcccagcaucaaagcggggaaugacauugccgcaugccugcgcaagaacggcaagaagguaauccaguugagucguaaaacauuugauuccgaguacgugaagaccagagcuaaugacugggauuucguugucacgacugacauaagcgagaugggcgccaacuuuaaggcagaacgggugaucgauccuaggcgcuguaugaaaccagugauucuaacagacggcgaggaacgagucauccuggccgggcccaugccuguaacccauucuucagcugcccaaagacggggaaggauuggucgcaauccgaagaacgagaaugaccaguauaucuacaugggcgaaccacucgagaacgaugaggacugcgcgcacuggaaagaagcaaagauguuacuggauaauauaaacacccccgaggggauuaucccuuccauguucgaacccgagagagaaaaaguggacgccauugauggagaguacaggcuucggggcgaggcucguaagacuuuuguugaccugaugcgccgaggugaucucccagugugguuggccuauaaagucgcugcagaagggaucaauuacgccgacagaaagugguguuucgauggcauaaagaacaaccagauccuggaggaaaauauggagguggagauuuggacaaaagaaggagagaggaagaaacucaagccucgguggcuggacgcucgcaucuauagugauccccuugcccuaaaagaauuuaaggaguucgcagcgggcagaaagagccugaccuugaacuuaauuacagaaauggggaggcugccaacuuucaugacgcagaaagcccggaaugcucucgacaaccuggccguucuucauaccgcagaggcuggaggucgagccuacaaucacgcacugucggagcucccugaaacauuggagacucugcuacugcucacccuucuggccacagugaccggcgggaucuuuuuauucuugaugucuggaaagggcauagguaaaaugacucuggggaugugcugcauuaucacggcuuccauccuccugugguaugcgcaaauucagccgcacuggaucgccgcaagcauaauucuugaauuuuuccugaucguccucuugauucccgagccagaaaagcagagaaccccucaggauaaccaacugacauacgugguaaucgcuauauuaacugugguugccgccaccauggcaaaugagaugggcuuucuagagaaaacaaagaaggaccugggacucggcucaaucaccacucaggaaagugagucuaacauucuugacaucgaucugcgccccgcuuccgccuggacauuguaugcggucgcuacgaccuucgugacuccaaugcugaggcauagcauugaaaauucaagugugaacgucagccucacagccaucgcaaaucaggccaccguucugauggggcuuggaaaagguuggccucucuccaagauggacauuggcgugccccuguuggcuaucggguguuacucucagguaaacccgauaacccugacagcagccuuacuacugcucguggcgcacuacgcuauuaucggaccaggccuucaagccaaagcaacucgggaggcccagaagcgugcugccgcagguaucaugaaaaauccuacggucgaugggauuaccgugauagaccuggaacccaucccauaugaucccaaguuugagaagcaguugggccagguuaugcugcucauucugugcgugacacaaguccuuaugaugagaacuaccugggcuuuaugugaggcccugacacucgcgaccggaccuaucagcacuuugugggaaggcaacccggggagguucuggaauacgacaauugccguauccauggcaaacaucuuucgcggaucauaccuggcuggcgccggucuacuguucucuauaaugaaaaauaccacuaacacccggcgagggacaggaaacaucggcgagacucucggugaaaaguggaaaaguagacuuaaugcacugggcaagucggaguuucagauuuauaaaaagagcgggauccaggagguggacaggaccuuggcuaaagaaggaauuaagcgcggcgagacagaucaucacgccguuucccgggggucugccaagcugagaugguucguggaacguaacauggucacgcccgagggaaaaguggucgaccucggcugcgguagagggggauggucauacuauuguggcggucugaagaaugugcgggaaguuaaaggcuuaaccaaagggggaccaggccaugaggagccuauccccaugagcacuuacggguggaaccuugugcgccugcaauccggaguagauguguuuuucacaccuccagaaaaaugcgacacccuccuaugugauauaggcgagaguucucccaauccuacuauugaagcgggucgaacacugagagucuugaaccugguugagaauuggcucaacaauaacacccaguucugcaucaaggugcuuaauccauauaugcccagcgucaucgaaaagauggaggcucugcagaggaaauacgggggagcauuggugcggaacccgcugucacgcaauuccacgcacgagauguacuggguaaguaacgccaccggcaauauugugagcucuguuaacaugauauccagaaugcucaucaacagguuuacaaugaagcacaaaaaggcuacuuaugaaccugacguggauuuaggcucagggacccgaaauauuggaaucgagagcgaaauuccaaaccuggacaucauagguaaacggaucgagaagauuaagcaggaacaugagacaucguggcacuacgaccaagaucaucccuauaaaacuugggccuaccacggcucuuaugagaccaagcagacagggagugcauccagcauggucaauggagugguccgucuucugaccaaaccuugggacgugguuccaaugguaacucagauggccaugacggauacaacccccuucggccagcaaagaguguuuaaggaaaaagucgacacucgcacccaggagccgaaggaagguacaaagaaacuaaugaagaucacggcugaguggcucuggaaagagcuggggaagaaaaagaccccuaggauguguacucgggaagaguucacaagaaaagugcgcucaaacgcggccuugggagcaauuuuuaccgaugaaaauaaguggaaguccgcuagggaggccguugaagacggccgauucugggagcugguggaucgggagagaaaccuccaccuugaaggcaaaugcgagacuugugucuacaauaugauggggaagagggagaaaaagcugggagaguuugguaaagcaaagggcucucgcgccaucugguauaugugguuaggggcucguuuccuggaauuugaggccuugggauuccucaacgaggaccauugguuuagccggggcaauagucuguccgguguggaaggggagggacuacacagacuuggcuacauucugagggauguaggcaagaaagaagggggagcgauguacgcagacgauacagccgguugggacacccgcauaacacucgaggaccugaagaacgaagagauggugacuaaucauaugaaaggcgagcacaagaaauuggcugaagccaucuucaagcugaccuaucagaacaagguuguccgagugcagcggcccacgccaagagggaccgugauggauauuaucagcaggcgcgaccaaagaggaucuggccaggucgguacauacgggcucaauacuuuuaccaacaucgaggcacagcuuauucggcaaauggaaggagagggcauauucaaaucaauccagcaucugacagcuacugaggaaauugccguucagaauugguuagcuagggugggccgugagcgacugagucgcauggccaucuccggggaugacugcguagugaagccuauugaugacagauucgcaagcgcguugaccgcccucaacgauaugggaaaaguccggaaggacauccagcaaugggaacccucuagggguuggaacgauuggacacaggugccauuuugcucgcaccacuuccaugagcugguuaugaaagacggccgcgugcuagucgugcccuguagaaaucaggaugaacuuauagggcgggcuaggaucucacagggagccggcuggagccugaaggagacagcaugccucgguaaguccuaugcucaaauguggacccugauguacuuucaccgacgugacuugagauuagccgcaaacgccauuuguagugcgguaccuucucauuggguuccaacuagccgcacaaccugguccauccacgcuaaacacgaguggaugacuaccgaagauaugcuggccguguggaaucgggucuggauucaggagaacccguggauggaagacaagacacccguggagucaugggaagaggugccuuaucucgggaaaagggaggaccaguggugcggaagucuuaucggccugacgucuagagcaaccugggccaagaauauacagacugcuauuaaccaaguccgcagccuaaucggcaaugaagaguacacagauuauaugccauccaugaaacgguucaggcgagaagaggaagaggccgggguucugugguga

SEQ ID NO: 14515 - RNA, 9876 nt, Artificial Sequence
  derived and/or modified CDS sequence (opt3) from DENV-2__FJ850053__SS-prME
acagccggagugaucgucaugcugauucccacagcuauggcauuccaccucacuacgagaaauggggagccucauaugauaguuggaaggcaggaaaaggguaaaagccuucuguuuaagaccgaggacggcgugaauaugugcacauugauggccaucgauuuaggggaacugugugaggacacuauuaccuacaaaugcccacuacuccggcaaaaugaaccggaggauaucgacuguuggugcaauuccacaucuaccugggugacuuauggaacauguaccacgacuggcgagcaccgccgagaaaagcguucaguggcgcuggucccccauguggguauggggcuugagaccagaacagaaacuuggaugaguagcgagggagcuuggaaacacguucagaggauugagaccuggauccugcggcauccuggcuucacaauuauggccgcaaucuuggccuacaccauuggcacgacucacuuucagcgcgcucucaucuucauucugcugacagcaguggccccauccaugaccaugagaugcaucgggauaucuaacagggauuuugucgaaggagugucggguggcucauggguagacauuguucucgagcacgggagcugugugacuacaauggcuaagaauaagcccaccuuagauuucgaacugaucaaaacggaggccaagcagccugcgacccuucggaaauauugcauugaagcaaaguugacaaacacuaccacagagagucgcuguccaacucaaggagagcccucccugaaugaagaacaggacaaacgauuuaucugcaagcauucuauggucgauagaggcugggguaacggguguggacuauucggcaagggcgggaucgugaccugcgccauguuuacaugcaaaaagaauauggaaggaaaagugguccagccugagaaccucgaauacaccauuguuauaacuccacacagcggugaggagcaugcugugggcaaugacacggggaagcacggaaaagaaaucaagauuacaccgcaguccucaaucaccgaggccgaacugacuggcuaugguaccguaacaauggaguguagucccaggaccgggcuugauuucaacgaaauggugcuguugcaaauggaggacaaagcauggcucguccaccggcagugguuucuggauuuaccucugccauggcuccccggcgcugacacucagggaagcaauuggauacagaaggagacacuugugacguucaagaacccucaugccaaaaagcaagacguugugguccugggcucucaggaaggggcgaugcacaccgccuugacuggagcaacagagauucagauguccucagguaaucuacuguuuaccggccaucucaaaugccgucugcgcauggauaaacuucaacugaaagggaugagcuacaguauguguacaggaaaguucaagaucgugaaagaaaucgcugagacucagcacggcaccauuguaaucagaguucaguaugagggugacgggucuccaugcaagauucccuucgaaauaacggauuuggagaaaaggcaugugcucggccggcugaucaccgucaacccgauugugacagaaaaggacuccccugucaacaucgaggccgaacccccauuuggagauagcuacaucauuauaggcguggagccugggcaguuaaaacugaauugguucaagaagggaucgucuaucggucaaauguuugagacuaccaugcgaggcgcuaaacgcauggccauucuaggggacacagcaugggauuucggaucccucggcgguguuuuuacuucaaucgggaaggcccugcaccagguguucggcgcuauuuacggagcggcauuuaguggcguaagcuggaccaugaaaauccuuauaggggucaucauuacguggaucggaaugaacuccagaucuaccagcuugucagugagucugguucucgugggcgucgugacccuguaucuuggugccaugguacaggcugacuccgggugugugguuagcuggaagaauaaagaacugaagugcggaucuggcauuuucaucacugauaacguccacacauggaccgagcaguacaaguuucaacccgaaucaccaaguaaauuggccagcgcaauacagaaggcccaugaggaagguauuuguggcaucagguccgugacucggcucgagaaucugauguggaaacagauuacccccgaguuaaaccacauccugucugaaaaugaggugaagcuaacaauaaugacgggggacauccgcggaauuaugcaggcuggcaaaagaucgcucaggccucaaccaaccgaacugaaguauagcuggaaaacuugggggaaggccaagaugcuuuccacagagccgcauaaccagaccuucuugaucgauggacccgaaacagcagagugcccuaauacuaaccgugcguggaacucacuggaggucgaagacuacggcuuugguguuuucaccacgaacauuuggcucaaacugcgggagaagcaggacguguuuugugauaguaaauuaaugucugcugccaucaaggacaaucgagcagugcacgccgauaugggguauuggauagaaagcgcucugaacgacacauggaaaauggagaaggccuccuucauugagguaaagucaugccacuggccaaaaagccauacccuuuggucuaauggagucuuggaauccgagaugaucauccccaagaacuucgcaggcccugugagucagcacaacuacagaccagguuaucauacucaaaccgcuggccccuggcaccucgggaaacuggaaauggauuuugaccuaugugagggaacaacuguuguggucaccgaagauugcggcaauagggggccgagccugcgcacaacgaccgccucuggaaagcucauuacugaguggugcugucgguccugcacacugccuccacuuagauacaggggcgaggacgguuguugguacgggauggaaauccgccccuugaaagagaaggaagagaaccugguaaauucauuaguuaccgcgggacauggccagauugauaacuucagucucggugugcugggcauggcccuuuuucuggaagagauguugcgaacucggauagggacaaagcacgcuauccuccugguagcagucagcuucgugacccuaauuacgggaaauaugucguuucgugaccugggcagagugauggucaugguuggggccacuaugaccgaugacaucggaaugggcgugacauaucucgcucugcuugccgcauucaaaguaaggccuaccuuugcggccgguuugcuguuacgcaagcucacuuccaaagagcugaugauggcuacaauugggaucgcccuucugucucagagcaccauacccgaaacaauccuagagcucacugaugcacuggcuuugggaaugauggugcugaagauuguccggaacauggaaaaauaccaauuagccgugaccaucauggcaauuucaugcguuccaaaugccgugauccuccagaacgcuuggaaggucaguuguacgauacuggcggccguguccguuucuccucuucuguugacaagcucccagcagaaggcagacuggauuccccucgcucugaccaucaaaggccuaaauccaacugccaucuuccugaccacacuuucaagaacuagcaagaaaaggaguuggccgcucaacgaggccauuauggcugugggcauggucucuauacuggcauccagcuugcugaagaaugacaucccuaugaccgggcccuuaguagccggaggucuccugacggugugcuauguucuuacaggccgaucggcggaucuggaauuggagcgcgcugccgacgugaaaugggaggaucaagcagaaauuucagggucuaguccaauccucuccauuaccaucagcgaggacggaucuaugagcauaaagaacgaagaggaggaacagacucugacaauccuaauucggaccggccugcuugucaucuccgguguguuucccguaucaauuccuaucacugccgcugcaugguaccucugggaggugaaaaagcagagagccgggguccugugggauguuccaagucccccuccgguggaaaaggcggaguuggaagacggagcuuauaggauaaaacagcguggcauuuuaggcuacagccaaaucggggccggaguguauaaggaggguacauuccacaccauguggcaugucacgcgcggcgcagugcugaugcaccgggggaaaagaaucgagccaucuugggccgauguuaagaaagaccucauuuccuacggaggcgguuggaagcuggaaggggaguggaaggaaggagaggaaguacaggugcuugcucuggagcccggcaaaaauccuagggccguccagacuaagccaggcaucuuuaaaaccaacacagggaccauaggagcagugucauuggauuucagucccgguacaagcggcuccccuauuguugaccgaaaggggaaaguggucggacuauacggcaauggugugguaacucggucuggggcuuaugucucggccaucgcgcagaccgaaaagagcauugaagauaacccggagaucgaagacgauauauuucgcaagaaaagacugacgauuauggaccuccaucccggagccggcaagacaaaaagguaccugccagcaaucgugcgggaggcuaucaagcgaggccuuagaacuuuaauucuggccccuacccgcguuguggcugcagaaauggaggaggcccucaggggguugcccauccguuaucaaacaaccgccauuaaaacugaacacaccggacgggagauagucgaccugaugugucaugcuacauucacgaugagacuccugucaccagugaggguuccuaacuacaaucuuaucauuauggaugaagcgcacuucacugaccccgcauccaucgccgcucgcgguuauaucaguacccgaguggagaugggcgaggccgcagggauuuuuaugacagccaccccaccgggaucuagagauccuuucccccagagcaacgcuccaauaauggacgaggagcgggaaauccccgagagguccuggaacucaggccacgaaugggucacugauuuuaaggguaagacagugugguucguaccuucuauuaaagcggggaacgacaucgccgcaugccugcgcaagaauggcaagaaggugauucaguugagccguaaaaccuuugauagugaguacguuaagacgagagcuaacgacugggauuucgucgugacuacagacaucuccgagaugggcgccaauuuuaaggcagaacgggugauagauccaaggcgcuguaugaaacccgucauccuaaccgacggcgaggaacgaguaauucuggccgggccuaugccggugacccauagcucugcugcccaaagacggggaaggaucggucgcaacccaaagaaugagaacgaccaguauauuuacaugggcgaaccccucgagaaugaugaggacugcgcgcacuggaaagaagcaaagauguuacuggauaacaucaauacuccugaggggauaauucccucaauguucgaaccagagagagaaaaaguugacgccaucgauggagaguacaggcuucggggcgaggcucguaagacauuuguggaccugaugcgccgaggugaucucccugucugguuggccuauaaaguggcugcagaagggauuaacuacgccgacagaaagugguguuucgauggcaucaagaauaaccagauacuggaggaaaacauggagguugagaucuggaccaaagaaggagagaggaagaaacucaagccccgguggcuggacgcucgcauuuauuccgauccacuugcccuaaaagaauuuaaggaguucgcagcgggcagaaagagucugacauugaauuuaaucacugaaauggggaggcugccuacguucaugacccagaaagcccggaacgcucucgacaaucuggccgugcuucauacagcagaggcuggaggucgagccuacaaccacgcacugagcgagcucccggaaacuuuggagacccugcuacugcucacacuucuggccaccgucacuggcgggauauuuuuauucuugaugucgggaaagggcaucgguaaaaugacgcuggggaugugcugcauaauuaccgcuucuauccuccugugguaugcgcaaauccagccccacuggauugccgcauccaucauacuugaauuuuuccugauugugcucuugaucccagagccugaaaagcagagaacaccccaggauaaucaacugacuuacguagugauugcuaucuuaaccguugucgccgccacaauggcaaacgagaugggcuuucuagagaaaaccaagaaggaccugggacucggcagcauaacuacacaggaaucagagaguaauauccuugacauugaucugcgcccagcuucugccuggacguuguaugcgguggcuaccacuuucgugacaccuaugcugaggcauuccaucgaaaacagcucagucaauguuagucucaccgccauugcaaaccaggccaccgugcugauggggcuuggaaaagguuggccccucagcaagauggacaucggcguaccgcuguuggcuauuggguguuacucccaggugaauccaaucacacugacugcagccuuacuacugcucgucgcgcacuacgcuauaauuggaccuggccuucaagccaaagcaacgcgggaggcccagaagcgugcugccgcagguaucaugaaaaaccccaccguggaugggaucacaguuauugaccuggaaccaauacccuaugauccuaaguuugagaagcaguugggccaggugaugcugcucauccugugcgucacucaaguacuuaugaugagaaccacaugggcuuuaugugaggcccugacccucgcgacuggaccgauuucuacguugugggaaggcaaucccgggagguucuggaacacaaccaucgccgugagcauggcaaauauuuuucgcggauccuaccuggcuggcgccggucuacuguucucaaucaugaaaaacacuaccaauacacggcgagggacuggaaacauaggcgagacccucggugaaaaguggaaaucuagacuuaacgcacugggcaagagugaguuucagaucuauaaaaagucggggauucaggagguugacaggacauuggcuaaagaaggaaucaagcgcggcgagacggaucaucacgccgugagccggggguccgccaagcugagaugguucgucgaacguaauauggugaccccagagggaaaagucguggaccucggcugcgguaggggaggguggucuuacuauuguggcggucugaagaacguucgggaagugaaaggcuuaacuaaagggggaccuggccaugaggagcccauuccuaugucaacauacggguggaaucuuguacgccugcaaagcggaguggaugucuuuuucaccccacccgaaaaaugcgacacucuccuaugugauaucggcgaguccaguccuaacccaacaauagaagcgggucgaacccugagaguuuugaaucugguggagaacuggcucaauaacaauacgcaguucugcauuaagguccuuaaccccuauaugccgucugugaucgaaaagauggaggcucugcagaggaaauacgggggagcauugguacggaauccucugagccgcaacucaacccacgagauguacuggguguccaaugccacaggcaacaucguuaguagcgugaauaugauuucuagaaugcucauaaacagguuuacuaugaagcacaaaaaggcuaccuaugaaccagacgucgauuuaggcuccgggacacgaaacaucggaauugagucagaaauccccaaucuggacauuaucgguaaacggauagagaagaucaagcaggaacaugagacuagcuggcacuacgaccaagaucauccuuauaaaaccugggccuaccacggcucguaugagacaaagcagaccgggucugcaaguuccauggugaacggagucgugcgucuucugacuaaaccaugggacguuguacccauggugacgcagauggccaugacagauaccacuccguucggccagcaaagagucuuuaaggaaaaaguggacacccgcacacaggagccuaaggaagguacgaagaaacuaaugaagauuaccgcugaguggcucuggaaagagcuggggaagaaaaagacucccaggauguguacacgggaagaguucaccagaaaaguucgcagcaaugcggccuugggagcaaucuuuacugaugaaaacaaguggaagucagcuagggaggccguggaagacggccgauucugggagcuggucgaucgggagagaaaucuccaccuugaaggcaaaugcgagacauguguguacaacaugauggggaagagggagaagaagcugggagaguuugguaaagcaaagggcucccgcgccauuugguauaugugguuaggggcucguuuccuggaauuugaggccuugggauuccucaaugaggaccauugguuuucucggggcaacagccugagugguguagaaggggagggacuacacagacuuggcuacauccugagggaugugggcaagaaagaagggggagcgauguacgcagacgauaccgccgguugggacacacgcauuacucucgaggaccugaagaaugaagagaugguuaccaaccauaugaaaggcgagcacaagaaauuggcugaagccauauucaagcugacguaucagaauaaggucgugcgagugcagcggccaaccccuagagggacagucauggauaucauuuccaggcgcgaccaaagaggaagcggccagguugguacuuacgggcucaacaccuuuacaaauauggaggcacagcuuauccggcaaauggaaggagagggcaucuucaaaucuauucagcaucugacugcuaccgaggaaauagccgugcagaacugguuagcuaggguaggccgugagcgacugucacgcauggccaucaguggggaugacugcguggucaagcccauugaugacagauucgcauccgcguugacggcccucaaugauaugggaaaagugcggaaggacauccagcaaugggaaccaagcagggguuggaacgauuggacacagguucccuuuugcucucaccacuuccaugagcuggugaugaaagacggccgcguccuagugguaccuuguagaaaccaggaugaacuuauugggcgggcuaggaucucgcagggagccggcuggucacugaaggagaccgcaugccucgguaagagcuaugcucaaauguggacucugauguacuuucaccgacgugacuugagauuagccgcaaaugccauauguuccgcgguuccaagucauugggugccgacaucucgcaccacuuggagcauccacgcuaaacacgaguggaugaccacagaagauaugcuggccgucuggaaccggguguggauucaggagaaucccuggauggaagacaagacgccuguggaguccugggaagaggucccauaucucgggaaaagggaggaccaguggugcggaucacuuaucggccugaccaguagagcaacuugggccaagaacauucagacagcuaucaaucaaguucgcucucuaauaggcaacgaagaguacaccgauuauaugcccagcaugaaacgguucaggcgagaagaggaagaggccggggugcugugguga

SEQ ID NO: 14516 - RNA, 9876 nt, Artificial Sequence
  derived and/or modified CDS sequence (opt3) from DENV-2__JN819420__SS-prME
accgccggcgugaucgucaugcugauucccacagcuauggcauuccaccucacuacgagaaacggggagccucauaugauaguuggaaggcaggaaaaggguaaaagccuucuguuuaagaccgaggacggcgugaauaugugcacauugauggccaucgauuuaggggaacugugugaggacacuauuaccuacaaaugcccacuacuccggcaaaacgaaccggaggauaucgacuguuggugcaauuccacaucuaccuggguaacuuauggaacauguaccacgacuggcgagcaccgccgagaaaagcguucaguggcgcuggucccccauguggguauggggcuugagaccagaacagaaacuuggaugaguagcgagggagcuuggaaacacguucagaggauugagaccuggauccugcggcauccuggcuucacaauaauggccgcaaucuuggccuacaccauuggcacgacucacuuucagcgcgcucucaucuucauucugcugacagcaguggccccauccaugaccaugagaugcaucgggauaucuaacagggauuuugucgaaggagugucggguggcucauggguagacauuguucucgagcacgggagcugugugacuacaauggcuaagaauaagcccaccuuagauuucgaacugaucaaaacggaggccaagcagccugcgacccuucggaaauauugcauugaagcaaaguugacaaacacuaccacagagagucgcuguccaacucaaggagagcccucccugaaugaagagcaggacaaacgauuuaucugcaagcauucuauggucgauagaggcugggguaacggguguggacuauucggcaagggcgggaucgugaccugcgccauguuuacaugcaaaaagaauauggaaggaaaagugguccagccugagaaccucgaauacaccauuguuauaacuccacacagcggugaggagcaugcugugggcaaugacacggggaagcacggaaaagaaaucaagauuacaccgcaguccucaaucaccgaggccgaacugacuggcuaugguaccguaacaauggaguguagucccaggaccgggcuugauuucaacgaaauggugcuguugcaaauggaggacaaagcauggcucguccaccggcagugguuucuggauuuaccucugccauggcuccccggcgcugacacucagggaagcaauuggauacagaaggagacacuugugacguucaagaacccucaugccaaaaagcaagacguugugguccugggcucucaggaaggggcgaugcacaccgccuugacuggagcaacagagauucagauguccucagguaaucuacuguuuaccggccaucucaaaugccgucugcgcauggauaagcuucaacugaaagggaugagcuacaguauguguacaggaaaguucaagaucgugaaagaaaucgcugagacucagcacggcaccauuguaaucagaguucaguaugagggugacgggucuccaugcaagauucccuucgaaauaacggauuuggagaaaaggcaugugcucggccggcugaucaccgucaacccgauugugacagaaaaggacuccccugucaacaucgaggccgaacccccauuuggagauagcuacaucauuauaggcguggagccugggcaguuaaaacugaauugguucaagaagggaucgucuaucggucaaauguuugagacuaccaugcgaggcgcuaaacgcauggccauucuaggggacacagcaugggauuucggaucccucggcgguguuuuuacuucaaucgggaaggcccugcaccagguguucggcgcuauuuacggagcggcauuuaguggcguaagcuggaccaugaaaauccuuauaggggucaucauuacguggaucggaaugaacuccagaucuacaagcuugucagugagucugguucucgugggcgucgugacccuguaucuuggugccguagugcaggcugacuccggguguguugucagcuggaagaauaaagaacugaagugcggaucuggcauuuucaucacugauaacgugcacacauggaccgagcaguacaaguuucaacccgaaucaccaaguaaauuggccagcgcaauacagaaggcccaugaggaagguauuuguggcaucagguccgugacucggcucgagaaucugauguggaaacagauuacccccgaguuaaaccacauccugucugaaaaugaggucaagcuaacaauaaugacgggggacaucaaaggaauuaugcaggcuggcaagcgcucgcucagaccucaaccaaccgaacugaaauauagcuggaagacuugggggaaggccaaaaugcuuuccacagagucacauaaccagaccuucuugaucgauggaccggaaacagcagagugccccaauacuaacagggcguggaauagucuggagguugaagacuacggcuuugguguguucaccacgaacauuuggcucaagcugcgugagaaacaggacguguuuugugauucuaaguuaaugagcgcugccaucaaagacaaucgggcaguacacgccgauaugggguauuggauagaauccgcucugaacgacacauggaagauggagcgagccucauucauugaggucaagagcugccacuggccuaaaucucauacccuuugguccaauggaguguuggaaagugagaugaucaucccaaagaacuucgcaggccccguuagccagcacaacuacagaccugguuaucauacucaaaccgcuggcccauggcaccucgggaaacuggaaauggauuuugacuucugugagggaacaacuguggucgugaccgaagauugcggcaauagggggcccucucuacgcacaacgaccgccuccggaaagcugauuacugaguggugcugucggucaugcacacucccgccucugagauacaggggcgaggacgguuguugguacgggauggaaauccgcccacuuaaagagaaggaagagaacuugguuaauagucuggugaccgcgggacauggccagauugauaacuuuagcuuagguguacucggcauggcccuguuccuugaagagaugcugcgaacucggauagggacaaagcacgcuaucuugcucgucgcagugucguuugugacccugauuacgggaaauauguccuuccgugaccuaggcagagucaugguuauggugggggccacuaugaccgaugacaucggaaugggcguaacauaucuggcucuccuggccgcauuuaaagugaggcccaccuucgcggccggucuuuugcugcgcaaguuaacuucuaaagagcucaugauggcuacaauugggaucgcccugcuuagccagucaaccauaccugaaacaauccuggagcuaacugaugcacucgcucugggaaugauggucuugaagauugugcggaacauggaaaaauaccaacuggccguuaccaucauggcaauuaguugcgugcccaaugccgucaucuuacagaacgcuuggaagguguccuguacgauacucgcggccguuucugugagcccacugcuucugacauccucacagcagaaggcagacuggauuccuuuggcucucaccaucaaaggccugaaucccacugccaucuuucuaaccacacugagcagaacuaguaagaaaaggucuuggccacuuaacgaggccauuauggcugucggcaugguauccauacucgcaagcucgcuguugaagaaugacaucccgaugaccgggccucugguggccggagguuuacucacgguuugcuaugugcugacaggccgaucagcggaucuugaacuggagcgcgcugccgacgucaaaugggaggaucaagcagaaauuucugggaguucccccaucuugagcauuaccaucucugaggacggaagcauguccauaaagaacgaagaggaggaacagacucucacaauccugauucggaccggccuacuggugaucucagguguauucccagugaguauucccaucacugccgcugcaugguaccuuugggaggucaaaaagcagagagccgggguucucugggaugugccuagcccacccccuguggaaaaggcggagcuggaagacggagcuuauaggauaaaacagcguggcauuuugggcuacucucaaaucggggccggagucuauaaggaggguacauuucacaccauguggcaugugacgcgcggcgcaguuuuaaugcaccgggggaaaagaaucgagccguccugggccgauguaaagaaagaccugauuucauacggaggcgguuggaagcucgaaggggaguggaaggaaggagaggaagugcagguccuggcucuugagccaggcaaaaaucccagggccgugcagacuaagccuggcaucuucaaaaccaacacagggaccauaggagcaguuagucuggauuuuagcccagguacauccggcucucccauuguggaccgaaaggggaaagucgugggauuguacggcaaugguguagucacucggucgggggcuuaugugagcgccaucgcgcagaccgagaagucaauugaagauaacccugagaucgaagacgauauauuccgcaagaaaagacuaacgauuauggaccugcauccgggagccggcaagacaaaaagguaccuccccgcaaucguucgggaggcuaucaagcgaggccugagaacucuuauuuuagccccaacccgcguggucgcugcagaaauggaggaggcccugagggggcucccuauccguuaucaaacacccgccauuaaaaccgaacacacuggacgggagauaguggacuugaugugucaugcuaccuucacaaugagacugcucuccccaguuagggugccuaacuacaaucugaucauuauggaugaagcgcacuuuacggaccccgcaaguaucgccgcucgcgguuauaucucuacucgagucgagaugggcgaggccgcagggauuuucaugaccgccacaccaccgggaagcagagauccuuuuccccaguccaacgcuccaauaauggacgaagagcgggaaauccccgagaggucauggaauucuggccacgaaugggugaccgauuucaaggguaagacuguaugguuugugccuagcauuaaagcggggaacgacaucgccgcaugccuucgcaagaauggaaaaaagguuauucagcugagucguaaaacauucgauuccgaguacgucaagaccagagcuaacgacugggauuuuguggugacgacugacaucagcgagaugggcgccaauuucaaggcagaacgggucauagauccaaggcgcuguaugaaacccguaaucuugacagacucugaggaacgagugauucuagccggcccuaugccgguuacccauucauccgcugcccaaagacgggggaggaucggacgcaacccaaagaaugagaacgaccaguauauuuacaugggugaaccccuggagaaugaugaggacugcgcgcacuggaaagaagcaaagaugcucuuagauaacaucaauaccccugagggcauaauucccaguauguuugaaccagagagagaaaaaguggacgccaucgauggggaguacaggcugcggggagaggcucguaagacuuucgucgaccuuaugcgccgaggcgaucugccuguguggcucgccuauaaaguugcugcagaagguauuaacuacgccgacagaaagugguguuuugaugggaucaagaauaaccagauauuggaggaaaacauggagguggagaucuggacaaaagaaggcgagaggaagaaacugaagccccgguggcucgacgcucgcauuuauagcgauccacuggcccuuaaagaauucaaggaguucgcagcgggaagaaagucgcuaacccugaauuugaucacagaaaugggcagguuaccuacuuuuaugacgcagaaagcccggaacgcucuggacaaucucgccguccugcauaccgcagaggcugggggacgagccuacaaccacgcacuuucugagcugccggaaacacucgagacuuugcugcuacugacccuccuugccacagugaccgguggcauuuuccuguuuuuaauguccgggaagggaaucggcaaaaugacuuuggguaugugcugcauaauuacggcuagcauccugcucugguaugcgcaaauccagccccacuggauugccgcaucaaucauacuggaauucuuucuuauuguacugcucaucccagagccugaaaagcagagaaccccccaggauaaucaauugacauacgugguuauugcuauccugacugucguggccgccaccauggcaaacgagaugggguucuuagagaaaacaaagaaggaccuaggccugggaaguauaaccacucaggaaucugaguccaauauccucgacauugaucuucgcccagcuagcgccuggacacuguaugcgguggcuacgaccuuugucacuccuauguugaggcauucaaucgaaaacaguagcguuaaugugucccugacagccauugcaaaccaggccaccguacucaugggccuggggaaaggauggccccuuucuaagauggacaucggugugccgcuccuggcuaugggcuguuacagccaguucaaaccaauuaccuugacagcagcccuguuacuacuggucgcgcacuacgcuaucauagggccuggacuccaagccaaggcaacucgggaggcccagaaacgugcugccgcaggcauuaugaagaaucccacgguggaugguaucaccguuaucgaccuugaaccaauucccuaugauccuaaguuugagaaacagcuggggcaggugauguugcugauacucugcgucacacaaguacugaugaugagaacuaccugggcucuuugugaggccuuaacacuggcgaccggcccgaucuccacucucugggaaggaaaccccggcagguucuggaauacgacaauugccgugucaauggcaaacaucuuucgcgggucuuacuuggcuggagccggccugcuauucaguauuaugaagaauaccacuucgacccggcgagguacagggaacaucggagagacucugggcgaaaaauggaagagcagacucaaugcacuugguaaauccgaguuucagauauauaagaaaucuggcauccaggagguugacaggacccuggcuaaggaagggauuaagcgcggagagacagaucaucacgccgugucacggggcagcgccaaauugagaugguucgucgaacguaacauggugacgccagaggggaaggucguggaccugggaugcggcaggggugggugguccuacuauuguggaggccucaaaaacguucgggaagugaagggucugaccaaaggcgggccuggacaugaggagcccaucccuaugaguacuuacggcuggaauuuaguacgccuucaaucugggguggaugucuucuuuacaccacccgaaaagugcgacacccugcucugugauauuggagagagcucaccuaacccaacuaucgaagcgggccgaacacuaagaguucugaauuugguggagaacuggcugaauaacaauacccaguucugcauaaagguccucaaccccuauaugccguccgugauugaaaaaauggaggcucuucagaggcaguacgguggggcacugguacggaauccuuugagucgcaacagcacgcacgagauguacugggugucuaaugccaccggaaacaucguuuccucagugaauaugaucagcagaaugcugauuaacagguuuacaaugaagcacaaaaaggcuacuuaugaaccagacgucgaucucggcucgggcacccgaaauauagggaucgagucugaaauucccaacuuagacaucauuggaaaacggaucgagaagauaaagcaagaacaugagaucaguuggcacuacgaccaggaucauccuuauaaaacaugggccuaccacgguuccuaugagacuaagcagaccggcagcgcaucauccauggugaacggggucgugcgucugcuuacaaaaccaugggacguuguacccauggugacccagauggccaugacugauacgacaccguucggacaacagagagucuuuaaggaaaaaguggacacccgcacucaggagccuaaggaaggcaccaagaaacugaugaagauuacagcugaguggcuauggaaagagcucgguaagaaaaagacgcccaggauguguacccgggaagaguucacuaaaaagguuagaucuaaugcggcccugggggcaaucuuuacagaugaaaacaaguggaaaagcgcucgcgaggccguggaagacggaagguucugggaguuggucgaucgagagcggaaucugcaccucgaaggcaagugcgagaccuguguguacaacaugaugggcaaaagagaaaagaaacuuggggaguuuggaaaggcaaaggguaguagggccauuugguauauguggcugggcgcucgcuucuuagaauuugaggcccugggguucuugaaugaggaccauugguuuucccguggaaacagccucucuggcguagaaggugaggggcugcaccggcuaggauacauccuuagagaugugggcaaaaaggaaggcggggcgauguacgcagacgauacugccggaugggacacaaggauuacccuggaggaccucaaaaaugaagagaugguuacaaaccauaugaagggugagcacaaaaagcuggcugaagccauauucaaguugacuuaucagaauaaagucgugcgcgugcaacgaccaaccccucggggcacggucauggauaucauuucaagaagggaccagcgcgggaguggacagguuggcaccuacggucugaacacauucacuaauauggaggcacaacucaucagacagauggaaggggagggaaucuuuaaguccauucagcaucuuaccgcuacagaggaaauagccgugcagaacuggcuggcucggguaggcagggagcguuuaagccgaauggccaucucuggcgaugacugcguggucaaacccauugaugaccgcuucgcaucggcgcugacugccuugaaugauauggggaaggugagaaaagacauccaacagugggaaccaucacggggauggaacgauuggacccagguucccuuuugcagccaccacuuccaugagcucgugaugaaggacgguaggguccuggugguaccuugucgcaaucaggaugaacuaauuggcagagcucggaucucccaaggggccggauggagucuuaaggagacggcaugccugggcaaaucuuaugcucagauguggacacucauguacuuucacaggcgagaccugcguuuggccgcaaacgccauauguagcgcgguuccaucccauugggugccgaccucaagaacuacauggaguauccacgcuaagcacgaguggaugaccacugaagauauguuagccgucuggaaccgcguguggauucaggagaaucccuggauggaagacaaaaccccuguggagucuugggaagaggucccauaucuggguaagcgggaggaccaguggugcgggagccucaucggacuuacauccagggcaacgugggccaaaaacauucaaaccgcuaucaaucagguuagaucacugauaggcaacgaagaguacacugauuauaugcccagcaugaagcgcuuccggagggaagaggaagaggccggcgugcuaugguga

SEQ ID NO: 14517 - RNA, 9876 nt, Artificial Sequence
  derived and/or modified CDS sequence (opt3) from DENV-2__FJ850118__SS-prME
accgccggagugaucgucaugcugauucccaccgcuauggcauuccaccucacuacgagaaauggggagccucauaugauaguuggaaggcaggaaaaggguaaaagccuucuguuuaagaccgaggacggcgugaauaugugcacauugauggccaucgauuuaggggaacugugugaggacacuauuaccuacaaaugcccacuacuccggcaaaacgaaccggaggauaucgacuguuggugcaauuccacaucuaccuggguaacuuauggaacauguaccacgacuggcgagcaccgccgagaaaagcguucaguggcgcuggucccccauguggguauggggcuugagaccaggacagaaacuuggaugaguagcgagggagcuuggaaacacguucagaggauugagaccuggauccugcggcauccuggcuucacaauuauggccgcaaucuuggccuacaccauuggcacgacucacuuucagcgcgcucucaucuucauucugcugacagcaguggccccauccaugaccaugagaugcaucgggauaucuaacagggauuuugucgaaggagugucggguggcucauggguagacauuguucucgagcacgggagcugugugacuacaauggcuaagaauaagcccaccuuagauuucgaacugaucaaaacggaggccaagcagccugcgacccuucggaaauauugcauugaagcaaaguugacaaacacuaccacagagagucgcuguccaacucaaggagagcccucccugaaugaggaacaggacaaacgauuuaucugcaagcauucuauggucgauagaggcugggguaacggguguggacuauucggcaagggcgggaucgugaccugcgccauguuuacaugcaaaaagaauauggaaggaaaagugguccagccugagaaccucgaauacaccauuguuauaacuccacacagcggugaggagcaugcugugggcaaugacacggggaagcacggaaaagaaaucaagauuacaccgcaguccucaaucaccgaggccgaacugacuggcuaugguaccguaacaauggaguguagucccaggaccgggcuugauuucaacgaaauggugcuguugcaaauggaggacaaagcauggcucguccaccggcagugguuucuggauuuaccucugccauggcuccccggcgcugacacucagggaagcaauuggauacagaaggagacacuugugacguucaagaacccucaugccaaaaagcaagacguugugguccugggcucucaggaaggggcgaugcacaccgccuugacuggagcaacagagauucagauguccucagguaaucuacuguuuaccggccaucucaaaugccgucugcgcauggauaaacuucaacugaaagggaugagcuacaguauguguacaggaaaguucaagaucgugaaagaaaucgcugagacucagcacggcaccauuguaaucagaguucaguaugagggugacgggucuccaugcaagauucccuucgaaauaacggauuuggagaaaaggcaugugcucggccggcugaucaccgucaacccgauugugacagaaaaggacuccccugucaacaucgaggccgaacccccauuuggagauagcuacaucauuauaggcguggagccugggcaguuaaaacugaauugguucaagaagggaucgucuaucggucaaauguuugagacuaccaugcgaggcgcuaaacgcauggccauucuaggggacacagcaugggauuucggaucccucggcgguguuuuuacuucaaucgggaaggcccugcaccagguguucggcgcuauuuacggagcggcauuuaguggcguaagcuggaccaugaaaauccuuauaggggucaucauuacguggaucggaaugaacuccagaucuacuagcuugucagugagucugguucucgugggcgucgugacccuguaucuuggugccaugguacaggcugacuccgggugugugguuagcuggaagaauaaagaacugaagugcggaucuggcauuuucaucacugauaacguccacacauggaccgagcaguacaaguuucaacccgaaucaccaaguaaauuggccagcgcaauacagaaggcccaugaggaagguauuuguggcaucagguccgugacucggcucgagaaucugauguggaaacagauuacccccgaguuaaaccacauccugucugaaaaugaggugaagcuaacaauaaugacgggggacauccgcggaauuaugcaggcuggcaaaagaucgcucaggccucaaccaaccgaacugaaguauagcuggaaaacuugggggaaggccaagaugcuuuccacagagucacauaaccagaccuucuugaucgauggaccggaaacagcagagugccccaauacuaaccgugcguggaauagucuggaggucgaagacuacggcuuugguguuuucaccacgaacauuuggcucaaacugcgggagaagcaggacguguuuugugauucuaaauuaaugagcgcugccaucaaggacaaucgagcagugcacgccgauaugggguauuggauagaauccgcucugaacgacacauggaaaauggagaaggccucauucauugagguaaagagcugccacuggccuaaaucucauacccuuugguccaauggagucuuggaaagugagaugaucaucccaaagaacuucgcaggccccgugagccagcacaacuacagaccugguuaucauacucaaaccgcuggcccauggcaccucgggaaacuggaaauggauuuugaccuaugugagggaacaacuguuguggucaccgaagauugcggcaauagggggcccucucugcgcacaacgaccgccuccggaaagcucauuacugaguggugcugucggucaugcacacugccgccucuuagauacaggggcgaggacgguuguugguacgggauggaaauccgcccauugaaagagaaggaagagaaccuggugaauaguuuaguuaccgcgggauauggccagauugauaacuucagccucggugugcugggcauggcccuuuuucuggaagagauguugcgaacucggauagggacaaagcaugcuauccuccugguagcagucucguucgugacccuaauuacgggaaauauguccuuucgugaccugggcagagugauggucaugguuggggccacuaugaccgaugacaucggaaugggcgugacauaccucgcucugcuugccgcauucaaaguaaggcccaccuuugcggccgguuugcuguuacgcaagcucacuucuaaagagcugaugauggcuacaauugggaucgcccuucugagccagucaaccauaccugaaacaauccuagagcucacugaugcacuggcuuugggaaugauggugcugaagauuguccggaacauggaaaaauaucaauuagccgugaccaucauggcaauuaguugcguucccaaugccgugauccuccagaacgcuuggaaggucuccuguacgauacuggcggccgugucuguuagcccacuucuguugacauccucacagcagaaggcagacuggauuccucucgcucugaccaucaaaggccuaaaucccacugccaucuuccugaccacacuuagcagaacaaguaagaaaaggucuuggccacucaacgaggccauuauggcugugggcauggucuccauacuggcaagcucguugcugaagaaugacaucccgaugaccgggccuuuaguagccggaggucuccugacggugugcuacguucuuacaggccgaucagcggaucuggaauuggagcgcgcugccgacgugaaaugggaggaucaagcagaaauuucugggaguucccccauccucagcauuaccaucucugaggacggaagcauguccauaaagaacgaagaggaggaacagacucugacaauccuaauucggaccggccugcuugucaucucagguguguuuccaguaaguauucccaucacugccgcugcaugguaucucugggaggugaaaaagcagagagccgggguccugugggauguuccuagcccacccccuguggaaaaggcggaguuggaagacggagcuuacaggauaaaacagcguggcauuuuaggcuauucucaaaucggggccggaguguacaaggaggguacauuccacaccauguggcacgucacgcgcggcgcagugcugaugcaucgggggaaaagaaucgagccguccugggccgauguuaagaaagaccucauuucauacggaggcgguuggaagcuggaaggggaguggaaggaaggagaggaaguacaggugcuugcucuggagccaggcaaaaaucccagggccguccagacuaagccuggcaucuuuaaaaccaacacagggaccauaggagcagugaguuuggauuucagcccagguacauccggcucucccauuguugaccgaaaggggaaaguggucggacuauauggcaauggugugguaacucggucgggggcuuacgucagcgccaucgcgcagaccgagaagucaauugaagauaacccugagaucgaagacgauauauuucgcaagaaaagacugacgauuauggaccuccacccgggagccggcaagacaaaaagguaucugcccgcaaucgugcgggaggcuaucaagcgaggccuuagaacuuuaauucuggccccaacccgcguuguggcugcagaaauggaggaggcccucaggggguugccuauccguuaccaaacacccgccauuaaaaccgaacauacuggacgggagauagucgaccugaugugucacgcuaccuucacaaugagacuccuguccccagugaggguuccuaacuauaaucuuaucauuauggaugaagcgcauuucacggaccccgcaaguaucgccgcucgcgguuacaucucuacucgaguggagaugggcgaggccgcagggauuuuuaugaccgccacaccaccgggaagcagagauccuuucccccaguccaacgcuccaauaauggacgaagaacgggaaauccccgagaggucauggaacucuggccacgaaugggucaccgauuuuaaggguaagacugugugguucguaccuagcauuaaagcggggaacgacaucgccgcaugccugcgcaagaauggcaagaaggugauucaguugagucguaaaacauuugauuccgaguauguuaagaccagagcuaacgacugggauuucgucgugacgacugacaucagcgagaugggcgccaauuuuaaggcagaacgggugauagauccaaggcgcuguaugaaacccgucauccuaacagacggcgaggaacgaguaauucuggccgggccuaugccggugacccacucuucagcugcccaaagacggggaaggaucggucgcaacccaaagaaugagaacgaccaguacauuuacaugggcgaaccccucgagaaugaugaggacugcgcgcauuggaaagaagcaaagauguuacuggauaacaucaauaccccugaggggauaauucccuccauguucgaaccagagagagaaaaaguugacgccaucgauggagaguauaggcuucggggcgaggcucguaagacuuuuguggaccugaugcgccgaggugaucucccugucugguuggccuacaaaguggcugcagaagggauuaacuaugccgacagaaagugguguuucgauggcaucaagaauaaccagauacuggaggaaaacauggagguugagaucuggacaaaagaaggagagaggaagaaacucaagccccgguggcuggacgcucgcauuuacagugauccacuugcccuaaaagaauuuaaggaguucgcagcgggcagaaagagccugaccuugaauuuaaucacagaaauggggaggcugccuacuuucaugacgcagaaagcccggaacgcucucgacaaucuggccgugcuucacaccgcagaggcuggaggucgagccuauaaccaugcacugucggagcucccggaaacauuggagacucugcuacugcucacccuucuggccacagucaccggcgggauauuuuuauucuugaugucuggaaagggcaucgguaaaaugacucuggggaugugcugcauaauuacggcuuccauccuccugugguacgcgcaaauccagccccacuggauugccgcaagcaucauacuugaauuuuuccugauugugcucuugaucccagagccugaaaagcagagaacaccccaggauaaucaacugacauauguagugauugcuaucuuaacuguugucgccgccaccauggcaaacgagaugggcuuucuagagaaaacaaagaaggaccugggacucggcucaauaaccacucaggaaagugagucuaauauccuugacauugaucugcgcccagcuuccgccuggacauuguacgcgguggcuacgaccuucgugacuccuaugcugaggcacagcaucgaaaacucaagugucaauguuagccucacagccauugcaaaccaggccaccgugcugauggggcuuggaaaagguuggccccucuccaagauggacaucggcguaccgcuguuggcuauuggguguuacucucaggugaauccaaucacccugacagcagccuuacuacugcucgucgcgcauuaugcuauaauuggaccuggccuucaagccaaagcaacucgggaggcccagaagcgugcugccgcagguaucaugaaaaaccccacgguggaugggaucaccguuauugaccuggaaccaauacccuacgauccuaaguuugagaagcaguugggccaggugaugcugcucauccugugcgucacacaaguacuuaugaugagaacuaccugggcuuuaugugaggcccugacacucgcgaccggaccgauuagcacuuugugggaaggcaaucccgggagguucuggaacacgacaaucgccguguccauggcaaauauuuuucgcggaucauaucuggcuggcgccggucuacuguucucuaucaugaaaaacaccacuaauacccggcgagggacaggaaacauaggcgagacucucggugaaaaguggaaaaguagacuuaacgcacugggcaagucggaguuucagaucuacaaaaagagcgggauucaggagguugacaggaccuuggcuaaagaaggaaucaagcgcggcgagacagaucaccaugccgugucccgggggucugccaagcugagaugguucgucgaacguaauauggugacgccagagggaaaagucguggaccucggcugcgguagagggggauggucauauuacuguggcggucugaagaacguucgggaagugaaaggcuuaaccaaagggggaccuggccacgaggagcccauuccuaugagcacuuauggguggaaucuuguacgccugcaauccggaguggaugucuuuuucacaccacccgaaaaaugcgacacccuccuaugugauaucggcgagaguucuccuaacccaacuauagaagcgggucgaacacugagaguuuugaaucugguggagaacuggcucaauaacaauacccaguucugcauuaagguccuuaaccccuacaugccgagcgugaucgaaaagauggaggcucugcagaggaaauacgggggagcauugguacggaauccucugucacgcaacuccacgcaugagauguauugggugaguaaugccaccggcaacaucguuagcucugugaauaugauuuccagaaugcucauaaacagguuuacaaugaagcacaaaaaggcuacuuacgaaccagacgucgauuuaggcucagggacccgaaacaucggaauugagagcgaaauccccaaucuggacauuaucgguaaacggauagagaagaucaagcaggaacacgagacaucguggcauuaugaccaagaucacccuuacaaaacuugggccuaucauggcucuuacgagaccaagcagacagggagugcauccagcauggugaacggagucgugcgucuucugaccaaaccaugggacguuguacccauggugacucagauggccaugacggauacaaccccguucggccagcaaagagucuuuaaggaaaaaguggacacucgcacccaggagccuaaggaagguacaaagaaacuaaugaagauuacggcugaguggcucuggaaagagcuggggaagaaaaagacccccaggauguguacucgggaagaguucacaagaaaaguucgcucaaaugcggccuugggagcaaucuuuaccgaugaaaacaaguggaaguccgcuagggaggccguggaagacggccgauucugggagcuggucgaucgggagagaaaucuccaccuugaaggcaaaugcgagacuuguguguauaacaugauggggaagagggagaagaagcugggagaguuugguaaagcaaagggcucucgcgccauuugguacaugugguuaggggcucguuuccuggaauuugaggccuugggauuccucaaugaggaccacugguuuagccggggcaacagucuguccgguguagaaggggagggacuacauagacuuggcuacauccugagggaugugggcaagaaagaagggggagcgauguaugcagacgauacagccgguugggacacccgcauuacacucgaggaccugaagaaugaagagaugguuacuaaccacaugaaaggcgagcauaagaaauuggcugaagccauauucaagcugaccuaccagaauaaggucgugcgagugcagcggccaacgccuagagggaccgucauggauaucauuagcaggcgcgaccaaagaggaucuggccagguugguacauaugggcucaacacuuuuaccaauauggaggcacagcuuauccggcaaauggaaggagagggcaucuucaaaucaauucagcaccugacagcuacugaggaaauagccgugcagaacugguuagcuaggguaggccgugagcgacugagucgcauggccaucuccggggaugacugcguggucaagcccauugaugacagauucgcaagcgcguugaccgcccucaaugauaugggaaaagugcggaaggacauccagcaaugggaaccaucuagggguuggaacgauuggacgcagguucccuuuugcucgcaucacuuccacgagcuggugaugaaagacggccgcguccuagugguaccuuguagaaaccaggaugaacuuauugggcgggcuaggaucucacagggagccggcuggagccugaaggagacagcaugccucgguaaguccuacgcucaaauguggacccugauguauuuucaucgacgugacuugagauuagccgcaaaugccauauguagugcgguuccaccgcacugggugcccacuucucgcacaaccuggagcauccaugcuaaacacgaguggaugacuaccgaagauaugcuggccgucuggaaccggguguggauucaggagaauccuuggauggaagacaagacaccaguggaguccugggaagagguccccuaccucgggaaaagggaggaccaguggugcggaucacuuaucggccugacgaguagagcaaccugggccaagaacauucagacugcuaucaaucaaguucgcucucuaauaggcaacgaagaguauacagauuacaugccuagcaugaaacgguucaggcgagaagaggaagaggccggggugcugugguga

SEQ ID NO: 14518 - RNA, 9876 nt, Artificial Sequence
  derived and/or modified CDS sequence (opt3) from DENV-2__JN819416__SS-prME
accgccggcgugauagucaugcugauucccacagcuauggcauuccaccucacuacgagaaacggggagccucauaugauaguuggaaggcaggaaaaggguaaaagccuucuguuuaagaccgaggacggcgugaauaugugcacauugauggccaucgauuuaggggaacugugugaggacacuauuaccuacaaaugcccacuacuccggcaaaacgaaccggaggauaucgacuguuggugcaauuccacaucuaccuggguaacuuauggaacauguaccacgacuggcgagcaccgccgagaaaagcguucaguggcgcuggucccccauguggguauggggcuugagaccagaacagaaacuuggaugaguagcgagggagcuuggaaacacguucagaggauugagaccuggauccugcggcauccuggcuucacaauuauggccgcaaucuuggccuacaccauuggcacgacucacuuucagcgcgcucucaucuucauucugcugacagcaguggccccauccaugaccaugagaugcaucgggauaucuaacagggauuuugucgaaggagugucggguggcucauggguagacauuguucucgagcacgggagcugugugacuacaauggcuaagaauaagcccaccuuagauuucgaacugaucaaaacggaggccaagcagccugcgacccuucggaaauauugcauugaagcaaaguugacaaacacuaccacagagagucgcuguccaacucaaggagagcccucccugaaugaagaacaggacaaacgauuuaucugcaagcauucuauggucgauagaggcugggguaacggguguggacuauucggcaagggcgggaucgugaccugcgccauguuuacaugcaaaaagaauauggaaggaaaagugguccagccugagaaccucgaauacaccauuguuauaacuccacacagcggugaggagcaugcugugggcaaugacacggggaagcacggaaaagaaaucaagauuacaccgcaguccucaaucaccgaggccgaacugacuggcuaugguaccguaacaauggaguguagucccaggaccgggcuugauuucaacgaaauggugcuguugcaaauggaggacaaagcauggcucguccaccggcagugguuucuggauuuaccucugccauggcuccccggcgcugacacucagggaagcaauuggauacagaaggagacacuugugacguucaagaacccucaugccaaaaagcaagacguugugguccugggcucucaggaaggggcgaugcacaccgccuugacuggagcaacagagauucagauguccucagguaaucuacuguuuaccggccaucucaaaugccgucugcgcauggauaaacuucaacugaaagggaugagcuacaguauguguacaggaaaguucaagaucgugaaagaaaucgcugagacucagcacggcaccauuguaaucagaguucaguaugagggugacgggucuccaugcaagauucccuucgaaauaacggauuuggagaaaaggcaugugcucggccggcugaucaccgucaacccgauugugacagaaaaggacuccccugucaacaucgaggccgaacccccauuuggagauagcuacaucauuauaggcguggagccugggcaguuaaaacugaauugguucaagaagggaucgucuaucggucaaauguuugagacuaccaugcgaggcgcuaaacgcauggccauucuaggggacacagcaugggauuucggaucccucggcgguguuuuuacuucaaucgggaaggcccugcaccagguguucggcgcuauuuacggagcggcauuuaguggcguaagcuggaccaugaaaauccuuauaggggucaucauuacguggaucggaaugaacuccagaucuacuagcuugucagugagucugguucucgugggcgucgugacccuguaucuuggugccaugguacaggcugacuccgggugugugguuagcuggaagaauaaagaacugaagugcggaucuggcauuuucaucacugauaacguccacacauggaccgagcaguacaaguuucaacccgaaucaccaaguaaauuggccagcgcaauacagaaggcccaugaggaagguauuuguggcaucagguccgugacucggcucgagaaucugauguggaaacagauuacccccgaguuaaaccacauccugucugaaaaugaggugaagcuaacaauaaugacgggggacaucaaaggaauuaugcaggcuggcaagcgcucgcucagaccucaaccaaccgaacugaaauauagcuggaagacuugggggaaggccaaaaugcuuuccacagagucacauaaccagaccuucuugaucgauggaccggaaacagcagagugccccaauacuaacagggcguggaauagucuggaggucgaagacuacggcuuugguguuuucaccacgaacauuuggcucaagcugcgugagaaacaggacguguuuugugauucuaaguuaaugagcgcugccaucaaagacaaucgggcagugcacgccgauaugggguauuggauagaauccgcucugaacgacacauggaagauggagaaggccucauucauugagguaaaaagcugccacuggccuaagucucauacccuuugguccaauggagucuuggaaagugagaugaucauccccaagaauuucgcaggccccgugagccagcacaacuaccgaccugguuaucauacucaaaccgcuggcccauggcaccucgggaagcuggaaauggauuuugaccuaugugagggaacaacuguuguggucaccgaagauugcggcaauagagggcccucucugaggacaacgaccgccuccggaaaacucauuacugaguggugcugucgcucaugcacacugccgccucuucgguacagaggcgaggacgguuguugguacgggauggaaaucaggccauugaaggagaaggaagagaaccuggugaauaguuuaguuaccgcgggacauggccagauugauaacuucagccucggugugcugggcauggcccuuuuucuggaagagauguugcgcacucgaauagggacaaaacacgcuauccuccugguagcagucucguucgugacccuaauuacgggaaauauguccuuucgggaccugggccgugugauggucaugguuggggccacuaugaccgaugacaucggaaugggcgugacauaucucgcucugcuugccgcauucaagguaagacccaccuuugcggccgguuugcuguuaaggaaacucacuucuaaggagcugaugauggcuacaauugggaucgcccuucugagccagucaaccauaccugaaacaauccuagagcucacugaugcacuggcuuugggaaugauggugcugaaaauuguccgcaacauggaaaaguaccaauuagccgugaccaucauggcaauuaguugcguucccaaugccgugauccuccagaacgcuuggaaggucuccuguacgauacuggcggccgugucuguuagcccacuucuguugacauccucacagcagaaagcagacuggauuccucucgcucugaccaucaagggccuaaaucccacugccaucuuccugaccacacuuagccggacaaguaaaaagagaucuuggccacucaacgaggccauuauggcugugggcauggucuccauacuggcaagcucguugcugaaaaaugacaucccgaugaccgggccuuuaguagccggaggucuccugacggugugcuauguucuuacaggcaggucagcggaucuggaauuggagcgagcugccgacgugaagugggaggaucaagcagaaauuucugggaguucccccauccucagcauuaccaucucugaggacggaagcauguccaucaaaaacgaagaggaggaacagacucugacaauccuaauucgcaccggccugcuugucaucucagguguguuuccaguaaguauucccaucacugccgcugcaugguaccucugggaggugaagaagcagcgggccgggguccugugggauguuccuagcccacccccuguggaaaaagcggaguuggaagacggagcuuauagaauaaagcagaggggcauuuuaggcuacucucaaaucggggccggaguguauaaagaggguacauuccacaccauguggcaugucacgcguggcgcagugcugaugcaccgcgggaagcggaucgagccguccugggccgauguuaaaaaggaccucauuucauacggaggcgguuggaagcuggaaggggaguggaaagaaggagaggaaguacaggugcuugcucuggagccaggcaagaaucccagagccguccagacuaaaccuggcaucuuuaagaccaacacagggaccauaggagcagugaguuuggauuucagcccagguacauccggcucucccauuguugacaggaaagggaagguggucggacuauacggcaauggugugguaacucgaucgggggcuuaugucagcgccaucgcgcagaccgagaagucaauugaagauaacccugagaucgaagacgauauauuucggaaaaagcgccugacgauuauggaccuccauccgggagccggcaaaacaaagagauaccugcccgcaaucgugagggaggcuaucaaacggggccuucgaacuuuaauucuggccccaaccagaguuguggcugcagaaauggaggaggcccuccgcggguugccuaucagguaucaaacacccgccauuaagaccgaacacacuggacgugagauagucgaccugaugugucaugcuaccuucacaaugcggcuccuguccccagugagaguuccuaacuacaaucuuaucauuauggaugaagcgcacuucacggaccccgcaaguaucgccgcuagggguuauaucucuacucgcguggagaugggcgaggccgcagggauuuuuaugaccgccacaccaccgggaagccgagauccuuucccccaguccaacgcuccaauaauggacgaagagagagaaauccccgagcggucauggaacucuggccacgaaugggucaccgauuuuaaggguaaaacugugugguucguaccuagcauuaaggcggggaacgacaucgccgcaugccugaggaaaaauggaaagaaagugauucaguugagucgcaagacauuugauuccgaguacguuaagacccgugcuaacgacugggauuucgucgugacgacugacaucagcgagaugggcgccaauuuuaaagcagaaagagugauagauccacggagguguaugaagcccgucauccuaacagacggcgaggaacgcguaauucuggccgggccuaugccggugacccauucuucagcugcccaacgaagaggacggaucgguaggaaccccaaaaaugagaacgaccaguauauuuacaugggcgaaccccucgagaaugaugaggacugcgcgcacuggaaggaagcaaaaauguuacuggauaacaucaauaccccugaggggauaauucccuccauguucgaaccagagcgcgaaaagguugacgccaucgauggagaguacagacuuaggggcgaggcucggaaaacuuuuguggaccugaugcgucgcggugaucucccugucugguuggccuauaagguggcugcagaagggauuaacuacgccgaccgaaagugguguuucgauggcaucaaaaauaaccagauacuggaggaaaacauggagguugagaucuggacaaaggaaggagagaggaaaaagcucaaacccagauggcuggacgcucggauuuauagugauccacuugcccuaaaggaauuuaaggaguucgcagcgggccgcaaaagccugaccuugaauuuaaucacagaaauggggagacugccuacuuucaugacgcagaaggccaggaacgcucucgacaaucuggccgugcuucauaccgcagaggcuggaggucgggccuacaaccacgcacugucggagcucccggaaacauuggagacucugcuacugcucacccuucuggccacagucaccggcgggauauuuuuauucuugaugucuggaaaaggcaucgguaagaugacucuggggaugugcugcauaauuacggcuuccauccuccugugguaugcgcaaauccagccccacuggauugccgcaagcaucauacuugaauuuuuccugauugugcucuugaucccagagccugaaaaacagcgaaccccacaggauaaucaacugacauacguagugauugcuaucuuaacuguugucgccgccaccauggcaaacgagaugggcuuucuagagaagacaaagaaagaccugggacucggcucaauaaccacucaggaaagugagucuaauauccuugacauugaucugagaccagcuuccgccuggacauuguaugcgguggcuacgaccuucgugacuccuaugcugcgccauagcaucgaaaacucaagugucaauguuagccucacagccauugcaaaccaggccaccgugcugauggggcuuggaaaggguuggccccucuccaaaauggacaucggcguaccgcuguuggcuauuggguguuacucucaggugaauccaaucacccugacagcagccuuacuacugcucgucgcgcacuacgcuauaauuggaccuggccuucaagccaaggcaacuagggaggcccagaaacgggcugccgcagguaucaugaagaaccccacgguggaugggaucaccguuauugaccuggaaccaauacccuaugauccuaaguuugagaaacaguugggccaggugaugcugcucauccugugcgucacacaaguacuuaugaugcguacuaccugggcuuuaugugaggcccugacacucgcgaccggaccgauuagcacuuugugggaaggcaaucccgggagauucuggaacacgacaaucgccguguccauggcaaauauuuuuaggggaucauaccuggcuggcgccggucuacuguucucuaucaugaagaacaccacuaauacccgccgggggacaggaaacauaggcgagacucucggugaaaaauggaagagucgacuuaacgcacugggcaaaucggaguuucagaucuauaagaaaagcgggauucaggagguugacagaaccuuggcuaaggaaggaaucaagaggggcgagacagaucaucacgccgugucccgcgggucugccaaacugcggugguucgucgaaagaaauauggugacgccagagggaaaggucguggaccucggcugcggucgugggggauggucauacuauuguggcggucugaaaaacguuagggaagugaagggcuuaaccaaagggggaccuggccaugaggagcccauuccuaugagcacuuacggguggaaucuuguacggcugcaauccggaguggaugucuuuuucacaccacccgaaaagugcgacacccuccuaugugauaucggcgagaguucuccuaacccaacuauagaagcgggucgcacacugcgaguuuugaaucugguggagaacuggcucaauaacaauacccaguucugcauuaagguccuuaaccccuauaugccgagcgugaucgagaaaauggaggcucugcagagaaaguacgggggagcauugguaaggaauccucugucacggaacuccacgcacgagauguacugggugaguaaugccaccggcaacaucguuagcucugugaauaugauuucccgcaugcucauaaacagauuuacaaugaaacacaagaaagcuacuuaugaaccagacgucgauuuaggcucagggaccaggaacaucggaauugagagcgaaauccccaaucuggacauuaucgguaagcgaauagagaagaucaaacaggaacaugagacaucguggcacuacgaccaagaucauccuuauaagacuugggccuaccacggcucuuaugagaccaaacagacagggagugcauccagcauggugaacggagucgugcggcuucugaccaagccaugggacguuguacccauggugacucagauggccaugacggauacaaccccguucggccagcaacgugucuuuaaagaaaagguggacacuagaacccaggagccuaaggaagguacgaaaaagcuaaugaaaauuacagcugaguggcucuggaaggagcuggggaaaaagaaaaccccacgcauguguacuagggaagaguucacacggaagguuagaucaaaugcggccuugggagcaaucuuuaccgaugaaaacaaguggaaauccgcucgcgaggccguggaagacucuagguucugggagcuggucgaucgagagcggaaucuccaccuugaaggcaagugcgagacuuguguguacaacaugaugggcaaaagagaaaagaaacugggggaguuuggaaaggcaaaggguagcagggccauuugguauaugugguuaggcgcucgcuuccuggaauuugaggccuugggguuccucaaugaggaccauugguuuagucguggaaacucccugagcggcguagaaggugaggggcuacaccggcuuggauacauccugagagaugugggcaaaaaggaaggcggggcgauguacgcagacgauacagccggaugggacaccaggauuacacucgaggaccugaaaaaugaagagaugguuacuaaccauaugaagggugagcacaaaaaguuggcugaagccauauucaagcugaccuaucagaauaaagucgugcgcgugcagcgaccaacgccucggggcaccgucauggauaucauuucuagaagggaccaacgcgggucaggacagguuggcacauacggucucaacacuuuuaccaauauggaggcacagcuuaucagacaaauggaaggggagggaaucuucaagaguauucagcaucugacagcuacugaggaaauagccgugcagaacugguuagcucggguaggcagggagcgucugucccgaauggccaucagcggcgaugacugcguggucaaacccauugaugaccgcuucgcaucugcguugaccgcccucaaugauauggggaaggugagaaaagacauccagcaaugggaaccaucgcggggauggaacgauuggacgcagguucccuuuugcucacaccacuuccaugagcuggugaugaaggacgguaggguccuagugguaccuugucgcaaccaggaugaacuuauuggcagagcucggaucagccagggggccggauggucccugaaggagacagcaugccucggcaaaaguuaugcucaaauguggacccugauguacuuucacaggcgagacuugcguuuagccgcaaaugccauauguucugcgguuccaccgcauugggugcccacuagcagaacaaccugguccauccacgcuaagcacgaguggaugacuaccgaagauaugcuggccgucuggaaccgcguguggauucaggagaauccuuggauggaagacaaaacaccaguggagucaugggaagagguccccuaucucgguaagcgggaggaccaguggugcgggagucuuaucggacugacgucuagggcaaccugggccaaaaacauucagacugcuaucaaucaaguuagaagccuaauaggcaacgaagaguacacagauuauaugccuuccaugaagcgcuuccggagggaagaggaagaggccggcgugcugugguga

SEQ ID NO: 14519 - RNA, 9876 nt, Artificial Sequence
  derived and/or modified CDS sequence (opt3) from DENV-2__FJ850119__SS-prME
accgccggcgugauagucaugcugauucccacggcuauggcauuccaccucacuacgagaaacggggagccucauaugauaguuggaaggcaggaaaaggguaaaagccuucuguuuaagaccgaggacggcaucaauaugugcacauugauggccauugauuuaggggaacugugugaggacacuaucaccuacaaaugcccacuacuccggcaaaacgaaccggaggauauugacuguuggugcaauuccacaucuaccugggugacuuauggaacauguaccacgacuggcgagcaccgccgagaaaagcguucaguugcgcuggugccccaugucgguauggggcuugagaccagaacagaaacuuggaugaguagcgagggagcuuggaaacacgugcagaggaucgagaccuggauacugcggcauccuggcuucacaaucauggccgcaauuuuggccuacaccaucggcacgacucacuuucagcgcgcucucauuuucauccugcugacagcaguugccccauccaugaccaugagaugcauagggauuucuaacagggauuuuguggaaggagucucggguggcucauggguggacaucguccucgagcacgggagcuguguuacuacaauggcuaagaauaagcccaccuuagauuucgaacugauuaaaacggaggccaagcagccugcgacccuucggaaauauugcaucgaagcaaaguugacaaacacuaccacagagagucgcuguccaacucaaggagagcccucccugaaugaagaacaggacaaacgauuuaucugcaagcauucuaugguggauagaggcugggguaacggguguggacuauucggcaagggcgggauuguaaccugcgccauguuuacaugcaaaaagaauauggaaggaaaaguggugcagccugagaaccucgaauacaccauagucaucacuccacacagcggugaggagcaugcuguuggcaaugacacggggaagcacggaaaagaaauuaagaucacaccgcaguccucaauaaccgaggccgaacugacuggcuaugguaccgugacaauggaguguagucccaggaccgggcuugauuucaacgaaaugguacuguugcaaauggaggacaaagcauggcucgugcaccggcagugguuucuggauuuaccucugccauggcuccccggcgcugacacucagggaagcaauuggauucagaaggagacacuugucacguucaagaacccucaugccaaaaagcaagacgugguugugcugggcucucaggaaggggcgaugcacaccgccuugacuggagcaacagagauccagauguccucagguaaucuacuguuuaccggccaucucaaaugccgucugcgcauggauaaacuucaacugaaagggaugagcuacaguauguguacaggaaaguucaagaucgucaaagaaauugcugagacucagcacggcaccaucgugauuagaguacaguaugagggugacgggucuccaugcaagauacccuucgaaaucacggauuuggagaaaaggcauguucucggccggcugauuaccgugaacccgaucgucacagaaaaggacuccccugugaacaucgaggccgaacccccauuuggagauagcuacauuauaaucggcgucgagccugggcaguuaaaacugaauugguucaagaagggaucgucuauuggucaaauguuugagacuaccaugcgaggcgcuaaacgcauggccauccuaggggacacagcaugggauuucggaucccucggcgguguguuuacuucaauugggaaggcccugcaccagguuuucggcgcuaucuacggagcggcauuuaguggcgugagcuggaccaugaaaauacuuaucgggguaauuaucacguggauuggaaugaacuccagaucuacuagcuugucagucagucuggugcucguuggcguggucacccuguaucuuggugccauggugcaggcugacuccggguguguagugagcuggaagaauaaagaacugaagugcggaucuggcaucuucauaacugauaacguucacacauggaccgagcaguacaaguuucaacccgaaucaccaaguaaauuggccagcgcaauucagaaggcccaugaggaagguaucuguggcauuagguccgucacucggcucgagaaucugauguggaaacagaucacccccgaguuaaaccacauacugucugaaaaugaggugaagcuaacaaucaugacgggggacauuaaaggaaucaugcaggcuggcaagcgcucgcucagaccucaaccaaccgaacugaaauauagcuggaagacuugggggaaggccaaaaugcuuuccacagagucacauaaccagaccuucuugauugauggaccggaaacagcagagugccccaauacuaacagggcguggaauagucuggagguggaagacuacggcuuuggugucuucaccacgaacaucuggcucaagcugcgugagaaacaggacguauuuugugauucuaaguuaaugagcgcugccauaaaagacaaucgggcagugcacgccgauaugggguauuggauugaauccgcucugaacgacacauggaagauggagaaggccucauucaucgaggugaaaagcugccacuggccuaagucucauacccuuugguccaauggaguauuggaaagugagaugaucauucccaagaauuucgcaggccccgucagccagcacaacuaccgaccugguuaucauacucaaaccgcuggcccauggcaccucgggaagcuggaaauggauuuugaccuaugugagggaacaacugugguugugaccgaagauugcggcaauagagggcccucucugaggacaacgaccgccuccggaaaacucaucacugaguggugcugucgcucaugcacacugccgccucuucgguacagaggcgaggacgguuguugguacgggauggaaauuaggccauugaaggagaaggaagagaaccuggucaauaguuuagugaccgcgggacauggccagauagauaacuucagccucgguguucugggcauggcccuuuuucuggaagagauguugcgcacucgaaucgggacaaaacacgcuauucuccugguggcaguaucguucgucacccuaaucacgggaaauauguccuuucgggaccugggccgugugauggugauggucggggccacuaugaccgaugacauuggaaugggcguuacauaucucgcucugcuugccgcauucaaggugagacccaccuuugcggccgguuugcuguuaaggaaacucacuucuaaggagcugaugauggcuacaaucgggauagcccuucugagccagucaaccaucccugaaacaauucuagagcucacugaugcacuggcuuugggaaugaugguacugaaaaucgugcgcaacauggaaaaguaccaauuagccgucaccauuauggcaaucaguugcgugcccaaugccguuauacuccagaacgcuuggaagguguccuguacgauucuggcggccgucucugugagcccacuucuguugacauccucacagcagaaagcagacuggaucccucucgcucugaccaucaagggccuaaaucccacugccauuuuccugaccacacuuagccggacaaguaaaaagagaucuuggccacucaacgaggccauaauggcuguuggcaugguguccauccuggcaagcucguugcugaaaaaugacauuccgaugaccgggccuuuagucgccggaggucuccugacgguaugcuaugugcuuacaggcaggucagcggaucuggaauuggagcgagcugccgacguuaagugggaggaucaagcagaaaucucugggaguucccccauucucagcaucaccauaucugaggacggaagcauguccaucaaaaacgaagaggaggaacagacucugacaauucuaauccgcaccggccugcuugugauuucaggugucuuuccagugaguauccccauaacugccgcugcaugguaccucugggagguaaagaagcagcgggccggggugcugugggaugucccuagcccacccccuguugaaaaagcggaguuggaagacggagcuuauagaauuaagcagaggggcaucuuaggcuacucucaaaucggggccggaguguauaaagaggguacauuccacaccauguggcaugugacgcguggcgcaguccugaugcaccgcgggaagcggauugagccguccugggccgaugugaaaaaggaccucaucucauacggaggcgguuggaagcuggaaggggaguggaaagaaggagaggaaguucagguacuugcucuggagccaggcaagaaucccagagccgugcagacuaaaccuggcauauuuaagaccaacacagggaccauuggagcagucaguuuggauuucagcccagguacauccggcucucccaucguggacaggaaagggaagguugugggacuauacggcaauggugucgugacucgaucgggggcuuauguaagcgccauugcgcagaccgagaagucaaucgaagauaacccugagauagaagacgauauuuuucggaaaaagcgccugacgaucauggaccuccauccgggagccggcaaaacaaagagauaccugcccgcaaucgucagggaggcuauuaaacggggccuucgaacuuuaauccuggccccaaccagagugguugcugcagaaauggaggaggcccuccgcggguugccuauuagguaucaaacacccgccauaaagaccgaacacacuggacgugagaucguggaccugaugugucaugcuaccuucacaaugcggcuccuguccccagucagagugccuaacuacaaucuuauuaucauggaugaagcgcacuucacggaccccgcaaguaucgccgcuagggguuauauuucuacucgcguugagaugggcgaggccgcagggauauuuaugaccgccacaccaccgggaagccgagauccuuucccccaguccaacgcuccaaucauggacgaagagagagaaauucccgagcggucauggaacucuggccacgaaugggugaccgauuuuaaggguaaaacugucugguucgugccuagcaucaaggcggggaacgacauugccgcaugccugaggaaaaauggaaagaaaguaauccaguugagucgcaagacauuugauuccgaguacgugaagacccgugcuaacgacugggauuucguugucacgacugacauaagcgagaugggcgccaauuuuaaagcagaaagagugaucgauccacggagguguaugaagcccgugauucuaacagacggcgaggaacgcgucauccuggccgggccuaugccgguaacccauucuucagcugcccaacgaagaggacggauugguaggaaccccaaaaaugagaacgaccaguauaucuacaugggcgaaccccucgagaaugaugaggacugcgcgcacuggaaggaagcaaaaauguuacuggauaacauaaauaccccugaggggauuauccccuccauguucgaaccagagcgcgaaaagguggacgccauugauggagaguacagacuuaggggcgaggcucggaaaacuuuuguugaccugaugcgucgcggugaucucccugugugguuggccuauaaggucgcugcagaagggaucaacuacgccgaccgaaagugguguuucgauggcaucaaaaauaaccagauccuggaggaaaacauggagguggagauuuggacaaaggaaggagagaggaaaaagcucaaacccagauggcuggacgcucggaucuauagugauccacuugcccuaaaggaauuuaaggaguucgcagcgggccgcaaaagccugaccuugaauuuaauuacagaaauggggagacugccuacuuucaugacgcagaaggccaggaacgcucucgacaaucuggccguucuucauaccgcagaggcuggaggucgggccuacaaccacgcacugucggagcucccggaaacauuggagacucugcuacugcucacccuucuggccacagugaccggcgggaucuuuuuauucuugaugucuggaaaaggcauagguaagaugacucuggggaugugcugcauuaucacggcuuccauccuccugugguaugcgcaaauucagccccacuggaucgccgcaagcauaauucuugaauuuuuccugaucguccucuugauuccagagccugaaaaacagcgaaccccacaggauaaucaacugacauacgugguaaucgcuauauuaacugugguugccgccaccauggcaaacgagaugggcuuucuagagaagacaaagaaagaccugggacucggcucaaucaccacucaggaaagugagucuaauauucuugacaucgaucugagaccagcuuccgccuggacauuguaugcggucgcuacgaccuucgugacuccuaugcugcgccauagcauugaaaacucaagugugaaugucagccucacagccaucgcaaaccaggccaccguucugauggggcuuggaaaggguuggccccucuccaaaauggacauuggcgugccgcuguuggcuaucggguguuacucucagguaaauccaauaacccugacagcagccuuacuacugcucguggcgcacuacgcuauuaucggaccuggccuucaagccaaggcaacuagggaggcccagaaacgggcugccgcagguaucaugaagaaccccacggucgaugggauuaccgugauagaccuggaaccaauccccuaugauccuaaguuugagaaacaguugggccagguuaugcugcucauucugugcgugacacaaguccuuaugaugcguacuaccugggcuuuaugugaggcccugacacucgcgaccggaccgaucagcacuuugugggaaggcaaucccgggagauucuggaacacgacaauugccguauccauggcaaauaucuuuaggggaucauaccuggcuggcgccggucuacuguucucuauaaugaagaacaccacuaauacccgccgggggacaggaaacaucggcgagacucucggugaaaaauggaagagucgacuuaacgcacugggcaaaucggaguuucagauuuauaagaaaagcgggauccaggagguggacagaaccuuggcuaaggaaggaauuaagaggggcgagacagaucaucacgccguuucccgcgggucugccaaacugcggugguucguggaaagaaauauggucacgccagagggaaagguggucgaccucggcugcggucgugggggauggucauacuauuguggcggucugaaaaacgugagggaaguuaagggcuuaaccaaagggggaccuggccaugaggagcccaucccuaugagcacuuacggguggaaucuugugcggcugcaauccggaguagauguguuuuucacaccacccgaaaagugcgacacccuccuaugugauauaggcgagaguucuccuaacccaacuauugaagcgggucgcacacugcgagucuugaaucugguugagaacuggcucaauaacaauacccaguucugcaucaaggugcuuaaccccuauaugccgagcgucaucgagaaaauggaggcucugcagagaaaguacgggggagcauuggugaggaauccucugucacggaacuccacgcacgagauguacuggguaaguaaugccaccggcaacauugugagcucuguuaauaugauaucccgcaugcucaucaacagauuuacaaugaaacacaagaaagcuacuuaugaaccagacguggauuuaggcucagggaccaggaacauuggaaucgagagcgaaauucccaaucuggacaucauagguaagcgaaucgagaagauuaaacaggaacaugagacaucguggcacuacgaccaagaucauccuuauaagacuugggccuaccacggcucuuaugagaccaaacagacagggagugcauccagcauggucaacggagugguccggcuucugaccaagccaugggacgugguucccaugguaacucagauggccaugacggauacaaccccguucggccagcaacguguguuuaaagaaaaggucgacacuagaacccaggagccuaaggaagguacgaaaaagcuaaugaaaaucacagcugaguggcucuggaaggagcuggggaaaaagaaaaccccacgcauguguacuagggaagaguucacacggaaggugagaucaaaugcggccuugggagcaauuuuuaccgaugaaaacaaguggaaauccgcucgcgaggccguugaagacggcagguucugggagcugguggaucgagagcggaaucuccaccuugaaggcaagugcgagacuugugucuacaacaugauggggaaaagagaaaagaaacugggagaguuugguaaggcaaagggcucuagggccaucugguauaugugguuaggggcucgcuuccuggaauuugaggccuugggauuccucaaugaggaccauugguuuagccguggcaacagucuguccgguguggaaggggagggacuacaccggcuuggcuacauucugagagauguaggcaaaaaggaagggggagcgauguacgcagacgauacagccgguugggacaccaggauaacacucgaggaccugaaaaaugaagagauggugacuaaccauaugaagggcgagcacaaaaaguuggcugaagccaucuucaagcugaccuaucagaauaaaguuguccgcgugcagcgaccaacgccucgggggaccgugauggauauuaucagcagaagggaccaacgcggaucuggccaggucgguacauacgggcucaacacuuuuaccaauauggaggcacagcuuaucagacaaauggaaggagagggcauuuucaagucaauacagcaucugacagcuagugaggaaacugccguucagaacugguuagcucgggugggcagggagcgucugucccgaauggccaucagcggggaugacugcguagugaaacccauugaugaccgcuucgcaucugcguugaccgcccucaaugauaugggaaaggucagaaaagacauccagcaaugggaaccaucgcgggguuggaacgauuggacacaggugcccuuuugcucacaccacuuccaugagcugguuaugaaggacggcagggugcuagucgugccuugucgcaaccaggaugaacuuauugggagagcucggaucagccagggagccggcuggucccugaaggagacagcaugccucgguaaaaguuaugcucaaauguggacccugauguacuuucacaggcgagacuugcguuuagccgcaaaugccauauguucugcgguaccaccgcauuggguucccacuagcagaacaaccugguccauccacgcuaagcacgaguggaugacuaccgaagauaugcuggccguguggaaccgcgucuggauucaggagaauccuuggauggaagacaaaacaccaguggagucaugggaagaggugcccuaucucgggaagcgggaggaccaguggugcggaagucuuaucggccugacgucuagggcaaccugggccaaaaacauucagacugcuaucaaucaagucagaagccuaauaggcaacgaagaguacacagauuauaugccuuccaugaagcgcuuccggagggaagaggaagaggccgggguucugugguga

SEQ ID NO: 14520 - RNA, 9876 nt, Artificial Sequence
  derived and/or modified CDS sequence (opt3) from DENV-2__FJ850064__SS-prME
accgccggcgugauagucaugcugauucccaccgcuauggcauuccaccucacuacgagaaacggggagccucauaugauaguuggaaggcaggaaaaggguaaaagccuucuguuuaagaccgaggacggcgugaauaugugcacguugauggccaucgauuuaggggaacugugugaggacacuauuaccuacaaaugcccacuacuccggcaaaacgaaccggaggauaucgacuguuggugcaauuccacaucuaccuggguaacuuauggaacauguaccacgacuggcgagcaccgccgagaaaagcguucaguggcgcuggucccccauguggguauggggcuugagaccagaacagaaacuuggaugaguagcgagggagcuuggaaacacguucagaggauugagaccuggauccugcggcauccuggcuucacaauuauggccgcaaucuuggccuacaccauuggcacgacucacuuucagcgcgcucucaucuucauucugcugacagcaguggccccauccaugaccaugagaugcaucgggauaucuaacagggauuuugucgaaggagugucggguggcucauggguagacauuguucucgagcacgggagcugugugacuacaauggcuaagaauaagcccaccuuagauuucgaacugaucaaaacggaggccaagcagccugcgacccuucggaaauauugcauugaagcaaaguugacaaacacuaccacagagagucgcuguccaacucaaggagagcccucccugaaugaggaacaggacaaacgauuuaucugcaagcauucuauggucgauagaggcugggguaacggguguggacuauucggcaagggcgggaucgugaccugcgccauguuuacaugcaaaaagaauauggaaggaaaagugguccagccugagaaccucgaauacaccauuguuauaacuccacacagcggugaggagcaugcugugggcaaugacacggggaagcacggaaaagaaaucaagauuacaccgcaguccucaaucaccgaggccgaacugacuggcuaugguaccguaacaauggaguguagucccaggaccgggcuugauuucaacgaaauggugcuguugcaaauggaggacaaagcauggcucguccaccggcagugguuucuggauuuaccucugccauggcuccccggcgcugacacucagggaagcaauuggauacagaaggagacacuugugacguucaagaacccucaugccaaaaagcaagacguugugguccugggcucucaggaaggggcgaugcacaccgccuugacuggagcaacagagauucagauguccucagguaaucuacuguuuaccggccaucucaaaugccgucugcgcauggauaaacuucaacugaaagggaugagcuacaguauguguacaggaaaguucaagaucgugaaagaaaucgcugagacucagcacggcaccauuguaaucagaguucaguaugagggugacgggucuccaugcaagauucccuucgaaauaacggauuuggagaaaaggcaugugcucggccggcugaucaccgucaacccgauugugacagaaaaggacuccccugucaacaucgaggccgaacccccauuuggagauagcuacaucauuauaggcguggagccugggcaguuaaaacugaauugguucaagaagggaucgucuaucggucaaauguuugcuacuaccaugcgaggcgccaaacgcauggcaauucuaggggacacagccugggauuucggaucccucggcgguguuuuuacuucaaucgggaaggcucugcaccagguguucggcgcgauuuacggagcagccuuuaguggcguaagcuggaccaugaaaauccuuauaggggucaucauuacguggaucggaaugaacuccagaucuacuagcuugucagugagucugguucucgugggcgucgugacccuguaucuuggugcuaugguacaggccgacuccgggugugugguuagcuggaagaauaaagagcugaagugcggaucuggcauuuucaucacugauaacguccacacauggaccgaacaguacaaguuucaacccgagucaccaaguaaauuggcaagcgccauacagaaggcucaugaagaggguauuuguggcaucagguccgugacucggcucgaaaaucugauguggaaacagauuacccccgaguuaaaccacauccugucugagaaugaagugaagcuaacaauaaugacgggggacaucaaaggaauuaugcaggccggcaagcgcucgcucagaccucaaccaaccgagcugaaauauagcuggaagacuugggggaaggcaaaaaugcuuuccacagaaucacauaaccagaccuucuugaucgauggaccggagacagcggaaugccccaauacuaacagggcuuggaauagucuggaggucgaggacuacggcuuugguguuuucaccacgaacauuuggcucaagcugcgugaaaaacaggacguguuuugugauucuaaguuaaugagcgccgcaaucaaagacaaucgggccgugcacgcugauaugggguauuggauagaguccgcccugaacgacacauggaagauggaaaaggcaucauucauugagguaaaaagcugccacuggccuaagucucauacccuuugguccaauggagucuuggagagugaaaugaucauccccaagaauuucgcuggccccgugagccagcacaacuaccgaccugguuaucauacucaaaccgccggcccauggcaccucgggaagcuggagauggauuuugaccuaugugaaggaacaacuguuguggucaccgaggauugcggcaauagagggcccucucugaggacaacgaccgcguccggaaaacucauuacugaauggugcugucgcucaugcacacugccgccucuucgguacagaggcgaggacgguuguugguacgggauggagaucaggccauugaaggaaaaggaggaaaaccuggugaauaguuuaguuaccgccggacauggccagauugauaacuucagccucggugugcugggcauggcucuuuuucuggaggaaauguugcgcacucgaauagggacaaaacacgcaauccuccugguagccgucucguucgugacccuaauuacgggaaauauguccuuucgggaccugggccgugugauggucaugguuggggcuacuaugaccgaugacaucggaaugggcgugacauaucucgcccugcuugcagcguucaagguaagacccaccuuugccgcugguuugcuguuaaggaaacucacuucuaaggagcugaugauggccacaauugggaucgcacuucugagccagucaaccauaccugagacaauccuagaacucacugaugcucuggccuugggaaugauggugcugaaaauuguccgcaacauggagaaguaccaauuagcagugaccaucauggccauuaguugcguucccaaugcugugauccuccagaacgcguggaaggucuccuguacgauacuggccgcagugucuguuagcccacuucuguugacauccucacagcagaaagcugacuggauuccucucgcccugaccaucaagggccuaaaucccacugccaucuuccugaccacacuuagccggacaaguaaaaagagaucuuggccacucaacgaagcuauuauggcagugggcauggucuccauacuggccagcucguugcugaaaaaugacaucccgaugaccgggccuuuaguagcgggaggucuccugacggugugcuauguucuuacaggcaggucagcugaucuggaguuggaacgagccgcagacgugaagugggaggaucaagccgagauuucugggaguucccccauccucagcauuaccaucucugaagacggaagcauguccaucaaaaacgaggaagaggagcagacucugacaauccuaauucgcaccggccugcuugucaucucagguguguuuccaguaaguauucccaucacugcugcagccugguaccucugggaagugaagaagcagcgggcggggguccugugggauguuccuagcccacccccuguggagaaagcugaauuggaggacggagccuauagaauaaagcagaggggcauuuuaggcuacucucaaaucggggcaggaguguauaaagaagguacauuccacaccauguggcaugucacgcguggcgccgugcugaugcaccgcgggaagcggaucgagccguccugggcugauguuaaaaaggaccucauuucauacggaggcgguuggaagcuggagggggaauggaaagagggagaagagguacaggugcuugcccuggaaccaggcaagaaucccagagcaguccagacuaaaccuggcaucuuuaagaccaacacagggaccauaggagcugugaguuuggauuucagcccagguacauccggcucucccauuguugacaggaaagggaagguggucggacuauacggcaauggugugguaacucgaucgggggccuaugucagcgcgaucgcccagaccgagaagucaauugaggauaacccugaaaucgaggacgauauauuucggaaaaagcgccugacgauuauggaccuccauccgggagcaggcaaaacaaagagauaccugcccgcuaucgugagggaagccaucaaacggggccuucgaacuuuaauucuggcuccaaccagaguuguggcagccgagauggaagaggcccuccgcggguugccuaucagguaucaaacacccgcuauuaagaccgagcacacuggacgugaaauagucgaccugaugugucaugcgaccuucacaaugcggcuccuguccccagugagaguuccuaacuacaaucuuaucauuauggaugaggcacacuucacggaccccgccaguaucgcugccagggguuauaucucuacucgcguggaaaugggcgaggcagccgggauuuuuaugaccgcuacaccaccgggaagccgagauccuuucccccaguccaacgcgccaauaauggacgaggaaagagagauccccgaacggucauggaacucuggccacgagugggucaccgauuuuaaggguaaaacugugugguucguaccuagcauuaaggccgggaacgacaucgcagcuugccugaggaaaaauggaaagaaagugauucaguugagucgcaagacauuugauuccgaauacguuaagacccgugccaacgacugggauuucgucgugacgacugacaucagcgagaugggcgcaaauuuuaaagccgagagagugauagauccacggagguguaugaagcccgucauccuaacagacggcgaagaacgcguaauucuggcugggccuaugccggugacccauucuucagccgcgcaacgaagaggacggaucgguaggaaccccaaaaaugaaaacgaccaguauauuuacaugggcgagccccucgaaaaugaugaggacugcgcacacuggaaggaggccaaaauguuacuggauaacaucaauaccccugaagggauaauucccuccauguucgagccagaacgcgagaagguugacgcuaucgauggagaauacagacuuaggggcgaggcccggaaaacuuuuguggaccugaugcgucgcggugaucucccugucugguuggcuuauaagguggcagccgaggggauuaacuacgcugaccgaaagugguguuucgauggcaucaaaaauaaccagauacuggaagagaacauggaaguugagaucuggacaaaggagggagaaaggaaaaagcucaaacccagauggcuggacgcccggauuuauagugauccacuugcacuaaaggaguuuaaggaguucgcggccggccgcaaaagccugaccuugaauuuaaucacagagauggggagacugccuacuuucaugacgcagaaggcuaggaacgcccucgacaaucuggcagugcuucauaccgcugaagccggaggucgggcauacaaccacgcccugucggagcucccggagacauuggaaacucugcuacugcucacccuucuggcuacagucaccggcgggauauuuuuauucuugaugucuggaaaaggcaucgguaagaugacucuggggaugugcugcauaauuacggcguccauccuccugugguaugcccaaauccagccccacuggauugcagcuagcaucauacuugaguuuuuccugauugugcucuugaucccagaaccugagaaacagcgaaccccacaggauaaucaacugacauacguagugauugccaucuuaacuguugucgccgcaaccauggcuaacgaaaugggcuuucuagagaagacaaagaaagaccugggacucggcucaauaaccacucaggagagugaaucuaauauccuugacauugaucugagaccagccuccgcguggacauuguaugcuguggccacgaccuucgugacuccuaugcugcgccauagcaucgagaacucaagugucaauguuagccucacagcaauugccaaccaggcuaccgugcugauggggcuuggaaaggguuggccccucuccaaaauggacaucggcguaccgcuguuggcaauuggguguuacucucaggugaauccaaucacccugacagccgcguuacuacugcucgucgcucacuacgccauaauuggaccuggccuucaagcaaaggccacuagggaagcucagaaacgggccgcagcugguaucaugaagaaccccacgguggaugggaucaccguuauugaccuggagccaauacccuaugauccuaaguuugaaaaacaguugggccaggugaugcugcucauccugugcgucacacaaguacuuaugaugcguacuaccugggccuuaugugaggcgcugacacucgccaccggaccgauuagcacuuugugggagggcaaucccgggagauucuggaacacgacaaucgcaguguccauggcuaauauuuuuaggggaucauaccuggccggcgcaggucuacuguucucuaucaugaagaacaccacuaauacccgccgggggacaggaaacauaggcgaaacucucggugagaaauggaagagucgacuuaacgcucugggcaaaucggaauuucagaucuauaagaaaagcgggauucaggagguugacagaaccuuggccaaggagggaaucaagaggggcgaaacagaucaucacgccgugucccgcgggucugcgaaacugcggugguucgucgagagaaauauggugacgccagaaggaaaggucguggaccucggcugcggucgugggggauggucauacuauuguggcggucugaaaaacguuagggaggugaagggcuuaaccaaagggggaccuggccaugaggaaccaauuccuaugagcacuuacggguggaaucuuguacggcugcaauccggaguggaugucuuuuucacaccacccgagaagugcgacacccuccuaugugauaucggcgaaaguucuccuaacccaacuauagaggcuggucgcacacugcgaguuuugaaucugguggaaaacuggcucaauaacaauacccaguucugcauuaagguccuuaaccccuauaugccgagcgugaucgagaaaauggaagcacugcagagaaaguacgggggagccuugguaaggaauccucugucacggaacuccacgcacgagauguacugggugaguaaugcuaccggcaacaucguuagcucugugaauaugauuucccgcaugcucauaaacagauuuacaaugaaacacaagaaagccacuuaugagccagacgucgauuuaggcucagggaccaggaacaucggaauugaaagcgaggugcccaaucuggacaucauugguaagcgaaucgaaaagauaaaacaggagcaugaaacaucguggcacuacgaccaagaucauccuuauaagacuugggcauaccacggcucuuaugagaccaaacagacagggagugccuccagcauggucaacggagugguucggcuucugaccaagccaugggacguagugcccauggucacucagauggcuaugacggauacaaccccguucggccagcaacguguguuuaaagagaagguugacacuagaacccaggaaccuaaggaggguacgaaaaagcuaaugaaaaucacagcggaauggcucuggaaggagcuggggaaaaagaaaacaccccgcauguguacuagggaggaguucacacggaaggugagaucaaaugccgcauugggagcuauuuuuaccgaugagaacaaguggaaauccgcccgcgaagcagucgaggacggcagguucugggaacugguggaucgagagcggaaucuccaccuugagggcaagugcgaaacuuguguauacaacaugauggggaaaagagagaagaaacugggagaauuugguaaggccaagggcucuagggcuaucugguauaugugguuaggggcccgcuuccuggaguuugaagcguugggauuccucaaugaggaccauugguuuagccguggcaacagucuguccgguguggagggggaaggacuacaccggcuuggcuacauucugagagauguuggcaaaaaggaagggggagcaauguacgccgacgauacagcugguugggacaccaggaucacacucgaagaccugaaaaaugaggaaauggucacuaaccauaugaagggcgagcacaaaaaguuggccgaggcaauuuucaagcugaccuaucagaauaaaguggugcgcguccagcgaccaacgccucgggggaccguuauggauauaaucagcagaagggaccaacgcggaucuggccagguggguacauacgggcucaacacuuuuaccaauauggaagcucagcuuauuagacaaauggagggagaaggcaucuucaagucaauccagcaucugacagccacugaggagauugcuguacagaacugguuagcccgggugggcagggaacgucugagucgaauggcaauauccggggaugacugcgucgugaaacccaucgaugaccgcuucgcgagcgccuugaccgcucucaaugauaugggaaagguuagaaaagacauucagcaaugggagccaucucgggguuggaacgauuggacacaggugcccuuuugcucgcaccacuuccaugaacuggucaugaaggacggcagggugcuaguaguuccuugucgcaaccaggaugagcuuaucgggagagcccggauuucacagggagcaggcuggagccugaaggaaacagcuugccucgguaaauccuaugcccaaauguggacccugauguacuuucacaggcgagacuugcguuuagcagccaaugcgaucuguagugcugugccaccgcauuggguccccacuucuagaacaaccuggagcauacacgccaagcacgaguggaugacuaccgaggauaugcuggcaguguggaaccgcguguggauccaggaaaauccuuggauggaggacaaaacaccagucgaauccugggaggaaguucccuaucucgggaagcgggaggaccaguggugcggaucacuuauuggccugacgaguagggccaccugggcuaaaaacauccagacugccauuaaucaagugagaucucuaaucggcaacgaggaauacacagauuauaugccuagcaugaagcgcuuccggagggaggaagaggaagcagggguacugugguga

SEQ ID NO: 14521 - RNA, 9876 nt, Artificial Sequence
  derived and/or modified CDS sequence (opt3) from DENV-2__FJ850065__SS-prME
accgccggcgugaucgucaugcugauucccacagcuauggcauuccaccucacuacgagaaacggggagccucauaugauaguuggaaggcaggaaaaggguaaaagccuucuguuuaagaccgaggacggcgugaauaugugcacauugauggccaucgauuuaggggaacugugugaggacacuauuaccuacaaaugcccacuacuccggcaaaacgaaccggaggauaucgacuguuggugcaauuccacaucuaccuggguaacuuauggaacauguaccacgacuggcgagcaccgccgagaaaagcguucaguggcgcuggucccccauguggguauggggcuugagaccagaacagaaacuuggaugaguagcgagggagcuuggaaacacguucagaggauugagaccuggauccugcggcauccuggcuucacaauaauggccgcaaucuuggccuacaccauuggcacgacucacuuucagcgcgcucucaucuucauucugcugacagcaguggccccauccaugaccaugagaugcaucgggauaucuaacagggauuuugucgaaggagugucggguggcucauggguagacauuguucucgagcacgggagcugugugacuacaauggcuaagaauaagcccaccuuagauuucgaacugaucaaaacggaggccaagcagccugcgacccuucggaaauauugcacagaagcaaaguugacuaacaccacaacugagagucgcuguccaacccaaggagagcccucccugaaugaagagcaggacaaacgauuuauuugcaagcauucuauggucgauagaggcugggguaacggguguggacuauucggcaagggcgggaucgugacaugcgccauguuuaccugcaaaaagaauauggaaggaaaagugguccagccugagaaccucgaauacacuaucguuauuacgccacacagcggugaggagcaugcugugggcaaugacacagggaagcacggaaaagaaauaaagaucaccccgcaguccucaauuacugaggccgaacugaccggcuaugguacaguaaccauggaguguagucccaggacugggcuugauuucaacgaaauggugcuguugcaaauggaggacaaagcauggcucguccaccggcagugguuucuggauuuaccucugccauggcuccccggcgcugacacacagggaagcaauuggauccagaaggagacgcuugugaccuucaagaacccucaugccaaaaagcaagacguugugguccugggcucucaggaaggggcgaugcacacugccuugacaggagcaaccgagauacagauguccucagguaaucuacuguuuacaggccaucucaaaugccgucugcgcauggauaagcuucaacugaaagggaugagcuacaguauguguacuggaaaguucaagauugugaaagaaaucgcugagacccagcacggcacgaucguaauuagaguucaguaugagggugacgggucuccaugcaagauccccuucgaaauuaccgauuuggagaaaaggcaugugcucggccggcugauaacagucaacccgaucgugacugaaaaggacuccccugucaacauugaggccgaacccccauuuggagauagcuacaucaucauuggcguggagccugggcaguuaaaacugaauugguucaagaagggaucgucuauaggucaaauguuugagaccacaaugcgaggcgcuaaacgcauggccauccuaggggacacugcaugggauuucggaucccucggcgguguuuuuaccucaauugggaaggcccugcaccagguguucggcgcuaucuacggagcggcauuuaguggcguaagcuggacgaugaaaauucuuaucggggucauaaucacauggauuggaaugaacuccagaucuaccagcuugucagugagucugguucucgugggcgucgugacucuguaucuuggugccaugguacaggcugacuccgggugugugguuagcuggaagaauaaagaacugaagugcggaucuggcaucuucauuacagauaacguccacaccuggacugagcaguacaaguuucaacccgaaucaccaaguaaauuggccagcgcaauccagaaggcccaugaggaagguauauguggcauuagguccgugacccggcucgagaaucugauguggaaacagaucacacccgaguuaaaccacauucugucugaaaaugaggugaagcuaacgaucaugaccggggacauaaaaggaaucaugcaggcuggcaagcgcucgcucagaccucaaccaacugaacugaaauauagcuggaagacaugggggaaggccaaaaugcuuuccaccgagucacauaaccagacauucuugauugauggaccggaaacugcagagugccccaauaccaacagggcguggaauagucuggaggucgaagacuacggcuuugguguuuucacgacaaacaucuggcucaagcugcgugagaaacaggacguguuuugugauucuaaguuaaugagcgcugccauuaaagacaaucgggcagugcacgccgauaugggguauuggaucgaauccgcucugaacgacaccuggaagauggagaaggccucauucauagagguaaaaagcugccacuggccuaagucucauacucuuugguccaauggagucuuggaaagugagaugauuaucccaaaaaacuucgcaggccccgugagccagcacaacuaccgaccugguuaucauacccaaacagcuggcccauggcaccucgggaagcuggaaauggauuuugaccuaugugagggaacuaccguuguggucacagaagauugcggcaauagagggcccucucugaggacgaccacugccuccggaaaacucaucacagaguggugcugucgcucaugcacccugccgccucuucgguacagaggcgaggacgguuguugguacgggauggaaauuaggccauugaaggagaaggaagagaaccuggugaauaguuuaguuacugcgggacauggccagaucgauaacuucagccucggugugcugggcauggcccuuuuucuggaagagauguugcgcacacgaauugggaccaaacacgcuauacuccugguagcagucucguucgugacgcuaaucacuggaaauauguccuuucgggaccugggccgugugauggucaugguuggggccaccaugacagaugacauuggaaugggcgugaccuaucucgcucugcuugccgcauucaagguaagacccacuuuugcggccgguuugcuguuaaggaaacucacaucuaaggagcugaugauggcuaccaucgggauugcccuucugagccagucaacaaucccugaaacuauacuagagcucaccgaugcacuggcuuugggaaugauggugcugaaaaucguccgcaacauggaaaaguaccaauuagccgugacgauuauggcaaucaguugcguucccaaugccgugauucuccagaacgcuuggaaggucuccuguacaauccuggcggccgugucuguuagcccacuucuguugaccuccucacagcagaaagcagacuggauaccucucgcucugacuauuaagggccuaaaucccaccgccaucuuccugacaacucuuagccggaccaguaaaaagagaucuuggccacucaacgaggccaucauggcugugggcauggucuccauucuggcaagcucguugcugaaaaaugacauaccgaugacggggccuuuaguagccggaggucuccugacagugugcuauguucuuaccggcaggucagcggaucuggaauuggagcgagcugccgacgugaagugggaggaucaagcagaaaucucugggaguucccccauucucagcaucacuauuucugaggacggaagcauguccaucaaaaacgaagaggaggaacagacacugaccauacuaauccgcacuggccugcuugucauuucagguguguuuccaguaaguauccccauuacagccgcugcaugguaccucugggaggugaagaagcagcgggccgggguccugugggauguuccuagcccacccccuguggaaaaagcggaguuggaagacggagcuuauagaaucaagcagaggggcauauuaggcuacucucaaauuggggccggaguguauaaagaggguaccuuccacacgauguggcaugucacucguggcgcagugcugaugcaccgcgggaagcggaucgagccguccugggccgauguuaaaaaggaccucaucucauacggaggcgguuggaagcuggaaggggaguggaaagaaggagaggaaguacaggugcuugcucuggagccaggcaagaaucccagagccguccagaccaaaccuggcauuuuuaagacaaacaccgggacaaucggagcagugaguuuggauuucagcccagguacuuccggcucucccauaguugacaggaaagggaagguggucggacuauacggcaauggugugguaacccgaucgggggcuuaugucagcgccauugcgcagacggagaagucaaucgaagauaacccugagauugaagaggacaucuuucggaaaaagcgccugacaauaauggaucuccauccgggagccggcaaaacuaagagauaccugcccgcaauugugagggaagcuaucaaacggggccuucgaaccuuaauccuggccccaacaagaguuguggcugcagagauggaggaagcccuccgcggguugccuauuagguaucaaacccccgccaucaagacugagcacaccggacgugaaauugucgaccugaugugucaugcuacauucacgaugcggcuccuguccccagugagaguuccuaacuacaaucuuauaaucauggacgaggcgcacuucacugaucccgcaaguauugccgcuagggguuauaucucuacccgcguggagaugggcgaagccgcagggaucuuuaugacagccaccccaccgggaagccgagacccuuucccccaguccaacgcuccaauuauggaugaggaaagagagauacccgaacggucauggaauucuggccacgagugggucacugacuuuaaggguaaaacagugugguucguaccuagcaucaaggcggggaacgauauugccgcaugccugaggaaaaauggaaagaaagugauccaguugagucgcaagaccuuugacuccgaguacguuaagacgcgugcuaacgauugggacuucgucgugacuacagauauuagcgaaaugggcgccaauuuuaaagcagagagagugaucgacccacggagguguaugaagcccgucauacuaaccgauggcgaagagcgcguaauccuggccgggccuaugccggugacccauucuucagcugcccaacgaagaggacggauugguaggaacccaaaaaaugaaaacgaccaguauaucuacaugggcgagccccucgagaaugacgaagauugcgcgcacuggaaggaggcaaaaauguuacuggacaacauuaauacuccugaagggaucauacccuccauguucgagccagaacgcgagaagguugaugccauugacggagaguacagacuuaggggcgaagcucggaaaacauuuguggaucugaugcgucgcggugaccucccugucugguuggccuauaagguggcugcagaggggaucaacuacgccgaucgaaagugguguuucgacggcauuaaaaauaaccagauccuggaagagaacauggagguugaaauauggaccaaggagggagaaagaaaaaagcucaaacccagguggcuggaugcucggaucuauagugacccacuugcccuaaaggaguuuaaggaauucgcagcgggccgcaaaagccugacauugaauuuaauuacugagauggggagacugccuacguucaugacccagaaggccaggaacgcucucgauaaucuggccgugcuucauacagcagaggcuggaggucgggccuacaaccacgcacugucggaacucccggagacuuuggaaacccugcuacugcucacacuucuggccaccgucacuggcgggaucuuuuuauucuugaugucuggaaaaggcauugguaagaugacgcuggggaugugcugcaucauaaccgcuuccauucuccugugguaugcgcaaauccagccccacuggaucgccgcaagcauuauccuugaguuuuuccugauagugcucuugauuccagaaccugagaaacagcgaacaccccaggacaaucaacugacuuacguagugaucgcuauuuuaaccguugucgccgccacaauggcaaacgagaugggcuuucuagaaaagaccaagaaagaucugggacucggcucaaucacuacacaggagagugaaucuaauauacuugacaucgaccugagaccagcuuccgccuggacguuguaugcgguggcuaccacuuucgugacaccuaugcugcgccauagcauugagaacucaagugucaauguuagccucaccgccaucgcaaaccaggccaccgugcugauggggcuuggaaaggguuggccccucuccaaaauggauauuggcguaccgcuguuggcuaucggguguuacucucaggugaauccaauuacacugacugcagccuuacuacugcucgucgcgcacuacgcuaucauaggaccuggccuucaagccaaggcaacgagggaagcccagaaacgggcugccgcagguauuaugaagaaccccaccguggacgggaucacaguuaucgaucuggagccaauucccuaugacccuaaguuugagaaacaguugggccaggugaugcugcucauacugugcgucacucaaguacuuaugaugcguaccacaugggcuuuaugugaagcccugacccucgcgacuggaccgaucagcacguugugggagggcaaucccgggagauucuggaacacaaccauugccguguccauggcaaauaucuuuaggggaucauaccuggcuggcgccggucuacuguucucuauuaugaagaacacuaccaauacacgccgggggacuggaaacaucggcgaaacccucggugagaaauggaagagucgacuuaacgcacugggcaaaucggaguuucagauauauaagaaaagcgggauccaggaaguugauagaacauuggcuaaggagggaauuaagaggggcgaaacggaccaucacgccgugucccgcgggucugccaaacugcggugguucgucgagagaaauauggugaccccagaaggaaaggucguggaucucggcugcggucgugggggauggucauacuauuguggcggucugaaaaacguuagggaggugaagggcuuaacuaaagggggaccuggccaugaggaacccaucccuaugagcacauacggguggaaucuuguacggcugcaauccggaguggacgucuuuuucaccccacccgagaagugcgauacucuccuaugugacauuggcgaaaguucuccuaacccaacaaucgaggcgggucgcacccugcgaguuuugaaucugguggaaaacuggcucaauaacaauacgcaguucugcauaaagguccuuaaccccuauaugccgagcgugauugagaaaauggaggcucugcagagaaagcacgggggagcauugguaaggaauccucugucacggaacuccacccacgaaauguacugggugaguaaugccacaggcaacaucguuagcucugugaauaugaucucccgcaugcucauuaacagauuuacuaugaaacauaagaaagcuaccuacgagccagaugucgacuuaggcucagggacaaggaacauaggaaucgaaagcgagauucccaaucuggauaucauugguaagcgaaucgaaaagauaaaacaggagcacgagacuucguggcauuaugaccaagaccacccuuacaagaccugggccuaucacggcucuuacgaaacaaaacagaccgggagugcauccagcauggugaacggagucgugcggcuucugacuaagccaugggauguuguacccauggugacgcagauggccaugacagacaccacuccguucggccagcaacgugucuuuaaagagaagguggauaccagaacacaggaaccuaaggaggguacgaaaaagcuaaugaaaaucaccgcugaguggcucuggaaggaacuggggaaaaagaaaacuccccgcauguguacaagggaggaauucacccggaagguuagaucaaaugcggccuugggagcaauuuuuacugacgagaacaaguggaaauccgcucgcgaagccguggaggauggcagguucugggagcuggucgaccgagaacggaaucuccaucuugagggcaagugcgaaacauguguguauaacaugauggggaaaagagagaagaaacugggagaauuugguaaggcaaagggcucuagggccaucugguacaugugguuaggggcucgcuuccuggaguuugaggccuugggauuccucaaugaagaucacugguuuagccguggcaacagucuguccgguguagagggggaaggacuacaucggcuuggcuauauucugagagacgugggcaaaaaggaggggggagcgauguacgcagaugacaccgccgguugggauacaaggaucacucucgaagaccugaaaaaugaggagaugguuaccaaccacaugaagggcgaacauaaaaaguuggcugaggccauuuucaagcugacguaccagaauaaagucgugcgcgugcagcgaccaaccccucgggggacagucauggacauaaucagcagaagggaucaacgcggaucuggccagguugguacuuaugggcucaacaccuuuacaaauauggaagcacagcuuauuagacaaauggagggagagggcaucuucaagucaauccagcaccugacugcuaccgaagagauugccgugcagaacugguuagcucggguaggcagggaacgucugagucgaauggccauauccggggacgauugcguggucaaacccaucgacgaucgcuucgcaagcgcguugacggcccucaaugacaugggaaaggugagaaaagauauucagcaaugggagccaucucgggguuggaacgacuggacacagguucccuuuugcucgcaccauuuccacgaacuggugaugaaggauggcaggguccuagugguaccuugucgcaaccaggacgagcuuaucgggagagcucggauuucacagggagccggcuggagccugaaggagaccgcaugccucgguaaauccuacgcucaaauguggacucugauguauuuucauaggcgagauuugcguuuagccgcaaaugccaucuguagugcgguuccaccgcacugggugcccacaucuagaaccacuuggagcauacacgcuaagcaugaauggaugaccacagaggacaugcuggccgucuggaaccgcguguggauccaggaaaauccuuggauggaggauaaaacgccaguggaauccugggaggagguccccuaccucgggaagcgggaagaccaguggugcggaucacuuauuggccugaccaguagggcaacuugggccaaaaacauccagacagcuauuaaucaaguuagaucucuaaucggcaacgaggaauauaccgacuacaugccuagcaugaagcgcuuccggagggaggaagaggaggccggggugcugugguga

SEQ ID NO: 14522 - RNA, 9876 nt, Artificial Sequence
  derived and/or modified CDS sequence (opt3) from DENV-2__FJ873808__SS-prME
acagccggagugaucgucaugcugauuccaacagcuauggcauuccaccucacuacgagaaacggggaaccucauaugauaguuggaaggcaggaaaaggguaaaagccuucuguuuaagaccgaggacggcgugaauaugugcacauugauggccaucgauuuaggggaacugugugaggacacuauuaccuacaaaugcccacuacuccggcaaaacgaaccggaggauaucgacuguuggugcaauuccacaucuaccuggguaacuuauggaacauguaccacgacuggcgagcaccgccgagaaaagcguucaguggcgcuggucccccauguggguauggggcuugagaccagaacagaaacuuggaugaguagcgagggagcuuggaaacacguucagaggauugagaccuggauccugcggcauccuggcuucacaauuauggccgcaaucuuggccuacaccauuggcacgacucacuuucagcgcgcucucaucuucauucugcugacagcaguggccccauccaugaccaugagaugcaucgggauaucuaacagggauuuugucgaaggagugucggguggcucauggguagacauuguucucgagcacgggagcugugugacuacaauggcuaagaauaagcccaccuuagauuucgaacugaucaaaacggaggccaagcagccugcgacccuucggaaauauugcauugaagcaaaguugacaaacacuaccacagagagucgcuguccaacucaaggagagcccucccugaaugaggaacaggacaaacgauuuaucugcaagcauucuauggucgauagaggcugggguaacggguguggacuauucggcaagggcgggaucgugaccugcgccauguuuacaugcaaaaagaauauggaaggaaaagugguccagccugagaaccucgaauacaccauuguuauaacuccacacagcggugaggagcaugcugugggcaaugacacggggaagcacggaaaagaaaucaagauuacaccgcaguccucaaucaccgaggccgaacugacuggcuaugguaccguaacaauggaguguagucccaggaccgggcuugauuucaacgaaauggugcuguugcaaauggaggacaaagcauggcucguccaccggcagugguuucuggauuuaccucugccauggcuccccggcgcugacacucagggaagcaauuggauacagaaggagacacuugugacguucaagaacccucaugccaaaaagcaagacguugugguccugggcucucaggaaggggcgaugcacaccgccuugacuggagcaacagagauucagauguccucagguaaucuacuguuuaccggccaucucaaaugccgucugcgcauggauaaacuucaacugaaagggaugagcuacaguauguguacaggaaaguucaagaucgugaaagaaaucgcugagacucagcacggcaccauuguaaucagaguucaguaugagggugacgggucuccaugcaagauucccuucgaaauaacggauuuggagaaaaggcaugugcucggccggcugaucaccgucaacccgauugugacagaaaaggacuccccugucaacaucgaggccgaacccccauuuggagauagcuacaucauuauaggcguggagccugggcaguuaaaacugaauugguucaagaagggaucgucuaucggucaaauguuugagacuaccaugcgaggcgcuaaacgcauggccauucuaggggacacagcaugggauuucggaucccucggcgguguuuuuacuucaaucgggaaggcccugcaccagguguucggcgcuauuuacggagcggcauuuaguggcguaagcuggaccaugaaaauccuuauaggggucaucauuacguggaucggaaugaacuccagaucuaccagcuugucagugagucugguucucgugggcgucgugacccuguaucuuggugccaugguacaggcugacuccgggugugugguuagcuggaagaauaaagaacugaagugcggaucuggcauuuucaucacugauaacguccacacauggaccgagcaguacaaguuucaacccgaaucaccaaguaaauuggccagcgcaauacagaaggcccaugaggaagguauuuguggcaucagguccgugacucggcucgagaaucugauguggaaacagauuacccccgaguuaaaccacauccugucugaaaaugaggugaagcuaacaauaaugacgggggacaucaaaggaauuaugcaggcuggcaagcgcucgcucagaccucaaccaaccgaacugaaauauagcuggaagacuugggggaaggccaaaaugcuuuccacagagucacauaaccagaccuucuugaucgauggaccggaaacagcagagugccccaauacuaacagggcguggaauagucuggaggucgaagacuacggcuuugguguuuucaccacgaacauuuggcucaagcugcgugagaaacaggacguguuuugugauucuaaguuaaugagcgcugccaucaaagacaaucgggcagugcacgccgauaugggguauuggauagaauccgcucugaacgacacauggaagauggagaaggccucauucauugagguaaaaagcugccacuggccuaagucucauacccuuugguccaauggagucuuggaaagugagaugaucauccccaagaauuucgcaggccccgugagccagcacaacuaccgaccugguuaucauacucaaaccgcuggcccauggcaccucgggaagcuggaaauggauuuugaccuaugugagggaacaacuguuguggucaccgaagauugcggcaauagagggcccucucugaggacaacgaccgccuccggaaaacucauuacugaguggugcugucgcucaugcacacugccgccucuucgguacagaggcgaggacgguuguugguacgggauggaaaucaggccauugaaggagaaggaagagaaccuggugaauaguuuaguuaccgcgggacauggccagauugauaacuucagccucggugugcugggcauggcccuuuuucuggaagagauguugcgcacucgaauagggacaaaacacgcuauccuccugguagcagucucguucgugacccuaauuacgggaaauauguccuuucgggaccugggccgugugauggucaugguuggggccacuaugaccgaugacaucggaaugggcgugacauaucucgcucugcuugccgcauucaagauuagacccaccuuugcggccgguuugcuguuaaggaaacucacuucuaaggagcugaugauggcuacaaucgggauagcccuucugagccagucaaccaucccugaaacaauucuagagcucacugaugcacuggcuuugggaaugaugguacugaaaaucgugcgcaacauggaaaaguaccaauuagccgucaccauuauggcaaucaguugcgugcccaaugccguuauacuccagaacgcuuggaagguguccugugcgauucuggccgcagucucugugagcccacuucuguugacguccucaaaacagaaggcugacuggaucccucucgcccugacaaucaaaggccuaaaucccaccgccauuuuccugacuacccuuagccggacaaguaagaaaagaucuuggccacucaacgaggcuguuauggcagugggcauggucuccauacuggccagcucguugcugaagaaugacaucccgaugacugggccuuuaguagcgggaggucuccugaccgugugcuauguucuuacgggcaggucagcugaucuggaauuggagcgagccgcagacgugaaaugggaggaucaggccgaaauuucugggaguucccccauccucagcauuacaaucucugaggacggaagcauguccauaaagaacgaagaggaggaacaaacccugacuauccuaauucgcacaggccugcuugucaucucagguguguuuccaguaaguauucccaucaccgcugcagccugguaccucugggaggugaagaaacagcgggcggggguccugugggauguuccuagcccacccccuguggaaaaggcugaguuggaagacggagccuauagaauaaaacagaggggcauuuuaggcuacucucagaucggggcaggaguguauaaggaggguacuuuccacacaauguggcaugucacccguggcgccgugcugaugcaccgcgggaaacggaucgagccguccugggcugauguuaagaaggaccucauuucauacggaggcgguuggaaacuggaaggggaguggaaggaaggagaggaaguacaagugcuugcccuggagccaggcaaaaaucccagagcaguccagacgaagccuggcaucuuuaaaacuaacaccgggacaauaggagcugugaguuuggauuucagcccagguaccuccggcucucccauuguugacaggaaggggaagguggucggacuauacggcaauggugugguaacacgaucgggggccuaugucagcgcgaucgcccagacugagaaaucaauugaagauaacccugagaucgaagacgauauauuucggaagaaacgccugaccauuauggaccuccauccgggagcaggcaagacgaaaagauaccugcccgcuaucgugagggaggccaucaagcggggccuucgaacauuaauucuggcuccaacuagaguuguggcagccgaaauggaggaggcccuccgcggguugccuaucagguaucagacccccgcuauuaagacagaacacaccggacgugagauagucgaccugaugugucaugcgacuuucaccaugcggcuccuguccccagugagaguuccuaacuacaaucuuaucauuauggaugaagcacacuucacagaccccgccaguaucgcugccagggguuauaucucuacgcgcguggagaugggcgaggcagccgggauuuuuaugacugcuaccccaccgggaagccgagauccuuucccccaauccaacgcgccaauaauggacgaagagagagaaauccccgagcggucauggaacucuggccacgaaugggucacagauuuuaaagguaagaccgugugguucguaccuagcauuaaagccgggaacgacaucgcagcuugccugaggaagaauggcaagaaggugauucaguugagucgcaagacuuuugauuccgaguacguuaaaacacgugccaacgacugggauuucgucgugaccacggacaucagcgagaugggcgcaaauuuuaaggccgaaagagugauagauccacggagguguaugaaacccgucauccuaacugacggcgaggaacgcguaauucuggcugggccuaugccggugacacauucuucagccgcgcagcgaagaggacggaucgguaggaacccaaagaaugagaacgaccaauauauuuacaugggcgaaccccucgagaaugaugaggacugcgcacacuggaaagaagccaagauguuacuggauaacaucaauaccccugaggggauaauucccuccauguucgaaccagagcgcgaaaaaguugacgcuaucgauggagaguacagacuuaggggcgaggcccggaagaccuuuguggaccugaugcgucgcggugaucucccugucugguuggcuuauaagguggcagccgaagggauuaacuacgcugaccgaaaaugguguuucgauggcaucagaaauaaccagauacuggaggaaaacauggagguugagaucuggacuaaggaaggagagaggaaaaagcucaaaccccgguggcuggacgcccgcauuuauagugauccacuugcacuaaaggaauuuaaggaguucgcggccggcagaaaaagccugacauugaauuuaaucaccgaaauggggaagcugccuacauucaugacucagaaagcuaggaacgcccucgacaaucuggcagugcuucauacggcugaggccggaggucgggcauacaaccacgcccugucggagcucccggaaaccuuggagacacugcuacugcucacucuucuggcuaccgucacaggcgggauauuuuuauucuugaugucuggaaagggcaucgguaaaaugacccuggggaugugcugcauaauuacugcguccauccuccugugguaugcccagauccaaccccacuggauugcagcuagcaucauacuugaauuuuuccugauugugcucuugaucccagagccugaaaagcagcgaacgccccaggauaaucagcugaccuacguagugauugccaucuuaacaguugucgccgcaacuauggcuaacgagaugggcuuucuagagaagaccaaaaaggaccugggacucggcucaauaacaacccaagaaagugagucuaauauccuugacauugaucugagaccagccuccgcguggacuuuguaugcuguggccacaacguucgugaccccuaugcugcgccauagcaucgaaaacucaagugucaauguuagccucacugcaauugccaaccaggcuacagugcugauggggcuuggaaaagguuggccccucuccaagauggacaucggcguaccgcuguuggcaauuggguguuacucucaggugaauccaaucacccugaccgccgcguuacuacugcucgucgcucacuacgccauaauuggaccuggccuucaggcaaaagccacaagggaggcucaaaagcgggccgcagcugguaucaugaagaaccccacuguggaugggaucacgguuauugaccuggaaccaauacccuaugauccuaaauuugagaagcaguugggccaggugaugcugcucauccugugcgucacccagguacuuaugaugcguacaacuugggccuuaugugaggcgcugacccucgccacaggaccgauuagcaccuugugggaaggcaaucccgggagauucuggaacacuacgaucgcaguguccauggcuaauauuuuuaggggaucauaccuggccggcgcaggucuacuguucucuaucaugaaaaacacaaccaauacucgccgggggaccggaaacauaggcgagacacucggugaaaaguggaaaagucgacuuaacgcucugggcaagucggaguuucaaaucuauaaaaagagcgggauucaggagguugacagaacuuuggccaaggaaggaaucaaaaggggcgagaccgaucaucacgccgugucccgcgggucugcgaagcugcggugguucgucgaaagaaauauggugacaccagagggaaaagucguggaccucggcugcggucgugggggauggucauacuauuguggcggucugaagaacguuagggaagugaaaggcuuaacgaaagggggaccuggccaugaggagcccauuccuaugagcaccuacggguggaaucuuguacggcugcaguccggaguggaugucuuuuucacuccacccgaaaagugcgacacacuccuaugugauaucggcgagaguucuccuaacccaaccauagaagcuggucgcacucugcgaguuuugaaucugguggagaacuggcucaauaacaauacacaauucugcauuaaaguccuuaaccccuauaugccgagcgugaucgaaaagauggaggcacugcagagaaaauacgggggagccuugguaaggaauccucugucacggaacuccacccacgagauguacugggugaguaaugcuacgggcaacaucguuagcucugugaauaugauuucccgcaugcucauaaacagauuuaccaugaagcacaaaaaggccacauaugaaccagacgucgauuuaggcucagggacuaggaacaucggaauugagagcgaaauccccaaucuggacauuaucgguaagcgaauagagaaaaucaagcaggaacaugagaccucguggcacuacgaccaggaucauccuuauaaaacaugggcauaccacggcucuuaugagacuaagcaaaccgggagugccuccagcauggugaacggagucgugcggcuucugacaaaaccaugggacguuguacccauggugacccagauggcuaugacugauacgacaccguucggccagcagcgugucuuuaaggaaaagguggacaccagaacucaagagccuaaagaagguaccaagaaacuaaugaagauuacagcggaguggcucuggaaagagcuggggaagaaaaagacgccccgcauguguaccagggaagaguucacucggaagguuagaucaaaugccgcauugggagcuaucuuuacagaugaaaacaaauggaaguccgcccgcgaggcaguggaagacggcagguucugggagcuggucgaucgagagcggaaucuccaccuugaaggcaaaugcgagaccuguguguacaacaugauggggaagagagagaaaaagcugggagaguuugguaaggccaaaggcucuagggcuauuugguauaugugguuaggggcccgcuuccuggaauuugaggcguugggauuccucaaugaggaccauugguuuagccguggcaacagucuguccgguguagaaggggagggacuacaccggcuuggcuacauccugagagaugugggcaagaaagaagggggagcaauguacgccgacgauacugcugguugggacacaaggauuacccucgaggaccugaagaaugaagagaugguuacaaaccauaugaaaggcgagcacaagaaguuggccgaagcaauauucaaacugacuuaucagaauaaggucgugcgcgugcagcgaccaaccccucgggggacggucauggauaucauuagcagaagggaccagcgcggaucuggccaaguugguaccuacgggcucaacacauuuacuaauauggaggcucagcuuaucagacagauggaaggagagggcaucuucaaaucaauucaacaucugaccgccacagaggaaauagcugugcagaacugguuagcccggguaggcagggagcgucugagucgaauggcaaucuccggggaugacugcguggucaagcccauugaugaccgcuucgcgagcgccuugacugcucucaaugauaugggaaaagugagaaaggacauccagcagugggaaccaucucgggguuggaacgauuggacccaaguucccuuuugcucgcaccacuuccaugagcuggugaugaaggacggcaggguccuagugguaccuugucgcaaccaggaugaacuuauugggagagcccggaucucacagggagcaggcuggagccugaaagagacggcuugccucgguaaguccuaugcccagauguggacacugauguacuuucacaggcgagacuugcguuuagcagccaaugcgauauguagugcuguuccaccgcauugggugcccaccucuagaacuacauggagcauccacgccaaacacgaguggaugaccacugaagauaugcuggcagucuggaaccgcguguggauucaagggaauccuuggauggaggacaagaccccaguggaauccugggaggaaguccccuaucucggaaaacgggaggaccaguggugcggcucacuuaucggccugacaaguagggccacgugggcuaagaacauucagaccgccaucaaucagguuagaucucuaauagggaacgaggaauacacugauuauaugccuagcaugaagcgcuuccggagggaggaagaggaagcaggagugcugugguga

SEQ ID NO: 14523 - RNA, 9876 nt, Artificial Sequence
  derived and/or modified CDS sequence (opt3) from DENV-2__FJ850120__SS-prME
accgccggcgugaucgucaugcugauucccacagcuauggcauuccaccucacuacgagaaacggggagccucauaugauaguuggaaggcaggaaaaggguaaaagccuucuguuuaagaccgaggacggcgugaauaugugcacauugauggccaucgauuuaggggaacugugugaggacacuauuaccuacaaaugcccacuacuccggcaaaacgaaccggaggauaucgacuguuggugcaauuccacaucuaccuggguaacuuauggaacauguaccacgacuggcgagcaccgccgagaaaagcguucaguggcgcuggucccccauguggguauggggcuugagaccagaacagaaacuuggaugaguagcgagggagcuuggaaacacguucagaggauugagaccuggauccugcggcauccuggcuucacaauaauggccgcaaucuuggccuacaccauuggcacgacucacuuucagcgcgcucucaucuucauucugcugacagcaguggccccauccaugaccaugagaugcaucgggauaucuaacagggauuuugucgaaggagugucggguggcucauggguagacauuguucucgagcacgggagcugugugacuacaauggcuaagaauaagcccaccuuagauuucgaacugaucaaaacggaggccaagcagccugcgacccuucggaaauauugcauugaagcaaaguugacaaacacuaccacagagagucgcuguccaacucaaggagagcccucccugaaugaagagcaggacaaacgauuuaucugcaagcauucuauggucgauagaggcugggguaacggguguggacuauucggcaagggcgggaucgugaccugcgccauguuuacaugcaaaaagaauauggaaggaaaagugguccagccugagaaccucgaauacaccauuguuauaacuccacacagcggugaggagcaugcugugggcaaugacacggggaagcacggaaaagaaaucaagauuacaccgcaguccucaguaaccgaggccgaacugacuggcuaugguaccgugacaauggaguguagucccaggaccgggcuugauuucaacgaaaugguccuguugcaaauggaggacaaagcauggcucgugcaccggcagugguuucuggauuuaccucugccauggcuccccggcgcugacacucagggaagcaauuggauccagaaggagacacuuguuacguucaagaacccucaugccaaaaagcaagacguggucgugcugggcucucaggaaggggcgaugcacaccgccuugacuggagcaacagagauacagauguccucagguaaucuacuguuuaccggccaucucaaaugccgucugcgcauggauaagcuucaacugaaagggaugagcuacaguauguguacaggaaaguucaagauuguaaaagaaaucgcugagacucagcacggcaccaucguuauuagagugcaguaugagggugacgggucuccaugcaagauccccuucgaaauuacggauuuggagaaaaggcauguccucggccggcugauaaccgugaacccgaucgucacagaaaaggacuccccugugaacauugaggccgaacccccauuuggagauagcuacaucaucauuggcguugagccugggcaguuaaaacugaauugguucaagaagggaucgucuauaggucaaauguuugagacuaccaugcgaggcgcuaaacgcauggccauccuaggggacacagcaugggauuucggaucccucggcgguguguuuacuucaauugggaaggcccugcaccagguauucggcgcuaucuacggagcggcauuuaguggcgucagcuggaccaugaaaauucuuaucggggugauaaucacguggauuggaaugaacuccagaucuacaagcuugucaguuagucuggugcucgucggcgugguaacccuguaucuuggugccauggugcaggcugacuccggguguguugucagcuggaagaauaaagaacugaagugcggaucuggcaucuucauuacugauaacgugcacacauggaccgagcaguacaaguuucaacccgaaucaccaaguaaauuggccagcgcaauccagaaggcccaugaggaagguauauguggcauuagguccgugacucggcucgagaaucugauguggaaacagaucacccccgaguuaaaccacauucugucugaaaaugaggucaagcuaacaaucaugacgggggacauacgcggaaucaugcaggcuggcaaaagaucgcucaggccucaaccaaccgaacugaaguauagcuggaaaacuugggggaaggccaagaugcuuuccacagagucacauaaccagaccuucuugauugauggaccggaaacagcagagugccccaauacuaaccgugcguggaauagucuggagguugaagacuacggcuuugguguguucaccacgaacaucuggcucaaacugcgggagaagcaggacguguuuugugauucuaaauuaaugagcgcugccauuaaggacaaucgagcaguacacgccgauaugggguauuggaucgaauccgcucugaacgacacauggaaaauggagaaggccucauucauagaggucaagagcugccacuggccuaaaucucauacccuuugguccaauggaguguuggaaagugagaugauuaucccaaagaacuucgcaggccccguuagccagcacaacuacagaccugguuaucauacucaaaccgcuggcccauggcaccucgggaaacuggaaauggauuuugaccuaugugagggaacaacuguggucgugaccgaagauugcggcaauagggggcccucucugcgcacaacgaccgccuccggaaagcucaucacugaguggugcugucggucaugcacacugccgccucuuagauacaggggcgaggacgguuguugguacgggauggaaauucgcccauugaaagagaaggaagagaaccugguuaauaguuuagugaccgcgggacauggccagaucgauaacuucagccucgguguacugggcauggcccuuuuucuggaagagauguugcgaacucggauugggacaaagcacgcuauacuccuggucgcagugucguucgugacccuaaucacgggaaauauguccuuucgugaccugggcagagucaugguuauggugggggccacuaugaccgaugacauuggaaugggcguaacauaucucgcucugcuugccgcauucaaagugaggcccaccuuugcggccgguuugcuguuacgcaagcucacuucuaaagagcugaugauggcuacaaucgggauugcccuucugagccagucaaccaucccugaaacaauacuagagcucacugaugcacuggcuuugggaaugaugguccugaagaucgugcggaacauggaaaaauaccaauuagccguuaccauuauggcaaucaguugcgugcccaaugccgucauucuccagaacgcuuggaagguguccuguacgauccuggcggccguuucugugagcccacuucuguugacauccucacagcagaaggcagacuggauaccucucgcucugaccauuaaaggccuaaaucccacugccaucuuccugaccacacuuagcagaacuaguaagaaaaggucuuggccacucaacgaggccaucauggcugucggcaugguauccauucuggcaagcucguugcugaagaaugacauaccgaugaccgggccuuuaguggccggaggucuccugacgguuugcuaugugcuuacaggccgaucagcggaucuggaauuggagcgcgcugccgacgucaaaugggaggaucaagcagaaaucucugggaguucccccauucucagcaucaccauuucugaggacggaagcauguccaucaagaacgaagaggaggaacagacucugacaauacuaauccggaccggccugcuugugauuucagguguauuuccagugaguauccccauuacugccgcugcaugguaccucugggaggucaaaaagcagagagccgggguucugugggaugugccuagcccacccccuguggaaaaggcgaaauuggaggacggagcuuauaggaucaagcagcguggcauauuaggcuacucucaaauuggggccggagucuauaaagaagguacauuccacaccauguggcaugugacgcgcggcgcaguucugaugcaccgggggaagagaaucgagccguccugggccgauguaaaaaaggaccucaucucauacggaggcgguuggaagcuggagggggaauggaaagagggagaagaggugcagguccuugcucuggaaccaggcaagaaucccagggccgugcagacuaaaccuggcauuuuuaagaccaacacagggaccaucggagcaguuaguuuggauuucagcccagguacauccggcucucccauaguggaccgaaaagggaaggucgugggacuauacggcaaugguguagucacucggucgggggcuuaugugagcgccauugcgcagaccgagaagaacaucgaggauaacccugaaauugaggacgauaucuuucgcaaaaagagacugacgauaauggaccuccauccgggagccggcaaaacaaagagguaccugcccgcaauuguucgggaagcuaucaaacgaggccuuagaacuuuaauccuggccccaacccgcguggucgcugcagagauggaagaggcccucaggggguugccuauucguuaucaaacacccgccaucaagaccgagcacacuggacgggaaauuguggaccugaugugucaugcuaccuucacaaugagacuccugucaccaguuagggugccuaauuacaaccuuauaaucauggaugaggcgcacuucacggaccccgcauccauugccgcucgcgguuauaucaguacucgagucgaaaugggcgaggccgcagggaucuuuaugaccgccacaccaccgggaucuagagauccuuucccccagagcaaugcuccaauuauggacgaggaacgggagauacccgaaagguccuggaacucaggccacgagugggugaccgauuuuaaggguaaaacuguaugguucgugccuucuaucaaggcggggaaugacauugccgcaugccugcgcaaaaacggaaagaaaguuauccaguugagccguaagacauuugauagugaauacgucaagaccagagcuaaugacugggauuucguggugacgacugacauuuccgagaugggcgccaacuuuaaagcagagcgggucaucgauccaaggcgcuguaugaagcccguaauacuaacagacggcgaagagcgagugauccuggccgggccuaugccgguuacccauagcucugcugcccaaagacggggaaggauuggucgcaauccaaaaaacgaaaaugaccaguauaucuacaugggcgagccccucgaaaacgaugaggacugcgcgcacuggaaggaggcaaaaauguuacuggauaauauuaacaccccugaagggaucauacccucaauguucgagccagaaagagagaagguggacgccauugauggagaauacaggcuucggggcgaggcucguaaaacuuuugucgaccugaugcgccgaggugaucucccugugugguuggccuauaagguugcugcagaggggaucaauuacgccgacagaaagugguguuucgauggcauuaaaaacaaccagauccuggaagagaauauggaaguggagauauggacaaaggagggagaaaggaaaaagcucaaaccccgguggcuggacgcucgcaucuauuccgauccacuugcccuaaaggaguuuaaggaauucgcagcgggcagaaaaagucugaccuugaacuuaauuacagagauggggaggcugccuacuuucaugacgcagaaggcccggaaugcucucgacaaccuggccguccuucauaccgcagaagcuggaggucgagccuacaaucacgcacugagcgagcucccggagacauuggaaacucugcuacugcucacccuucuggccacagugaccggcgggaucuuuuuauucuugaugucgggaaaaggcauugguaagaugacucuggggaugugcugcaucauaacggcuucuauucuccugugguaugcgcaaauccagccccacuggaucgccgcauccauuauccuugaguuuuuccugauaguacucuugauuccagaaccugagaaacagagaaccccccaggauaaccaacugacauacgugguuaucgcuauuuuaacugucguggccgccaccauggcaaaugaaaugggcuuucuagagaagacaaagaaagaccugggacucggcagcaucaccacucaggagucagaaaguaacauacuugacaucgaucugcgcccagcuucugccuggacauuguaugcgguggcuacgaccuucgucacuccuaugcugaggcauuccauugagaauagcucaguuaacgugagucucacagccaucgcaaaucaggccaccguacugauggggcuuggaaaggguuggccccucagcaaaauggacauuggcgugccgcuguuggcuaucggguguuacucccaggucaacccaauuacccugacagcagccuuacuacugcucguggcgcacuacgcuaucauaggaccuggccuucaagccaaggcaacucgggaagcccagaaacgugcugccgcagguauuaugaagaaucccacgguugaugggaucaccgugaucgaccuggagccaauucccuaugauccuaaguuugaaaaacaguugggccaggucaugcugcucauacugugcguaacacaagugcuuaugaugagaacuaccugggcuuuaugugaggcccugacacucgcgaccggaccgaucucuacuuugugggagggcaaccccgggagguucuggaauacgacaauugccguuagcauggcaaacaucuuucgcggauccuaccuggcuggcgccggucuacuguucucaauuaugaagaauaccacuaacacccggcgagggacaggaucuaucggcgaaacucucggugagaaauggaagaguagacuuaacgcacugggcaaaucggaauuucagauauauaagaaaagcgggauccaggagguggacaggaccuuggcuaaggagggaauuaagcgcggcgaaacagaucaucacgccgucucccgggggucugccaaacugagaugguucguggagcguaauauggucacgccagaaggaaaggugguugaccucggcugcgguagggggggauggucauacuauuguggcggucugaaaaacgugcgggagguaaagggcuuaaccaaagggggaccuggccaugaagagcccaucccuaugagcacuuacggguggaaucuugugcgccugcaauccggagucgauguuuuuuucacaccacccgagaagugcgacacccuccuaugugauauuggcgaaaguucuccuaacccaacuaucgaggcgggucgaacacugagaguguugaaucuggucgaaaacuggcucaauaacaauacccaguucugcauaaaggugcuuaaccccuauaugccgagcguaauugagaaaauggaagcucugcagaggaaguacgggggagcauuggugcggaauccucugucacgcaacuccacgcacgagauguacuggguuaguaaugccaccggcaacaucgugagcucugucaauaugaucuccagaaugcucauuaacagguuuacaaugaaacacaagaaagcuacuuaugagccagacguggauuuaggcucagggacccgaaacauaggaaucgaaaaugagauucccaaccuggacaucauugguaagcggaucgaaaagauaaaacaggagcaugaaacaagcuggcacuacgaccaagaucauccuuauaagacuugggccuaccacggcucguaugagaccaaacagacagggucugcaaguuccauggucaauggagugguucgucuucugaccaagccaugggacguagugcccauggucacucagauggccaugacggauacaaccccguucggccagcaaagaguguuuaaagagaagguugacacucgcacccaggaaccuaaggaggguacaaaaaagcuaaugaaaaucacggcugaauggcucuggaaggagcuggggaaaaagaaaacccccaggauguguacucgggaggaauucacaagaaaggugcgcagcaacgcggccuugggagcaauuuuuaccgaugagaauaaguggaaaucagcuagggaagccgucgaggacucccgauucugggaacugguggaucgggagagaaaccuccaccuugagggcaagugcgaaacuuguguauacaauaugaugggcaaaagggagaagaaacugggggaauuuggaaaggcaaaggguucucgcgccaucugguauaugugguuaggcgcucguuuccuggaguuugaagccuugggguuccucaacgaggaccauugguuuagccggggaaauagucuguccggcguggagggugaagggcuacacagacuuggauacauucugagggauguuggcaaaaaggagggcggggcgauguacgcagacgauacagccggaugggacacccgcaucacacucgaagaccugaaaaacgaggaaauggucacuaaucauaugaagggugagcacaaaaaguuggcugaggccauuuucaagcugaccuaucagaacaaaguggugcgaguccagcggccaacgccuagaggcaccguuauggauauaaucagcaggcgcgaccaaagagggucuggacaggugggcacauacggucucaauacuuuuaccaacauggaagcacagcuuauucggcaaauggagggggaaggaaucuucaagucaauccagcaucugacagcuacugaggagauugccguacagaauugguuagcuagggugggccgugaacgacugagucgcauggccauauccggcgaugacugcgucgugaaacccaucgaugacagauucgcaagcgcguugaccgcccucaacgauauggggaagguucggaaagacauucagcaaugggagccaucuaggggauggaacgauuggacgcaggugcccuuuugcucgcaccacuuccaugaacuggucaugaaggacggucgcgugcuaguaguuccuuguagaaaucaggaugagcuuaucggccgggcuaggauuucacagggggccggauggagccugaaggaaacagcaugccucggcaaauccuaugcucaaauguggacccugauguacuuucaccgacgugacuugagauuagccgcaaacgccaucuguagugcggugccaucucauugggucccgacuagccgcacaaccugguccauacacgcuaagcacgaguggaugacuaccgaggauaugcuggccguguggaaucggguguggauccaggaaaaccccuggauggaggacaaaacaccugucgaaucaugggaggaaguuccauaucucgguaagagggaggaccaguggugcgggagucuuauuggacugacgucuagagcaaccugggccaaaaauauccagacugcuauuaaccaagugcgcagccuaaucggcaaugaggaauacacagauuauaugcccuccaugaagcgguucaggcgagaggaagaggaagccggcguacugugguga

SEQ ID NO: 14524 - RNA, 9876 nt, Artificial Sequence
  derived and/or modified CDS sequence (opt3) from DENV-2__FJ850121__SS-prME
acagcaggcgugauagucaugcugauuccaacagcuauggcuuuccaccucacuacgagaaacggggagccucauaugauaguuggaaggcaggaaaaggguaaaagccuucuguuuaagaccgaggacggcgugaauaugugcacauugauggccaucgauuuaggggaacugugugaggacacuauuaccuacaaaugcccacuacuccggcaaaacgaaccggaggauaucgacuguuggugcaauuccacaucuaccuggguuacuuauggaacauguaccacgacuggcgagcaccgccgagaaaagcguucaguggcgcuggucccacauguggguauggggcuugagaccagaacagaaacuuggaugaguagcgagggagcuuggaaacacguucagaggauugagaccuggauccugcggcauccuggcuucacaauuauggccgcaaucuuggccuacaccauuggcacgacucacuuucagcgcgcucucaucuucauucugcugacagcaguggccccauccaugaccaugagaugcaucgggauaucuaacagggauuuugucgaaggagugucggguggcucauggguagacauuguucucgagcacgggagcugugugacuacaauggcuaagaauaagcccaccuuagauuucgaacugaucaaaacggaggccaagcagccugcgacccuucggaaauauugcauugaagcaaaguugacaaacacuaccacagagagucgcuguccaacucaaggagagcccucccugaaugaagaacaggacaaacgauuuaucugcaagcauucuauggucgauagaggcugggguaacggguguggacuauucggcaagggcgggaucgugaccugcgccauguuuacaugcaaaaagaauauggaaggaaaaauugugcagccugagaaccucgaauacaccauagucaucacuccacacagcggugaggagcaugcuguuggcaaugacacggggaagcacggaaaagaaauuaagaucacaccgcaguccucaauaaccgaggccgaacugacuggcuaugguaccgugacaauggaguguagucccaggaccgggcuugauuucaacgaaaugguacuguugcaaauggaggacaaagcauggcucgugcaccggcagugguuucuggauuuaccucugccauggcuccccggcgcugacacucagggaagcaauuggauucagaaggagacacuugucacguucaagaacccucaugccaaaaagcaagacgugguugugcugggcucucaggaaggggcgaugcacaccgccuugacuggagcaacagagauccagauguccucagguaaucuacuguuuaccggccaucucaaaugccgucugcgcauggauaaacuucaacugaaagggaugagcuacaguauguguacaggaaaguucaagaucgucaaagaaauugcugagacucagcacggcaccaucgugauuagaguacaguaugagggugacgggucuccaugcaagauacccuucgaaaucacggauuuggagaaaaggcauguucucggccggcugauuaccgugaacccgaucgucacagaaaaggacuccccugugaacaucgaggccgaacccccauuuggagauagcuacauuauaaucggcgucgagccugggcaguuaaaacugaauugguucaagaagggaucgucuauuggucaaauguuugagacuaccaugcgaggcgcuaaacgcauggccauccuaggggacacagcaugggauuucggaucccucggcgguguguuuacuucaauugggaaggcccugcaccagguuuucggcgcuaucuacggagcggcauuuaguggcgugagcuggaccaugaaaauacuuaucgggguaauuaucacguggauuggaaugaacuccagaucuaccagcuugucagucagucuggugcucguuggcguggucacccuguaucuuggugccauggugcaggcugacuccggguguguagugagcuggaagaauaaagaacugaagugcggaucuggcaucuucauaacugauaacguucacacauggaccgagcaguacaaguuucaacccgaaucaccaaguaaauuggccagcgcaauucagaaggcccaugaggaagguaucuguggcauuagguccgucacucggcucgagaaucugauguggaaacagaucacccccgaguuaaaccacauacugucugaaaaugaggugaagcuaacaaucaugacgggggacauuaaaggaaucaugcaggcuggcaagcgcucgcucagaccucaaccaaccgaacugaaauauagcuggaagacuugggggaaggccaaaaugcuuuccacagagucacauaaccagaccuucuugauugauggaccggaaacagcagagugccccaauacuaacagggcguggaauagucuggagguggaagacuacggcuuuggugucuucaccacgaacaucuggcucaagcugcgugagaaacaggacguauuuugugauucuaaguuaaugagcgcugccauaaaagacaaucgggcagugcacgccgauaugggguauuggauugaauccgcucugaacgacacauggaagauggagaaggccucauucaucgaggugaaaagcugccacuggccuaagucucauacccuuugguccaauggaguauuggaaagugagaugaucauucccaagaauuucgcaggccccgucagccagcacaacuaccgaccugguuaucauacucaaaccgcuggcccauggcaccucgggaagcuggaaauggauuuugaccuaugugagggaacaacugugguugugaccgaagauugcggcaauagagggcccucucugaggacaacgaccgccuccggaaaacucaucacugaguggugcugucgcucaugcacacugccgccucuucgguacagaggcgaggacgguuguugguacgggauggaaauuaggccauugaaggagaaggaagagaaccuggucaauaguuuagugaccgcgggacauggccagauagauaacuucagccucgguguucugggcauggcccuuuuucuggaagagauguugcgcacucgaaucgggacaaaacacgugacccuccugguagcugucucguucgugacgcuaauuacuggaaauauguccuuucgggaccugggccgugugauggucaugguuggggcaaccaugacagaugacaucggaaugggcgugaccuaucucgcccugcuugcugccuucaagguaagacccacuuuugcagcggguuugcuguuaaggaaacucacaucuaaggagcugaugauggccaccauugggaucgcacuucugagccagucaacaauaccugaaacuauccuagagcucaccgaugcccuggcauugggaaugauggugcugaaaauuguccgcaacauggaaaaguaccaauuagcugugacgaucauggccauuaguugcguucccaaugcagugauccuccagaacgccuggaaggucuccuguacaauacuggcugcggugucuguuagcccacuucuguugaccuccucacagcagaaagccgacuggauuccucucgcacugacuaucaagggccuaaaucccaccgcuaucuuccugacaacucuuagccggaccaguaaaaagagaucuuggccacucaacgaggccauuauggccgugggcauggucuccauacuggcuagcucguugcugaaaaaugacaucccgaugacggggccuuuaguagcaggaggucuccugacagugugcuauguucuuaccggcaggucagccgaucuggaauuggagcgagcggcugacgugaagugggaggaucaagccgaaauuucugggaguucccccauccucagcauuacuaucucugaggacggaagcauguccaucaaaaacgaagaggaggaacagacacugaccauccuaauucgcacuggccugcuugucaucucagguguguuuccaguaaguauucccaucacagcagccgcuugguaccucugggaggugaagaagcagcgggcagggguccugugggauguuccuagcccacccccuguggaaaaagccgaguuggaagacggagcguauagaauaaagcagaggggcauuuuaggcuacucucaaaucggggcuggaguguauaaagaggguaccuuccacacgauguggcaugucacucguggcgccgugcugaugcaccgcgggaagcggaucgagccguccugggcagauguuaaaaaggaccucauuucauacggaggcgguuggaagcuggaaggggaguggaaagaaggagaggaaguacaggugcuugcccuggagccaggcaagaaucccagagcuguccagaccaaaccuggcaucuuuaagacaaacaccgggacaauaggagccgugaguuuggauuucagcccagguacuuccggcucucccauuguugacaggaaagggaagguggucggacuauacggcaauggugugguaacccgaucgggggcauaugucagcgcuaucgcccagacggagaagucaauugaagauaacccugagaucgaagacgauauauuucggaaaaagcgccugacaauuauggaccuccauccgggagcgggcaaaacuaagagauaccugcccgccaucgugagggaggcaaucaaacggggccuucgaaccuuaauucuggcuccaacaagaguuguggccgcugaaauggaggaggcacuccgcggguugccuaucagguaucaaacccccgccauuaagacugaacacaccggacgugagauagucgaccugaugugucaugccacauucacgaugcggcuccuguccccagugagaguuccuaacuacaaucuuaucauuauggaugaagcucacuucacugaccccgcgaguaucgcagccagggguuauaucucuacccgcguggagaugggcgaggcugccgggauuuuuaugacagcaaccccaccgggaagccgagauccuuucccccaguccaacgccccaauaauggacgaagagagagaaauccccgagcggucauggaacucuggccacgaaugggucacugauuuuaaggguaaaacagugugguucguaccuagcauuaaggcugggaacgacaucgcggccugccugaggaaaaauggaaagaaagugauucaguugagucgcaagaccuuugauuccgaguacguuaagacgcgugcaaacgacugggauuucgucgugacuacagacaucagcgagaugggcgcuaauuuuaaagccgaaagagugauagauccacggagguguaugaagcccgucauccuaaccgacggcgaggaacgcguaauucuggcagggccuaugccggugacccauucuucagccgcucaacgaagaggacggaucgguaggaaccccaaaaaugagaacgaccaguauauuuacaugggcgaaccccucgagaaugaugaggacugcgcccacuggaaggaagcgaaaauguuacuggauaacaucaauacuccugaggggauaauucccuccauguucgaaccagagcgcgaaaagguugacgcaaucgauggagaguacagacuuaggggcgaggcccggaaaacauuuguggaccugaugcgucgcggugaucucccugucugguuggcuuauaagguggccgcugaagggauuaacuacgcagaccgaaagugguguuucgauggcaucaaaaauaaccagauacuggaggaaaacauggagguugagaucuggaccaaggaaggagagaggaaaaagcucaaacccagauggcuggacgcccggauuuauagugauccacuugcucuaaaggaauuuaaggaguucgccgcaggccgcaaaagccugacauugaauuuaaucacugaaauggggagacugccuacguucaugacccagaaggcgaggaacgcccucgacaaucuggcugugcuucauacagccgaggcaggaggucgggcuuacaaccacgcccugucggagcucccggaaacuuuggagacccugcuacugcucacacuucuggcaaccgucacuggcgggauauuuuuauucuugaugucuggaaaaggcaucgguaagaugacgcuggggaugugcugcauaauuaccgccuccauccuccugugguaugcucaaauccagccccacuggauugcggccagcaucauacuugaauuuuuccugauugugcucuugaucccagagccugaaaaacagcgaacaccccaggauaaucaacugacuuacguagugauugcaaucuuaaccguugucgcugccacaauggccaacgagaugggcuuucuagagaagaccaagaaagaccugggacucggcucaauaacuacacaggaaagugagucuaauauccuugacauugaucugagaccagcauccgcuuggacguuguaugccguggcgaccacuuucgugacaccuaugcugcgccauagcaucgaaaacucaagugucaauguuagccucaccgcuauugccaaccaggcaaccgugcugauggggcuuggaaaggguuggccccucuccaaaauggacaucggcguaccgcuguuggccauuggguguuacucucaggugaauccaaucacacugacugcugcauuacuacugcucgucgcccacuacgcgauaauuggaccuggccuucaagcuaaggccacgagggaggcacagaaacgggccgcugccgguaucaugaagaaccccaccguggaugggaucacaguuauugaccuggaaccaauacccuaugauccuaaguuugagaaacaguugggccaggugaugcugcucauccugugcgucacucaaguacuuaugaugcguaccacaugggcauuaugugaggcucugacccucgccacuggaccgauuagcacguugugggaaggcaaucccgggagauucuggaacacaaccaucgcgguguccauggccaauauuuuuaggggaucauaccuggcaggcgcuggucuacuguucucuaucaugaagaacacuaccaauacacgccgggggacuggaaacauaggcgagacccucggugaaaaauggaagagucgacuuaacgcccugggcaaaucggaguuucagaucuauaagaaaagcgggauucaggagguugacagaacauuggcaaaggaaggaaucaagaggggcgagacggaucaucacgcugugucccgcgggucugccaaacugcggugguucgucgaaagaaauauggugaccccagagggaaaggucguggaccucggcugcggucgugggggauggucauacuauuguggcggucugaaaaacguuagggaagugaagggcuuaacuaaagggggaccuggccaugaggagcccauuccuaugagcacauacggguggaaucuuguacggcugcaauccggaguggaugucuuuuucaccccacccgaaaagugcgacacucuccuaugugauaucggcgagaguucuccuaacccaacaauagaagccggucgcacccugcgaguuuugaaucugguggagaacuggcucaauaacaauacgcaguucugcauuaagguccuuaaccccuauaugccgagcgugaucgagaaaauggaggcgcugcagagaaaguacgggggagcuuugguaaggaauccucugucacggaacuccacccacgagauguacugggugaguaaugcaacaggcaacaucguuagcucugugaauaugauuucccgcaugcucauaaacagauuuacuaugaaacacaagaaagccaccuaugaaccagacgucgauuuaggcucagggacaaggaacaucggaauugagagcgaaauccccaaucuggacauuaucgguaagcgaauagagaagaucaaacaggaacaugagacuucguggcacuacgaccaagaucauccuuauaagaccugggcuuaccacggcucuuaugagacaaaacagaccgggagugccuccagcauggugaacggagucgugcggcuucugacuaagccaugggacguuguacccauggugacgcagauggcaaugacagauaccacuccguucggccagcaacgugucuuuaaagaaaagguggacaccagaacacaggagccuaaggaagguacgaaaaagcuaaugaaaauuaccgccgaguggcucuggaaggagcuggggaaaaagaaaacuccccgcauguguacaagggaagaguucacccggaagguuagaucaaaugcugcguugggagccaucuuuacugaugaaaacaaguggaaauccgcacgcgaggcuguggaagacggcagguucugggagcuggucgaucgagagcggaaucuccaccuugaaggcaagugcgagacauguguguacaacaugauggggaaaagagaaaagaaacugggagaguuugguaaggccaagggcucuagggcaauuugguauaugugguuaggggcccgcuuccuggaauuugaggcuuugggauuccucaaugaggaccauugguuuagccguggcaacagucuguccgguguagaaggggagggacuacaccggcuuggcuacauccugagagaugugggcaaaaaggaagggggagccauguacgcggacgauaccgcagguugggacacaaggauuacucucgaggaccugaaaaaugaagagaugguuaccaaccauaugaagggcgagcacaaaaaguuggccgaagcuauauucaagcugacguaucagaauaaagucgugcgcgugcagcgaccaaccccucgggggacagucauggauaucauuagcagaagggaccaacgcggaucuggccagguugguacuuacgggcucaacaccuuuacaaauauggaggcccagcuuaucagacaaauggaaggagagggcaucuucaagucaauucagcaucugacugcaaccgaggaaauagcugugcagaacugguuagcccggguaggcagggagcgucugagucgaauggcuaucuccggggaugacugcguggucaaacccauugaugaccgcuucgccagcgcauugacggcgcucaaugauaugggaaaggugagaaaagacauccagcaaugggaaccaucucgggguuggaacgauuggacacagguucccuuuugcucgcaccacuuccaugagcuggugaugaaggacggcaggguccuagugguaccuugucgcaaccaggaugaacuuauugggagagcccggaucucacagggagcuggcuggagccugaaggagaccgccugccucgguaaauccuaugcacaaauguggacucugauguacuuucacaggcgagacuugcguuuagcugccaaugcaauauguagugccguuccaccgcauugggugcccacaucuagaaccacuuggagcauccacgcgaagcacgaguggaugaccacagaagauaugcuggcugucuggaaccgcguguggauucaggagaauccuuggauggaagacaaaacgccaguggaguccugggaagagguccccuaucucgggaagcgggaggaccaguggugcggaucacuuaucggccugaccaguagggccacuugggccaaaaacauucagacagccaucaaucaaguuagaucucuaauaggcaacgaagaguacaccgauuauaugccuagcaugaagcgcuuccggagggaagaggaagaggcuggggugcugugguga

SEQ ID NO: 14525 - RNA, 9876 nt, Artificial Sequence
  derived and/or modified CDS sequence (opt3) from DENV-2__GQ199897__SS-prME
accgccggcgugauaguaaugcugauucccacggcuauggcauuccaccucacuacgagaaacggggagccucauaugauaguuggaaggcaggaaaaggguaaaagccuucuguuuaagaccgaggacggcgugaauaugugcacauugauggccaucgauuuaggggaacugugugaggacacuauuaccuacaaaugcccacuacuccggcaaaacgaaccggaggauaucgacuguuggugcaauuccacaucuaccuggguaacuuauggaacauguaccacgacuggcgagcaccgccgagaaaagcguucaguggcgcuggucccccauguggguauggggcuugagaccagaacagaaacuuggaugaguagcgagggagcuuggaaacacguucagaggauugagaccuggauccugcggcauccuggcuucacaauaauggccgcaaucuuggccuacaccauuggcacgacucacuuucagcgcgcucucaucuucauucugcugacagcaguggccccauccaugaccaugagaugcaucgggauaucuaacagggauuuugucgaaggagugucggguggcucauggguugacauuguucucgagcacgggagcugugugacuacaauggcuaagaauaagcccaccuuagauuucgaacugaucaaaacggaggccaagcagccugcgacccuucggaaauauugcauugaagcaaaguugacaaacacuaccacagagagucgcuguccaacucaaggagagcccucccugaaugaagaacaggacaaacgauuuaucugcaagcauucuauggucgauagaggcugggguaacggguguggacuauucggcaagggcgggaucgugaccugcgccauguuuacaugcaaaaagaauauggaaggaaaagugguccagccugagaaccucgaauacaccauuguuauaacuccacacagcggugaggagcaugcugugggcaaugacacggggaagcacggaaaagaaaucaagauuacaccgcaguccucaaucaccgaggccgaacugacuggcuaugguaccguaacaauggaguguagucccaggaccgggcuugauuucaacgaaauggugcuguugcaaauggaggacaaagcauggcucguccaccggcagugguuucuggauuuaccucugccauggcuccccggcgcugacacucagggaagcaauuggauacagaaggagacacuugugacguucaagaacccucaugccaaaaagcaagacguugugguccugggcucucaggaaggggcgaugcacaccgccuugacuggagcaacagagauucagauguccucagguaaucuacuguuuaccggccaucucaaaugccgucugcgcauggauaaacuucaacugaaagggaugagcuacaguauguguacaggaaaguucaagaucgugaaagaaaucgcugagacucagcacggcaccauuguaaucagaguucaguaugagggugacgggucuccaugcaagauucccuucgaaauaacggauuuggagaaaaggcaugugcucggccggcugaucaccgucaacccgauugugacagaaaaggacuccccugucaacaucgaggccgaacccccauuuggagauagcuacaucauuauaggcguggagccugggcaguuaaaacugaauugguucaagaagggaucgucuaucggucaaauguuugagacuaccaugcgaggcgcuaaacgcauggccauucuaggggacacagcaugggauuucggaucccucggcgguguuuuuacuucaaucgggaaggcccugcaccagguguucggcgcuauuuacggagcggcauuuaguggcguaagcuggaccaugaaaauccuuauaggggucaucauuacguggaucggaaugaacuccagaucuacuagcuugucagugagucugguucucgugggcgucgugacccuguaucuuggugccaugguacaggcugacuccgggugugugguuagcuggaagaauaaagaacugaagugcggaucuggcauuuucaucacugauaacguccacacauggaccgagcaguacaaguuucaacccgaaucaccaaguaaauuggccagcgcaauacagaaggcccaugaggaagguauuuguggcaucagguccgugacucggcucgagaaucugauguggaaacagauuacccccgaguuaaaccacauccugucugaaaaugaggugaagcuaacaauaaugacgggggacaucaaaggaauuaugcaggcuggcaagcgcucgcucagaccucaaccaaccgaacugaaauauagcuggaagacuugggggaaggccaaaaugcuuuccacagagucacauaaccagaccuucuugaucgauggaccggaaacagcagagugccccaauacuaacagggcguggaauagucuggaggucgaagacuacggcuuugguguuuucaccacgaacauuuggcucaagcugcgugagaaacaggacguguuuugugauucuaaguuaaugagcgcugccaucaaagacaaucgggcagugcacgccgauaugggguauuggauagaauccgcucugaacgacacauggaagauggagaaggccucauucauugagguaaaaagcugccacuggccuaagucucauacccuuugguccaauggagucuuggaaagugagaugaucauccccaagaauuucgcaggccccgugagccagcacaacuaccgaccugguuaucauacucaaaccgcuggcccauggcaccucgggaagcuggaaauggauuuugaccuaugugagggaacaacuguuguggucaccgaagauugcggcaauagagggcccucucugaggacaacgaccgccuccggaaaacucauuacugaguggugcugucgcucaugcacacugccgccucuucgguacagaggcgaggacgguuguugguacgggauggaaaucaggccauugaaggagaaggaagagaaccuggugaauaguuuaguuaccgcgggacauggccagauugauaacuucagccucggugugcugggcauggcccuuuuucuggaagagauguugcgcacucgaauagggacaaaacacgcuauccuccugguagcagucucguucgugacccuaauuacgggaaauauguccuuucgggaccugggccgugugauggucaugguuggggccacuaugaccgaugacaucggaaugggcgugacauaucucgcucugcuugccgcauucaagguaagacccaccuuugcggccgguuugcuguuaaggaaacucacuucuaaggagcugaugauggcuacaauugggaucgcccuucugagccagucaaccauaccugaaacaauccuagagcucacugaugcacuggcuuugggaaugauggugcugaaaauuguccgcaacauggaaaaguaccaauuagccgugaccaucauggcaauuaguugcguucccaaugccgugauccuccagaacgcuuggaaggucuccuguacgauacuggcggccgugucuguuagcccacuucuguugacauccucacagcagaaagcagacuggauuccucucgcucugaccaucaagggccuaaaucccacugccaucuuccugaccacacuuagccggacaaguaaaaagagaucuuggccacucaacgaggccauuauggcugugggcauggucuccauacuggcaagcucguugcugaaaaaugacaucccgaugaccgggccuuuaguagccggaggucuccugacggugugcuauguucuuacaggcaggucagcggaucuggaauuggagcgagcugccgacgugaagugggaggaucaagcagaaauuucugggaguucccccauccucagcauuaccaucucugaggacggaagcauguccaucaaaaacgaagaggaggaacagacucugacaauccuaauucgcaccggccugcuugucgugucagguguauuuccagugaguauccccauuacugccgcugcaugguaccucugggaggucaagaagcagcgggccgggguucugugggaugugccuagcccacccccuguggaaaaagcggaguuggaagacggagcuuauagaaucaagcagaggggcauauuaggcuacucucaaauuggggccggagucuauaaagaggguacauuccacaccauguggcaugugacgcguggcgcaguucugaugcaccgcgggaagcggaucgagccguccugggccgaugucaaaaaggaccucaucucauacggaggcgguuggaagcuggaaggggaguggaaagaaggagaggaagugcagguccuugcucuggagccaggcaagaaucccagagccgugcagacuaaaccuggcauuuuuaagaccaacacagggaccaucggagcaguuaguuuggauuucagcccagguacauccggcucucccauaguggacaggaaagggaaggucgugggacuauacggcaaugguguagucacucgaucgggggcuuaugugagcgccauugcgcagaccgagaagucaaucgaagauaacccugagauugaagacgauaucuuucggaaaaagcgccugacgauaauggaccuccauccgggagccggcaaaacaaagagauaccugcccgcaauuguuagggaggcuaucaaacggggccuucgaacuuuaauccuggccccaaccagaguggucgcugcagaaauggaggaggcccuccgcggguugccuauuagguaucaaacacccgccaucaagaccgaacacacuggacgugagauuguggaccugaugugucaugcuaccuucacaaugcggcuccuguccccaguuagagugccuaacuacaaucuuauaaucauggaugaagcgcacuucacggaccccgcaaguauugccgcuagggguuauaucucuacucgcgucgagaugggcgaggccgcagggaucuuuaugaccgccacaccaccgggaagccgagauccuuucccccaguccaacgcuccaauuauggacgaagagagagaaauacccgagcggucauggaacucuggccacgaaugggugaccgauuuuaaggguaaaacuguaugguucgugccuagcaucaaggcggggaacgacauugccgcaugccugaggaaaaauggaaagaaaguuauccaguugagucgcaagacauuugauuccgaguacgucaagacccgugcuaacgacugggauuucguggugacgacugacauuagcgagaugggcgccaauuuuaaagcagaaagagucaucgauccacggagguguaugaagcccguaauacuaacagacggcgaggaacgcgugauccuggccgggccuaugccgguuacccauucuucagcugcccaacgaagaggacggauugguaggaaccccaaaaaugagaacgaccaguauaucuacaugggcgaaccccucgagaaugaugaggacugcgcgcacuggaaggaagcaaaaauguuacuggauaacauuaauaccccugaggggaucauacccuccauguucgaaccagagcgcgaaaagguggacgccauugauggagaguacagacuuaggggcgaggcucggaaaacuuuugucgaccugaugcgucgcggugaucucccugugugguuggccuauaagguugcugcagaagggaucaacuacgccgaccgaaagugguguuucgauggcauuaaaaauaaccagauccuggaggaaaacauggagguggagauauggacaaaggaaggagagaggaaaaagcucaaacccagauggcuggacgcucggaucuauagugauccacuugcccuaaaggaauuuaaggaguucgcagcgggccgcaaaagccugaccuugaauuuaauuacagaaauggggagacugccuacuuucaugacgcagaaggccaggaacgcucucgacaaucuggccguccuucauaccgcagaggcuggaggucgggccuacaaccacgcacugucggagcucccggaaacauuggagacucugcuacugcucacccuucuggccacagugaccggcgggaucuuuuuauucuugaugucuggaaaaggcauugguaagaugacucuggggaugugcugcaucauaacggcuuccauucuccugugguaugcgcaaauccagccccacuggaucgccgcaagcauuauccuugaauuuuuccugauaguacucuugauuccagagccugaaaaacagcgaaccccacaggauaaucaacugacauacgugguuaucgcuauuuuaacugucguggccgccaccauggcaaacgagaugggcuuucuagagaagacaaagaaagaccugggacucggcucaaucaccacucaggaaagugagucuaauauacuugacaucgaucugagaccagcuuccgccuggacauuguaugcgguggcuacgaccuucgucacuccuaugcugcgccauagcauugaaaacucaaguguuaaugugagccucacagccaucgcaaaccaggccaccguacugauggggcuuggaaaggguuggccccucuccaaaauggacauuggcgugccgcuguuggcuaucggguguuacucucaggucaauccaauuacccugacagcagccuuacuacugcucguggcgcacuacgcuaucauaggaccuggccuucaagccaaggcaacuagggaggcccagaaacgggcugccgcagguauuaugaagaaccccacgguugaugggaucaccgugaucgaccuggaaccaauucccuaugauccuaaguuugagaaacaguugggccaggucaugcugcucauacugugcguaacacaagugcuuaugaugcguacuaccugggcuuuaugugaggcccugacacucgcgaccggaccgaucagcacuuugugggaaggcaaucccgggagauucuggaacacgacaauugccguuuccauggcaaauaucuuuaggggaucauaccuggcuggcgccggucuacuguucucuauuaugaagaacaccacuaauacccgccgggggacaggaaacaucggcgagacucucggugaaaaauggaagagucgacuuaacgcacugggcaaaucggaguuucagauauauaagaaaagcgggauccaggagguggacagaaccuuggcuaaggaaggaauuaagaggggcgagacagaucaucacgccgucucccgcgggucugccaaacugcggugguucguggaaagaaauauggucacgccagagggaaaggugguugaccucggcugcggucgugggggauggucauacuauuguggcggucugaaaaacgugagggaaguaaagggcuuaaccaaagggggaccuggccaugaggagcccaucccuaugagcacuuacggguggaaucuugugcggcugcaauccggagucgauguauuuuucacaccacccgaaaagugcgacacccuccuaugugauauuggcgagaguucuccuaacccaacuaucgaagcgggucgcacacugcgaguguugaaucuggucgagaacuggcucaauaacaauacccaguucugcauaaaggugcuuaaccccuauaugccgagcguaauugagaaaauggaggcucugcagagaaaguacgggggagcauuggugaggaauccucugucacggaacuccacgcacgagauguacuggguuaguaaugccaccggcaacaucgugagcucugucaauaugaucucccgcaugcucauuaacagauuuacaaugaaacacaagaaagcuacuuaugaaccagacguggauuuaggcucagggaccaggaacauaggaaucgagagcgaaauucccaaucuggacaucauugguaagcgaaucgagaagauaaaacaggaacaugagacaucguggcacuacgaccaagaucauccuuauaagacuugggccuaccacggcucuuaugagaccaaacagacagggagugcauccagcauggucaacggagugguucggcuucugaccaagccaugggacguagugcccauggucacucagauggccaugacggauacaaccccguucggccagcaacguguguuuaaagaaaagguugacacuagaacccaggagccuaaggaagguacgaaaaagcuaaugaaaaucacagcugaguggcucuggaaggagcuggggaaaaagaaaaccccacgcauguguacuagggaagaguucacacggaaggugagaucaaaugcggccuugggagcaauuuuuaccgaugaaaacaaguggaaauccgcucgcgaggccgucgaagacggcagguucugggagcugguggaucgagagcggaaucuccaccuugaaggcaagugcgagacuuguguauacaacaugauggggaaaagagaaaagaaacugggagaguuugguaaggcaaagggcucuagggccaucugguauaugugguuaggggcucgcuuccuggaauuugaggccuugggauuccucaaugaggaccauugguuuagccguggcaacagucuguccgguguggaaggggagggacuacaccggcuuggcuacauucugagagauguuggcaaaaaggaagggggagcgauguacgcagacgauacagccgguugggacaccaggaucacacucgaggaccugaaaaaugaagagauggucacuaaccauaugaagggcgagcacaaaaaguuggcugaagccauuuucaagcugaccuaucagaauaaaguggugcgcguccagcgaccaacgccucgggggaccguuauggauauaaucagcagaagggaccaacgcggaucuggccagguggguacauacgggcucaacacuuuuaccaauauggaggcacagcuuauuagacaaauggaaggagagggcaucuucaagucaauccagcaucugacagcuacugaggaaauugccguacagaacugguuagcucgggugggcagggagcgucugagucgaauggccauauccggggaugacugcgucgugaaacccaucgaugaccgcuucgcaagcgcguugaccgcccucaaugauaugggaaagguuagaaaagacauucagcaaugggaaccaucucgggguuggaacgauuggacacaggugcccuuuugcucgcaccacuuccaugagcuggucaugaaggacggcagggugcuaguaguuccuugucgcaaccaggaugaacuuaucgggagagcucggauuucacagggagccggcuggagccugaaggagacagcaugccucgguaaauccuaugcucaaauguggacccugauguacuuucacaggcgagacuugcguuuagccgcaaaugccaucuguagugcggugccaccgcauuggguccccacuucuagaacaaccuggagcauacacgcuaagcacgaguggaugacuaccgaagauaugcuggccguguggaaccgcguguggauccaggagaauccuuggauggaagacaaaacaccagucgaguccugggaagagguucccuaucucgggaagcgggaggaccaguggugcggaucacuuauuggccugacgaguagggcaaccugggccaaaaacauccagacugcuauuaaucaagugagaucucuaaucggcaacgaagaguacacagauuauaugccuagcaugaagcgcuuccggagggaagaggaagaggccgggguacugugguga

SEQ ID NO: 14526 - RNA, 9876 nt, Artificial Sequence
  derived and/or modified CDS sequence (opt3) from DENV-2__GQ199895__SS-prME
accgccggcgugauagucaugcugauucccacagcuauggcauuccaccucacuacgagaaacggggagccucauaugauaguuggaaggcaggaaaaggguaaaagccuucuguuuaagaccgaggacggcgugaauaugugcacauugauggccaucgauuuaggggaacugugugaggacacuauuaccuacaaaugcccacuacuccggcaaaacgaaccggaggauaucgacuguuggugcaauuccacaucuaccuggguaacuuauggaacauguaccacgacuggcgagcaccgccgagaaaagcguucaguggcgcuggucccccauguggguauggggcuugagaccagaacagaaacuuggaugaguagcgagggagcuuggaaacacguucagaggauugagaccuggauccugcggcauccuggcuucacaauuauggccgcaaucuuggccuacaccauuggcacgacucacuuucagcgcgcucucaucuucauucugcugacagcaguggccccauccaugaccaugagaugcaucgggauaucuaacagggauuuugucgaaggagugucggguggcucauggguagacauuguucucgagcacgggagcugugugacuacaauggcuaagaauaagcccaccuuagauuucgaacugaucaaaacggaggccaagcagccugcgacccuucggaaauauugcauugaagcaaaguugacaaacacuaccacagagagucgcuguccaacucaaggagagcccucccugaaugaggaacaggacaaacgauuuaucugcaagcauucuauggucgauagaggcugggguaacggguguggacuauucggcaagggcgggaucgugaccugcgccauguuuacaugcaaaaagaauauggaaggaaaagugguccagccugagaaccucgaauacaccauuguuauaacuccacacagcggugaggagcaugcugugggcaaugacacggggaagcacggaaaagaaaucaagauuacaccgcaguccucaaucaccgaggccgaacugacuggcuaugguaccguaacaauggaguguagucccaggaccgggcuugauuucaacgaaauggugcuguugcaaauggaggacaaagcauggcucguccaccggcagugguuucuggauuuaccucugccauggcuccccggcgcugacacucagggaagcaauuggauacagaaggagacacuugugacguucaagaacccucaugccaaaaagcaagacguugugguccugggcucucaggaaggggcgaugcacaccgccuugacuggagcaacagagauucagauguccucagguaaucuacuguuuaccggccaucucaaaugccgucugcgcauggauaaacuucaacugaaagggaugagcuacaguauguguacaggaaaguucaagaucgugaaagaaaucgcugagacucagcacggcaccauuguaaucagaguucaguaugagggugacgggucuccaugcaagauucccuucgaaauaacggauuuggagaaaaggcaugugcucggccggcugaucaccgucaacccgauugugacagaaaaggacuccccugucaacaucgaggccgaacccccauuuggagauagcuacaucauuauaggcguggagccugggcaguuaaaacugaauugguucaagaagggaucgucuaucggucaaauguuugagacuaccaugcgaggcgcuaaacgcauggccauucuaggggacacagcaugggauuucggaucccucggcgguguuuuuacuucaaucgggaaggcccugcaccagguguucggcgcuauuuacggagcggcauuuaguggcguaagcuggaccaugaaaauccuuauaggggucaucauuacguggaucggaaugaacuccagaucuacuagcuugucagugagucugguucucgugggcgucgugacccuguaucuuggugccaugguacaggcugacuccgggugugugguuagcuggaagaauaaagaacugaagugcggaucuggcauuuucaucacugauaacguccacacauggaccgagcaguacaaguuucaacccgaaucaccaaguaaauuggccagcgcaauacagaaggcccaugaggaagguauuuguggcaucagguccgugacucggcucgagaaucugauguggaaacagauuacccccgaguuaaaccacauccugucugaaaaugaggugaagcuaacaauaaugacgggggacaucaaaggaauuaugcaggcuggcaagcgcucgcucagaccucaaccaaccgaacugaaauauagcuggaagacuugggggaaggccaaaaugcuuuccacagagucacauaaccagaccuucuugaucgauggaccggaaacagcagagugccccaauacuaacagggcguggaauagucuggaggucgaagacuacggcuuugguguuuucaccacgaacauuuggcucaagcugcgugagaaacaggacguguuuugugauucuaaguuaaugagcgcugccaucaaagacaaucgggcagugcacgccgauaugggguauuggauagaauccgcucugaacgacacauggaagauggagaaggccucauucauugagguaaaaagcugccacuggccuaagucucauacccuuugguccaauggagucuuggaaagugagaugaucauccccaagaauuucgcaggccccgugagccagcacaacuaccgaccugguuaucauacucaaaccgcuggcccauggcaccucgggaagcuggaaauggauuuugaccuaugugagggaacaacuguuguggucaccgaagauugcggcaauagagggcccucucugaggacaacgaccgccuccggaaaacucauuacugaguggugcugucgcucaugcacacugccgccucuucgguacagaggcgaggacgguuguugguacgggauggaaaucaggccauugaaggagaaggaagagaaccuggugaauaguuuaguuaccgcgggacauggccagauugauaacuucagccucggugugcugggcauggcccuuuuucuggaagagauguugcgcacucgaauagggacaaaacacgcuauccuccugguagcagucucguucgugacccuaauuacgggaaauauguccuuucgggaccugggccgugugauggucaugguuggggccacuaugaccgaugacaucggaaugggcgugacauaucucgcucugcuugccgcauucaagguaagacccaccuuugcggccgguuugcuguuaaggaaacucacuucuaaggagcugaugauggcuacaauugggaucgcccuucugagccagucaaccauaccugaaacaauccuagagcucacugaugcacuggcuuugggaaugauggugcugaaaauuguccgcaacauggaaaaguaccaauuagccgugaccaucauggcaauuaguugcguucccaaugccgugauccuccagaacgcuuggaaggucuccuguacgauacuggcggccgugucuguuagcccacuucuguugacauccucacagcagaaagcagacuggauuccucucgcucugaccaucaagggccuaaaucccacugccaucuuccugaccacacuuagccggacaaguaaaaagagaucuuggccacucaacgaggccauuauggcugugggcauggucuccauacuggcaagcucguugcugaaaaaugacaucccgaugaccgggccuuuaguagccggaggucuccugacggugugcuauguucuuacaggcaggucagcggaucuggaauuggagcgagcugccgacgugaagugggaggaucaagcagaaauuucugggaguucccccauccucagcauuaccaucucugaggacggaagcauguccaucaaaaacgaagaggaggaacagacucugacaauccuaauucgcaccggccugcuugucaucucagguguguuuccaguaaguauucccaucacugccgcugcaugguaccucugggaggugaagaagcagcgggccgggguccugugggauguuccuagcccacccccuguggaaaaagcggaguuggaagacggagcuuauagaauaaagcagaggggcauuuuaggcuacucucaaaucggggccggaguguauaaagaggguacauuccacaccauguggcaugucacgcguggcgcagugcugaugcaccgcgggaagcggaucgagccguccugggccgauguuaaaaaggaccucauuucauacggaggcgguuggaagcuggaaggggaguggaaagaaggagaggaaguacaggugcuugcucuggagccaggcaagaaucccagagccguccagacuaaaccuggcaucuuuaagaccaacacagggaccauaggagcagugaguuuggauuucagcccagguacauccggcucucccauuguugacaggaaagggaagguggucggacuauacggcaauggugugguaacucgaucgggggcuuaugucagcgccaucgcgcagaccgagaagucaauugaagauaacccugagaucgaagaggacauauuucggaaaaagcgccugacgauuauggaucuccauccgggagccggcaaaacaaagagauaccugcccgcaaucgugagggaagcuaucaaacggggccuucgaacuuuaauucuggccccaaccagaguuguggcugcagagauggaggaagcccuccgcggguugccuaucagguaucaaacacccgccauuaagaccgagcacacuggacgugaaauagucgaccugaugugucaugcuaccuucacaaugcggcuccuguccccagugagaguuccuaacuacaaucuuaucauuauggacgaggcgcacuucacggaucccgcaaguaucgccgcuagggguuauaucucuacucgcguggagaugggcgaagccgcagggauuuuuaugaccgccacaccaccgggaagccgagacccuuucccccaguccaacgcuccaauaauggaugaggaaagagagauccccgaacggucauggaacucuggccacgagugggucaccgacuuuaaggguaaaacugugugguucguaccuagcauuaaggcggggaacgauaucgccgcaugccugaggaaaaauggaaagaaagugauucaguugagucgcaagacauuugacuccgaguacguuaagacccgugcuaacgauugggacuucgucgugacgacugauaucagcgaaaugggcgccaauuuuaaagcagagagagugauagacccacggagguguaugaagcccgucauccuaacagauggcgaagaacgcguaauucuggccgggccuaugccggugacccauucuucagcugcccaacgaagaggacggaucgguaggaaccccaaaaaugaaaacgaccaguauauuuacaugggcgagccccucgagaaugacgaagauugcgcgcacuggaaggaggcaaaaauguuacuggacaacaucaauaccccugaagggauaauucccuccauguucgagccagaacgcgagaagguugaugccaucgacggagaguacagacuuaggggcgaagcucggaaaacuuuuguggaucugaugcgucgcggugaccucccugucugguuggccuauaagguggcugcagaggggauuaacuacgccgaucgaaagugguguuucgacggcaucaaaaauaaccagauacuggaagagaacauggagguugaaaucuggacaaaggagggagaaaggaaaaagcucaaacccagauggcuggaugcucggauuuauagugacccacuugcccuaaaggaguuuaaggaguucgcagcgggccgcaaaagccugaccuugaauuuaaucacagagauggggagacugccuacuuucaugacgcagaaggccaggaacgcucucgauaaucuggccgugcuucauaccgcagaggcuggaggucgggccuacaaccacgcacugucggaacucccggagacauuggaaacucugcuacugcucacccuucuggccacagucaccggcgggauauuuuuauucuugaugucuggaaaaggcaucgguaagaugacucuggggaugugcugcauaauuacggcuuccauccuccugugguaugcgcaaauccagccccacuggauugccgcaagcaucauacuugaguuuuuccugauugugcucuugaucccagaaccugagaaacagcgaaccccacaggacaaucaacugacauacguagugauugcuaucuuaacuguugucgccgccaccauggcaaacgagaugggcuuucuagaaaagacaaagaaagaucugggacucggcucaauaaccacucaggagagugaaucuaauauccuugacauugaccugagaccagcuuccgccuggacauuguaugcgguggcuacgaccuucgugacuccuaugcugcgccauagcaucgagaacucaagugucaauguuagccucacagccauugcaaaccaggccaccgugcugauggggcuuggaaaggguuggccccucuccaaaauggauaucggcguaccgcuguuggcuauuggguguuacucucaggugaauccaaucacccugacagcagccuuacuacugcucgucgcgcacuacgcuauaauuggaccuggccuucaagccaaggcaacuagggaagcccagaaacgggcugccgcagguaucaugaagaaccccacgguggacgggaucaccguuauugaucuggagccaauacccuaugacccuaaguuugagaaacaguugggccaggugaugcugcucauccugugcgucacacaaguacuuaugaugcguacuaccugggcuuuaugugaagcccugacacucgcgaccggaccgauuagcacuuugugggagggcaaucccgggagauucuggaacacgacaaucgccguguccauggcaaauauuuuuaggggaucauaccuggcuggcgccggucuacuguucucuaucaugaagaacaccacuaauacccgccgggggacaggaaacauaggcgaaacucucggugagaaauggaagagucgacuuaacgcacugggcaaaucggaguuucagaucuauaagaaaagcgggauucaggaaguugauagaaccuuggcuaaggagggaaucaagaggggcgaaacagaccaucacgccgugucccgcgggucugccaaacugcggugguucgucgagagaaauauggugacgccagaaggaaaggucguggaucucggcugcggucgugggggauggucauacuauuguggcggucugaaaaacguuagggaggugaagggcuuaaccaaagggggaccuggccaugaggaacccauuccuaugagcacuuacggguggaaucuuguacggcugcaauccggaguggacgucuuuuucacaccacccgagaagugcgauacccuccuaugugacaucggcgaaaguucuccuaacccaacuauagaggcgggucgcacacugcgaguuuugaaucugguggaaaacuggcucaauaacaauacccaguucugcauuaagguccuuaaccccuauaugccgagcgugaucgagaaaauggaggcucugcagagaaaguacgggggagcauugguaaggaauccucugucacggaacuccacgcacgaaauguacugggugaguaaugccaccggcaacaucguuagcucugugaauaugauuucccgcaugcucauaaacagauuuacaaugaaacacaagaaagcuacuuaugagccagaugucgacuuaggcucagggaccaggaacaucggaauugaaagcgagauccccaaucuggauauuaucgguaagcgaauagaaaagaucaaacaggagcaugagacaucguggcacuacgaccaagaccauccuuauaagacuugggccuaccacggcucuuaugaaaccaaacagacagggagugcauccagcauggugaacggagucgugcggcuucugaccaagccaugggauguuguacccauggugacucagauggccaugacggacacaaccccguucggccagcaacgugucuuuaaagagaagguggauacuagaacccaggaaccuaaggaggguacgaaaaagcuaaugaaaauuacagcugaguggcucuggaaggaacuggggaaaaagaaaaccccacgcauguguacuagggaggaguucacacggaagguuagaucaaaugcggccuugggagcaaucuuuaccgacgagaacaaguggaaauccgcucgcgaagccguggaggauggcagguucugggagcuggucgaccgagaacggaaucuccaccuugagggcaagugcgaaacuuguguguacaacaugauggggaaaagagagaagaaacugggagaauuugguaaggcaaagggcucuagggccauuugguauaugugguuaggggcucgcuuccuggaguuugaggccuugggauuccucaaugaagaucauugguuuagccguggcaacagucuguccgguguagagggggaaggacuacaccggcuuggcuacauccugagagacgugggcaaaaaggaagggggagcgauguacgcagaugacacagccgguugggauaccaggauuacacucgaagaccugaaaaaugaggagaugguuacuaaccauaugaagggcgaacacaaaaaguuggcugaggccauauucaagcugaccuaucagaauaaagucgugcgcgugcagcgaccaacgccucgggggaccgucauggacaucauuagcagaagggaucaacgcggaucuggccagguugguacauacgggcucaacacuuuuaccaauauggaagcacagcuuaucagacaaauggagggagagggcaucuucaagucaauucagcaucugacagcuacugaagagauagccgugcagaacugguuagcucggguaggcagggaacgucugagucgaauggccaucuccggggacgauugcguggucaaacccauugacgaucgcuucgcaagcgcguugaccgcccucaaugacaugggaaaggugagaaaagauauccagcaaugggagccaucucgggguuggaacgacuggacgcagguucccuuuugcucgcaccacuuccaugaacuggugaugaaggauggcaggguccuagugguaccuugucgcaaccaggacgagcuuauugggagagcucggaucucacagggagccggcuggagccugaaggagacagcaugccucgguaaauccuaugcucaaauguggacccugauguacuuucacaggcgagauuugcguuuagccgcaaaugccauauguagugcgguuccaccgcauugggugcccacuucuagaacaaccuggagcauccacgcuaagcacgaauggaugacuaccgaggacaugcuggccgucuggaaccgcguguggauucaggaaaauccuuggauggaggauaaaacaccaguggaauccugggaggagguccccuaucucgggaagcgggaagaccaguggugcggaucacuuaucggccugacgaguagggcaaccugggccaaaaacauucagacugcuaucaaucaaguuagaucucuaauaggcaacgaggaauacacagacuauaugccuagcaugaagcgcuuccggagggaggaagaggaggccggggugcugugguga

SEQ ID NO: 14527 - RNA, 9876 nt, Artificial Sequence
  derived and/or modified CDS sequence (opt3) from DENV-2__FJ898478__SS-prME
accgccggcgugauagucaugcugauucccacugcuauggcauuccaccucacuacgagaaacggggagccucauaugauaguuggaaggcaggaaaaggguaaaagccuucuguuuaagaccgaggacggcgugaauaugugcacauugauggccaucgauuuaggggaacugugugaggacacuauuaccuacaaaugcccacuacuccggcaaaacgaaccggaggauaucgacuguuggugcaauuccacaucuaccuggguaacuuauggaacauguaccacgacuggcgagcaccgccgagaaaagcguucaguggcgcuggucccccauguggguauggggcuugagaccagaacagaaacuuggaugaguagcgagggagcuuggaaacacguucagaggauugagaccuggauccugcggcauccuggcuucacaauuauggccgcaaucuuggccuacaccauuggcacgacucacuuucagcgcgcucucaucuucauucugcugacagcaguggccccauccaugaccaugagaugcaucgggauaucuaacagggauuuugucgaaggagugucggguggcucauggguagacauuguucucgagcacgggagcugugugacuacaauggcuaagaauaagcccaccuuagauuucgaacugaucaaaacggaggccaagcagccugcgacccuucggaaauauugcauugaagcaaaguugacaaacacuaccacagagagucgcuguccaacucaaggagagcccucccugaaugaagaacaggacaaacgauuuaucugcaagcauucuauggucgauagaggcugggguaacggguguggacuauucggcaagggcgggaucgugaccugcgccauguuuacaugcaaaaagaauauggaaggaaaagugguccagccugagaaccucgaauacaccauuguuauaacuccacacagcggugaggagcaugcugugggcaaugacacggggaagcacggaaaagaaaucaagauuacaccgcaguccucaaucaccgaggccgaacugacuggcuaugguaccguaacaauggaguguagucccaggaccgggcuugauuucaacgaaauggugcuguugcaaauggaggacaaagcauggcucguccaccggcagugguuucuggauuuaccucugccauggcuccccggcgcugacacucagggaagcaauuggauacagaaggagacacuugugacguucaagaacccucaugccaaaaagcaagacguugugguccugggcucucaggaaggggcgaugcacaccgccuugacuggagcaacagagauucagauguccucagguaaucuacuguuuaccggccaucucaaaugccgucugcgcauggauaaacuucaacugaaagggaugagcuacaguauguguacaggaaaguucaagaucgugaaagaaaucgcugagacucagcacggcaccauuguaaucagaguucaguaugagggugacgggucuccaugcaagauucccuucgaaauaacggauuuggagaaaaggcaugugcucggccggcugaucaccgucaacccgauugugacagaaaaggacuccccugucaacaucgaggccgaacccccauuuggagauagcuacaucauuauaggcguggagccugggcaguuaaaacugaauugguucaagaagggaucgucuaucggucaaauguuugagacuaccaugcgaggcgcuaaacgcauggccauucuaggggacacagcaugggauuucggaucccucggcgguguuuuuacuucaaucgggaaggcccugcaccagguguucggcgcuauuuacggagcggcauuuaguggcguaagcuggaccaugaaaauccuuauaggggucaucauuacguggaucggaaugaacuccagaucuacuagcuugucagugagucugguucucgugggcgucgugacccuguaucuuggugccaugguacaggcugacuccgggugugugguuagcuggaagaauaaagaacugaagugcggaucuggcauuuucaucacugauaacguccacacauggaccgagcaguacaaguuucaacccgaaucaccaaguaaauuggccagcgcaauacagaaggcccaugaggaagguauuuguggcaucagguccgugacucggcucgagaaucugauguggaaacagauuacccccgaguuaaaccacauccugucugaaaaugaggugaagcuaacaauaaugacgggggacaucaaaggaauuaugcaggcuggcaagcgcucgcucagaccucaaccaaccgaacugaaauauagcuggaagacuugggggaaggccaaaaugcuuuccacagagucacauaaccagaccuucuugaucgauggaccggaaacagcagagugccccaauacuaacagggcguggaauagucuggaggucgaagacuacggcuuugguguuuucaccacgaacauuuggcucaagcugcgugagaaacaggacguguuuugugauucuaaguuaaugagcgcugccaucaaagacaaucgggcagugcacgccgauaugggguauuggauagaauccgcucugaacgacacauggaagauggagaaggccucauucauugagguaaaaagcugccacuggccuaagucucauacccuuugguccaauggagucuuggaaagugagaugaucauccccaagaauuucgcaggccccgugagccagcacaacuaccgaccugguuaucauacucaaaccgcuggcccauggcaccucgggaagcuggaaauggauuuugaccuaugugagggaacaacuguuguggucaccgaagauugcggcaauagagggcccucucugaggacaacgaccgccuccggaaaacucauuacugaguggugcugucgcucaugcacacugccgccucuucgguacagaggcgaggacgguuguugguacgggauggaaaucaggccauugaaggagaaggaagagaaccuggugaauaguuuaguuaccgcgggacauggccagauugauaacuucagccucggugugcugggcauggcccuuuuucuggaagagauguugcgcacucgaauagggacaaaacacgcuauccuccugguagcagucucguucgugacccuaauuacgggaaauauguccuuucgggaccugggccgugugauggucaugguuggggccacuaugaccgaugacaucggaaugggcgugacauaucucgcucugcuugccgcauucaagguaagacccaccuuugcggccgguuugcuguuaaggaaacucacuucuaaggagcugaugauggcuacaauugggaucgcccuucugagccagucaaccauaccugaaacaauccuagagcucacugaugcacuggcuuugggaaugauggugcugaaaauuguccgcaacauggaaaaguaccaauuagccgugaccaucauggcaauuaguugcguucccaaugccgugauccuccagaacgcuuggaaggucuccuguacgauacuggcggccgugucuguuagcccacuucuguugacauccucacagcagaaagcagacuggauuccucucgcucugaccaucaagggccuaaaucccacugccaucuuccugaccacacuuagccggacaaguaaaaagagaucuuggccacucaacgaggccauuauggcugugggcauggucuccauacuggcaagcucguugcugaaaaaugacaucccgaugaccgggccuuuaguagccggaggucuccugacggugugcuauguucuuacaggcaggucagcggaucuggaauuggagcgagcugccgacgugaagugggaggaucaagcagaaauuucugggaguucccccauccucagcauuaccaucucugaggacggaagcauguccaucaaaaacgaagaggaggaacagacucugacaauccuaauucgcaccggccugcuugucaucucagguguguuuccaguaaguauucccaucacugccgcugcaugguaccucugggaggugaagaagcagcgggccgggguccugugggauguuccuagcccacccccuguggaaaaagcggaguuggaagacggagcuuauagaauaaagcagaggggcauuuuaggcuacucucaaaucggggccggaguguauaaagaggguacauuccacaccauguggcaugucacgcguggcgcagugcugaugcaccgcgggaagcggaucgagccguccugggccgauguuaaaaaggaccucauuucauacggaggcgguuggaagcuggaaggggaguggaaagaaggagaggaaguacaggugcuugcucuggagccaggcaagaaucccagagccguccagacuaaaccuggcaucuuuaagaccaacacagggaccauaggagcagugaguuuggauuucagcccagguacauccggcucucccauuguugacaggaaagggaagguggucggacuauacggcaauggugugguaacucgaucgggggcuuaugucagcgccaucgcgcagaccgagaagucaauugaagauaacccugagaucgaagacgauauauuucggaaaaagcgccugacgauuauggaccuccauccgggagccggcaaaacaaagagauaccugcccgcaaucgugagggaggcuaucaaacggggccuucgaacuuuaauucuggccccaaccagaguuguggcugcagaaauggaggaggcccuccgcggguugccuaucagguaucaaacacccgccauuaagaccgaacacacuggacgugagauagucgaccugaugugucaugcuaccuucacaaugcggcuccuguccccagugagaguuccuaacuacaaucuuaucauuauggaugaagcgcacuucacggaccccgcaaguaucgccgcuagggguuauaucucuacucgcguggagaugggcgaggccgcagggauuuuuaugaccgccacaccaccgggaagccgagauccuuucccccaguccaacgcuccaauaauggacgaagagagagaaauccccgagcggucauggaacucuggccacgaaugggucaccgauuuuaaggguaaaacugugugguucguaccuagcauuaaggcggggaacgacaucgccgcaugccugaggaaaaauggaaagaaagugauucaguugagucgcaagacauuugauuccgaguacguuaagacccgugcuaacgacugggauuucgucgugacgacugacaucagcgagaugggcgccaauuuuaaagcagaaagagugauagauccacggagguguaugaagcccgucauccuaacagacggcgaggaacgcguaauucuggccgggccuaugccggugacccauucuucagcugcccaacgaagaggacggaucgguaggaaccccaaaaaugagaacgaccaguauauuuacaugggcgaaccccucgagaaugaugaggacugcgcgcacuggaaggaagcaaaaauguuacuggauaacaucaauaccccugaggggauaauucccuccauguucgaaccagagcgcgaaaagguugacgccaucgauggagaguacagacuuaggggcgaggcucggaaaacuuuuguggaccugaugcgucgcggugaucucccugucugguuggccuauaagguggcugcagaagggauuaacuacgccgaccgaaagugguguuucgauggcaucaaaaauaaccagauacuggaggaaaacauggagguugagaucuggacaaaggaaggagagaggaaaaagcucaaacccagauggcuggacgcucggauuuauagugauccacuugcccuaaaggaauuuaaggaguucgcagcgggccgcaaaagccugaccuugaauuuaaucacagaaauggggagacugccuacuuucaugacgcagaaggccaggaacgcucucgacaaucuggccgugcuucauaccgcagaggcuggaggucgggccuacaaccacgcacugucggagcucccggaaacauuggagacucugcuacugcucacccuucuggccacagucaccggcgggauauuuuuauucuugaugucuggaaaaggcaucgguaagaugacucuggggaugugcugcauaauuacggcuuccauccuccugugguaugcgcaaauccagccccacuggauugccgcaagcaucauacuugaauuuuuccugauugugcucuugaucccagagccugaaaaacagcgaaccccacaggauaaucaacugacauacguagugauugcuaucuuaacuguugucgccgccaccauggcaaacgagaugggcuuucuagagaagacaaagaaagaccugggacucggcucaauaaccacucaggaaagugagucuaauauccuugacauugaucugagaccagcuuccgccuggacauuguaugcgguggcuacgaccuucgugacuccuaugcugcgccauagcaucgaaaacucaagugucaauguuagccucacagccauugcaaaccaggccaccgugcugauggggcuuggaaaggguuggccccucuccaaaauggacaucggcguaccgcuguuggcuauuggguguuacucucaggugaauccaaucacccugacagcagccuuacuacugcucgucgcgcacuacgcuauaauuggaccuggccuucaagccaaggcaacuagggaggcccagaaacgggcugccgcagguaucaugaagaaccccacgguggaugggaucaccguuauugaccuggaaccaauacccuaugauccuaaguuugagaaacaguugggccaggugaugcugcucauccugugcgucacacaaguacuuaugaugcguacuaccugggcuuuaugugaggcccugacacucgcgaccggaccgauuagcacuuugugggaaggcaaucccgggagauucuggaacacgacaaucgccguguccauggcaaauauuuuuaggggaucauaccuggcuggcgccggucuacuguucucuaucaugaagaacaccacaaguacccgccgggggacaggaaauauaggcgagacucucggugaaaaauggaagucgcgacuuaacgcacugggcaaaagcgaguuucagaucuauaagaaauccgggauucaggagguugacagaaccuuggcuaaggaaggaaucaagaggggcgagacagaucaucacgccgugucucgcgggucagccaaacugcggugguucgucgaaagaaacauggugacgccagagggaaaggucguggaccucggcugcggucgugggggauggagcuacuauuguggcggucugaaaaauguuagggaagugaagggcuuaaccaaagggggaccuggccaugaggagcccauuccuauguccacuuacggguggaaccuuguacggcugcaaaguggaguggaugucuuuuucacaccacccgaaaagugcgacacccuccuaugugauaucggcgagucuagcccuaauccaacuauagaagcgggucgcacacugcgaguuuugaaccugguggagaauuggcucaacaauaacacccaguucugcauuaagguccuuaaucccuauaugccgucagugaucgagaaaauggaggcucugcagagaaaguacgggggagcauugguaaggaacccucugucccggaauaguacgcacgagauguacugggugagcaacgccaccggcaauaucguuucuuccgugaacaugauuucacgcaugcucauaaauagauuuacaaugaaacacaagaaagcuacuuaugaaccagacgucgauuuaggcagcgggaccaggaacaucggaauugagucggaaauccccaaccuggacauuaucgguaagcgaauagagaagaucaaacaggaacaugagacaucuuggcacuacgaccaagaucauccuuauaagacuugggccuaccacggcaguuaugagaccaaacagacaggguccgcaagcucaauggugaauggagucgugcggcuucugaccaagccaugggacguuguacccauggugacucagauggccaugacggauacaaccccguucggccagcaacgugucuuuaaagaaaagguggacacuagaacccaggagccuaaggaagguacgaaaaagcuaaugaaaauuacagcugaguggcucuggaaggagcuggggaaaaagaaaaccccacgcauguguacuagggaagaguucacacggaagguuagauccaacgcggccuugggagcaaucuuuaccgaugaaaauaaguggaaaucugcucgcgaggccguggaagacggcagguucugggagcuggucgaucgagagcggaaccuccaccuugaaggcaagugcgagacuuguguguacaauaugauggggaaaagagaaaagaaacugggagaguuugguaaggcaaagggcagcagggccauuugguauaugugguuaggggcucgcuuccuggaauuugaggccuugggauuccucaacgaggaccauugguuuagucguggcaauucccugagcgguguagaaggggagggacuacaccggcuuggcuacauccugagagaugugggcaaaaaggaagggggagcgauguacgcagacgauacagccgguugggacaccaggauuacacucgaggaccugaaaaacgaagagaugguuacuaaucauaugaagggcgagcacaaaaaguuggcugaagccauauucaagcugaccuaucagaacaaagucgugcgcgugcagcgaccaacgccucgggggaccgucauggauaucauuucuagaagggaccaacgcggaucaggccagguugguacauacgggcucaauacuuuuaccaacauggaggcacagcuuaucagacaaauggaaggagagggcaucuucaagaguauucagcaucugacagcuacugaggaaauagccgugcagaauugguuagcucggguaggcagggagcgucugucccgaauggccaucagcggggaugacugcguggucaaacccauugaugaccgcuucgcaucugcguugaccgcccucaacgauaugggaaaggugagaaaagacauccagcaaugggaaccaucgcgggguuggaaugauuggacgcagguucccuuuugcucacaccacuuccaugagcuggugaugaaggacggcaggguccuagugguaccuugucgcaaccaggaugaacuuauugggagagcucggaucagccagggagccggcuggucccugaaggagacagcaugccucgguaaaaguuaugcucaaauguggacccugauguacuuucacaggcgagacuugcguuuagccgcaaacgccauauguucugcgguuccaagccauugggugccgacuuccagaacaaccuggucaauccacgcuaagcacgaguggaugacuaccgaagauaugcuggccgucuggaaucgcguguggauucaggagaaccccuggauggaagacaaaacaccuguggagaguugggaagaggucccauaucucgggaagcgggaggaccaguggugcggaucucuuaucggccugacgagcagggcaaccugggccaaaaauauucagacugcuaucaaccaaguuagaucccuaauaggcaaugaagaguacacagauuauaugcccucaaugaagcgcuuccggagggaagaggaagaggccggggugcugugguga

SEQ ID NO: 14528 - RNA, 9876 nt, Artificial Sequence
  derived and/or modified CDS sequence (opt3) from DENV-2__GQ199869__SS-prME
accgccggcgugaucgucaugcugauucccacagcuauggcauuccaccucacuacgagaaacggggagccucauaugauaguuggaaggcaggaaaaggguaaaagccuucuguuuaagaccgaggacggcgugaauaugugcacauugauggccaucgauuuaggggaacugugugaggacacuauuaccuacaaaugcccacuacuccggcaaaacgaaccggaggauaucgacuguuggugcaauuccacaucuaccuggguaacuuauggaacauguaccacgacuggcgagcaccgccgagaaaagcguucaguggcgcuggucccccauguggguauggggcuugagaccagaacagaaacuuggaugaguagcgagggagcuuggaaacacguucagaggauugagaccuggauccugcggcauccuggcuucacaauaauggccgcaaucuuggccuacaccauuggcacgacucacuuucagcgcgcucucaucuucauucugcugacagcaguggccccauccaugaccaugagaugcaucgggauaucuaacagggauuuugucgaaggagugucggguggcucauggguagacauuguucucgagcacgggagcugugugacuacaauggcuaagaauaagcccaccuuagauuucgaacugaucaaaacggaggccaagcagccugcgacccuucggaaauauugcauugaagcaaaguugacaaacacuaccacagagagucgcuguccaacucaaggagagcccucccugaaugaagagcaggacaaacgauuuaucugcaagcauucuauggucgauagaggcugggguaacggguguggacuauucggcaagggcgggaucgugaccugcgccauguuuacaugcaaaaagaauauggaaggaaaagugguccagccugagaaccucgaauacaccauuguuauaacuccacacagcggugaggagcaugcugugggcaaugacacggggaagcacggaaaagaaaucaagauuacaccgcaguccucaaucaccgaggccgaacugacuggcuaugguaccguaacaauggaguguagucccaggaccgggcuugauuucaacgaaauggugcuguugcaaauggaggacaaagcauggcucguccaccggcagugguuucuggauuuaccucugccauggcuccccggcgcugacauacagggaagcaauuggauucagaaggagacucuugugacauucaagaacccucaugccaaaaagcaagacguugugguccugggcucucaggaaggggcgaugcacacggccuugaccggagcaacugagauccagauguccucagguaaucuacuguuuacaggccaucucaaaugccgucugcgcauggauaagcuucaacugaaagggaugagcuacaguauguguaccggaaaguucaagaucgugaaagaaauugcugagacacagcacggcacuaucguaauuagaguucaguaugagggugacgggucuccaugcaagauacccuucgaaaucaccgauuuggagaaaaggcaugugcucggccggcugauuacggucaacccgaucgugaccgaaaaggacuccccugucaacaucgaggccgaacccccauuuggagauagcuacauuauaaucggcguggagccugggcaguuaaaacugaauugguucaagaagggaucgucuauuggucaaauguuugagacaacuaugcgaggcgcuaaacgcauggccauccuaggggacaccgcaugggauuucggaucccucggcgguguuuuuacaucaauugggaaggcccugcaccagguguucggcgcuaucuacggagcggcauuuaguggcguaagcuggacuaugaaaauacuuaucggggucauuaucaccuggauuggaaugaacuccagaucuacgagcuugucagugagucugguucucgugggcgucgugacacuguaucuuggugccguagugcaggcugacuccggguguguugucagcuggaagaauaaagaacugaagugcggaucuggcaucuucauaaccgauaacgugcacacuuggacagagcaguacaaguuucaacccgaaucaccaaguaaauuggccagcgcaauucagaaggcccaugaggaagguaucuguggcauuagguccgugacccggcucgagaaucugauguggaaacagaucacucccgaguuaaaccacauacugucugaaaaugaggucaagcuaaccaucaugacaggggacauuaaaggaaucaugcaggcuggcaagcgcucgcucagaccucaaccaacggaacugaaauauagcuggaagaccugggggaaggccaaaaugcuuuccacugagucacauaaccagacauucuugauugauggaccggaaaccgcagagugccccaauacaaacagggcguggaauagucuggagguugaagacuacggcuuugguguguucacuaccaacaucuggcucaagcugcgugagaaacaggacguguuuugugauucuaaguuaaugagcgcugccauaaaagacaaucgggcaguacacgccgauaugggguauuggauugaauccgcucugaacgacacguggaagauggagaaggccucauucaucgaggucaaaagcugccacuggccuaagucucauacacuuugguccaauggaguguuggaaagugagaugaucauuccaaaaaacuucgcaggccccguuagccagcacaacuaccgaccugguuaucauacccaaacugcuggcccauggcaccucgggaagcuggaaauggauuuugacuucugugagggaaccacaguggucgugacugaagauugcggcaauagagggcccucucuaaggaccacaacggccuccggaaaacugaucaccgaguggugcugucgcucaugcacucucccgccucugcgguacagaggcgaggacgguuguugguacgggauggaaauuaggccacuuaaggagaaggaagagaacuugguuaauagucuggugacagcgggacauggccagauagauaacuuuagcuuagguguacucggcauggcccuguuccuugaagagaugcugcgcacccgaaucgggacuaaacacgcuauuuugcucgucgcagugucguuugugacacugaucaccggaaauauguccuuccgggaccuaggccgugucaugguuauggugggggccacgaugacugaugacauuggaaugggcguaaccuaucuggcucuccuggccgcauuuaaggugagacccacauucgcggccggucuuuugcugaggaaauuaaccucuaaggagcucaugauggcuacuaucgggauagcccugcuuagccagucaacaaucccugaaaccauucuggagcuaacagaugcacucgcucugggaaugauggucuugaaaaucgugcgcaacauggaaaaguaccaacuggccguuacuauuauggcaaucaguugcgugcccaaugccgucauauuacagaacgcuuggaagguguccuguaccauucucgcggccguuucugugagcccacugcuucugacguccucacagcagaaagcagacuggaucccuuuggcucucacaaucaagggccugaaucccaccgccauuuuucuaacuacccugagccggacaaguaaaaagagaucuuggccacuuaacgaggccauaauggcugucggcaugguauccauccucgcaagcucgcuguugaaaaaugacauuccgaugacugggccucugguggccggagguuuacucaccguuugcuaugugcugacgggcaggucagcggaucuugaacuggagcgagcugccgacgucaagugggaggaucaagcagaaaucucugggaguucccccauuuugagcaucacaauaucugaggacggaagcauguccaucaaaaacgaagaggaggaacagacccucacuauucugauccgcacaggccuacuggugauuucagguguauucccagugaguauccccauaaccgccgcugcaugguaccuuugggaggucaagaagcagcgggccgggguucucugggaugugccuagcccacccccuguggaaaaagcggagcuggaagacggagcuuauagaauuaagcagaggggcaucuugggcuacucucaaaucggggccggagucuauaaagaggguacuuuucacacaauguggcaugugacccguggcgcaguuuuaaugcaccgcgggaagcggauugagccguccugggccgauguaaaaaaggaccugaucucauacggaggcgguuggaagcucgaaggggaguggaaagaaggagaggaagugcagguccuggcucuugagccaggcaagaaucccagagccgugcagacgaaaccuggcauauucaagacuaacaccgggacaauuggagcaguuagucuggauuuuagcccagguaccuccggcucucccaucguggacaggaaagggaaggucgugggauuguacggcaaugguguagucacacgaucgggggcuuaugugagcgccauugcgcagacugagaagucaaucgaagauaacccugagauagaagacgauauuuuccggaaaaagcgccuaaccaucauggaccugcauccgggagccggcaaaacgaagagauaccuccccgcaaucguuagggaggcuauuaaacggggccugcgaacacuuaucuuagccccaacuagaguggucgcugcagaaauggaggaggcccugcgcgggcucccuauuagguaucaaacccccgccauaaagacagaacacaccggacgugagaucguggacuugaugugucaugcuacuuucaccaugcggcugcucuccccaguuagagugccuaacuacaaucugauuaucauggaugaagcgcacuuuacagaccccgcaaguaucgccgcuagggguuauauuucuacgcgcgucgagaugggcgaggccgcagggauauucaugacugccaccccaccgggaagccgagauccuuuuccccaguccaacgcuccaaucauggacgaagagagagaaauucccgagcggucauggaauucuggccacgaaugggugacagauuucaaggguaaaaccguaugguuugugccuagcaucaaggcggggaacgacauugccgcaugccuuaggaaaaauggaaagaaaguuauccagcugagucgcaagacuuucgauuccgaguacgucaagacacgugcuaacgacugggauuuuguggugaccacggacauaagcgagaugggcgccaauuucaaagcagaaagagucaucgauccacggagguguaugaagcccguaauuuugacugacggcgaggaacgcgugauccuagccgggccuaugccgguuacacauucuucagcugcccaacgaagaggacggauugguaggaacccaaaaaaugagaacgaccaguauaucuacaugggcgaaccccuggagaaugaugaggacugcgcgcacuggaaggaagcaaaaaugcucuuagauaacauaaauaccccugaggggauuauccccuccauguuugaaccagagcgcgaaaagguggacgccauugauggagaguacagacugaggggcgaggcucggaaaaccuucgucgaccuuaugcgucgcggugaucugccuguguggcucgccuauaagguugcugcagaagggaucaacuacgccgaccgaaagugguguuuugauggcauaaaaaauaaccagaucuuggaggaaaacauggagguggagauuuggacuaaggaaggagagagaaaaaagcugaaacccagguggcucgacgcucggaucuauagugauccacuggcccuuaaggaauucaaggaguucgcagcgggccgcaaaagccuaacacugaauuugauuaccgaaauggggagauuaccuacauuuaugacucagaaggccaggaacgcucuggacaaucucgccguccugcauacggcagaggcuggaggucgggccuacaaccacgcacuuucggagcugccggaaacccucgagacauugcugcuacugacucuccuugccaccgugacaggcgggaucuuccuguuuuuaaugucuggaaaaggcauagguaagaugaccuuggggaugugcugcauuaucacugcuuccauccugcucugguaugcgcaaauucagccccacuggaucgccgcaagcauaauucuggaauucuuucuuaucguacugcucauuccagagccugaaaaacagcgaacgccccaggauaaucaauugaccuacgugguuaucgcuauacugacagucguggccgccacuauggcaaacgagaugggcuucuuagagaagaccaagaaagaccuaggacugggcucaaucacaacccaggaaagugagucuaauauucucgacaucgaucuuagaccagcuuccgccuggacucuguaugcgguggcuacaacguuugucaccccuauguugcgccauagcauugaaaacucaaguguuaaugugagccugacugccaucgcaaaccaggccacaguacucauggggcugggaaaggguuggccccuuuccaaaauggacauuggcgugccgcuccuggcuaucggguguuacucucaggucaauccaauaaccuugaccgcagcccuguuacuacugguggcgcacuacgcuauuaucggaccuggccuccaagccaaggcaacaagggaggcccagaaacgggcugccgcagguaucaugaagaaccccacuguugaugggauuacggugauagaccuugaaccaauccccuaugauccuaaguucgagaaacagcugggccaggucauguugcugauucucugcguaacccaagugcugaugaugcguacaacuugggcucuuugugaggccuuaacccuggcgacaggaccgaucagcacccucugggaaggcaaucccgggagauuuuggaacacuacgauugccguuuccauggcaaauaucuucaggggaucauacuuggcuggcgccggucugcuauuuucuauaaugaagaacacaaccaguacucgccgggggaccggaaauaucggcgagacacugggugaaaaauggaagucgcgacucaacgcacuuggcaaaagcgaguuccagauuuauaagaaauccgggauccaggagguggacagaacucuggcuaaggaaggaauuaagaggggcgagaccgaucaucacgccgucucucgcgggucagccaaauugcggugguuuguggaaagaaacauggucacaccagagggaaaggugguugaccugggcugcggucgugggggauggagcuacuauuguggcggucucaaaaaugugagggaaguaaagggccugacgaaagggggaccuggccaugaggagcccaucccuauguccaccuacggguggaacuuagugcggcuucaaaguggagucgauguuuucuucacuccacccgaaaagugcgacacacugcucugugauauaggcgagucuagcccuaauccaaccauugaagcgggucgcacucuacgagugcugaacuuggucgagaauuggcugaacaauaacacacaguuuugcaucaaggugcucaaucccuauaugccgucaguaaucgaaaaaauggaggcucuucagagacaguacgggggagcacuggugaggaacccuuugucccggaauaguacccacgagauguacuggguuagcaacgccacgggcaauauugugucuuccgucaacaugauaucacgcaugcugaucaauagauucaccaugaagcacaaaaaggcuacauaugaaccagacguggaucucggcagcgggacuaggaacauuggaaucgagucggaaauucccaacuuagacaucauagguaaacgaaucgagaagauuaagcaagaacaugagaucucuuggcacuacgaccaggaucauccuuauaaaaccugggccuaccacggcaguuaugagacaaagcagacuggguccgcaagcucaauggucaauggagugguucggcugcuuaccaaaccaugggacguagugcccauggucacacagauggccaugaccgauacuacgccguuuggccaacagcguguguucaaggaaaaaguugacacaagaacccaggagccuaaggaagguacuaagaaacugaugaagauuaccgcugaguggcuauggaaagagcucgggaagaaaaagacaccccgcauguguacgagggaagaguuuaccaaaaaggugcgguccaacgcggcccugggagcaaucuucacugaugaaaauaaguggaaaucugcuagagaggccgucgaagacggccgcuuuugggaguugguggauagggagcgaaaccugcaccucgaaggcaagugcgagacauguguauacaauaugauggggaaacgggaaaagaaacuuggagaguucgguaaggcaaagggcagcagagccauuugguauauguggcugggggcuagguuuuuagaauucgaggcccugggauuuuugaacgaggaccauugguucagucgcggcaauucccucagcgguguggaaggggagggacugcaccgucuaggcuacauacuucgggauguuggcaaaaaggaagggggagcgauguacgcagacgauaccgccgguugggacacuagaaucacacuggaggaccucaaaaacgaagagauggucaccaaucauaugaagggcgagcacaaaaagcuggcugaagccauuuuuaaguugacauaucagaacaaaguggugaggguccaacgcccaacuccucgagggaccguuauggauaucaucucucggagagaccagaggggaucaggccagguggguacguacgggcugaauaccuucacaaacauggaggcacaacucauucgccagauggaaggagagggcauauucaagaguauccagcaucuuacugcuaccgaggaaauugccguacagaauuggcuggcuagagugggccgggagagguuaucccguauggccaucagcggggaugacugcgucgugaaacccauugaugaccgauuugcaucugcgcugacagccuugaacgauaugggaaagguucgcaaagacauccaacagugggaaccaucgagagguuggaaugauuggacucaggugcccuucugcucacaccacuuucaugagcucgucaugaaggacggccgggugcugguaguuccuuguaggaaccaggaugaacuaauagggcgcgcuagaaucagccaaggagccggcuggucccuuaaggagaccgcaugccuggguaaaaguuaugcucagauguggacgcucauguacuuccaccggagggaccugcgauuggccgcaaacgccauuuguucugcggugccaagccauugggucccgacaucccguaccacuuggucaauccacgcuaagcacgaguggaugacaaccgaagauauguuagccguguggaauagaguguggauucaggagaaccccuggauggaagacaaaacuccugucgagaguugggaagagguuccauaucuggggaagcgcgaggaccaguggugcggaucucucaucggccuuaccagccgggcaacaugggccaaaaauauacaaacggcuauuaaccaggugaggucccugaucggcaaugaagaguacaccgauuauaugcccucaaugaagagauuucgccgggaagaggaagaggccgggguacuaugguga

SEQ ID NO: 14529 - RNA, 9876 nt, Artificial Sequence
  derived and/or modified CDS sequence (opt3) from DENV-2__JX079688__SS-prME
accgccggcgugauaguaaugcugauuccaacugcuauggcuuuccaccucacuacgagaaacggggaaccucauaugauaguuggaaggcaggaaaaggguaaaagccuucuguuuaagaccgaagacggcgugaauaugugcacauugauggccaucgauuuaggggaacugugugaagacacuauuaccuacaaaugcccacuacuccggcaaaacgaaccggaggauaucgacuguuggugcaauuccacaucuaccuggguaacuuauggaacauguaccacgacuggcgagcaccgccgagaaaagcguucaguggcgcuggucccccauguggguauggggcuugagaccagaacagaaacuuggaugaguagcgagggagcuuggaaacacguucagaggauugagaccuggauccugcggcauccuggcuucacaauaauggccgcaaucuuggccuacaccauuggcacgacucacuuucagcgcgcucucaucuucauucugcugacagcaguggccccauccaugaccaugagaugcaucgggauaucuaacagggauuuugucgaaggagugucggguggcucauggguagacauuguucucgagcacgggagcugugugacuacaauggcuaagaauaagcccaccuuagauuucgaacugaucaaaacggaggccaagcagccugcgacccuucggaaauauugcauugaagcaaaguugacaaacacuaccacagagagucgcuguccaacucaaggagagcccucccugaaugaagaacaggacaaacgauuuaucugcaagcauucuauggucgauagaggcugggguaacggguguggacuauucggcaagggcgggaucgugaccugcgccauguuuacaugcaaaaagaauauggaaggaaaagugguccagccugagaaccucgaauacaccauuguuauaacuccacacagcggugaggagcaugcugugggcaaugacacggggaagcacggaaaagaaaucaagauuacaccgcaguccucaaucaccgaggccgaacugacuggcuaugguaccguaacaauggaguguagucccaggaccgggcuugauuucaacgaaauggugcuguugcaaauggaggacaaagcauggcucguccaccggcagugguuucuggauuuaccucugccauggcuccccggcgcugacacucagggaagcaauuggauacagaaggagacacuugugacguucaagaacccucaugccaaaaagcaagacguugugguccugggcucucaggaaggggcgaugcacaccgccuugacuggagcaacagagauucagauguccucagguaaucuacuguuuaccggccaucucaaaugccgucugcgcauggauaaacuucaacugaaagggaugagcuacaguauguguacaggaaaguucaagaucgugaaagaaaucgcugagacucagcacggcaccauuguaaucagaguucaguaugagggugacgggucuccaugcaagauucccuucgaaauaacggauuuggagaaaaggcaugugcucggccggcugaucaccgucaacccgauugugacagaaaaggacuccccugucaacaucgaggccgaacccccauuuggagauagcuacaucauuauaggcguggagccugggcaguuaaaacugaauugguucaagaagggaucgucuaucggucaaauguuugagacuaccaugcgaggcgcuaaacgcauggccauucuaggggacacagcaugggauuucggaucccucggcgguguuuuuacuucaaucgggaaggcccugcaccagguguucggcgcuauuuacggagcggcauuuaguggcguaagcuggaccaugaaaauccuuauaggggucaucauuacguggaucggaaugaacuccagaucuacuagcuugucagugagucugguucucgugggcgucgugacccuguaucuuggugccguagugcaggcugacuccggguguguugucagcuggaagaauaaagaacugaagugcggaucuggcauuuucaucacugauaacgugcacacauggaccgagcaguacaaguuucaacccgaaucaccaaguaaauuggccagcgcaauacagaaggcccaugaggaagguauuuguggcaucagguccgugacucggcucgagaaucugauguggaaacagauuacccccgaguuaaaccacauccugucugaaaaugaggucaagcuaacaauaaugacgggggacaucaaaggaauuaugcaggcuggcaagcgcucgcucagaccucaaccaaccgaacugaaauauagcuggaagacuugggggaaggccaaaaugcuuuccacagagucacauaaccagaccuucuugaucgauggaccggaaacagcagagugccccaauacuaacagggcguggaauagucuggagguugaagacuacggcuuugguguguucaccacgaacauuuggcucaagcugcgugagaaacaggacguguuuugugauucuaaguuaaugagcgcugccaucaaagacaaucgggcaguacacgccgauaugggguauuggauagaauccgcucugaacgacacauggaagauggagaaggccucauucauugaggucaaaagcugccacuggccuaagucucauacccuuugguccaauggaguguuggaaagugagaugaucauccccaagaauuucgcaggccccguuagccagcacaacuaccgaccugguuaucauacucaaaccgcuggcccauggcaccucgggaagcuggaaauggauuuugacuucugugagggaacaacuguggucgugaccgaagauugcggcaauagagggcccucucuaaggacaacgaccgccuccggaaaacugauuacugaguggugcugucgcucaugcacacucccgccucugcgguacagaggcgaggacgguuguugguacgggauggaaaucaggccacuuaaggagaaggaagagaacuugguuaauagucuggugaccgcgggacauggccagauugauaacuuuagcuuagguguacucggcauggcccuguuccuugaagagaugcugcgcacucgaauagggacaaaacacgcuaucuugcucgucgcagugucguuugugacccugauuacgggaaauauguccuuccgggaccuaggccgugucaugguuauggugggggccacuaugaccgaugacaucggaaugggcguaacauaucuggcucuccuggccgcauuuaaggugagacccaccuucgcggccggucuuuugcugaggaaauuaacuucuaaggagcucaugauggcuacaauugggaucgcccugcuuagccagucaaccauaccugaaacaauccuggagcuaacugaugcacucgcucugggaaugauggucuugaaaauugugcgcaacauggaaaaguaccaacuggccguuaccaucauggcaauuaguugcgugcccaaugccgucaucuuacagaacgcuuggaagguguccuguacgauacucgcggccguuucugugagcccacugcuucugacauccucacagcagaaagcagacuggauuccuuuggcucucaccaucaagggccugaaucccacugccaucuuucuaaccacacugagccggacaaguaaaaagagaucuuggccacuuaacgaggccauuauggcugucggcaugguauccauacucgcaagcucgcuguugaaaaaugacaucccgaugaccgggccucugguggccggagguuuacucacgguuugcuaugugcugacaggcaggucagcggaucuugaacuggagcgagcugccgacgucaagugggaggaucaagcagaaauuucugggaguucccccaucuugagcauuaccaucucugaggacggaagcauguccaucaaaaacgaagaggaggaacagacucucacaauccugauucgcaccggccuacuggugaucucagguguauucccagugaguauucccaucacugccgcugcaugguaccuuugggaggucaagaagcagcgggccgggguucucugggaugugccuagcccacccccuguggaaaaagcggagcuggaagacggagcuuauagaauaaagcagaggggcauuuugggcuacucucaaaucggggccggagucuauaaagaggguacauuucacaccauguggcaugugacgcguggcgcaguuuuaaugcaccgcgggaagcggaucgagccguccugggccgaugucaaaaaggaccugauuucauacggaggcgguuggaagcucgaaggggaguggaaagaaggagaggaagugcagguccuggcucuugagccaggcaagaaucccagagccgugcagacuaaaccuggcaucuucaagaccaacacagggaccauaggagcaguuagucuggauuuuagcccagguacauccggcucucccauuguggacaggaaagggaaggucgugggauuguacggcaaugguguagucacucgaucgggggcuuaugugagcgccaucgcgcagaccgagaagucaauugaagauaacccugagaucgaagacgauauauuccggaaaaagcgccuaacgauuauggaccugcauccgggagccggcaaaacaaagagauaccuccccgcaaucguuagggaggcuaucaaacggggccugcgaacucuuauuuuagccccaaccagaguggucgcugcagaaauggaggaggcccugcgcgggcucccuaucagguaucaaacacccgccauuaagaccgaacacacuggacgugagauaguggacuugaugugucaugcuaccuucacaaugcggcugcucuccccaguuagagugccuaacuacaaucugaucauuauggaugaagcgcacuuuacggaccccgcaaguaucgccgcuagggguuauaucucuacucgcgucgagaugggcgaggccgcagggauuuucaugaccgccacaccaccgggaagccgagauccuuuuccccaguccaacgcuccaauaauggacgaagagagagaaauccccgagcggucauggaacucuggccacgaaugggugaccgauuucaaggguaaaacuguaugguuugugccuagcauuaaggcggggaacgacaucgccgcaugccuuaggaaaaauggaaagaaaguuauucagcugagucgcaagacauucgauuccgaguacgucaagacccgugcuaacgacugggauuuuguggugacgacugacaucagcgagaugggcgccaauuucaaagcagaaagagucauagauccacggagguguaugaagcccguaaucuugacagacggcgaggaacgcgugauucuagccgggccuaugccgguuacccauucuucagcugcccaacgaagaggacggaucgguaggaaccccaaaaaugagaacgaccaguauauuuacaugggcgaaccccuggagaaugaugaggacugcgcgcacuggaaggaagcaaaaaugcucuuagauaacaucaauaccccugaggggauaauucccuccauguuugaaccagagcgcgaaaagguggacgccaucgauggagaguacagacugaggggcgaggcucggaaaacuuucgucgaccuuaugcgucgcggugaucugccuguguggcucgccuauaagguugcugcagaagggauuaacuacgccgaccgaaagugguguuuugauggcaucaaaaauaaccagauauuggaggaaaacauggagguggagaucuggacaaaggaaggagagaggaaaaagcugaaacccagauggcucgacgcucggauuuauagugauccacuggcccuuaaggaguucaaggaguucgcagcgggccgcaaaagccuaacccugaauuugaucacagaaauggggagauuaccuacuuuuaugacgcagaaggccaggaacgcucuggacaaucucgccguccugcauaccgcagaggcuggaggucgggccuacaaccacgcacuuucggagcugccggaaacacucgagacuuugcugcuacugacccuccuugccacagugaccggcgggauuuuccuguuuuuaaugucuggaaaaggcaucgguaagaugacuuuggggaugugcugcauaauuacggcuuccauccugcucuggcacgcgcaaauccagccccauuggauugccgcaagcaucauacuggaguucuuucuuauuguacugcucaucccagagccugaaaaacagcgaaccccacaggauaaucaauugacauaugugguuauugcuauccugacugucguggccgccaccauggcaaacgagaugggcuucuuagagaagacaaagaaagaccuaggacugggcucaauaaccacucaggaaagugagucuaauauccucgacauugaucuuagaccagcuuccgccuggacacuguacgcgguggcuacgaccuuugucacuccuauguugcgccacagcaucgaaaacucaaguguuaaugugagccugacagccauugcaaaccaggccaccguacucauggggcugggaaaggguuggccccuuuccaaaauggacaucggcgugccgcuccuggcuauuggguguuauucucaggucaauccaaucaccuugacagcagcccuguuacuacugguggcgcauuacgcuauaauuggaccuggccuccaagccaaggcaacuagggaggcccagaaacgggcugccgcagguaucaugaagaaccccacgguugaugggaucaccgugauugaccuugaaccaauacccuacgauccuaaguucgagaaacagcugggccaggucauguugcugauccucugcguaacacaagugcugaugaugcguacuaccugggcucuuugugaggccuuaacacuggcgaccggaccgauuagcacucucugggaaggcaaucccgggagauuuuggaacacgacaaucgccguuuccauggcaaauauuuucaggggaucauauuuggcuggcgccggucugcuauuuucuaucaugaagaacaccacaaguacccgccgggggacaggaaauauaggcgagacucugggugaaaaauggaagucgcgacucaacgcacuuggcaaaagcgaguuccagaucuacaagaaauccgggauucaggagguggacagaacccuggcuaaggaaggaaucaagaggggcgagacagaucaccaugccgucucucgcgggucagccaaauugcggugguuuguggaaagaaacauggucacgccagagggaaaggugguugaccugggcugcggucgugggggauggagcuauuacuguggcggucucaaaaaugugagggaaguaaagggccugaccaaagggggaccuggccacgaggagcccauuccuauguccacuuauggguggaacuuagugcggcuucaaaguggagucgauguuuucuucacaccacccgaaaagugcgacacccugcucugugauaucggcgagucuagcccuaauccaacuauagaagcgggucgcacacuacgagugcugaacuuggucgagaauuggcugaacaauaacacccaguuuugcauuaaggugcucaaucccuacaugccgucaguaaucgagaaaauggaggcacuucagagacaguaugggggagcacuggugaggaacccuuugucccggaauaguacgcacgagauguacuggguuagcaacgccaccggcaauaucgugucuuccgucaacaugauuucacgcaugcugauaaauagauucacaaugaagcauaaaaaggcuacuuacgaaccagacguggaucucggcagcgggaccaggaacaucggaauugagucggaaauccccaacuuagacauuaucgguaaacgaauagagaagaucaagcaagaacacgagauuucuuggcauuaugaccaggaucacccuuacaaaacaugggccuaucacggcaguuacgagacuaagcagaccggguccgcaagcucaauggucaauggagugguucggcugcuuacaaaaccaugggacguagugcccauggucacccagauggccaugacugauacgacaccguuuggccaacagcguguguucaaggaaaaaguugacaccagaacucaggagccuaaggaagguaccaagaaacugaugaagaucacagcugaguggcuauggaaagagcucgggaagaaaaagacgccccgcauguguaccagggaagaguuuacuaaaaaggugcgguccaacgcggcccugggagcaauuuucacagaugaaaauaaguggaaaucugcuagagaggccgucgaagacggccgcuuuugggaguugguggauagggagcgaaaccugcaucucgaaggcaagugcgagaccuguguauauaauaugauggggaaacgggaaaagaaacuuggagaguucgguaaggcaaagggcagcagagccaucugguacauguggcugggggcuagguuuuuagaguucgaggcccugggauuuuugaacgaggaccacugguucagucgcggcaauucccucagcgguguggaaggggagggacugcaucgucuaggcuauauucuucgggauguuggcaaaaaggaagggggagcgauguacgcagacgauacugccgguugggacacaagaauaacccuggaggaccucaaaaacgaagagauggucacaaaucacaugaagggcgagcauaaaaagcuggcugaagccaucuuuaaguugacuuaccagaacaaaguggugaggguccaacgcccaaccccucgagggacgguuauggauauuaucucucggagagaccagaggggaucaggccagguggguaccuaugggcugaauacauucacuaacauggaggcacaacucauccgccagauggaaggagagggcauuuucaagaguauacagcaccuuaccgcuacagaggaaaucgccguacagaauuggcuggcuagagugggccgggagagguuaucccguauggccauuagcggggaugacugcgucgugaaacccaucgaugaccgauuugcaucugcgcugacugccuugaacgauaugggaaagguucgcaaagacauucaacagugggaaccaucgagagguuggaaugauuggacccaggugcccuucugcucacaccauuuucacgagcucgucaugaaggacggccgggugcugguaguuccuuguaggaaccaggaugaacuaaucgggcgcgcuagaauaagccaaggagccggcuggucccuuaaggagacggcaugccuggguaaaaguuacgcucagauguggacacucauguauuuccaucggagggaccugcgauuggccgcaaacgccaucuguucugcggugccaagccacugggucccgaccucccguacuacauggucaauucacgcuaagcaugaguggaugaccacugaagauauguuagccguguggaauagaguguggauccaggagaaccccuggauggaagacaaaaccccugucgagaguugggaagagguuccauaccuggggaagcgcgaggaccaguggugcggaucucucauuggccuuacaagccgggcaacgugggccaaaaauauccaaaccgcuauaaaccaggugaggucccugauuggcaucgaagaguauacugauuacaugcccucaaugaagagauuucgccgggaagaggaagaggccgggguacuaugguga

SEQ ID NO: 14530 - RNA, 9876 nt, Artificial Sequence
  derived and/or modified CDS sequence (opt3) from DENV-2__JF357906__SS-prME
accgccggagugaucgucaugcugauucccacggcuauggcauuccaccucacuacgcggaauggggaaccucauaugauaguuggaagacaggaaaaggguaaaagccuucuguuuaagaccgaagacggcgugaauaugugcacauugauggccaucgauuuaggggaacugugugaggacacuauuaccuacaaaugcccacuacuccggcaaaacgaaccggaggauaucgacuguuggugcaauuccacaucuaccugggugacuuauggaacauguaccacgacuggcgagcaccgccgagaaaagcguucaguggcgcuggucccccauguggguauggggcuugagaccagaacagaaacuuggaugaguagcgagggagcuuggaaacacguucagaggauugagaccuggauccugcggcauccuggcuucacaauaauggccgcaguguuggccuacaccaucggcacgacucacuuucagaaggcucucauuuucauccugcugacagcagucgccccauccaugaccaugcgcugcauugggaucucuaacagagauuuuguggaaggaguaucggguggcucauggguugacauagugcucgagcacgggagcugugucacuacaauggcuaagaauaaacccaccuuagauuucgaacugauuaagacggaggccaaacagccugcgacccuuaggaaguauugcaucgaagcaaaauugacaaacacuaccacagagagucgguguccaacucaaggagagcccucccugaaugaagaacaggacaagcgcuuuauuugcaagcauucuaugguggaucgaggcugggguaacggguguggacuauucggcaaaggcgggaucgugaccugcgccauguuuacaugcaagaaaaauauggaaggaaaggucguucagccugagaaccucgaauacaccaucgugauuacuccacacagcggugaggagcaugcuguaggcaaugacacggggaaacacggaaaggaaauaaaaaucacaccgcaguccucaauuaccgaggccgaacugacuggcuaugguaccgugacaauggaguguagucccagaaccgggcuugauuucaacgaaaugguccuguugcaaauggaggacaaggcauggcucgugcacaggcagugguuucuggauuuaccucugccauggcuccccggcgcugacacucagggaagcaauuggauccagaaggagacacuuguuacguucaaaaacccucaugccaagaaacaagacguggucgugcugggcucucaggaaggggcgaugcacaccgccuugacuggagcaacagagauacagauguccucagguaaucuacuguuuaccggccaucucaagugccggcugcguauggauaaacuucaacugaaggggaugagcuacaguauguguacaggaaaguucaaaauuguaaaggaaaucgcugagacucagcacggcaccaucguuauucgcgugcaguaugagggugacgggucuccaugcaaaauccccuucgaaauuacggauuuggagaagagacauguccucggcaggcugauaaccgugaacccgaucgucacagaaaaagacuccccugugaacauugaggccgaacccccauuuggagauagcuacaucaucauuggcguugagccugggcaguuaaagcugaauugguucaagaaaggaucgucuauaggucaaauguuugagacuaccaugcggggcgcuaagcgaauggccauccuaggggacacagcaugggauuucggaucccucggcgguguguuuacuucaauugggaaagcccugcaccagguauucggcgcuaucuacggagcggcauuuaguggcgucagcuggaccaugaagauucuuaucggggugauaaucacguggauuggaaugaacucccgcucuacuagcuugucaguuagucuggugcucgucggcgugguaacccuguaucuuggugccgugguucaggcugacuccgggugugucgugagcuggaaaaauaaggaacugaagugcggaucuggcaucuucauuacugauaacgugcacacauggaccgagcaguacaaauuucaacccgaaucaccaaguaaguuggccagcgcaauccagaaagcccaugaggaagguauauguggcauuagauccgucacuaggcucgagaaucugauguggaagcagaucacccccgaguuaaaccacauucugucugaaaaugagguuaaacuaacaaucaugacgggggacauaaagggaaucaugcaggcuggcaaacggucgcuccgcccucaaccaaccgaacugaaguauagcuggaagacuugggggaaagccaagaugcuuuccacagagucacauaaccagaccuucuugauugauggaccggaaacagcagagugccccaauacuaacagagcguggaauagucuggagguggaagacuacggcuuugguguguucaccacgaacaucuggcucaaacugagggagaagcaggacguauuuugugauucuaaauuaaugagcgcugccauuaaggacaaucgugcaguccacgccgauaugggguauuggaucgaauccgcucugaacgacacauggaagauggagaaagccucauucauagagguaaagagcugccacuggccuaaaucucauacccuuugguccaauggaguuuuggaaagugagaugauuaucccaaagaacuucgcaggccccgugagccagcacaacuaccggccugguuaucauacucaaaccgcuggcccauggcaccucgggaaacuggaaauggauuuugacuucugugagggaacaacugucgugguuaccgaagauugcggcaaucgagggcccucucuaagaacaacgaccgccuccggaaagcugaucacugaguggugcuguaggucaugcacacucccgccucugcgcuaccggggcgaggacgguuguugguacgggauggaaauuagaccacuuaaggagaaagaagagaacuuggugaauagucugguaaccgcgggacauggccagaucgauaacuuuagcuuagguguccucggcauggcccuguuccuugaagagaugcugaggacucgcauugggacaaagcacgcuauauugcucguggcagugucguuugucacccugaucacgggaaauauguccuuccgagaccuaggccggguuauggugaugguaggggccacuaugaccgaugacauuggaaugggcgugacauaucuggcucuccuggccgcauuuaaaguccgucccaccuucgcggccggucuuuugcugagaaaguuaacuucuaaagagcucaugauggcuacaaucgggauugcccugcuuagccagucaaccaucccugaaacaauacuggagcuaacugaugcacucgcucugggaaugaugguguugaagaucguuaggaacauggaaaaguaccaacuggccgugaccauuauggcaaucaguugcguccccaaugccgugauuuuacagaacgcuuggaaaguuuccuguacgauccucgcggccgugucugucagcccacugcuucugacauccucacagcagaaggcagacuggauaccuuuggcucucaccauuaaaggccugaaucccacugccaucuuucuaaccacacugagccgcacaaguaagaaacggucuuggccacuuaacgaggccaucauggcuguaggcaugguguccauucucgcaagcucgcuguugaagaaugacauaccgaugaccgggccucugguugccggagguuuacucacggugugcuauguccugacaggcagaucagcggaucuugaacuggagagggcugccgacgugaaaugggaggaucaagcagaaaucucugggaguucccccauuuugagcaucaccauuucugaggacggaagcauguccaucaagaacgaagaggaggaacagacucucacaauacugauccgaaccggccuacugguaauuucagguaucuucccagugaguauucccaucacugccgcugcaugguaccuuugggaggucaagaaacagcgcgccgggguucucugggaugugccuagcccacccccuguggaaaaggcggagcuggaagacggagcuuaucggauaaaacagagaggcauuuugggcuacucucaaaucggggccggagucuauaaggaggguacauuucacaccauguggcaugugacgaggggcgcaguuuuaaugcaccgugggaaacgcaucgagccguccugggccgauguaaagaaggaccugauuucauacggaggcgguuggaaacucgaaggggaguggaaggaaggagaggaagugcagguccuggcucuugagccaggcaaaaauccccgggccgugcagacuaagccuggcaucuucaaaaccaacacagggaccauaggagcaguuagucuggauuuuagcccagguacauccggcucucccauuguggacagaaaggggaaggucgugggauuguacggcaaugguguagucacuaggucgggggcuuaugugagcgccaucgcgcagaccgagaaaucaauugaagauaacccugagaucgaagacgauauauuccgaaagaaacggcuaacgauuauggaccugcauccgggagccggcaagacaaaacgcuaccuccccgcaaucguuagagaggcuaucaagaggggccugcggacucuuauuuuagccccaacccgaguggucgcugcagaaauggaggaggcccugagagggcucccuauccgcuaucaaacacccgccauuaagaccgaacacacuggaagggagauaguggacuugaugugucaugcuaccuucacaaugcgucugcucuccccaguucgggugccuaacuacaaucugaucauuauggaugaagcgcacuuuacggaccccgcaaguaucgccgcuagagguuauaucucuacuagggucgagaugggcgaggccgcagggauuuucaugaccgccacaccaccgggaagccgcgauccuuuuccccaguccaacgcuccaauaauggacgaagaacgagaaauccccgagagaucauggaacucuggccacgaaugggugaccgauuucaaagguaagacuguaugguuugugccuagcauuaaagcggggaacgacaucgccgcaugccuucggaagaauggcaagaagguuauucagcugaguaggaagacauucgauuccgaguacgucaaaacccgcgcuaacgacugggauuuuguggugacgacugacaucagcgagaugggcgccaauuucaaggcagaacgugucauagauccaagacgguguaugaaacccguaaucuugacagacggcgaggaaagggugauucuagccgggccuaugccgguuacccauucuucagcugcccaacgccgaggaagaaucggucggaacccaaagaaugagaacgaccaguauauuuacaugggcgaaccccuggagaaugaugaggacugcgcgcacuggaaagaagcaaagaugcucuuagauaacaucaauaccccugaggggauaauucccuccauguuugaaccagagagggaaaaaguggacgccaucgauggagaguaccgccugagaggcgaggcuaggaagacuuucgucgaccuuaugcggcguggugaucugccuguguggcucgccuauaagguugcugcagaagggauuaacuacacagaccgcaaaugguguuuugauggcaucaagaauaaccagauauuggaggaaaacauggagguggagaucuggaccaaagaaggagagcgaaagaaacugaagcccagauggcucgacgccaggauuuauagugauccacuggcucuuaaggaguucaaagaguucgccgcaggcagaaagagccuaacacugaauuugaucacugaaauggggcgcuuaccuacguuuaugacccagaaagcgagaaacgcccuggacaaucucgcuguccugcauacagccgaggcaggagguagggcuuacaaccacgcccuuucggagcugccggaaacucucgagaccuugcugcuacugacacuccuugcaaccgugacuggcgggauuuuccuguuuuuaaugucuggaaagggcaucgguaaaaugacguuggggaugugcugcauaauuaccgccuccauccugcucugguaugcucaaauccagccccacuggauugcggccagcaucauacuggaguucuuucuuauuguacugcucaucccagagccugaaaagcagcggacaccccaggauaaucaauugacuuacgugguuauugcaauccugaccgucguggcugccacaauggccaacgagaugggcuucuuagagaagaccaaaaaggaccuaggacugggcucaauaacuacacaggaaagugagucuaauauccucgacauugaucuucgaccagcauccgcuuggacgcuguaugccguggcgaccacuuuugucacaccuauguugagacauagcaucgaaaacucaaguguuaaugugagccugaccgcuauugccaaccaggcaaccguacucauggggcugggaaaagguuggccccuuuccaagauggacaucggcgugccgcuccuggccauuggguguuacucucaggucaauccaaucacauugacugcugcacuguuacuacugguggcccacuacgcgauaauuggaccuggccuccaagcuaaagccacgcgcgaggcacagaagagggccgcugccgguaucaugaagaaccccaccguugaugggaucacagugauugaccuugaaccaauacccuaugauccuaaauucgagaagcagcugggccaggucauguugcugauccucugcguaacucaagugcugaugaugcggaccacaugggcacuuugugaggcuuuaacccuggccacuggaccgauuagcacgcucugggaaggcaaucccgggcguuuuuggaacacaaccaucgcgguuuccauggccaauauuuucagaggaucauacuuggcaggcgcuggucugcuauuuucuaucaugaaaaacacuaccaguacaaggcgcgggacuggaaauauaggcgagacccugggugaaaaguggaaaucgcggcucaacgcccuuggcaagagcgaguuccagaucuauaaaaaguccgggauucaggagguggaccgaacacuggcaaaggaaggaaucaaaagaggcgagacggaucaucacgcugucucuagggggucagccaaguugcgcugguuuguggaacggaacauggucaccccagagggaaaagugguugaccugggcugcgguagagggggauggagcuacuauuguggcggucucaagaaugugcgugaaguaaaaggccugacuaaagggggaccuggccaugaggagcccauuccuauguccacauacggguggaacuuagugaggcuucaaaguggagucgauguuuucuucaccccacccgaaaagugcgacacucugcucugugauaucggcgagucuagcccuaauccaacaauagaagccggucggacccuacgcgugcugaacuuggucgagaauuggcugaacaauaacacgcaguuuugcauuaaagugcucaaucccuauaugccgucaguaaucgaaaagauggaggcgcuucagcgacaguacgggggagcucuggugagaaacccuuuguccaggaauaguacccacgagauguacuggguuagcaacgcaacaggcaauaucgugucuuccgucaacaugauuucacggaugcugauaaaucgcuucacuaugaaacacaagaaagccaccuaugaaccagacguggaucucggcagcgggacaagaaacaucggaauugagucggaaauccccaacuuagacauuaucgguaagaggauagagaagaucaaacaagaacaugagauuucuuggcacuacgaccaggaucauccuuauaagacuugggcuuaccacggcaguuaugagaccaaacagacaggguccgccagcucaauggucaauggagugguucgacugcuuaccaagccaugggacguagugcccauggucacucagauggcaaugacggauacaaccccguuuggccaacagcggguguucaaagaaaagguugacacucguacccaggagccuaaggaagguaccaagaagcugaugaaaaucacggccgaguggcuauggaaggagcucgggaggaaaaagacaccccgcauguguacuagggaagaguuuacacggaaagugagauccaacgcugcgcugggagccauuuucaccgaugaaaauaaguggaagucugcacgcgaggcugucgaagacggcagguuuugggaguugguggaucgagagcggaaccugcaccucgaaggcaaaugcgagacuuguguauacaauaugauggggaagagagagaagaaacuuggagaguucgguaaagccaaaggcagcagggcaaucugguauauguggcugggggcccgcuuuuuagaguucgaggcucugggauuuuugaacgaggaccauugguucagucgugaaaauucccucagcggcguggagggugaagggcugcaccggcuaggauacauucuuagagauguuggcaagaaagagggcggggccauguacgcggacgauacagcaggaugggacaccaggauaacacuggaagaccucaagaacgaggagauggucacuaaucauaugaaaggugaacacaagaaacuggccgaggcuaucuuuaaguugaccuaucagaacaagguggugcgcguccaacgaccaacgccucggggcaccguuauggauauuaucucuagaagggaccagcgcgggucaggacaggugggcacauacggucugaauacuuucaccaacauggaagcccaacucaucagacagauggagggggagggaauuuucaaaaguauacagcaucuuacagcaacugaagagaucgcuguacagaauuggcuggcccgggugggcagggaacguuuaucccgaauggcuauuagcggcgaugacugcgucgugaagcccaucgaugaccgcuuugccucugcacugaccgcguugaacgauauggggaaaguuagaaaggacauucaacagugggagccaucgcggggauggaaugauuggacacaggugcccuucugcucacaccacuuucaugaacucgucaugaaagacgguagggugcugguaguuccuugucgcaaccaggaugagcuaaucggcagagcccggauaagccaaggggcuggauggucccuuaaggagacagccugccugggcaagaguuaugcacagauguggacccucauguacuuccacaggcgagaccugcguuuggcugccaacgcaaucuguucugccgugccaagccauugggucccgacuuccagaacaaccugguauauucacgcgaaacacgaauggaugacuaccgaggauauguuagcuguguggaaucgcguguggauccaggaaaaccccuggauggaggacaagacaccugucgaaucaugggaggagguuccauaccuggguaaacgggaagaccaguggugcgggagucucauuggacuuacgucuagggccaccugggcaaagaauauccaaacugccauaaaccaggugagaagccugauuggcaaugaggaauauacagauuacaugcccuccaugaaacgcuuucggagggaggaagaggaggcuggcguacuaugguga

SEQ ID NO: 14531 - RNA, 9873 nt, Artificial Sequence
  derived and/or modified CDS sequence (opt3) from DENV-2__HQ705624__SS-prME
accgccggcgugaucgucaugcugauucccacagcuauggcauuccaccucacuacgagaaacggggagccucauaugauaguuggaaggcaggaaaaggguaaaagccuucuguuuaagaccgaggacggcgugaauaugugcacauugauggccaucgauuuaggggaacugugugaggacacuauuaccuacaaaugcccacuacuccggcaaaacgaaccggaggauaucgacuguuggugcaauuccacaucuaccuggguaacuuauggaacauguaccacgacuggcgagcaccgccgagaaaagcguucaguggcgcuggucccccauguggguauggggcuugagaccagaacagaaacuuggaugaguagcgagggagcuuggaaacacguucagaggauugagaccuggauccugcggcauccuggcuucacaauaauggccgcaaucuuggccuacaccauuggcacgacucacuuucagcgcgcucucaucuucauucugcugacagcaguggccccauccaugaccaugagaugcaucgggauaucuaacagggauuuugucgaaggagugucggguggcucauggguagacauuguucucgagcacgggagcugugugacuacaauggcuaagaauaagcccaccuuagauuucgaacugaucaaaacggaggccaagcagccugcgacccuucggaaauauugcauugaagcaaaguugacaaacacuaccacagagagucgcuguccaacucaaggagagcccucccugaaugaagagcaggacaaacgauuuaucugcaagcauucuauggucgauagaggcugggguaacggguguggacuauucggcaagggcgggaucgugaccugcgccaaauuuacaugcaagaaaaauauggaaggaaaggugguccagccugagaaccucgaauacaccauuguuauaacuccacacagcggugaggagcaugcugugggcaaugacacggggaaacacggaaaggaaaucaaaauuacaccgcaguccucaaucaccgaggccgaacugacuggcuaugguaccguaacaauggaguguagucccaggaccgggcuugauuucaacgaaauggugcuguugcaaauggaggacaaggcauggcucguccaccggcagugguuucuggauuuaccucugccauggcuccccggcgcugacacucagggaagcaauuggauacagaaggagacacuugugacguucaaaaacccucaugccaagaaacaagacguugugguccugggcucucaggaaggggcgaugcacaccgccuugacuggagcaacagagauucagauguccucagguaaucuacuguuuaccggccaucucaagugccgucugcgcauggauaaacuucaacugaaggggaugagcuacaguauguguacaggaaaguucaaaaucgugaaggaaaucgcugagacucagcacggcaccauuguaaucagaguucaguaugagggugacgggucuccaugcaaagugcccuucgaaauuacggauuuggagaagaggcauguccucggccggcugauaaccgugaacccgaucgucacagaaaaagacuccccugugaacauugaggccgaacccccauuuggagauagcuacaucaucauuggcguugagccugggcaguuaaagcugaauugguucaagaaaggaucgucuauaggucaaauguuugagacuaccaugcgaggcgcuaagcgcauggccauccuaggggacacagcaugggauuucggaucccucggcgguguguuuacuucaauugggaaagcccugcaccagguauucggcgcuaucuacggagcggcauuuaguggcgucagcuggaccaugaagauucuuaucggggugauaaucacguggauuggaaugaacuccagaucuacaagcuugucaguuagucuggugcucgucggcgugguaacccuguaucuuggugccauggugcaggcugacuccggguguguugucagcuggaaaaauaaggaacugaagugcggaucuggcaucuucauuacugauaacgugcacacauggaccgagcaguacaaauuucaacccgaaucaccaaguaaguuggccagcgcaaucaaaaaggcccaugaggaagguauauguggcauuagguccgugacucggcucgagaaucugauguggaaacagaucacccccgaguuaaaccacauucugucugaaaaugaggucaagcuaacaaucaugacgggggacauacgcggaaucaugcaggcuggcaaaagaucgcucaggccucagccaaccgaacugaaguauagcuggaagacuugggggaaagccaagaugcuuuccacagagucacauaaccaaaccuucuugauugauggaccggaaacagcagagugccccaauacuaaccgugcguggaauagucuggagguugaagacuacggcuuugguguguucaccacgaacaucuggcucaaacugcgggacaagcaggauguguuuugugacucuaaauuaaugagcgcugccauuaaggauaaucgagcaguacacgccgacaugggguauuggaucgaguccgcucugaacgauacauggaagauggaaaaagccucauucauagaggucaagagcugccacuggccuaaaucucauacccuuugguccaauggaguguuggagagugaaaugauuaucccaaagaacuucgcaggccccguuagccagcacaacuacagaccugguuaucauacucagaccgcuggcccauggcaccucgggaaacuggagauggacuuugaucuaugugaaggaacaacuguggucgugaccgaggacugcggcaauagggggcccucucugcgcacaacgaccgccuccggaaagcucaucacugaauggugcugucggucaugcacacugccgccucuuagauacaggggcgaggaugguuguugguacgggauggagauucgcccauugaaggaaaaagaggaaaaccugguuaauaguuuagugaccgcgggacauggccaaaucgacaacuucagccucgguguacugggcauggcccuucuguuggaggaaaugcuccgaacucggauugggacaaagcacgcuauacugcuagucgcagugucguuugugacccugaucacgggaaauauguccuuccgugaucucggcagagucaugguuauggugggggccacuaugaccgacgauauuggaaugggcguaacauaucuggcucuuuuggccgcauuuaaagugaggcccaccuucgcggccggucuguuacuccgcaagcugacuucuaaagagcuuaugauggcuacaaucgggauugcccugcuaagccagucaaccaucccugagacaauacucgaacugacugacgcauuggcucugggaaugauggucuuaaagaucgugcggaacauggagaaguaccagcucgccguuaccgugauggcaauuaguugcguccccaaugccgugauccugcaaaacgcuuggaaaguuuccuguacgauucuugcggccgugucugucagcccacuguugcucacauccucacagcagaaggcagacuggaucccucuggcucuaaccauaaaaggccugaaucccacugccauuuuucuuaccacacucagcagaacuaguaagaaaaggucuuggccacugaacgaagccaucauggcuguaggcaugguguccaucuuggcaagcucgcuguuaaagaaugauauuccgaugaccgggccucucguugccggaggucugcuuacggugugcuauguccugacaggccgaucagcggacuuggagcucgaacgcgcugccgaugugaaaugggaggaccaggcagagauaucugggaguucccccauccugagcauuaccaucucugaagauggaagcauguccauuaagaacgaggaagaggagcaaacucuaacaauccugauacggaccggccuucucguaaucucagguguguucccagucaguauucccaucacugccgcugcaugguaccugugggaaguuaagaaacagagagccgggguguugugggacgugccuagcccacccccugucgagaaggcggaauuagaggauggagcuuauaggauuaaacagcguggcauccugggcuacucucagauaggggccggaguguauaaggaagguacauuucacaccauguggcauguuacgcgcggcgcaguacucaugcaccgggggaaaagaauugagccguccugggccgacgugaagaaggaucugaucucauacggaggcgguuggaaacuugagggggaauggaaggagggagaagagguccaagugcuggcuuuggaaccaggcaaaaaucccagggccguucagacuaagccuggcaucuucaaaaccaacacagggaccauuggagcagugagucuagacuuuccagguacaagcggcucccccaucgucgaucgaaaggggaaggugguaggacuguacggcaauggugucgugacucggucuggggcuuauguuucggccauagcgcagaccgagaaaagcauugaggacaacccugaaaucgaggaugacauuuuccgcaagaaaagacucacgaucauggaccugcauccgggagccggcaagacaaaaagguaccuucccgcaauagugcgggaagcuauuaagcgaggcuuaagaacucugauccucgccccaacccgcgucguggcugcagagauggaagaggccuugagggggcugccuauccguuaucagacaaccgccauuaagacugagcacaccggacgggaaaucguugaucucaugugucaugcuacauuuacgaugagacugcuuucacccgugagggucccaaacuacaaucugauuauaauggacgaggcgcacuucacugauccugcauccaucgccgcucgcgguuauauuaguacccgaguggaaaugggcgaggccgcagggaucuucaugacagccacccccccaggaucuagagacccguuuccucaaagcaacgcucccaucauggaugaggaacgggagauuccagaaagguccuggaauucaggccacgaguggguaacugacuucaaagguaagacagugugguuuguucccucuauaaaagcggggaacgauaucgccgcaugcuugcgcaagaauggaaaaaaggucauucagcuaagccguaagaccuucgacagugaauacgugaaaacgagagcuaacgauugggacuuuguggucacuacagauaucuccgagaugggcgccaauuucaaggcagagcggguaauugacccuaggcgcuguaugaaaccagugauccugaccgacggcgaagagcgaguuauacucgccgggcccaugccugugacccauagcucugcugcccagagacggggaaggaucggucgcaacccgaagaaugaaaacgaucaauauauuuacaugggcgagccauuagaaaaugacgaggauugcgcgcacuggaaagaggcaaagaugcugcuugacaacaucaauacucccgaagggauuaucccuucaauguuugagcccgaaagagagaaagucgaugccauagacggagaauacaggcugcggggcgaggcucguaagacauucguggaucucaugcgccgaggugacuugccaguuuggcuggccuauaagguggcugcagaggggauuaacuacgccgauagaaaaugguguuuugacggcaucaagaauaaccagauucucgaagagaacauggaagucgagaucuggaccaaagagggagaaaggaagaaacugaagccucgguggcuugaugcucgcauauauuccgacccccuagcccugaaggaguucaaagaauuugcagcgggcagaaagaguuugacauuaaaucugaucacugagauggggaggcucccaacguucaugacccagaaagcccggaacgcucuggauaaucuugccgugcugcauacagcagaagcuggaggucgagccuacaaccacgcacucagcgaguugccugagacucuggaaacccuacugcuccuuacacuguuagccaccguaacuggcgggauuuucuuguuucugaugucgggaaagggcaucgguaaaaugacgcucgggaugugcugcauuaucaccgcuucuauacugcuuugguaugcgcagauucaaccgcacuggaucgccgcauccaucauucuggaguucuuucucaucguguugcugauacccgaaccagagaagcagagaacaccucaggacaaucaguuaacuuacguugucauugcuauccuaaccgugguggccgccacaauggcaaacgaaaugggcuuccuggagaagaccaaaaaggaccucggacuuggcagcauuacuacacaagagucagaaaguaauauccuggauauagacuugcgccccgcuucugccuggacgcuguaugcggucgcuaccacuuuuguuacaccaaugcucaggcauuccaucgagaacagcucagugaauguaagucugaccgccauugcaaaccaggccaccgugcuuauggggcucggaaaagguuggccucugagcaagauggauaucggcguccccuugcuggcuauuggguguuacucccaggugaauccgaucacauuaacugcagcccuacugcuccuuguugcgcacuacgcuauuaucggaccaggccugcaggccaaagcaacgcgggaagcccaaaagcgugcugccgcagguauaaugaagaacccuaccguggacgggauuacagucaucgauuuggagcccaucccauaugaccccaaauucgaaaagcagcugggccagguaaugcuccugauucuuugcgugacucagguuuuaaugaugagaaccacaugggcucugugugaggcccucaccuuggcgacuggaccuauaucuacgcugugggagggcaauccggggagguuuuggaacacaaccaucgccgugagcauggcaaauauuuuccgcggauccuaccuagcuggcgccggucugcucuuuucaaucaugaaaaacacuaccaauacacggcgagggacuggaaacauuggcgaaacccuuggugagaaguggaaaucuagacugaacgcauugggcaagagugaauuccaaaucuauaaaaagucggggauacaggaggucgauaggacacuggcuaaggagggaaucaaacgcggcgaaacggaccaucacgccgugagccggggguccgccaagcucagaugguuugucgagcguaauauggugacccccgaaggaaaaguuguggaucugggcugcgguagggggggauggucuuacuauuguggcgguuuaaagaacguacgggaggugaaaggccuuacuaaggggggaccaggccaugaagagccuauucccaugucaacauacggguggaaucugguccgccuccagagcggaguugacguguucuuuaccccuccagagaagugcgauacucuacugugugacaucggcgaauccagucccaacccuacaauugaggcgggucgaaccuugagaguccugaaucucguggaaaacuggcuuaauaacaauacgcaauucugcaucaaaguacugaacccauauaugcccucugugauagagaagauggaagcuuugcagaggaaauacgggggagcacugguucggaauccgcucagccgcaacucaacccacgagauguacuggguguccaaugccacaggcaacauugucaguagcgugaauaugaucucuagaauguuaaucaacagguucacuaugaagcacaaaaaggcuaccuaugagccugaugucgaccugggcuccgggacacgaaacauuggaauagaaucagagaucccaaaucuugacauuaucgguaagcggauugaaaaaaucaagcaggagcaugaaacuagcuggcacuacgaucaggaccaucccuauaaaaccugggccuaccacggcucguaugagacaaagcaaaccgggucugcaaguuccauggugaacggaguuguacgucugcuaacuaaaccuugggauguggucccaauggugacgcagauggccaugacagacaccacucccuuuggccagcagagaguuuucaaggagaagguggauacccgcacacaagaaccgaaagaggguacgaagaaacucaugaagauaaccgcugaauggcuguggaaagaguuggggaagaaaaagacuccuaggauguguacacgggaggaauuuaccagaaagguccgcagcaaugcggcccugggagcaaucuucacugacgagaacaaauggaagucagcuagggaagccguggaggauggccgauuuugggaacucguagaccgggagagaaaucuucaccuggagggcaaaugcgaaacauguguguacaacaugauggggaagagggagaaaaaguuaggagaauucgguaaggcaaaaggcucccgcgccauuugguauauguggcugggggcucguuuuuuggaguucgaagcccucggauuucugaaugaggaucauugguucucucggggcaacagccuaagugguguugagggggaaggacuucacagacugggcuacauccucagggacgucggcaagaaagaggggggagcgauguacgcagaugacaccgccgguugggacacacgcauuacucuggaagauuugaagaaugaggaaauggugaccaaccauaugaaaggcgagcacaagaagcuggcugaggccaucuuuaaacucacguaucagaauaaggugguccgaguucagcggcccaccccaagagggacagugauggacauuauauccaggcgcgaucagagaggaagcggccaaguagguacuuacgggcuuaacaccuucacaaauauggaagcacagcugauccggcagauggagggagaaggcauuuuuaaaucuauccaacauuuaacugcuaccgaggagaucgccgugcagaacuggcuggcuagggucggccgugaacgauugucacgcauggccauuaguggggacgauugcgugguuaagccuauagacgauagauucgcauccgcgcucacggcccugaaugacaugggaaaagugcggaaggauauccagcagugggagcccagcagggguuggaacgacuggacacaagucccauucugcucucaccacuuucaugaacuagugaugaaggauggccgcguacuuguugugcccuguagaaaccaggacgagcugauugggcgggcuaggaucucgcagggagccggcuggucacucaaagaaaccgcaugccuggguaagagcuaugcucagauguggacuuugauguacuuccaccgacgugauuuaagacuggccgcaaaugccauuuguuccgcggucccuagucauugggugccaacaucucgcaccacuuggagcauccacgcuaaacacgaguggaugaccacagaggacaugcucgccguguggaaccgggucuggauacaagaaaauccguggauggaggacaagacgcccguugaauccugggaggaagugccuuaucuugggaaaagggaggaucaguggugcggaucacugaucggccuaaccaguagagcaacuugggccaagaacauucagacagcuaucaaucagguacgcucucugauuggcaacgaggaauacaccgacuauaugccaagcaugaagcgguuuaggcgagaggaagaggaagccggggugcucugguga

SEQ ID NO: 14532 - RNA, 9876 nt, Artificial Sequence
  derived and/or modified CDS sequence (opt3) from DENV-2__HQ705625__SS-prME
acagccggcgugaucguaaugcugauuccaacggcuauggcuuuccaccucacuacgagaaacggggaaccucauaugauaguuggaaggcaggaaaaggguaaaagccuucuguuuaagaccgaagacggcgugaauaugugcacauugauggccaucgauuuaggggaacugugugaagacacuauuaccuacaaaugcccacuacuccggcaaaacgaaccggaggauaucgacuguuggugcaauuccacaucuaccuggguaacuuauggaacauguaccacgacuggcgagcaccgccgagaaaagcguucaguggcgcuggucccccauguggguauggggcuugagaccagaacagaaacuuggaugaguagcgagggagcuuggaaacacguucagaggauugagaccuggauccugcggcauccuggcuucacaauaauggccgcaaucuuggccuacaccauuggcacgacucacuuucagcgcgcucucaucuucauucugcugacagcaguggccccauccaugaccaugagaugcaucgggauaucuaacagggauuuugucgaaggagugucggguggcucauggguagacauuguucucgagcacgggagcugugugacuacaauggcuaagaauaagcccaccuuagauuucgaacugaugaaaacggaggccaagcagccugcgacccuucggaaauauugcaucgaagcaaaguugacaaacacuaccacagagagucgcuguccaacucaaggagagcccucccugaaugaagaacaggacaaacgauuuauuugcaagcauucuauggucgauagaggcugggguaacggguguggacuauucggcaagggcgggaucgugaccugcgccauguuuacaugcaaaaagaauauggaaggaaaagugguccagccugagaaccucgaauacaccaucguuauuacuccacacagcggugaggagcaugcugugggcaaugacacggggaagcacggaaaagaaauaaagaucacaccgcaguccucaauuaccgaggccgaacugacuggcuaugguaccguaacaauggaguguagucccaggaccgggcuugauuucaacgaaauggugcuguugcaaauggaggacaaagcauggcucguccaccggcagugguuucuggauuuaccucugccauggcuccccggcgcugacacucagggaagcaauuggauccagaaggagacacuugugacguucaagaacccucaugccaaaaagcaagacguugugguccugggcucucaggaaggggcgaugcacaccgccuugacuggagcaacagagauacagauguccucagguaaucuacuguuuaccggccaucucaaaugccgucugcgcauggauaaacuucaacugaaagggaugagcuacaguauguguacaggaaaguucaagauugugaaagaaaucgcugagacucagcacggcaccaucguaauuagaguucaguaugagggugacgggucuccaugcaagauccccuucgaaauuacggauuuggagaaaaggcaugugcucggccggcugauaaccgucaacccgaucgugacagaaaaggacuccccugucaacauugaggccgaacccccauuuggagauagcuacaucaucauuggcguggagccugggcaguuaaaacugaauugguucaagaagggaucgucuauaggucaaauguuugagacuaccaugcgaggcgcuaaacgcauggccauccuaggggacacagcaugggauuucggaucccucggcgguguuuuuacuucaauugggaaggcccugcaccagguguucggcgcuaucuacggagcggcauuuaguggcguaagcuggaccaugaaaauucuuaucggggucauaaucacguggauuggaaugaacuccagaucuacuagcuugucagugagucugguucucgugggcgucgugacccuguaucuuggugccguagugcaggcugacuccggguguguugucagcuggaagaauaaagaacugaagugcggaucuggcaucuucauuacugauaacgugcacacauggaccgagcaguacaaguuucaacccgaaucaccaaguaaauuggccagcgcaauccagaaggcccaugaggaagguauauguggcauuagguccgugacucggcucgagaaucugauguggaaacagaucacccccgaguuaaaccacauucugucugaaaaugaggucaagcuaacaaucaugacgggggacauaaaaggaaucaugcaggcuggcaagcgcucgcucagaccucaaccaaccgaacugaaauauagcuggaagacuugggggaaggccaaaaugcuuuccacagagucacauaaccagaccuucuugauugauggaccggaaacagcagagugccccaauacuaacagggcguggaauagucuggagguugaagacuacggcuuugguguguucaccacgaacaucuggcucaagcugcgugagaaacaggacguguuuugugauucuaaguuaaugagcgcugccauuaaagacaaucgggcaguacacgccgauaugggguauuggaucgaauccgcucugaacgacacauggaagauggagaaggccucauucauagaggucaaaagcugccacuggccuaagucucauacccuuugguccaauggaguguuggaaagugagaugauuauccccaagaauuucgcaggccccguuagccagcacaacuaccgaccugguuaucauacucaaaccgcuggcccauggcaccucgggaagcuggaaauggauuuugacuucugugagggaacaacuguggucgugaccgaagauugcggcaauagagggcccucucuaaggacaacgaccgccuccggaaaacugaucacugaguggugcugucgcucaugcacacucccgccucugcgguacagaggcgaggacgguuguugguacgggauggaaauuaggccacuuaaggagaaggaagagaacuugguuaauagucuggugaccgcgggacauggccagaucgauaacuuuagcuuagguguacucggcauggcccuguuccuugaagagaugcugcgcacucgaauugggacaaaacacgcuauauugcucgucgcagugucguuugugacccugaucacgggaaauauguccuuccgggaccuaggccgugucaugguuauggugggggccacuaugaccgaugacauuggaaugggcguaacauaucuggcucuccuggccgcauuuaaggugagacccaccuucgcggccggucuuuugcugaggaaauuaacuucuaaggagcucaugauggcuacaaucgggauugcccugcuuagccagucaaccaucccugaaacaauacuggagcuaacugaugcacucgcucugggaaugauggucuugaaaaucgugcgcaacauggaaaaguaccaacuggccguuaccauuauggcaaucaguugcgugcccaaugccgucauuuuacagaacgcuuggaagguguccuguacgauccucgcggccguuucugugagcccacugcuucugacauccucacagcagaaagcagacuggauaccuuuggcucucaccauuaagggccugaaucccacugccaucuuucuaaccacacugagccggacaaguaaaaagagaucuuggccacuuaacgaggccaucauggcugucggcaugguauccauucucgcaagcucgcuguugaaaaaugacauaccgaugaccgggccucugguggccggagguuuacucacgguuugcuaugugcugacaggcaggucagcggaucuugaacuggagcgagcugccgacgucaagugggaggaucaagcagaaaucucugggaguucccccauuuugagcaucaccauuucugaggacggaagcauguccaucaaaaacgaagaggaggaacagacucucacaauacugauccgcaccggccuacuggugauuucagguguauucccagugaguauccccauuacugccgcugcaugguaccuuugggaggucaagaagcagcgggccgggguucucugggaugugccuagcccacccccuguggaaaaagcggagcuggaagacggagcuuauagaaucaagcagaggggcauauugggcuacucucaaauuggggccggagucuauaaagaggguacauuucacaccauguggcaugugacgcguggcgcaguuuuaaugcaccgcgggaagcggaucgagccguccugggccgaugucaaaaaggaccugaucucauacggaggcgguuggaagcucgaaggggaguggaaagaaggagaggaagugcagguccuggcucuugagccaggcaagaaucccagagccgugcagacuaaaccuggcauuuucaagaccaacacagggaccaucggagcaguuagucuggauuuuagcccagguacauccggcucucccauaguggacaggaaagggaaggucgugggauuguacggcaaugguguagucacucgaucgggggcuuaugugagcgccauugcgcagaccgagaagucaaucgaagauaacccugagauugaagacgauaucuuccggaaaaagcgccuaacgauaauggaccugcauccgggagccggcaaaacaaagagauaccuccccgcaauuguuagggaggcuaucaaacggggccugcgaacucuuaucuuagccccaaccagaguggucgcugcagaaauggaggaggcccugcgcgggcucccuauuagguaucaaacacccgccaucaagaccgaacacacuggacgugagauuguggacuugaugugucaugcuaccuucacaaugcggcugcucuccccaguuagagugccuaacuacaaucugauaaucauggaugaagcgcacuuuacggaccccgcaaguauugccgcuagggguuauaucucuacucgcgucgagaugggcgaggccgcagggaucuucaugaccgccacaccaccgggaagccgagauccuuuuccccaguccaacgcuccaauuauggacgaagagagagaaauacccgagcggucauggaacucuggccacgaaugggugaccgauuucaaggguaaaacuguaugguuugugccuagcaucaaggcggggaacgacauugccgcaugccuuaggaaaaauggaaagaaaguuauccagcugagucgcaagacauucgauuccgaguacgucaagacccgugcuaacgacugggauuuuguggugacgacugacauuagcgagaugggcgccaauuucaaagcagaaagagucaucgauccacggagguguaugaagcccguaauauugacagacggcgaggaacgcgugauccuagccgggccuaugccgguuacccauucuucagcugcccaacgaagaggacggauugguaggaaccccaaaaaugagaacgaccaguauaucuacaugggcgaaccccuggagaaugaugaggacugcgcgcacuggaaggaagcaaaaaugcucuuagauaacauuaauaccccugaggggaucauacccuccauguuugaaccagagcgcgaaaagguggacgccauugauggagaguacagacugaggggcgaggcucggaaaacuuucgucgaccuuaugcgucgcggugaucugccuguguggcucgccuauaagguugcugcagaagggaucaacuacgccgaccgaaagugguguuuugauggcaccaaaaauaaccagauuuuggaggaaaacauggagguggagaucuggaccaaggaaggagagaggaaaaagcugaaacccagauggcucgacgcucggauauauagugauccacuggcccuuaaggaguucaaggaguucgcagcgggccgcaaaagccuaacacugaauuugaucacugaaauggggagauuaccuacguuuaugacccagaaggccaggaacgcucuggacaaucucgccguccugcauacagcagaggcuggaggucgggccuacaaccacgcacuuucggagcugccggaaacucucgagaccuugcugcuacugacacuccuugccaccgugacuggcgggauuuuccuguuuuuaaugucuggaaaaggcaucgguaagaugacguuggggaugugcugcauuaucaccgcuuccauacugcucugguaugcgcaaauucagccccacuggaucgccgcaagcaucauucuggaguucuuucuuaucguacugcucauaccagagccugaaaaacagcgaacaccccaggauaaucaauugacuuacgugguuauugcuauccugaccgucguggccgccacaauggcaaacgagaugggcuucuuagagaagaccaagaaagaccuaggacugggcucaauuacuacacaggaaagugagucuaauauccucgacauagaucuuagaccagcuuccgccuggacgcuguaugcgguggcuaccacuuuugucacaccuauguugcgccauagcaucgaaaacucaaguguuaaugugagccugaccgccauugcaaaccaggccaccguacucauggggcugggaaaggguuggccccuuuccaaaauggacaucggcgugccgcuccuggcuauuggguguuacucucaggucaauccaaucacauugacugcagcccuguuacuacugguggcgcacuacgcuauuaucggaccuggccuccaagccaaggcaacgagggaggcccagaaacgggcugccgcagguauaaugaagaaccccaccguugaugggauuacagugaucgaccuugaaccaauccccuaugauccuaaguucgagaaacagcugggccaggucauguugcugauucucugcguaacucaagugcugaugaugcguaccacaugggcucuuugugaggccuuaacccuggcgacuggaccgauaagcacgcucugggaaggcaaucccgggagauuuuggaacacaaccaucgccguuuccauggcaaauauuuucaggggaucauacuuggcuggcgccggucugcuauuuucuaucaugaagaacacuaccaguacacgccgggggacuggaaauauuggcgagacccugggugaaaaauggaagucgcgacucaacgcacuuggcaaaagcgaguuccagaucuauaagaaauccgggauacaggagguggacagaacacuggcuaaggaaggaaucaagaggggcgagacggaucaucacgccgucucucgcgggucagccaaauugcggugguuuguggaaagaaacauggucaccccagagggaaaggugguugaccugggcugcggucgugggggauggagcuacuauuguggcggucucaaaaaugugagggaaguaaagggccugacuaaagggggaccuggccaugaggagcccauuccuauguccacauacggguggaacuuagugcggcuucaaaguggagucgauguuuucuucaccccacccgaaaagugcgacacucugcucugugauaucggcgagucuagcccuaauccaacaauugaagcgggucgcacccuacgagugcugaacuuggucgagaauuggcugaacaauaacacgcaguuuugcaucaaggugcucaaucccuauaugccgucaguaauagagaaaauggaggcacuucagagacaguacgggggagcacuggugaggaacccuuugucccggaauaguacccacgagauguacuggguuagcaacgccacaggcaauauugugucuuccgucaacaugaucucacgcaugcugaucaauagauucacuaugaagcacaaaaaggcuaccuaugaaccagacguggaucucggcagcgggacaaggaacauuggaauagagucggaaauccccaacuuagacauuaucgguaaacgaauugagaagaucaagcaagaacaugagauaucuuggcacuacgaccaggaucauccuuauaaaacuugggccuaccacggcaguuaugagaccaagcagacaggguccgcaagcucaauggucaauggagugguucggcugcuuaccaaaccaugggacguagugcccauggucacucagauggccaugacggauacaaccccguuuggccaacagcguguguucaaggaaaaaguugacacuagaacccaggagccuaaggaagguacaaagaaacugaugaagaucacggcugaguggcuauggaaagagcucgggaagaaaaagacaccacgcauguguacuagggaagaguuuaccaaaaaggugcgguccaacgcggcccugggagcaauuuucaccgaugaaaauaaguggaaaucugcuagagaggccgucgaagacggccgcuuuugggaguugguggauagggagcgaaaccugcaccucgaaggcaagugcgagacuuguguauacaauaugauggggaaacgggaaaagaaacuuggagaguucgguaaggcaaagggcagcagagccaucugguauauguggcugggggcuagguuuuuagaguucgaggcccugggauuuuugaacgaggaccauugguucagucgcggcaauucccucagcgguguggaaggggagggacugcaccgucuaggcuacauucuucgggauguuggcaaaaaggaagggggagcgauguacgcagacgauacagccgguugggacaccagaaucacacuggaggaccucaaaaacgaagagauggucacuaaucauaugaagggcgagcacaaaaagcuggcugaagccauuuuuaaguugaccuaucagaacaaaguggugaggguccaacgcccaacgccucgagggaccguuauggauauaaucucucggagagaccagaggggaucaggccagguggguacauacgggcugaauacuuucaccaacauggaggcacaacucauucgccagauggaaggagagggcaucuucaagaguauccagcaucuuacagcuacugaggaaauugccguacagaauuggcuggcuagagugggccgggagagguuaucccguauggccauaagcggggaugacugcgucgugaaacccaucgaugaccgauuugcaucugcgcugaccgccuugaacgauaugggaaagguucgcaaagacauucaacagugggaaccaucgagagguuggaaugauuggacacaggugcccuucugcucacaccacuuucaugagcucgucaugaaggacggccgggugcugguaguuccuuguaggaaccaggaugaacuaaucgggcgcgcuagaauuagccaaggagccggcuggucccuuaaggagacagcaugccuggguaaaaguuaugcucagauguggacccucauguacuuccaccggagggaccugcgauuggccgcaaacgccaucuguucugcggugccaagccauugggucccgacuucccguacaaccuggucaauacacgcuaagcacgaguggaugacuaccgaagauauguuagccguguggaauagaguguggauccaggagaaccccuggauggaagacaaaacaccugucgagaguugggaagagguuccauaucuggggaagcgcgaggaccaguggugcggaucucucauuggccuuacgagccgggcaaccugggccaaaaauauccaaacugcuauuaaccaggugaggucccugaucggcaaugaagaguacacagauuauaugcccucaaugaagagauuucgccgggaagaggaagaggccgggguacuaugguga

SEQ ID NO: 14533 - RNA, 9876 nt, Artificial Sequence
  derived and/or modified CDS sequence (opt3) from DENV-2__JF730052__SS-prME
acagccggcgugaucguaaugcugauuccaacagcuauggcuuuccaccucacuacgagaaacggggaaccucauaugauaguuggaaggcaggaaaaggguaaaagccuucuguuuaagaccgaagacggcgugaauaugugcacauugauggccaucgauuuaggggaacugugugaagacacuauuaccuacaaaugcccacuacuccggcaaaacgaaccggaggauaucgacuguuggugcaauuccacaucuaccuggguaacuuauggaacauguaccacgacuggcgagcaccgccgagaaaagcguucaguggcgcuggucccacauguggguauggggcuugagaccagaacagaaacuuggaugaguagcgagggagcuuggaaacacguucagaggauugagaccuggauccugcggcauccuggcuucacaauaauggccgcaaucuuggccuacaccauuggcacgacucacuuucagcgcgcucucaucuucauucugcugacagcaguggccccauccaugaccaugagaugcaucgggauaucuaacagggauuuugucgaaggagugucggguggcucauggguagacauuguucucgagcacgggagcugugugacuacaauggcuaagaauaagcccaccuuagauuucgaacugaugaaaacggaggccaagcagccugcgacccuucggaaauauugcaucgaagcaaaguugacaaacacuaccacagagagucgcuguccaacucaaggagagcccucccugaaugaagaacaggacaaacgauuuauuugcaagcauucuauggucgauagaggcugggguaacggguguggacuauucggcaagggcgggaucgugaccugcgccauguuuacaugcaaaaagaauauggaaggaaaagugguccagccugagaaccucgaauacaccaucguuauuacuccacacagcggugaggagcaugcugugggcaaugacacggggaagcacggaaaagaaauaaagaucacaccgcaguccucaauuaccgaggccgaacugacuggcuaugguaccguaacaauggaguguagucccaggaccgggcuugauuucaacgaaauggugcuguugcaaauggaggacaaagcauggcucguccaccggcagugguuucuggauuuaccucugccauggcuccccggcgcugacacucagggaagcaauuggauccagaaggagacacuugugacguucaagaacccucaugccaaaaagcaagacguugugguccugggcucucaggaaggggcgaugcacaccgccuugacuggagcaacagagauacagauguccucagguaaucuacuguuuaccggccaucucaaaugccgucugcgcauggauaaacuucaacugaaagggaugagcuacaguauguguacaggaaaguucaagauugugaaagaaaucgcugagacucagcacggcaccaucguaauuagaguucaguaugagggugacgggucuccaugcaagauccccuucgaaauuacggauuuggagaaaaggcaugugcucggccggcugauaaccgucaacccgaucgugacagaaaaggacuccccugucaacauugaggccgaacccccauuuggagauagcuacaucaucauuggcguggagccugggcaguuaaaacugaauugguucaagaagggaucgucuauaggucaaauguuugagacuaccaugcgaggcgcuaaacgcauggccauccuaggggacacagcaugggauuucggaucccucggcgguguuuuuacuucaauugggaaggcccugcaccagguguucggcgcuaucuacggagcggcauuuaguggcguaagcuggaccaugaaaauucuuaucggggucauaaucacguggauuggaaugaacuccagaucuaccagcuugucagugagucugguucucgugggcgucgugacccuguaucuuggugccguagugcaggcugacuccggguguguugucagcuggaagaauaaagaacugaagugcggaucuggcaucuucauuacugauaacgugcacacauggaccgagcaguacaaguuucaacccgaaucaccaaguaaauuggccagcgcaauccagaaggcccaugaggaagguauauguggcauuagguccgugacucggcucgagaaucugauguggaaacagaucacccccgaguuaaaccacauucugucugaaaaugaggucaagcuaacaaucaugacgggggacauaaaaggaaucaugcaggcuggcaagcgcucgcucagaccucaaccaaccgaacugaaauauagcuggaagacuugggggaaggccaaaaugcuuuccacagagucacauaaccagaccuucuugauugauggaccggaaacagcagagugccccaauacuaacagggcguggaauagucuggagguugaagacuacggcuuugguguguucaccacgaacaucuggcucaagcugcgugagaaacaggacguguuuugugauucuaaguuaaugagcgcugccauuaaagacaaucgggcaguacacgccgauaugggguauuggaucgaauccgcucugaacgacacauggaagauggagaaggccucauucauagaggucaaaagcugccacuggccuaagucucauacccuuugguccaauggaguguuggaaagugagaugauuauccccaagaauuucgcaggccccguuagccagcacaacuaccgaccugguuaucauacucaaaccgcuggcccauggcaccucgggaagcuggaaauggauuuugacuucugugagggaacaacuguggucgugaccgaagauugcggcaauagagggcccucucuaaggacaacgaccgccuccggaaaacugaucacugaguggugcugucgcucaugcacacucccgccucugcgguacagaggcgaggacgguuguugguacgggauggaaauuaggccacuuaaggagaaggaagagaacuugguuaauagucuggugaccgcgggacauggccagaucgauaacuuuagcuuagguguacucggcauggcccuguuccuugaagagaugcugcgcacucgaauugggacaaaacacgcuauauugcucgucgcagugucguuugugacccugacgacuggaaauauguccuuccgggaccuaggccgugucaugguuauggugggggccaccaugacagaugacaucggaaugggcguaaccuaucuggcucuccuggccgcauuuaaggugagacccacuuucgcggccggucuuuugcugaggaaauuaacaucuaaggagcucaugauggcuaccauugggaucgcccugcuuagccagucaacaauuccugaaacuauccuggagcuaaccgaugcacucgcucugggaaugauggucuugaaaauagugcgcaacauggaaaaguaccaacuggccguuacgaucauggcaauuaguugcgugcccaaugccgucaucuuacagaacgcuuggaagguguccuguacaauucucgcggccguuucugugagcccacugcuucugaccuccucacagcagaaagcagacuggaucccuuuggcucucacuauaaagggccugaaucccaccgccauuuuucuaacaacucugagccggaccaguaaaaagagaucuuggccacuuaacgaggccaucauggcugucggcaugguauccauccucgcaagcucgcuguugaaaaaugacauuccgaugacggggccucugguggccggagguuuacucacaguuugcuaugugcugaccggcaggucagcggaucuugaacuggagcgagcugccgacgucaagugggaggaucaagcagaaauaucugggaguucccccaucuugagcauuacuaucucugaggacggaagcauguccauuaaaaacgaagaggaggaacagacacucaccauccugauacgcacuggccuacuggugaucucagguguauucccagugaguauucccaucacagccgcugcaugguaccuuugggaggucaagaagcagcgggccgggguucucugggaugugccuagcccacccccuguggaaaaagcggagcuggaagacggagcuuauagaauuaagcagaggggcaucuugggcuacucucaaauaggggccggagucuauaaagaggguaccuuucacacgauguggcaugugacucguggcgcaguuuuaaugcaccgcgggaagcggauugagccguccugggccgaugucaaaaaggaccugaucucauacggaggcgguuggaagcucgaaggggaguggaaagaaggagaggaagugcagguccuggcucuugagccaggcaagaaucccagagccgugcagaccaaaccuggcaucuucaagacaaacaccgggacaauuggagcaguuagucuggauuuuagcccagguacuuccggcucucccaucguggacaggaaagggaaggucgugggauuguacggcaaugguguagucacccgaucgggggcuuaugugagcgccauagcgcagacggagaagucaauugaagauaacccugagaucgaagacgauauuuuccggaaaaagcgccuaacaaucauggaccugcauccgggagccggcaaaacuaagagauaccuccccgcaauaguuagggaggcuauuaaacggggccugcgaacccuuaucuuagccccaacaagaguggucgcugcagaaauggaggaggcccugcgcgggcucccuaucagguaucaaacccccgccauuaagacugaacacaccggacgugagaucguggacuugaugugucaugcuacauucacgaugcggcugcucuccccaguuagagugccuaacuacaaucugauuauaauggaugaagcgcacuuuacugaccccgcaaguaucgccgcuagggguuauauuucuacccgcgucgagaugggcgaggccgcagggaucuucaugacagccaccccaccgggaagccgagauccuuuuccccaguccaacgcuccaaucauggacgaagagagagaaauucccgagcggucauggaacucuggccacgaaugggugacugauuucaaggguaaaacaguaugguuugugccuagcauaaaggcggggaacgacaucgccgcaugccuuaggaaaaauggaaagaaaguuauucagcugagucgcaagaccuucgauuccgaguacgucaagacgcgugcuaacgacugggauuuuguggugacuacagacaucagcgagaugggcgccaauuucaaagcagaaagagucauugauccacggagguguaugaagcccguaaucuugaccgacggcgaggaacgcgugauacuagccgggccuaugccgguuacccauucuucagcugcccaacgaagaggacggaucgguaggaaccccaaaaaugagaacgaccaguauauuuacaugggcgaaccccuggagaaugaugaggacugcgcgcacuggaaggaagcaaaaaugcucuuagauaacaucaauacuccugaggggauuauccccuccauguuugaaccagagcgcgaaaagguggacgccauagauggagaguacagacugaggggcgaggcucggaaaacauucgucgaccuuaugcgucgcggugaucugccuguguggcucgccuauaagguugcugcagaagggauuaacuacgccgaccgaaagugguguuuugauggcaccaaaaauaaccagaucuuggaggaaaacauggagguggagauuuggacaaaggaaggagagaggaaaaagcugaaacccagauggcucgacgcucggaucuauagugauccacuggcccuuaaggaguucaaggaguucgcagcgggccgcaaaagccuaacucugaauuugauaacggaaauggggagauuaccuaccuuuaugacacagaaggccaggaacgcucuggacaaucucgccguccugcauacugcagaggcuggaggucgggccuacaaccacgcacuuucggagcugccggaaacccucgagacauugcugcuacugacccuccuugccacugugacgggcgggaucuuccuguuuuuaaugucuggaaaaggcauugguaagaugaccuuggggaugugcugcaucauuacagcuuccauccugcucugguaugcgcaaauacagccccacuggauugccgcaagcaucauccuggaguucuuucuuauuguacugcucaucccagagccugaaaaacagcgaacuccccaggauaaucaauugaccuacgugguuauagcuauucugacagucguggccgccaccauggcaaacgagaugggcuucuuagagaagacuaagaaagaccuaggacugggcucaaucacaacgcaggaaagugagucuaauauucucgacaucgaucuuagaccagcuuccgccuggacccuguaugcgguggcuacuacauuugucaccccuauguugcgccauagcauagaaaacucaaguguuaaugugagccugaccgccaucgcaaaccaggccacaguacucauggggcugggaaaggguuggccccuuuccaaaauggacauuggcgugccgcuccuggcuaucggguguuacucucaggucaauccaauuacuuugacggcagcccuguuacuacugguggcgcacuacgcuaucauuggaccuggccuccaagccaaggcaaccagggaggcccagaaacgggcugccgcagguaucaugaagaaccccacaguugaugggauaacugugauugaccuugaaccaauccccuaugauccuaaguucgagaaacagcugggccaggucauguugcugauccucugcguaacccaagugcugaugaugcguacaaccugggcucuuugugaggccuuaacucuggcgacgggaccgauuagcacacucugggaaggcaaucccgggagauuuuggaacaccacuauagccguuuccauggcaaauaucuucaggggaucauacuuggcuggcgccggucugcuauuuucuauuaugaagaacaccacaaguacucgccgggggaccggaaauaucggcgagacacugggugaaaaauggaagucgcgacucaacgcacuuggcaaaagcgaguuccagauuuauaagaaauccgggauccaggagguggacagaacgcuggcuaaggaaggaauaaagaggggcgagaccgaucaucacgccgucucucgcgggucagccaaauugcggugguuuguggaaagaaacauggucacuccagagggaaaggugguugaccugggcugcggucgugggggauggagcuacuauuguggcggucucaaaaaugugagggaaguaaagggccugacaaaagggggaccuggccaugaggagcccaucccuauguccaccuacggguggaacuuagugcggcuucaaaguggagucgauguuuucuucacuccacccgaaaagugcgacacacugcucugugauauuggcgagucuagcccuaauccaaccaucgaagcgggucgcacgcuacgagugcugaacuuggucgagaauuggcugaacaauaacacccaguuuugcauuaaggugcucaaucccuauaugccgucaguaaucgagaaaauggaggcacuucagagacaguacgggggagcacuggugaggaacccuuugucccggaauaguacacacgagauguacuggguuagcaacgccacuggcaauauagugucuuccgucaacaugauuucacgcaugcugaucaauagauucaccaugaagcacaaaaaggcuacauaugaaccagacguggaucucggcagcgggacuaggaacaucggaauugagucggaaauacccaacuuagacaucauugguaaacgaaucgagaagauuaagcaagaacaugagaucucuuggcacuacgaccaggaucauccuuauaaaaccugggccuaccacggcaguuaugagacaaagcagaccggguccgcaagcucaauggucaauggagugguucggcugcuuacuaaaccaugggacguagugcccauggucacgcagauggccaugacagauaccacuccguuuggccaacagcguguguucaaggaaaaaguugacaccagaacacaggagccuaaggaagguacgaagaaacugaugaagauaaccgcugaguggcuauggaaagagcucgggaagaaaaagacuccccgcauguguacaagggaagaguuuaccaaaaaggugcgguccaacgcggcccugggagcaaucuucacugaugaaaauaaguggaaaucugcuagagaggccgucgaagacggccgcuuuugggaguugguggauagggagcgaaaccugcaccucgaaggcaagugcgagacauguguauacaauaugauggggaaacgggaaaagaaacuuggagaguucgguaaggcaaagggcagcagagccauuugguauauguggcugggggcuagguuuuuagaguucgaggcccugggauuuuugaacgaggaccauugguucagucgcggcaauucccucagcgguguggaaggggagggacugcaccgucuaggcuacauccuucgggauguuggcaaaaaggaagggggagcgauguacgcagacgauaccgccgguugggacacaagaauuacucuggaggaccucaaaaacgaagagauggucaccaaucauaugaagggcgagcacaaaaagcuggcugaagccaucuuuaaguugacguaucagaacaaaguggugaggguccaacgcccaaccccucgagggacaguuauggauauuauaucucggagagaccagaggggaucaggccagguggguacuuacgggcugaauaccuucacaaacauggaggcacaacucauccgccagauggaaggagagggcauuuucaagaguauccagcaucuuacugcuaccgaggaaaucgccguacagaauuggcuggcuagagugggccgggagagguuaucccguauggccauuagcggggaugacugcgucgugaaacccauagaugaccgauuugcaucugcgcugacggccuugaacgauaugggaaagguucgcaaagacauccaacagugggaaccaucgagagguuggaaugauuggacacaggugcccuucugcucacaccacuuucaugagcucgucaugaaggacggccgggugcugguaguuccuuguaggaaccaggaugaacuaauugggcgcgcuagaaucagccaaggagccggcuggucccuuaaggagaccgcaugccuggguaaaaguuaugcucagauguggacucucauguacuuccaccggagggaccugcgauuggccgcaaacgccauuuguucugcggugccaagccauugggucccgacaucccguaccacuuggucaauccacgcuaagcacgaguggaugaccacagaagauauguuagccguguggaauagaguguggauacaggagaaccccuggauggaagacaaaacgccugucgagaguugggaagagguuccauaucuggggaagcgcgaggaccaguggugcggaucucucaucggccuuaccagccgggcaacuugggccaaaaauauucaaacagcuaucaaccaggugaggucccugauuggcaaugaagaguacaccgauuauaugcccucaaugaagagauuucgccgggaagaggaagaggccgggguacuaugguga

SEQ ID NO: 14534 - RNA, 9876 nt, Artificial Sequence
  derived and/or modified CDS sequence (opt3) from DENV-2__EU482748__SS-prME
accgccggcgugauagucaugcugauuccaacugcuauggcauuccaccucacuacgagaaacggggaaccucauaugauaguuggaaggcaggaaaaggguaaaagccuucuguuuaagaccgaggacggcgugaauaugugcacauugauggccaucgauuuaggggaacugugugaggaaacuauuaccuacaaaugcccacuacuccggcaaaacgagccggaggacaucgauuguuggugcaauuccacaucuaccuggguaacuuauggaacauguaccacgacuggcgaacaccgccgagagaagcguucaguggcgcuggucccccauguggguauggggcuugaaaccagaacagagacuuggaugaguagcgagggagcuuggaaacacguucagaggauugaaaccuggauccugcggcauccuggcuucacaauuauggccgcaaucuuggccuacaccauuggcacgacucacuuucagcgcgcucucaucuucauucugcugacagcaguggccccauccaugaccaugagaugcaucgggauaucuaacagggacuuugucgagggagugucggguggcucauggguagauauuguucucgaacacgggagcugugugacuacaauggcuaagaauaagcccaccuuagacuucgagcugaucaaaacggaagccaagcagccugcgacccuucggaaauauugcauugaggcaaaguugacaaacacuaccacagagagucgcuguccaacucaaggagaacccucccugaaugaggaacaggauaaacgauuuaucugcaagcauucuauggucgacagaggcugggguaacggguguggacuauucggcaagggcgggaucgugaccugcgccauguuuacaugcaaaaagaauauggagggaaaagugguccagccugaaaaccucgaguacaccauuguuauaacuccacacagcggugaggaacaugcugugggcaaugauacggggaagcacggaaaagagaucaagauuacaccgcaguccucaaucaccgaagccgagcugacuggcuaugguaccguaacaauggaauguagucccaggaccgggcuugacuucaacgagauggugcuguugcaaauggaggauaaagcauggcucguccaccggcagugguuucuggacuuaccucugccauggcuccccggcgcugauacucagggaagcaauuggauacagaaggaaacacuugugacguucaagaacccucaugccaaaaagcaagacguugugguccugggcucucaggagggggcgaugcacaccgccuugacuggagcaacagaaauucagauguccucagguaaucuacuguuuaccggccaucucaaaugccgucugcgcauggacaaacuucaacugaaagggaugagcuacaguauguguacaggaaaguucaagaucgugaaagagaucgcugagacucagcacggcaccauuguaaucagaguucaguaugaaggugaugggucuccaugcaagauucccuucgagauaacggacuuggagaagaggcaugugcucggccggcugaucaccgucaacccgauugugacagagaaggauuccccugucaacaucgaagccgagcccccauuuggagacagcuacaucauuauaggcguggagccugggcaguuaaaacugaauugguucaagaagggaucgucuaucggucaaauguuugaaacuaccaugcgaggcgcuaaacgcauggccauucuaggggauacagcaugggacuucggaucccucggcgguguuuuuacuucaaucgggaaggcccugcaccagguguucggcgcuauuuacggagcggcauuuaguggcguaagcuggaccaugaaaauccuuauaggggucaucauuacguggaucggaaugaacuccagaucuacuagcuugucagugagucugguucucgugggcgucgugacccuguaucuuggugccaugguacaggcugauuccgggugugugguuagcuggaagaauaaagagcugaagugcggaucuggcauuuucaucacugacaacguccacacauggaccgaacaguacaaguuucaacccgagucaccaaguaaauuggccagcgcaauacagaaggcccaugaagaggguauuuguggcaucagguccgugacucggcucgagaaucugauguggaaacagauuacccccgaauuaaaccacauccugucugagaaugaagugaagcuaacaauaaugacgggggauaucaaaggaauuaugcaggcuggcaagcgcucgcucagaccucaaccaaccgagcugaaauauagcuggaagacuugggggaaggccaaaaugcuuuccacagaaucacauaaccagaccuucuugaucgacggaccggagacagcagagugccccaauacuaacagggcguggaauagucuggaagucgaggauuacggcuuugguguuuucaccacgaacauuuggcucaagcugcgugaaaaacaggacguguuuugugacucuaaguuaaugagcgcugccaucaaagauaaucgggcagugcacgccgacaugggguauuggauagaguccgcucugaacgauacauggaagauggagaaggccucauucauugaaguaaaaagcugccacuggccuaagucucauacccuuugguccaauggagucuuggagagugaaaugaucauccccaaaaauuucgcaggccccgugagccagcacaacuaccgaccugguuaucauacucaaaccgcuggcccauggcaccucgggaagcuggagauggacuuugaucuaugugaaggaacaacuguuguggucaccgaggacugcggcaauagagggcccucucugaggacaacgaccgccuccggaaaacucauuacugaguggugcugucgcucaugcacacugccgccucuucgguacagaggcgaagaugguuguugguacgggauggagaucaggccauugaaggaaaaggaggaaaaccuggugaauaguuuaguuaccgcgggacauggccagauugacaacuucagccucggugugcugggcauggcccuuuuucuggaggagauguugcgcacucgaauagggacaaaacacgcuauccuccugguagcagucucguucgugacccuaauuacgggaaauauguccuuucgggaucugggccgugugauggucaugguuggggccacuaugaccgacgauaucggaaugggcgugacauaucucgcucugcuugccgcauucaagguaagacccaccuuugcggccgguuugcuguuaaggaaacucacuucuaaggaacugaugauggcuacaauugggaucgcccuucugagccagucaaccauaccugagacaauccuagaacucacugacgcacuggcuuugggaaugauggugcugaaaauuguccgcaacauggagaaguaccaauuagccgugaccaucauggcaauuaguugcguucccaaugccgugauccuccagaacgcuuggaaggucuccuguacgauacuggcggccgugucuguuagcccacuucuguugacauccucacagcagaaagcagauuggauuccucucgcucugaccaucaagggccuaaaucccacugccaucuuccugaccacacuuagccggacaaguaaaaagagaucuuggccacucaacgaagccauuauggcugugggcauggucuccauacuggcaagcucguugcugaaaaaugacaucccgaugaccgggccuuuaguagccggaggucuccugacggugugcuauguucuuacaggcaggucagcggaccuggaguuggagcgagcugccgaugugaagugggaagaccaagcagagauuucugggaguucccccauccucagcauuaccaucucugaagauggaagcauguccaucaaaaacgaggaggaagaacagacucugacaauccuaauucgcaccggccugcuugucaucucagguguguuuccaguaaguauucccaucacugccgcugcaugguaccucugggaagugaagaagcagcgggccgggguccugugggacguuccuagcccacccccuguggagaaagcggaauuggaggauggagcuuauagaauaaagcagaggggcauuuuaggcuacucucaaaucggggccggaguguauaaagaggguacauuccacaccauguggcaugucacgcguggcgcagugcugaugcaccgcgggaagcggaucgaaccguccugggccgacguuaaaaaggaucucauuucauacggaggcgguuggaagcuggagggggaauggaaagagggagaagagguacaggugcuugcucuggagccaggcaagaaucccagagccguccagacuaaaccuggcaucuuuaagaccaacacagggaccauaggagcagugaguuuggacuucagcccagguacauccggcucucccauuguugauaggaaagggaagguggucggacuauacggcaauggugugguaacucgaucgggggcuuaugucagcgccaucgcgcagaccgaaaagucaauugaggacaacccugaaaucgaggaugacauauuucggaaaaagcgccugacgauuauggaucuccauccgggagccggcaaaacaaagagauaccugcccgcaaucgugagggaagcuaucaaacggggccuucgaacuuuaauucuggccccaaccagaguuguggcugcagagauggaggaagcccuccgcggguugccuaucagguaucaaacacccgccauuaagaccgagcacacuggacgugaaauagucgaccugaugugucaugcuaccuucacaaugcggcuccuguccccagugagaguuccuaacuacaaucuuaucauuauggacgaggcgcacuucacggaucccgcaaguaucgccgcuagggguuauaucucuacucgcguggagaugggcgaagccgcagggauuuuuaugaccgccacaccaccgggaagccgagacccuuucccccaguccaacgcuccaauaauggaugaggaaagagagauccccgaacggucauggaacucuggccacgagugggucaccgacuuuaaggguaaaacugugugguucguaccuagcauuaaggcggggaacgauaucgccgcaugccugaggaaaaauggaaagaaagugauucaguugagucgcaagacauuugacuccgaguacguuaagacccgugcuaacgauugggacuucgucgugacgacugauaucagcgaaaugggcgccaauuuuaaagcagagagagugauagacccacggagguguaugaagcccgucauccuaacagauggcgaagaacgcguaauucuggccgggccuaugccggugacccauucuucagcugcccaacgaagaggacggaucgguaggaaccccaaaaaugaaaacgaccaguauauuuacaugggcgagccccucgagaaugacgaagauugcgcgcacuggaaggaggcaaaaauguuacuggacaacaucaauaccccugaagggauaauucccuccauguucgagccagaacgcgagaagguugaugccaucgacggagaguacagacuuaggggcgaagcucggaaaacuuuuguggaucugaugcgucgcggugaccucccugucugguuggccuauaagguggcugcagaggggauuaacuacgccgaucgaaagugguguuucgacggcaucaaaaauaaccagauacuggaagagaacauggagguugaaaucuggacaaaggagggagaaaggaaaaagcucaaacccagauggcuggaugcucggauuuauagugacccacuugcccuaaaggaguuuaaggaguucgcagcgggccgcaaaagccugaccuugaauuuaaucacagagauggggagacugccuacuuucaugacgcagaaggccaggaacgcucucgauaaucuggccgugcuucauaccgcagaggcuggaggucgggccuacaaccacgcacugucggaacucccggagacauuggaaacucugcuacugcucacccuucuggccacagucaccggcgggauauuuuuauucuugaugucuggaaaaggcaucgguaagaugacucuggggaugugcugcauaauuacggcuuccauccuccugugguaugcgcaaauccagccccacuggauugccgcaagcaucauacuugaguuuuuccugauugugcucuugaucccagaaccugagaaacagcgaaccccacaggacaaucaacugacauacguagugauugcuaucuuaacuguugucgccgccaccauggcaaacgagaugggcuuucuagaaaagacaaagaaagaucugggacucggcucaauaaccacucaggagagugaaucuaauauccuugacauugaccugagaccagcuuccgccuggacauuguaugcgguggcuacgaccuucgugacuccuaugcugcgccauagcaucgagaacucaagugucaauguuagccucacagccauugcaaaccaggccaccgugcugauggggcuuggaaaggguuggccccucuccaaaauggauaucggcguaccgcuguuggcuauuggguguuacucucaggugaauccaaucacccugacagcagccuuacuacugcucgucgcgcacuacgcuauaauuggaccuggccuucaagccaaggcaacuagggaagcccagaaacgggcugccgcagguaucaugaagaaccccacgguggacgggaucaccguuauugaucuggagccaauacccuaugacccuaaguuugagaaacaguugggccaggugaugcugcucauccugugcgucacacaaguacuuaugaugcguacuaccugggcuuuaugugaagcccugacacucgcgaccggaccgauuagcacuuugugggagggcaaucccgggagauucuggaacacgacaaucgccguguccauggcaaauauuuuuaggggaucauaccuggcuggcgccggucuacuguucucuaucaugaagaacaccacaaguacccgccgggggacaggaaauauaggcgaaacucucggugagaaauggaagucgcgacuuaacgcacugggcaaaagcgaguuucagaucuauaagaaauccgggauucaggaaguugauagaaccuuggcuaaggagggaaucaagaggggcgaaacagaccaucacgccgugucucgcgggucagccaaacugcggugguucgucgagagaaacauggugacgccagaaggaaaggucguggaucucggcugcggucgugggggauggagcuacuauuguggcggucugaaaaauguuagggaggugaagggcuuaaccaaagggggaccuggccaugaggaacccauuccuauguccacuuacggguggaaccuuguacggcugcaaaguggaguggacgucuuuuucacaccacccgagaagugcgauacccuccuaugugacaucggcgaaucuagcccuaauccaacuauagaggcgggucgcacacugcgaguuuugaaccugguggaaaauuggcucaacaauaacacccaguucugcauuaagguccuuaaucccuauaugccgucagugaucgagaaaauggaggcucugcagagaaaguacgggggagcauugguaaggaacccucugucccggaauaguacgcacgaaauguacugggugagcaacgccaccggcaauaucguuucuuccgugaacaugauuucacgcaugcucauaaauagauuuacaaugaaacacaagaaaacuaccuaugagccagaugucgacuuaggcagcgggacaaggaacaucggaauugaaucggagauccccaaccuggauauuaucgguaagcgaauagaaaagaucaaacaggagcaugagacuucuuggcacuacgaccaagaccauccuuauaagaccugggcuuaccacggcaguuaugaaacaaaacagaccggguccgccagcucaauggugaauggagucgugcggcuucugacuaagccaugggauguuguacccauggugacgcagauggcaaugacagacaccacuccguucggccagcaacgugucuuuaaagagaagguggauaccagaacacaggaaccuaaggaggguacgaaaaagcuaaugaaaauuaccgccgaguggcucuggaaggaacuggggaaaaagaaaacuccccgcauguguacaagggaggaguucacccggaagguuagauccaacgcugcguugggagccaucuuuacugacgagaauaaguggaaaucugcacgcgaagcuguggaggauggcagguucugggagcuggucgaccgagaacggaaccuccaccuugagggcaagugcgaaacauguguguacaauaugauggggaaaagagagaagaaacugggagaauuugguaaggccaagggcagcagggcaauuugguauaugugguuaggggcccgcuuccuggaguuugaggcuuugggauuccucaacgaagaucauugguuuagucguggcaauucccugagcgguguagagggggaaggacuacaccggcuuggcuacauccugagagacgugucuaaaaaggagggcggggccauguacgcggaugacaccgcaggaugggauacaaggauuacucucgaagaccugaaaaacgaggagaugguuaccaaucauaugaagggugaacacaaaaaguuggccgaggcuauauucaagcugacguaucagaacaaagucgugcgcgugcagcgaccaaccccucggggcacagucauggacaucauuucaagaagggaucaacgcgggaguggacagguuggcacuuacggucucaauaccuuuacaaacauggaagcccagcuuaucagacaaauggagggggagggaaucuucaaguccauucagcaucugacugcaaccgaagagauagugguacagaauugguuagcucgggugggcagggaacgucugagccgaauggccaucucuggcgacgauugcgucgugaaacccauugacgaucgcuucgcuucggccuugacggcacucaacgacauggggaagguuagaaaagauauccagcaaugggagccaucacggggauggaaugacuggacacaggugcccuuuugcagccaccacuuccaugaacuggucaugaaggaugguagggugcuaguaguuccuugucgcaaccaggacgagcuuauuggcagagcgcggaucucccagggggccggauggagucugaaggagaccgcuugccucggcaaaucuuaugcccaaauguggacucugauguacuuucacaggcgagauuugcguuuagcagcuaacgccauauguagcgcagugccaucccauugggucccgacaucaagaaccacuuggaguauccacgccaagcacgaauggaugaccacagaggacaugcuggcgguguggaaucgcguguggauucaggaaaaccccuggauggaggauaaaacgccugucgaaucuugggaggagguuccauaucucgguaagcgggaagaccaguggugcgggagccuuaucggacugaccuccagggcuacuugggccaaaaauauucagacagcaaucaaccaagugagaucacuaauaggcaaugaggaauacaccgacuauaugcccagcaugaagcgcuuccggagggaggaagaggaggccggcguacugugguga

SEQ ID NO: 14535 - RNA, 9876 nt, Artificial Sequence
  derived and/or modified CDS sequence (opt3) from DENV-2__EU482749__SS-prME
accgccggagugaucgucaugcugauucccacagcuauggcauuccaccucacuacgagaaauggggaaccucauaugauaguuggaaggcaggaaaaggguaaaagccuucuguuuaagaccgaggacggcgugaauaugugcacauugauggccaucgauuuaggggaacugugugaggacacuauuaccuacaaaugcccacuacuccggcaaaacgaaccggaggauaucgacuguuggugcaauuccacaucuaccuggguaacuuauggaacauguaccacgacuggcgagcaccgccgagaaaagcguucaguggcgcuggucccccauguggguauggggcuugagaccagaacagaaacuuggaugaguagcgagggagcuuggaaacacguucagaccauugagacauggauccugaggcauccuggcuucaccauuauggccgcaaucuuggccuacacgauuggcacuacacacuuucagcgggcucucaucuucauucugcugaccgcaguggccccauccaugacuaugcgcugcaucgggauaucuaacagagauuuugucgaaggagugucggguggcucauggguagacauuguucucgagcacgggagcugugugacaaccauggcuaagaauaagcccacguuagauuucgaacugaucaaaaccgaggccaagcagccugcgacacuuaggaaauauugcauugaagcaaaguugacuaacaccacaacugagagucgguguccaacccaaggagagcccucccugucugaggaacaggacaaacgcuuuaucugcaagcauagcauggucgaucgaggcugggguaauggguguggacuauucggcaagggcgggaucgugacaugcgccauguuuaccugcaaaaagaacauggaaggaaaagugguccagccugagaaucucgaauacacuauuguuauaacgccacacuccggugaggagcaugcugugggcaacgacacagggaagcacggaaaagaaaucaagauuaccccgcagucaaguaucacugaggccgaacugaccggcuaugguacaguaaccauggaguguagccccagaacugggcuugauuucaaugaaauggugcuguugcaaauggaggacaaagcauggcucguccacaggcagugguuucuggauuuaccucugccauggcuccccggcgcugacacacagggaucuaacuggauacagaaggagacgcuugugaccuucaagaauccucaugccaaaaagcaagacguugugguccugggcucccaggaaggggcgaugcacacugccuugacaggagcaaccgagauucagaugucaagcgguaaccuacuguuuacaggccaucucaaaugccggcugcguauggauaaacuucaacugaaagggaugaguuacucuauguguacuggaaaguucaagaucgugaaagaaaucgcugagacccagcacggcacgauuguaauccgcguucaguaugagggugacggguccccaugcaagauucccuucgaaauaaccgauuuggagaaaagacaugugcucggcaggcugaucacagucaauccgauugugacugaaaaggacagcccugucaacaucgaggccgaacccccauuuggagauucguacaucauuauaggcguggagccugggcaguuaaaacugaacugguucaagaagggaucuuccaucggucaaauguuugagaccacaaugcggggcgcuaaacgaauggccauucuaggggacacugcaugggauuucggaucacucggcgguguuuuuaccaguaucgggaaggcccugcaccagguguucggcgcuauuuacggagcggcauuuagcggcguauccuggacgaugaaaauccuuauaggggucaucauuacauggaucggaaugaacucucgcagcaccucauugagugugucccugguucucgugggcgucgugacucuguaucuuggugccaugguacaggcugacagcgggugugugguuucuuggaagaacaaagaacugaagugcggaucaggcauuuucaucacagauaauguccacaccuggacugagcaguacaaguuucaacccgaaaguccaagcaaauuggccuccgcaauacagaaggcccaugaggaagguauuuguggcaucagaucugugaccaggcucgagaaccugauguggaaacagauuacacccgaguuaaaucacauccugucggaaaacgaggugaagcuaacgauaaugaccggggacauccggggaauuaugcaggcuggcaaacgcagccucagaccucaaccaacugaacugaaguauuccuggaaaacaugggggaaggccaagaugcuuucaaccgagagucauaaucagacauucuugaucgauggaccggaaacugcagagugccccaacaccaauagggcguggaacucucuggaggucgaagacuacggcuuugguguuuucacgacaaauauuuggcucaaacugcgugagaagcaggacguguuuugugauagcaaauuaauguccgcugccaucaaggacaaccgggcagugcacgccgauaugggguauuggauagaaucagcucugaaugacaccuggaaaauggagaaggccagcuucauugagguaaagucuugccacuggccuaaaucccauacucuuuggaguaacggagucuuggaaagcgagaugaucaucccaaagaauuucgcaggccccgugucucagcacaacuaccgaccugguuaucauacccaaacagcuggcccauggcaccucgggaaacuggaaauggauuuugaccuaugugagggaacuaccguuguggucacagaagauugcggcaacagagggcccucccugaggacgaccacugccucaggaaagcucauuacagaguggugcugucgcaguugcacccugccgccucuucgguacagaggcgaggacgguuguugguacgggauggaaaucaggccauugaaagagaaggaagagaaucuggugaacagcuuaguuacugcgggacauggccagauugauaauuucucgcucggugugcugggcauggcccuuuuucuggaagagauguugcgcacacgaauagggaccaagcacgcuauccuccugguagcagucuccuucgugacgcuaauuacuggaaacaugucuuuucgggaccugggccgugugauggucaugguuggggccaccaugacagaugacaucggaaugggcgugaccuaucucgcucugcuugccgcauucaaaguaagacccacuuuugcggccgguuugcuguuaaggaagcucacaagcaaagagcugaugauggcuaccauugggaucgcccuucugucacagaguacaauaccugaaacuauccuagagcucaccgaugcacuggcuuugggaaugauggugcugaagauuguccgcaauauggaaaaauaccaauuagccgugacgaucauggcaauuuccugcguucccaacgccgugauccuccagaaugcuuggaaggucucuuguacaauacuggcggccgugagcguuuccccacuucuguugaccucaagccagcagaaggcagacuggauuccucucgcucugacuaucaaaggccuaaaccccaccgccaucuuccugacaacucuuagucggaccucuaagaaaagauccuggccacucaaugaggccauuauggcugugggcauggucagcauacuggcaucgucauugcugaagaacgacaucccgaugacggggccuuuaguagccggaggucuccugacagugugcuauguucuuaccggcaggucugcggaucuggaauuggagcgagcugccgacgugaaaugggaggaucaagcagaaauuaguggguccagccccauccucucuauuacuaucagcgaggacggauccaugucaauaaagaaugaagaggaggaacagacacugaccauccuaauucgcacuggccugcuugucaucagugguguguuuccaguaagcauucccaucacagccgcugcaugguaccucugggaggugaaaaagcagcgggccgggguccugugggauguuccuucuccacccccuguggaaaaggcggaguuggaagacggagcuuauagaauaaaacagaggggcauuuuaggcuacucccaaaucggggccggaguguauaaggaggguaccuuccacacgauguggcaugucacucguggcgcagugcugaugcaccgcgggaaacggaucgagccgucaugggccgauguuaagaaagaccucauuaguuacggaggcgguuggaagcuggaaggggaguggaaggaaggagaggaaguacaggugcuugcucuggagccaggcaaaaaccccagagccguccagaccaagccuggcaucuuuaaaacaaauaccgggacaauaggagcagugagcuuggauuucuccccagguacuucuggcucgcccauuguugacaggaaggggaaaguggucggacuauacggcaacggugugguaacccgaagcggggcuuaugucucagccaucgcgcagacggagaaguccauugaagauaauccugagaucgaagacgauauauuucggaagaaacgccugacaauuauggaccuccauccgggagccggcaagacuaaaagauaccugcccgcaaucgugagggaggcuaucaagcggggccuucgaaccuuaauucuggccccaacaagaguuguggcugcagaaauggaggaggcccuccgcggguugccuaucagguaucaaaccacugccauuaaaaccgaacacacaggacgugagauagucgaccugaugugucaugcuacguucacuaugcggcuccugagucccgugagaguuccaaacuacaaccuuaucauuauggaugaagcgcacuucaccgacccugcaucuaucgccgcuagggguuauaucagcacacgcguggagaugggcgaggccgcagggauuuuuaugaccgccacucccccaggaucccgagauccguucccucagucaaaugcucccauaauggacgaagagagagaaaucccagagcggucuuggaacagcggccacgaaugggucacagauuuuaaggguaagaccgugugguucguacccaguauuaaagcggggaaugacaucgccgcaugccugaggaagaacggcaagaaggugauucaguugucccgcaaaacguuugauagcgaguacguuaagacucgugcuaaugacugggauuucgucgugacaaccgacaucucugagaugggcgccaacuuuaaggcagaaagagugauagauccucggagguguaugaaaccagucauccuaaccgacggcgaggaacgcguaauucuggccgggcccaugccugugacucauucauccgcugcccaacgaagaggacggaucgguaggaauccgaagaacgagaaugaccaguauauuuacaugggcgaaccacucgagaacgaugaggacugcgcgcacuggaaagaagcaaagauguuacuggauaauaucaacacacccgaggggauaauuccuaguauguucgaacccgagcgcgaaaaaguugacgccaucgauggagaguacagacuuaggggcgaggcucggaagaccuuuguggaccugaugcgucgcggugaucucccagucugguuggccuauaaaguggcugcagaagggauuaauuacgccgaccgaaagugguguuucgauggcaucaagaacaaucagauacuggaggaaaacauggagguugagaucuggacaaaagaaggagagagaaagaaacucaagccuagguggcuggacgcucggauuuauagcgauccccuugcccuaaaagaauuuaaggaguucgcagcgggccgcaagucgcugacuuugaacuuaaucacggaaauggggagacugccaaccuucaugacacagaaagccaggaaugcucucgacaaccuggccgugcuucauacugcagaggcuggaggucgggccuacaaucacgcacugucugagcucccugaaaccuuggagacacugcuacugcucacccuucuggccacugucacgggcgggauauuuuuauucuugauguccggaaagggcaucgguaaaaugacccuggggaugugcugcauaauuacagcuagcauccuccugugguaugcgcaaauccagccgcacuggauugccgcaucaaucauacuugaauuuuuccugauugugcucuugauccccgagccagaaaagcagcgaacuccucaggauaaccaacugaccuacguagugauugcuaucuuaacaguugucgccgccaccauggcaaaugagaugggcuuucuagagaaaacuaagaaggaccugggacucggcaguauaacaacgcaggaaucugaguccaacauccuugacauugaucugagacccgcuagcgccuggaccuuguaugcgguggcuacuacauucgugaccccaaugcugcgccauucaaucgaaaauaguagcgucaacguuucccucaccgccauugcaaaucaggccacagugcugauggggcuuggaaaagguuggccucucucuaagauggacaucggcguaccccuguuggcuauuggguguuacagccaggugaacccgaucacucugacggcagccuuacuacugcucgucgcgcacuacgcuauaauuggaccaggccuucaagccaaagcaaccagggaggcccagaagcgggcugccgcagguaucaugaaaaauccuacaguggaugggaucacuguuauugaccuggaacccauaccauaugaucccaaguuugagaagcaguugggccaggugaugcugcucauccugugcgucacccaaguacuuaugaugcguacaaccugggcuuuaugugaggcccugacucucgcgacgggaccuauuuccacauugugggaaggcaacccggggagauucuggaauaccacuaucgccgugucaauggcaaacauuuuuaggggaucuuaccuggcuggcgccggucuacuguucaguaucaugaaaaauaccacaaacacucgccgggggaccggaaauauaggcgagacacucggugaaaaguggaaaucgcgacuuaacgcacugggcaagagcgaguuucagaucuauaaaaaguccgggauucaggagguugacagaacguuggcuaaagaaggaaucaagaggggcgagaccgaucaucacgccgugucucgcgggucagccaagcugcggugguucgucgaaagaaacauggugacucccgagggaaaagucguggaccucggcugcggucgugggggauggagcuacuauuguggcggucugaagaauguuagggaagugaaaggcuuaacaaaagggggaccaggccaugaggagccuauucccauguccaccuacggguggaaccuuguacggcugcaaaguggaguggaugucuuuuucacuccuccagaaaaaugcgacacacuccuaugugauaucggcgagucuagccccaauccuaccauagaagcgggucgcacgcugcgaguuuugaaccugguggagaauuggcucaacaauaacacccaguucugcauuaagguccuuaauccauauaugcccucagugaucgaaaagauggaggcucugcagagaaaauacgggggagcauugguaaggaacccgcugucccggaauaguacacacgagauguacugggugagcaacgccacuggcaauaucguuucuuccgugaacaugauuucacgcaugcucauaaauagauuuaccaugaagcacaaaaaggcuacauaugaaccugacgucgauuuaggcagcgggacuaggaacaucggaauugagucggaaaucccaaaccuggacauuaucgguaaacgaauagagaagaucaagcaggaacaugagaccucuuggcacuacgaccaagaucaucccuauaaaacaugggccuaccacggcaguuaugagaccaagcagacuggguccgcaagcucaauggugaauggagucgugcggcuucugacgaaaccuugggacguuguaccaauggugacacagauggccaugaccgauacuacccccuucggccagcaacgugucuuuaaggaaaaaguggacacaagaacgcaggagccgaaggaagguaccaagaaacuaaugaagauuacugcugaguggcucuggaaagagcuggggaagaaaaagacaccucgcauguguaccagggaagaguucacucggaaaguuagauccaacgcggccuugggagcaaucuuuacagaugaaaauaaguggaagucugcucgcgaggccguggaagacggcagguucugggagcuggucgaucgagagcggaaccuccaccuugaaggcaaaugcgagaccuguguguacaauaugauggggaagagagagaagaagcugggagaguuugguaaagcaaagggcagcagggccauuugguauaugugguuaggggcucgcuuccuggaauuugaggccuugggauuccucaacgaggaccauugguuuagucguggcaauucccugagcgguguagaaggggagggacuacaccggcuuggcuacauccugagagaugugggcaagaaagaagggggagcgauguacgcagacgauacagccgguugggacacuaggauuacccucgaggaccugaagaacgaagagaugguuacgaaucauaugaaaggcgagcacaagaaauuggcugaagccauauucaagcugaccuaucagaacaaggucgugcgcgugcagcgacccacaccacgggggacugucauggauaucauuucuagaagggaccaacgcggaucaggccagguugguaccuacgggcucaauacauuuacuaacauggaggcacagcuuaucagacaaauggaaggagagggcaucuucaaaaguauucagcaucugaccgcuacggaggaaauagccgugcagaauugguuagcucggguaggcagggagcgucugucccgaauggccaucagcggggaugacugcguggucaagccuauugaugaccgcuucgcaucugcguugacagcccucaacgauaugggaaaaaucagaaaggacauucagcaaugggaacccucgcgggguuggaaugauuggacccaggugccauuuugcucacaccacuuccaugagcugguuaugaaagacggcagggugcuagucgugcccugucgcaaccaggaugaacuuaucgggagagcucggauaagccagggagccggcuggucccugaaggagacugcaugccucgguaagaguuaugcucaaauguggacacugauguacuuucacaggcgagacuugcguuuagccgcaaacgccaucuguucugcgguaccuagccauuggguuccaaccuccagaacuaccuggucaauucacgcuaaacacgaguggaugacaacggaagauaugcuggccguguggaaucgcgucuggauccaggagaacccguggauggaagacaagacccccguggagaguugggaagaggugccuuaucucgggaaacgggaggaccaguggugcggaucucuuauuggccugacuagcagggcaacaugggccaagaauauccagaccgcuauaaaccaagucagaucccuaauuggcaaugaagaguacacugauuauaugccaucaaugaaacgcuuccggagggaagaggaagaggccgggguucugugguga

SEQ ID NO: 14536 - RNA, 9876 nt, Artificial Sequence
  derived and/or modified CDS sequence (opt3) from DENV-2__EU482751__SS-prME
accgccggcgugauaguaaugcugauuccaacugcuauggcuuuccaccucacuacgagaaacggggaaccucauaugauaguuggaaggcaggaaaaggguaaaagccuucuguuuaagaccgaagacggcgugaauaugugcacauugauggccaucgauuuaggggaacugugugaagacacuauuaccuacaaaugcccacuacuccggcaaaacgaaccggaagauaucgacuguuggugcaauuccacaucuaccuggguaacuuauggaacauguaccacgacuggcgagcaccgccgagaaaagcguucaguggcgcuggucccccauguggguauggggcuugagaccagaacagaaacuuggaugaguagcgagggagcuuggaaacacguucagaggauugagaccuggauccugcggcauccuggcuucacaauaauggccgcaaucuuggccuacaccauuggcacgacucacuuucagcgcgcucucaucuucauucugcugacagcaguggccccauccaugaccaugagaugcaucgggauaucuaacagggauuuugucgaaggagugucggguggcucauggguagacauuguucucgagcacgggagcugugugacuacaauggcuaagaauaagcccaccuuagauuucgaacugaucaaaacggaggccaagcagccugcgacccuucggaaauauugcauugaagcaaaguugacaaacacuaccacagagagucgcuguccaacucaaggagagcccucccugaaugaagaacaggacaaacgauuuaucugcaagcauucuauggucgauagaggcugggguaacggguguggacuauucggcaagggcgggaucgugaccugcgccauguuuacaugcaaaaagaauauggaaggaaaagugguccagccugagaaccucgaauacaccauuguuauaacuccacacagcggugaggagcaugcugugggcaaugacacggggaagcacggaaaagaaaucaagauuacaccgcaguccucaaucaccgaggccgaacugacuggcuaugguaccguaacaauggaguguagucccaggaccgggcuugauuucaacgaaauggugcuguugcaaauggaggacaaagcauggcucguccaccggcagugguuucuggauuuaccucugccauggcuccccggcgcugacacucagggaagcaauuggauacagaaggagacacuugugacguucaagaacccucaugccaaaaagcaagacguugugguccugggcucucaggaaggggcgaugcacaccgccuugacuggagcaacagagauucagauguccucagguaaucuacuguuuaccggccaucucaaaugccgucugcgcauggauaaacuucaacugaaagggaugagcuacaguauguguacaggaaaguucaagaucgugaaagaaaucgcugagacucagcacggcaccauuguaaucagaguucaguaugagggugacgggucuccaugcaagauucccuucgaaauaacggauuuggagaaaaggcaugugcucggccggcugaucaccgucaacccgauugugacagaaaaggacuccccugucaacaucgaggccgaacccccauuuggagauagcuacaucauuauaggcguggagccugggcaguuaaaacugaauugguucaagaagggaucgucuaucggucaaauguuugagacuaccaugcgaggcgcuaaacgcauggccauucuaggggacacagcaugggauuucggaucccucggcgguguuuuuacuucaaucgggaaggcccugcaccagguguucggcgcuauuuacggagcggcauuuaguggcguaagcuggaccaugaaaauccuuauaggggucaucauuacguggaucggaaugaacuccagaucuacuagcuugucagugagucugguucucgugggcgucgugacccuguaucuuggugccguagugcaggcugacuccggguguguugucagcuggaagaauaaagaacugaagugcggaucuggcauuuucaucacugauaacgugcacacauggaccgagcaguacaaguuucaacccgaaucaccaaguaaauuggccagcgcaauacagaaggcccaugaggaagguauuuguggcaucagguccgugacucggcucgagaaucugauguggaaacagauuacccccgaguuaaaccacauccugucugaaaaugaggucaagcuaacaauaaugacgggggacaucaaaggaauuaugcaggcuggcaagcgcucgcucagaccucaaccaaccgaacugaaauauagcuggaagacuugggggaaggccaaaaugcuuuccacagagucacauaaccagaccuucuugaucgauggaccggaaacagcagagugccccaauacuaacagggcguggaauagucuggagguugaagacuacggcuuugguguguucaccacgaacauuuggcucaagcugcgugagaaacaggacguguuuugugauucuaaguuaaugagcgcugccaucaaagacaaucgggcaguacacgccgauaugggguauuggauagaauccgcucugaacgacacauggaagauggagaaggccucauucauugaggucaaaagcugccacuggccuaagucucauacccuuugguccaauggaguguuggaaagugagaugaucauccccaagaauuucgcaggccccguuagccagcacaacuaccgaccugguuaucauacucaaaccgcuggcccauggcaccucgggaagcuggaaauggauuuugacuucugugagggaacaacuguggucgugaccgaagauugcggcaauagagggcccucucuaaggacaacgaccgccuccggaaaacugauuacugaguggugcugucgcucaugcacacucccgccucugcgguacagaggcgaggacgguuguugguacgggauggaaaucaggccacuuaaggagaaggaagagaacuugguuaauagucuggugaccgcgggacauggccagauugauaacuuuagcuuagguguacucggcauggcccuguuccuugaagagaugcugcgcacucgaauagggacaaaacacgcuaucuugcucgucgcagugucguuugugacccugauuacgggaaauauguccuuccgggaccuaggccgugucaugguuauggugggggccacuaugaccgaugacaucggaaugggcguaacauaucuggcucuccuggccgcauuuaaggugagacccaccuucgcggccggucuuuugcugaggaaauuaacuucuaaggagcucaugauggcuacaauugggaucgcccugcuuagccagucaaccauaccugaaacaauccuggagcuaacugaugcacucgcucugggaaugauggucuugaaaauugugcgcaacauggaaaaguaccaacuggccguuaccaucauggcaauuaguugcgugcccaaugccgucaucuuacagaacgcuuggaagguguccuguacgauacucgcggccguuucugugagcccacugcuucugacauccucacagcagaaagcagacuggauuccuuuggcucucaccaucaagggccugaaucccacugccaucuuucuaaccacacugagccggacaaguaaaaagagaucuuggccacuuaacgaggccauuauggcugucggcaugguauccauacucgcaagcucgcuguugaaaaaugacaucccgaugaccgggccucugguggccggagguuuacucacgguuugcuaugugcugacaggcaggucagcggaucuugaacuggagcgagcugccgacgucaagugggaggaucaagcagaaauuucugggaguucccccaucuugagcauuaccaucucugaggacggaagcauguccaucaagaacgaagaggaggaacagacucucacaauccugauucgcaccggccuacuggugaucucagguguauucccagugaguauucccaucacugccgcugcaugguaccuuugggaggucaagaagcagcgggccgggguucucugggaugugccuagcccacccccuguggaaaaagcggagcuggaagacggagcuuauagaauaaagcagaggggcauuuugggcuacucucaaaucggggccggagucuauaaagaggguacauuucacaccauguggcaugugacgcguggcgcaguuuuaaugcaccgcgggaagcggaucgagccguccugggccgaugucaaaaaggaccugauuucauacggaggcgguuggaagcucgaaggggaguggaaagaaggagaggaagugcagguccuggcucuugagccaggcaagaaucccagagccgugcagacuaaaccuggcaucuucaagaccaacacagggaccauaggagcaguuagucuggauuuuagcccagguacauccggcucucccauuguggacaggaaagggaaggucgugggauuguacggcaaugguguagucacucgaucgggggcuuaugugagcgccaucgcgcagaccgagaagucaauugaagauaacccugagaucgaagacgauauauuccggaaaaagcgccuaacgauuauggaccugcauccgggagccggcaaaacaaagagauaccuccccgcaaucguuagggaggcuaucaaacggggccugcgaacucuuauuuuagccccaaccagaguggucgcugcagaaauggaggaggcccugcgcgggcucccuaucagguaucaaacacccgccauuaagaccgaacacacuggacgugagauaguggacuugaugugucaugcuaccuucacaaugcggcugcucuccccaguuagagugccuaacuacaaucugaucauuauggaugaagcgcacuuuacggaccccgcaaguaucgccgcuagggguuauaucucuacucgcgucgagaugggcgaggccgcagggauuuucaugaccgccacaccaccgggaagccgagauccuuuuccccaguccaacgcuccaauaauggacgaagagagagaaauccccgagcggucauggaacucuggccacgaaugggugaccgauuucaaggguaaaacuguaugguuugugccuagcauuaaggcggggaacgacaucgccgcaugccuuaggaaaaauggaaagaaaguuauucagcugagucgcaagacauucgauuccgaguacgucaagacccgugcuaacgacugggauuuuguggugacgacugacaucagcgagaugggcgccaauuucaaagcagaaagagucauagauccacggagguguaugaagcccguaaucuugacagacggcgaggaacgcgugauucuagccgggccuaugccgguuacccauucuucagcugcccaacgaagaggacggaucgguaggaaccccaaaaaugagaacgaccaguauauuuacaugggcgaaccccuggagaaugaugaggacugcgcgcacuggaaggaagcaaaaaugcucuuagauaacaucaauaccccugaggggauaauucccuccauguuugaaccagagcgcgaaaagguggacgccaucgauggagaguacagacugaggggcgaggcucggaaaacuuucgucgaccuuaugcgucgcggugaucugccuguguggcucgccuauaagguugcugcagaagggauuaacuacgccgaccgaaagugguguuuugauggcaucaaaaauaaccagauauuggaggaaaacauggagguggagaucuggacaaaggaaggagagaggaaaaagcugaaacccagauggcucgacgcucggauuuauagugauccacuggcccuuaaggaguucaaggaguucgcagcgggccgcaaaagccuaacccugaauuugaucacagaaauggggagauuaccuacuuuuaugacgcagaaggccaggaacgcucuggacaaucucgccguccugcauaccgcagaggcuggaggucgggccuacaaccacgcacuuucggagcugccggaaacacucgagacuuugcugcuacugacccuccuugccacagugaccggcgggauuuuccuguuuuuaaugucuggaaaaggcaucgguaagaugacuuuggggaugugcugcauaauuacggcuuccauccugcucugguaugcgcaaauccagccccacuggauugccgcaagcaucauacuggaguucuuucuuauuguacugcucaucccagagccugaaaaacagcgaaccccacaggauaaucaauugacauacgugguuauugcuauccugacugucguggccgccaccauggcaaacgagaugggcuucuuagagaagacaaagaaagaccuaggacugggcucaauaaccacucaggaaagugagucuaauauccucgacauugaucuuagaccagcuuccgccuggacacuguaugcgguggcuacgaccuuugucacuccuauguugcgccauagcaucgaaaacucaaguguuaaugugagccugacagccauugcaaaccaggccaccguacucauggggcugggaaaggguuggccccuuuccaaaauggacaucggcgugccgcuccuggcuauuggguguuacucucaggucaauccaaucaccuugacagcagcccuguuacuacugguggcgcacuacgcuauaauuggaccuggccuccaagccaaggcaacuagggaggcccagaaacgggcugccgcagguaucaugaagaaccccacgguugaugggaucaccgugauugaccuugaaccaauacccuaugauccuaaguucgagaaacagcugggccaggucauguugcugauccucugcguaacacaagugcugaugaugcguacuaccugggcucuuugugaggccuuaacacuggcgaccggaccgauuagcacucucugggaaggcaaucccgggagauuuuggaacacgacaaucgccguuuccauggcaaauauuuucaggggaucauacuuggcuggcgccggucugcuauuuucuaucaugaagaacaccacaaguacccgccgggggacaggaaauauaggcgagacucugggugaaaaauggaagucgcgacucaacgcacuuggcaaaagcgaguuccagaucuauaagaaauccgggauucaggagguggacagaacccuggcuaaggaaggaaucaagaggggcgagacagaucaucacgccgucucucgcgggucagccaaauugcggugguuuguggaaagaaacauggucacgccagagggaaaggugguugaccugggcugcggucgugggggauggagcuacuauuguggcggucucaaaaaugugagggaaguaaagggccugaccaaagggggaccuggccaugaggagcccauuccuauguccacuuacggguggaacuuagugcggcuucaaaguggagucgauguuuucuucacaccacccgaaaagugcgacacccugcucugugauaucggcgagucuagcccuaauccaacuauagaagcgggucgcacacuacgagugcugaacuuggucgagaauuggcugaacaauaacacccaguuuugcauuaaggugcucaaucccuauaugccgucaguaaucgagaaaauggaggcacuucagagacaguacgggggagcacuggugaggaacccuuugucccggaauaguacgcacgagauguacuggguuagcaacgccaccggcaauaucgugucuuccgucaacaugauuucacgcaugcugauaaauagauucacaaugaagcacaaaaaggcuacuuaugaaccagacguggaucucggcagcgggaccaggaacaucggaauugagucggaaauccccaacuuagacauuaucgguaaacgaauagagaagaucaagcaagaacaugagauuucuuggcacuacgaccaggaucauccuuauaaaacaugggccuaccacggcaguuaugagacuaagcagaccggguccgcaagcucaauggucaauggagugguucggcugcuuacaaaaccaugggacguagugcccauggucacccagauggccaugacugauacgacaccguuuggccaacagcguguguucaaggaaaaaguugacaccagaacucaggagccuaaggaagguaccaagaaacugaugaagaucacagcugaguggcuauggaaagagcucgggaagaaaaagacgccccgcauguguaccagggaagaguuuacucggaaagugagauccaacgcggcccugggagcaauuuucacagaugaaaauaaguggaagucugcucgcgaggccgucgaagacggcagguuuugggaguugguggaucgagagcggaaccugcaccucgaaggcaaaugcgagaccuguguauacaauaugauggggaagagagagaagaaacuuggagaguucgguaaagcaaaaggcagcagggccaucugguauauguggcugggggcucgcuuuuuagaguucgaggcccugggauuuuugaacgaggaccauugguucagucguggcaauucccucagcgguguggaaggggagggacugcaccggcuaggcuacauucuuagagauguuggcaagaaagaagggggagcgauguacgcagacgauacugccgguugggacacaaggauaacccuggaggaccucaagaacgaagagauggucacaaaucauaugaaaggcgagcacaagaaacuggcugaagccaucuuuaaguugacuuaucagaacaagguggugcgcguccaacgaccaaccccucgggggacgguuauggauauuaucucuagaagggaccagcgcggaucaggccagguggguaccuacgggcugaauacauucacuaacauggaggcacaacucaucagacagauggaaggagagggcauuuucaaaaguauacagcaucuuaccgcuacagaggaaaucgccguacagaauuggcuggcucgggugggcagggagcguuuaucccgaauggccauuagcggggaugacugcgucgugaagcccaucgaugaccgcuuugcaucugcgcugacugccuugaacgauaugggaaaaguuagaaaggacauucaacagugggaaccaucgcgggguuggaaugauuggacccaggugcccuucugcucacaccacuuucaugagcucgucaugaaagacggcagggugcugguaguuccuugucgcaaccaggaugaacuaaucgggagagcucggauaagccaaggagccggcuggucccuuaaggagacggcaugccuggguaagaguuaugcucagauguggacacucauguacuuccacaggcgagaccugcguuuggccgcaaacgccaucuguucugcggugccaagccauugggucccgaccuccagaacuacauggucaauucacgcuaaacacgaguggaugaccacugaagauauguuagccguguggaaucgcguguggauccaggagaaccccuggauggaagacaagaccccugucgagaguugggaagagguuccauaucuggggaaacgggaggaccaguggugcggaucucucauuggccuuacaagcagggcaacgugggccaagaauauccaagcugccauaaaccaggugagaucccugauuggcaaugaagaguacaccgauuauaugcccucaaugaaacgcuuucggagggaagaggaagaggcagggguacuaugguga

SEQ ID NO: 14537 - RNA, 9876 nt, Artificial Sequence
  derived and/or modified CDS sequence (opt3) from DENV-2__GQ868604__SS-prME
accgccggcgugaucgucaugcugauucccacagcuauggcauuccaccucacuacgagaaacggggagccucauaugauaguuggaaggcaggaaaaggguaaaagccuucuguuuaagaccgaggacggcgugaauaugugcacauugauggccaucgauuuaggggaacugugugaggacacuauuaccuacaaaugcccacuacuccggcaaaacgaaccggaggauaucgacuguuggugcaauuccacaucuaccuggguaacuuauggaacauguaccacgacuggcgagcaccgccgagaaaagcguucaguggcgcuggucccccauguggguauggggcuugagaccagaacagaaacuuggaugaguagcgagggagcuuggaaacacguucagaggauugagaccuggauccugcggcauccuggcuucacaauaauggccgcaaucuuggccuacaccauuggcacgacucacuuucagcgcgcucucaucuucauucugcugacagcaguggccccauccaugaccaugagaugcaucgggauaucuaacagggauuuugucgaaggagugucggguggcucauggguagacauuguucucgagcacgggagcugugugacuacaauggcuaagaauaagcccaccuuagauuucgaacugaucaaaacggaggccaagcagccugcgacccuucggaaauauugcauugaagcaaaguugacaaacacuaccacagagagucgcuguccaacucaaggagagcccucccugaaugaagagcaggacaaacgauuuaucugcaagcauucuauggucgauagaggcugggguaacggguguggacuauucggcaagggcgggaucgugaccugcgccauguuuacaugcaaaaagaauauggaaggaaaagugguccagccugagaaccucgaauacaccauuguuauaacuccacacagcggugaggagcaugcugugggcaaugacacggggaagcacggaaaagaaaucaagauuacaccgcaguccucaaucaccgaggccgaacugacuggcuaugguaccguaacaauggaguguagucccaggaccgggcuugauuucaacgaaauggugcuguugcaaauggaggacaaagcauggcucguccaccggcagugguuucuggauuuaccucugccauggcuccccggcgcugacacucagggaagcaauuggauacagaaggagacacuugugacguucaagaacccucaugccaaaaagcaagacguugugguccugggcucucaggaaggggcgaugcacaccgccuugacuggagcaacagagauucagauguccucagguaaucuacuguuuaccggccaucucaaaugccgucugcgcauggauaagcuucaacugaaagggaugagcuacaguauguguacaggaaaguucaagaucgugaaagaaaucgcugagacucagcacggcaccauuguaaucagaguucaguaugagggugacgggucuccaugcaagauucccuucgaaauaacggauuuggagaaaaggcaugugcucggccggcugaucaccgucaacccgauugugacagaaaaggacuccccugucaacaucgaggccgaacccccauuuggagauagcuacaucauuauaggcguggagccugggcaguuaaaacugaauugguucaagaagggaucgucuaucggucaaauguuugagacuaccaugcgaggcgcuaaacgcauggccauucuaggggacacagcaugggauuucggaucccucggcgguguuuuuacuucaaucgggaaggcccugcaccagguguucggcgcuauuuacggagcggcauuuaguggcguaagcuggaccaugaaaauccuuauaggggucaucauuacguggaucggaaugaacuccagaucuacaagcuugucagugagucugguucucgugggcgucgugacccuguaucuuggugccguagugcaggcugacuccggguguguugucagcuggaagaauaaagaacugaagugcggaucuggcauuuucaucacugauaacgugcacacauggaccgagcaguacaaguuucaacccgaaucaccaaguaaauuggccagcgcaauacagaaggcccaugaggaagguauuuguggcaucagguccgugacucggcucgagaaucugauguggaaacagauuacccccgaguuaaaccacauccugucugaaaaugaggucaagcuaacaauaaugacgggggacaucaaaggaauuaugcaggcuggcaagcgcucgcucagaccucaaccaaccgaacugaaauauagcuggaagacuugggggaaggccaaaaugcuuuccacagagucacauaaccagaccuucuugaucgauggaccggaaacagcagagugccccaauacuaacagggcguggaauagucuggagguugaagacuacggcuuugguguguucaccacgaacauuuggcucaagcugcgugagaaacaggacguguuuugugauucuaaguuaaugagcgcugccaucaaagacaaucgggcaguacacgccgauaugggguauuggauagaauccgcucugaacgacacauggaagauggagaaggccucauucauugaggucaaaagcugccacuggccuaagucucauacccuuugguccaauggaguguuggaaagugagaugaucaucccaaaaaacuucgcaggccccguuagccagcacaacuaccgaccugguuaucauacucaaaccgcuggcccauggcaccucgggaagcuggaaauggauuuugaccuaugugagggaacaacuguggucgugaccgaagauugcggcaauagagggcccucucugaggacaacgaccgccuccggaaaacucauuacugaguggugcugucgcucaugcacacugccgccucuucgguacagaggcgaggacgguuguugguacgggauggaaaucaggccauugaaggagaaggaagagaaccugguuaauaguuuagugaccgcgggacgcggccagauugauaacuucagccucgguguacugggcauggcccuuuuucuggaagagauguugcgaacucggauagggacaaaacaugcuauccuccuggucgcagugucguucgugacccuaauuacgggaaauauguccuuucgugaccugggcagagucaugguuauggugggggccacuaugaccgaugacaucggaaugggcguaacauaucucgcucugcuugccgcauucaaggugaggcccaccuuugcggccgguuugcuguuacgcaaacucacuucuaaggagcugaugauggcuacaauugggaucgcccuucugagccagucaaccauaccugaaaacauccuagagcucacagaugcacuggcuuugggaaugaugguccugaaaauugugcggaauauggaaaaguaccaauuagccguuacuaucauggcaauuaguugcgugcccaacgccgucauccuccagaaugcuuggaagguguccuguaccauacuggcggccguuucugugagcccacuucuguugacguccucacagcagaaagcagacuggauuccucucgcucugacaaucaagggccuaaaccccaccgccaucuuccugacuacccuuagcagaacaaguaaaaagaggucuuggccacucaaugaggccauuauggcugucggcaugguauccauacuggcaagcucguugcugaaaaacgacaucccgaugacugggccuuuaguggccggaggucuccugaccguuugcuaugugcuuacgggccgaucagcggaucuggaauuggagcgcgcugccgacgucaagugggaggaucaagcagaaauuucugggaguucccccauccucagcauuacaaucucugaggacggaagcauguccauaaaaaaugaagaggaggaacagacccugacuauccuaauucggacaggccugcuugugaucucagguguauuuccagugaguauucccaucaccgccgcugcaugguaccucugggaggucaagaagcagagagccgggguucugugggaugugccuagcccacccccuguggaaaaagcggaguuggaagacggagcuuauaggauaaagcagcguggcauuuuaggcuacucucaaaucggggccggagucuauaaagaggguacuuuccacacaauguggcacgugacccgcggcgcaguucugaugcaucgggggaagagaaucgagccguccugggccgauguaaaaaaggaccucauuucauacggaggcgguuggaagcuggaaggggaguggaaagaaggagaggaagugcagguccuugcucuggagccaggcaagaaccccagggccgugcagacgaaaccuggcaucuuuaagacuaauaccgggacaauaggagcaguuaguuuggauuucagcccagguaccuccggcucucccauuguggaccgaaaagggaaggucgugggacuauacggcaacgguguagucacacggucgggggcuuaugugagcgccaucgcgcagacugagaagucaauugaagauaacccugagaucgaagacgauauauuucgcaaaaagagacugaccauuauggaccuccacccgggagccggcaaaacgaagagguaccugcccgcaaucguucgggaggcuaucaaacgaggccuuagaacauuaauucuggccccaacucgcguggucgcugcagaaauggaggaggcccucaggggguugccuauccguuaucaaacccccgccauuaagacagaacauaccggacgggagauaguggaccugaugugucacgcuacuuucaccaugagacuccuguccccaguuagggugccuaauuacaaccuuaucauuauggaugaagcgcauuucacagaccccgcaaguaucgccgcucgcgguuauaucucuacgcgagucgagaugggcgaggccgcagggauuuuuaugacugccaccccaccgggaagcagagauccuuucccccaguccaaugcuccaauaauggacgaagagcgggaaauccccgagaggucauggaacucuggccacgaaugggugacagauuuuaaggguaaaaccguaugguucgugccuagcauuaaggcggggaaugacaucgccgcaugccugcgcaaaaacggaaagaaaguuauucaguugagucguaagacuuuugauuccgaguacgucaagacaagagcuaaugacugggauuucguggugaccacggacaucagcgagaugggcgccaacuuuaaagcagaacgggucauagauccaaggcgcuguaugaagcccguaauccuaacugacggcgaggaacgagugauucuggccgggccuaugccgguuacacacucuucagcugcccaaagacggggaaggaucggucgcaauccaaaaaacgagaaugaccaguauauuuacaugggcgaaccccucgagaacgaugaggacugcgcgcauuggaaggaagcaaaaauguuacuggauaauaucaacaccccugaggggauaauucccuccauguucgaaccagagagagaaaagguggacgccaucgauggagaguacaggcuucggggcgaggcucguaaaaccuuugucgaccugaugcgccgaggugaucucccugugugguuggccuauaagguugcugcagaagggauuaauuacgccgacagaaagugguguuucgauggcaucaaaaacaaccagauacuggaggaaaauauggagguggagaucuggacuaaggaaggagagaggaaaaagcucaaaccccgguggcuggacgcucgcauuuauagugauccacuugcccuaaaggaauuuaaggaguucgcagcgggcagaaaaagccugacauugaacuuaaucaccgaaauggggaggcugccuacauucaugacucagaaggcccggaaugcucucgacaaccuggccguccuucacacggcagaggcuggaggucgagccuacaaucaugcacugucggagcucccggaaaccuuggagacacugcuacugcucacucuucuggccaccgugacaggcgggauuuuuuuauucuugaugucuggaaaaggcaucgguaagaugacccuggggaugugcugcauaauuacugcuuccauccuccugugguaugcgcaaauccagccccacuggauugccgcaagcaucauacuugaauuuuuccugauuguacucuugaucccagagccugaaaaacagagaacgccccaggauaaccaacugaccuacgugguuauugcuaucuuaacagucguggccgccacuauggcaaaugagaugggcuuucuagagaagaccaagaaagaccugggacucggcucaauaacaacccaggaaagugagucuaacauccuugacauugaucugcgcccagcuuccgccuggacuuuguaugcgguggcuacaacguucgucaccccuaugcugaggcacagcaucgaaaauucaaguguuaacgugagccucacugccauugcaaaucaggccacaguacugauggggcuuggaaaggguuggccccucuccaaaauggacaucggcgugccgcuguuggcuauuggguguuacucucaggucaacccaaucacccugaccgcagccuuacuacugcucguggcgcauuacgcuauaauuggaccuggccuucaagccaaggcaacacgggaggcccagaaacgugcugccgcagguaucaugaagaaucccacuguugaugggaucacggugauugaccuggaaccaauacccuaugauccuaaguuugagaaacaguugggccaggucaugcugcucauccugugcguaacccaagugcuuaugaugagaacaacuugggcuuuaugugaggcccugacccucgcgacaggaccgauuagcaccuugugggaaggcaaccccgggagguucuggaauacuacgaucgccguuuccauggcaaacauuuuucgcggaucauaccuggcuggcgccggucuacuguucucuaucaugaagaauacaaccaguacucggcgagggaccggaaacauaggcgagacacucggugaaaaauggaagucgagacuuaacgcacugggcaaaagcgaguuucagaucuauaagaaauccgggauucaggagguggacaggacuuuggcuaaggaaggaaucaagcgcggcgagaccgaucaccaugccgucucucgggggucagccaaacugagaugguucguggaacguaauauggucacaccagagggaaaggugguugaccucggcugcgguagggggggauggagcuacuauuguggcggucugaaaaacgugcgggaaguaaagggcuuaacgaaagggggaccuggccacgaggagcccauuccuauguccaccuacggguggaaucuugugcgccugcaaaguggagucgauguuuuuuucacuccacccgaaaagugcgacacacuccuaugugauaucggcgagucuagcccuaacccaaccauagaagcgggucgaacucugagaguguugaaucuggucgagaacuggcucaauaacaauacacaguucugcauuaaggugcuuaaccccuauaugccgucaguaaucgaaaaaauggaggcucugcagaggcaguacgggggagcauuggugcggaauccucugucccgcaacaguacccaugagauguacuggguuagcaaugccacgggcaacaucgugucuuccgucaauaugauuucaagaaugcucauaaacagguuuaccaugaagcacaaaaaggcuacauaugaaccagacguggauuuaggcagcgggacucgaaacaucggaauugagucggaaauccccaaucuggacauuaucgguaaacggauagagaagaucaagcaagaacacgagauuucuuggcauuacgaccaggaucacccuuauaaaaccugggccuaccauggcaguuaugagacaaagcagacuggguccgcaagcucaauggucaacggagugguucgucuucugaccaaaccaugggacguagugcccauggucacacagauggccaugaccgauacuacgccguucggccaacagagaguguuuaaggaaaaaguugacacacgcacccaggagccuaaggaagguacuaagaaacuaaugaagaucaccgcugaguggcucuggaaagagcuggggaagaaaaagacacccaggauguguacgcgggaagaguucaccaaaaaggugagauccaaugcggccuugggagcaauuuuuacugaugaaaacaaguggaaaucugcucgcgaggccgucgaagacggcagguucugggagcugguggaucgagagcggaaucuccaccuugaaggcaagugcgagacauguguauacaacaugauggggaaaagagaaaagaaacugggagaguuugguaaggcaaagggcagcagggccaucugguauaugugguuaggggcucgcuuccuggaauuugaggccuugggauuccucaaugaggaccacugguuuagucguggcaacucccugagcgguguggaaggggagggacuacaucggcuuggcuacauucugagagauguuggcaaaaaggaagggggagcgauguacgcagacgauaccgccgguugggacacuaggauaacacucgaggaccugaaaaaugaagagauggucaccaaccacaugaagggcgagcauaaaaaguuggcugaagccaucuucaagcugacauaucagaauaaaguggugcgcguccaacgaccaacuccucgggggaccguuauggauauuaucucuagaagggaccagcgcggaucaggccagguggguacguacgggcucaacaccuuuacaaauauggaggcacaacuuaucagacagauggaaggagagggcauuuucaagaguauacagcaccugacugcuaccgaggaaaucgccguacagaacugguuagcucgggugggcagggagcgucugucccgaauggccauuagcggggaugacugcgucgugaaacccaucgaugaccgcuucgcaucugcguugacagcccucaaugauaugggaaagguuagaaaagacauucaacagugggaaccaucgcgggguuggaacgauuggacucaggugcccuuuugcucacaucacuuccacgagcuggucaugaaggacggcagggugcuaguaguuccuugucgcaaccaggaugaacuuaucgggagagcucggauaagccaaggagccggcuggucccugaaggagaccgcaugccucgguaaaaguuaugcucagauguggacgcugauguacuuucauaggcgagacuugcguuuagccgcaaaugccaucuguucugcggugccaagccacugggucccgacauccagaaccacuuggucaauucaugcuaagcacgaguggaugacaaccgaagauaugcuggccguguggaaccgcguguggauccaggagaaucccuggauggaagacaaaacuccugucgagaguugggaagagguuccauaucucgggaagcgggaggaccaguggugcggaucucuuauuggccugaccagcagggcaacaugggccaaaaacauccaaacggcuauaaaucaggugagaucccuaauuggcaacgaagaguacaccgauuauaugcccucaaugaagcgcuuccggagggaagaggaagaggccgggguacugugguga

SEQ ID NO: 14538 - RNA, 9876 nt, Artificial Sequence
  derived and/or modified CDS sequence (opt3) from DENV-2__EU482752__SS-prME
acagccggagugaucgucaugcugauucccacagcuauggcauuccaccucacuacgagaaacggggagccucauaugauaguuggaaggcaggaaaaggguaaaagccuucuguuuaagaccgaggacggcgugaauaugugcacauugauggccaucgauuuaggggaacugugugaggacacuauuaccuacaaaugcccacuacuccggcaaaacgaaccggaggauaucgacuguuggugcaauuccacaucuaccuggguaacuuauggaacauguaccacgacuggcgagcaccgccgagaaaagcguucaguggcgcuggucccccauguggguauggggcuugagaccaggacagaaacuuggaugaguagcgagggagcuuggaaacacguucagaggauugagaccuggauccugcggcauccuggcuucacaauuauggccgcaaucuuggccuacaccauuggcacgacucacuuucagcgcgcucucaucuucauucugcugacagcaguggccccauccaugaccaugagaugcaucgggauaucuaacagggauuuugucgaaggagugucggguggcucauggguagacauuguucucgagcacgggagcugugugacuacaauggcuaagaauaagcccaccuuagauuucgaacugaucaaaacggaggccaagcagccugcgacccuucggaaauauugcauugaagcaaaguugacaaacacuaccacagagagucgcuguccaacucaaggagagcccucccugaaugaggaacaggacaaacgauuuaucugcaagcauucuauggucgauagaggcugggguaacggguguggacuauucggcaagggcgggaucgugaccugcgccauguuuacaugcaaaaagaauauggaaggaaaagugguccagccugagaaccucgaauacaccauuguuauaacuccacacagcggugaggagcaugcugugggcaaugacacggggaagcacggaaaagaaaucaagauuacaccgcaguccucaaucaccgaggccgaacugacuggcuaugguaccguaacaauggaguguagucccaggaccgggcuugauuucaacgaaauggugcuguugcaaauggaggacaaagcauggcucguccaccggcagugguuucuggauuuaccucugccauggcuccccggcgcugacacucagggaagcaauuggauacagaaggagacacuugugacguucaagaacccucaugccaaaaagcaagacguugugguccugggcucucaggaaggggcgaugcacaccgccuugacuggagcaacagagauucagauguccucagguaaucuacuguuuaccggccaucucaaaugccgucugcgcauggauaaacuucaacugaaagggaugagcuacaguauguguacaggaaaguucaagaucgugaaagaaaucgcugagacucagcacggcaccauuguaaucagaguucaguaugagggugacgggucuccaugcaagauucccuucgaaauaacggauuuggagaaaaggcaugugcucggccggcugaucaccgucaacccgauugugacagaaaaggacuccccugucaacaucgaggccgaacccccauuuggagauagcuacaucauuauaggcguggagccugggcaguuaaaacugaauugguucaagaagggaucgucuaucggucaaauguuugagacuaccaugcgaggcgcuaaacgcauggccauucuaggggacacagcaugggauuucggaucccucggcgguguuuuuacuucaaucgggaaggcccugcaccagguguucggcgcuauuuacggagcggcauuuaguggcguaagcuggaccaugaaaauccuuauaggggucaucauuacguggaucggaaugaacuccagaucuaccagcuugucagugagucugguucucgugggcgucgugacccuguaucuuggugccaugguacaggcugacuccgggugugugguuagcuggaagaauaaagaacugaagugcggaucuggcauuuucaucacugauaacguccacacauggaccgagcaguacaaguuucaacccgaaucaccaaguaaauuggccagcgcaauacagaaggcccaugaggaagguauuuguggcaucagguccgugacucggcucgagaaucugauguggaaacagauuacccccgaguuaaaccacauccugucugaaaaugaggugaagcuaacaauaaugacgggggacauccgcggaauuaugcaggcuggcaaaagaucgcucaggccucaaccaaccgaacugaaguauagcuggaaaacuugggggaaggccaagaugcuuuccacagagucacauaaccagaccuucuugaucgauggaccggaaacagcagagugccccaauacuaaccgugcguggaauagucuggaggucgaagacuacggcuuugguguuuucaccacgaacauuuggcucaaacugcgggagaagcaggacguguuuugugauucuaaauuaaugagcgcugccaucaaggacaaucgagcagugcacgccgauaugggguauuggauagaauccgcucugaacgacacauggaaaauggagaaggccucauucauugagguaaagagcugccacuggccuaaaucucauacccuuugguccaauggagucuuggaaagugagaugaucaucccaaagaacuucgcaggccccgugagccagcacaacuacagaccugguuaucauacucaaaccgcuggcccauggcaccucgggaaacuggaaauggauuuugaccuaugugagggaacaacuguuguggucaccgaagauugcggcaauagggggcccucucugcgcacaacgaccgccuccggaaagcucauuacugaguggugcugucggucaugcacacugccgccucuuagauacaggggcgaggacgguuguugguacgggauggaaauccgcccauugaaagagaaggaagagaaccuggugaauaguuuaguuaccgcgggacauggccagauugauaacuucagccucggugugcugggcauggcccuuuuucuggaagagauguugcgaacucggauagggacaaagcacgcuauccuccugguagcagucucguucgugacccuaauuacgggaaauauguccuuucgugaccugggcagagugauggucaugguuggggccacuaugaccgaugacaucggaaugggcgugacauaucucgcucugcuugccgcauucaaaguaaggcccaccuuugcggccgguuugcuguuacgcaagcucacuucuaaagagcugaugauggcuacaauugggaucgcccuucugagccagucaaccauaccugaaaacauccuagagcucacagaugcacuggcuuugggaaugauggugcugaagauuguccggaauauggaaaaauaccaauuagccgugacuaucauggcaauuaguugcguucccaacgccgugauccuccagaaugcuuggaaggucuccuguaccauacuggcggccgugucuguuagcccacuucuguugacguccucacagcagaaggcagacuggauuccucucgcucugacaaucaaaggccuaaaccccaccgccaucuuccugacuacccuuagcagaacaaguaagaaaaggucuuggccacucaaugaggccauuauggcugugggcauggucuccauacuggcaagcucguugcugaagaacgacaucccgaugacugggccuuuaguagccggaggucuccugaccgugugcuauguucuuacgggccgaucagcggaucuggaauuggagcgcgcugccgacgugaaaugggaggaucaagcagaaauuucugggaguucccccauccucagcauuacaaucucugaggacggaagcauguccauaaagaaugaagaggaggaacagacccugacuauccuaauucggacaggccugcuugucaucucagguguguuuccaguaaguauucccaucaccgccgcugcaugguaccucugggaggugaaaaagcagagagccgggguccugugggauguuccuagcccacccccuguggaaaaggcggaguuggaagacggagcuuauaggauaaaacagcguggcauuuuaggcuacucucaaaucggggccggaguguauaaggaggguacuuuccacacaauguggcaugucacccgcggcgcagugcugaugcaccgggggaaaagaaucgagccguccugggccgauguuaagaaagaccucauuucauacggaggcgguuggaagcuggaaggggaguggaaggaaggagaggaaguacaggugcuugcucuggagccaggcaaaaaccccagggccguccagacgaagccuggcaucuuuaaaacuaauaccgggacaauaggagcagugaguuuggauuucagcccagguaccuccggcucucccauuguugaccgaaaggggaaaguggucggacuauacggcaacggugugguaacacggucgggggcuuaugucagcgccaucgcgcagacugagaagucaauugaagauaacccugagaucgaagacgauauauuucgcaagaaaagacugaccauuauggaccuccauccgggagccggcaagacgaaaagguaccugcccgcaaucgugcgggaggcuaucaagcgaggccuuagaacauuaauucuggccccaacucgcguuguggcugcagaaauggaggaggcccucaggggguugccuauccguuaucaaaccacagccauuaaaaccgaacacacuggacgggagauagucgaccugaugugucaugcuaccuucacaaugagacuccugucccccgugaggguuccaaauuacaaccuuaucauuauggaugaagcgcacuucacggacccugcaaguaucgccgcucgcgguuauaucucuacucgaguggagaugggcgaggccgcagggauuuuuaugaccgccacacccccaggaagcagagauccguucccucaguccaaugcucccauaauggacgaagaacgggaaaucccagagaggucauggaacucuggccacgaaugggucaccgauuuuaaggguaagacugugugguucguacccagcauuaaagcggggaaugacaucgccgcaugccugcgcaagaacggcaagaaggugauucaguugagucguaaaacauuugauuccgaguacguuaagaccagagcuaaugacugggauuucgucgugacgacugacaucagcgagaugggcgccaacuuuaaggcagaacgggugauagauccuaggcgcuguaugaaaccagucauccuaacagacggcgaggaacgaguaauucuggccgggcccaugccugugacccauucuucagcugcccaaagacggggaaggaucggucgcaauccgaagaacgagaaugaccaguauauuuacaugggcgaaccacucgagaacgaugaggacugcgcgcacuggaaagaagcaaagauguuacuggauaauaucaacacccccgaggggauaauuccuuccauguucgaacccgagagagaaaaaguugacgccaucgauggagaguacaggcuucggggcgaggcucguaagacuuuuguggaccugaugcgccgaggugaucucccagucugguuggccuauaaaguggcugcagaagggauuaauuacgccgacagaaagugguguuucgauggcaucaagaacaaccagauacuggaggaaaauauggagguugagaucuggacaaaagaaggagagaggaagaaacucaagccucgguggcuggacgcucgcauuuauagugauccccuugcccuaaaagaauuuaaggaguucgcagcgggcagaaagagccugaccuugaacuuaaucacagaaauggggaggcugccaacuuucaugacgcagaaagcccggaaugcucucgacaaccuggccgugcuucauaccgcagaggcuggaggucgagccuacaaucacgcacugucggagcucccugaaacauuggagacucugcuacugcucacccuucuggccacagucaccggcgggauauuuuuauucuugaugucuggaaagggcaucgguaaaaugacucuggggaugugcugcauaauuacggcuuccauccuccugugguaugcgcaaauccagccgcacuggauugccgcaagcaucauacuugaauuuuuccugauugugcucuugauccccgagccagaaaagcagagaaccccucaggauaaccaacugacauacguagugauugcuaucuuaacuguugucgccgccaccauggcaaaugagaugggcuuucuagagaaaacaaagaaggaccugggacucggcucaauaaccacucaggaaagugagucuaacauccuugacauugaucugcgccccgcuuccgccuggacauuguaugcgguggcuacgaccuucgugacuccaaugcugaggcauagcaucgaaaauucaagugucaacguuagccucacagccauugcaaaucaggccaccgugcugauggggcuuggaaaagguuggccucucuccaagauggacaucggcguaccccuguuggcuauuggguguuacucucaggugaacccgaucacccugacagcagccuuacuacugcucgucgcgcacuacgcuauaauuggaccaggccuucaagccaaagcaacucgggaggcccagaagcgugcugccgcagguaucaugaaaaauccuacgguggaugggaucaccguuauugaccuggaacccauaccauaugaucccaaguuugagaagcaguugggccaggugaugcugcucauccugugcgucacacaaguacuuaugaugagaacuaccugggcuuuaugugaggcccugacacucgcgaccggaccuauuagcacuuugugggaaggcaacccggggagguucuggaauacgacaaucgccguguccauggcaaacauuuuucgcggaucauaccuggcuggcgccggucuacuguucucuaucaugaaaaauaccacuaacacccggcgagggacaggaaacauaggcgagacucucggugaaaaguggaaaaguagacuuaaugcacugggcaagucggaguuucagaucuauaaaaagagcgggauucaggagguugacaggaccuuggcuaaagaaggaaucaagcgcggcgagacagaucaucacgccgugucccgggggucugccaagcugagaugguucgucgaacguaacauggugacgcccgagggaaaagucguggaccucggcugcgguagagggggauggucauacuauuguggcggucugaagaauguucgggaagugaaaggcuuaaccaaagggggaccaggccaugaggagccuauucccaugagcacuuacggguggaaccuuguacgccugcaauccggaguggaugucuuuuucacaccuccagaaaaaugcgacacccuccuaugugauaucggcgagaguucucccaauccuacuauagaagcgggucgaacacugagaguuuugaaccugguggagaauuggcucaacaauaacacccaguucugcauuaagguccuuaauccauauaugcccagcgugaucgaaaagauggaggcucugcagaggaaauacgggggagcauugguacggaacccgcugucacgcaauuccacgcacgagauguacugggugaguaacgccaccggcaauaucguuagcucugugaacaugauuuccagaaugcucauaaacagguuuacaaugaagcacaaaaaggcuacuuaugaaccugacgucgauuuaggcucagggacccgaaauaucggaauugagagcgaaaucccaaaccuggacauuaucgguaaacggauagagaagaucaagcaggaacaugagacaucguggcacuacgaccaagaucaucccuauaaaacuugggccuaccacggcucuuaugagaccaagcagacagggagugcauccagcauggugaauggagucgugcgucuucugaccaaaccuugggacguuguaccaauggugacucagauggccaugacggauacaacccccuucggccagcaaagagucuuuaaggaaaaaguggacacucgcacccaggagccgaaggaagguacaaagaaacuaaugaagauuacggcugaguggcucuggaaagagcuggggaagaaaaagaccccuaggauguguacucgggaagaguucacaagaaaaguucgcucaaacgcggccuugggagcaaucuuuaccgaugaaaauaaguggaaguccgcuagggaggccguggaagacggccgauucugggagcuggucgaucgggagagaaaccuccaccuugaaggcaaaugcgagacuuguguguacaauaugauggggaagagggagaagaagcugggagaguuugguaaagcaaagggcucucgcgccauuugguauaugugguuaggggcucguuuccuggaauuugaggccuugggauuccucaacgaggaccauugguuuagccggggcaauagucuguccgguguagaaggggagggacuacacagacuuggcuacauccugagggaugugggcaagaaagaagggggagcgauguacgcagacgauacagccgguugggacacccgcauuacacucgaggaccugaagaacgaagagaugguuacuaaucauaugaaaggcgagcacaagaaauuggcugaagccauauucaagcugaccuaucagaacaaggucgugcgagugcagcggcccacgccaagagggaccgucauggauaucauuagcaggcgcgaccaaagaggaucuggccagguugguacauacgggcucaauacuuuuaccaacauggaggcacagcuuauccggcaaauggaaggagagggcaucuucaaaucaauucagcaucugacagcuacugaggaaauagccgugcagaauugguuagcuaggguaggccgugagcgacugagucgcauggccaucuccggggaugacugcguggucaagccuauugaugacagauucgcaagcgcguugaccgcccucaacgauaugggaaaagugcggaaggacauccagcaaugggaacccucuagggguuggaacgauuggacgcagguuccauuuugcucgcaccacuuccaugagcuggugaugaaagacggccgcguccuagugguacccuguagaaaucaggaugaacuuauugggcgggcuaggaucucacagggagccggcuggagccugaaggagacagcaugccucgguaaguccuaugcucaaauguggacccugauguacuuucaccgacgugacuugagauuagccgcaaacgccauauguagugcgguuccuucucauugggugccaacuagccgcacaaccugguccauccacgcuaaacacgaguggaugacuaccgaagauaugcuggccgucuggaaucggguguggauucaggagaacccguggauggaagacaagacacccguggagucaugggaagaggucccuuaucucgggaaaagggaggaccaguggugcggaagucuuaucggccugacgucuagagcaaccugggccaagaauauucagacugcuaucaaccaaguucgcagccuaauaggcaaugaagaguacacagauuauaugccauccaugaaacgguucaggcgagaagaggaagaggccggggugcugugguga

SEQ ID NO: 14539 - RNA, 9876 nt, Artificial Sequence
  derived and/or modified CDS sequence (opt3) from DENV-2__EU482753__SS-prME
accgccggagugaucgucaugcugauucccacagcuauggcauuccaccucacuacgagaaauggggagccucauaugauaguuggaaggcaggaaaaggguaaaagccuucuguuuaagaccgaggacggcgugaauaugugcaccuugauggccaucgauuuaggggaacugugugaggacacuauuaccuacaaaugcccacuacuccggcaaaacgaaccggaggauaucgacuguuggugcaauuccacaucuaccuggguaacuuauggaacauguaccacgacuggcgagcaccgccgagaaaagcguucaguggcgcuggucccccauguggguauggggcuugagaccaggacagaaacuuggaugaguagcgagggagcuuggaaacacguucagaggauugagaccuggauccugcggcauccuggcuucacaauuauggccgcaaucuuggccuacaccauuggcacgacucacuuucagcgcgcucucaucuucauucugcugacagcaguggccccauccaugaccaugagaugcaucgggauaucuaacagggauuuugucgaaggagugucggguggcucauggguagacauuguucucgagcacgggagcugugugacuacaauggcuaagaauaagcccaccuuagauuucgaacugaucaaaacggaggccaagcagccugcgacccuucggaaauauugcauugaagcaaaguugacaaacacuaccacagagagucgcuguccaacucaaggagagcccucccugaaugaggaacaggacaaacgauuuaucugcaagcauucuauggucgauagaggcugggguaacggguguggacuauucggcaagggcgggaucgugaccugcgccauguuuacaugcaaaaagaauauggaaggaaaagugguccagccugagaaccucgaauacaccauuguuauaacuccacacagcggugaggagcaugcugugggcaaugacacggggaagcacggaaaagaaaucaagauuacaccgcaguccucaaucaccgaggccgaacugacuggcuaugguaccguaacaauggaguguagucccaggaccgggcuugauuucaacgaaauggugcuguugcaaauggaggacaaagcauggcucguccaccggcagugguuucuggauuuaccucugccauggcuccccggcgcugacacucagggaagcaauuggauacagaaggagacacuugugacguucaagaacccucaugccaaaaagcaagacguugugguccugggcucucaggaaggggcgaugcacaccgccuugacuggagcaacagagauucagauguccucagguaaucuacuguuuaccggccaucucaaaugccgucugcgcauggauaaacuucaacugaaagggaugagcuacaguauguguacaggaaaguucaagaucgugaaagaaaucgcugagacucagcacggcaccauuguaaucagaguucaguaugagggugacgggucuccaugcaagauucccuucgaaauaacggauuuggagaaaaggcaugugcucggccggcugaucaccgucaacccgauugugacagaaaaggacuccccugucaacaucgaggccgaacccccauuuggagauagcuacaucauuauaggcguggagccugggcaguuaaaacugaauugguucaagaagggaucgucuaucggucaaauguuugagacuaccaugcgaggcgcuaaacgcauggccauucuaggggacacagcaugggauuucggaucccucggcgguguuuuuacuucaaucgggaaggcccugcaccagguguucggcgcuauuuacggagcggcauuuaguggcguaagcuggaccaugaaaauccuuauaggggucaucauuacguggaucggaaugaacuccagaucuacuagcuugucagugagucugguucucgugggcgucgugacccuguaucuuggugccaugguacaggcugacuccgggugugugguuagcuggaagaauaaagaacugaagugcggaucuggcauuuucaucacugauaacguccacacauggaccgagcaguacaaguuucaacccgaaucaccaaguaaauuggccagcgcaauacagaaggcccaugaggaagguauuuguggcaucagguccgugacucggcucgagaaucugauguggaaacagauuacccccgaguuaaaccacauccugucugaaaaugaggugaagcuaacaauaaugacgggggacauccgcggaauuaugcaggcuggcaaaagaucgcucaggccucaaccaaccgaacugaaguauagcuggaaaacuugggggaaggccaagaugcuuuccacagagucacauaaccagaccuucuugaucgauggaccggaaacagcagagugccccaauacuaaccgugcguggaauagucuggaggucgaagacuacggcuuugguguuuucaccacgaacauuuggcucaaacugcgggagaagcaggacguguuuugugauucuaaauuaaugagcgcugccaucaaggacaaucgagcagugcacgccgauaugggguauuggauagaauccgcucugaacgacacauggaaaauggagaaggccucauucauugagguaaagagcugccacuggccuaaaucucauacccuuugguccaauggagucuuggaaagugagaugaucaucccaaagaacuucgcaggccccgugagccagcacaacuacagaccugguuaucauacucaaaccgcuggcccauggcaccucgggaaacuggaaauggauuuugaccuaugugagggaacaacuguuguggucaccgaagauugcggcaauagggggcccucucugcgcacaacgaccgccuccggaaagcucauuacugaguggugcugucggucaugcacacugccgccucuuagauacaggggcgaggacgguuguugguacgggauggaaauccgcccauugaaagagaaggaagagaaccuggugaauaguuuaguuaccgcgggacauggccagauugauaacuucagccucggugugcugggcauggcccuuuuucuggaagagauguugcgaacucggauagggacaaagcacgcuauccuccugguagcagucucguucgugacccuaauuacgggaaauauguccuuucgugaccugggcagagugauggucaugguuggggccacuaugaccgaugacaucggaaugggcgugacauaucucgcucugcuugccgcauucaaaguaaggcccaccuuugcggccgguuugcuguuacgcaagcucacuucuaaagagcugaugauggcuacaauugggaucgcccuucugagccagucaaccauaccugaaacaauccuagagcucacugaugcacuggcuuugggaaugauggugcugaagauuguccggaacauggaaaaauaccaauuagccgugaccaucauggcaauuaguugcguucccaaugccgugauccuccagaacgcuuggaaggucuccuguacgauacuggcggccgugucuguuagcccacuucuguugacauccucacagcagaaggcagacuggauuccucucgcucugaccaucaaaggccuaaaucccacugccaucuuccugaccacacuuagcagaacaaguaagaaaaggucuuggccacucaacgaggccauuauggcugugggcauggucuccauacuggcaagcucguugcugaagaaugacaucccgaugaccgggccuuuaguagccggaggucuccugacggugugcuauguucuuacaggccgaucagcggaucuggaauuggagcgcgcugccgacgugaaaugggaggaucaagcagaaauuucugggaguucccccauccucagcauuaccaucucugaggacggaagcauguccauaaagaacgaagaggaggaacagacucugacaauccuaauucggaccggccugcuugucaucucagguguguuuccaguaaguauucccaucacugccgcugcaugguaccucugggaggugaaaaagcagagagccgggguccugugggauguuccuagcccacccccuguggaaaaggcggaguuggaagacggagcuuauaggauaaaacagcguggcauuuuaggcuacucucaaaucggggccggaguguauaaggaggguacauuccacaccauguggcaugucacgcgcggcgcagugcugaugcaccgggggaaaagaaucgagccguccugggccgauguuaagaaagaccucauuucauacggaggcgguuggaagcuggaaggggaguggaaggaaggagaggaaguacaggugcuugcucuggagccaggcaaaaaucccagggccguccagacuaagccuggcaucuuuaaaaccaacacagggaccauaggagcagugaguuuggauuucagcccagguacauccggcucucccauuguugaccgaaaggggaaaguggucggacuauacggcaauggugugguaacucggucgggggcuuaugucagcgccaucgcgcagaccgagaagucaauugaagauaacccugagaucgaagacgauauauuucgcaagaaaagacugacgauuauggaccuccauccgggagccggcaagacaaaaagguaccugcccgcaaucgugcgggaggcuaucaagcgaggccuuagaacuuuaauucuggccccaacccgcguuguggcugcagaaauggaggaggcccucaggggguugccuauccguuaucaaacaaccgccauuaaaacugaacacaccggacgggagauagucgaccugaugugucaugcuacauucacgaugagacuccugucccccgugaggguuccaaacuacaaucuuaucauuauggaugaagcgcacuucacugacccugcaaguaucgccgcucgcgguuauaucucuacccgaguggagaugggcgaggccgcagggauuuuuaugacagccacacccccaggaagcagagauccguucccucaguccaacgcucccauaauggacgaagaacgggaaaucccagagaggucauggaacucuggccacgaaugggucacugauuuuaaggguaagacagugugguucguacccagcauuaaagcggggaacgacaucgccgcaugccugcgcaagaauggcaagaaggugauucaguugagucguaaaaccuuugauuccgaguacguuaagacgagagcuaacgacugggauuucgucgugacuacagacaucagcgagaugggcgccaauuuuaaggcagaacgggugauagauccuaggcgcuguaugaaaccagucauccuaaccgacggcgaggaacgaguaauucuggccgggcccaugccugugacccauucuucagcugcccaaagacggggaaggaucggucgcaacccgaagaaugagaacgaccaguauauuuacaugggcgaaccacucgagaaugaugaggacugcgcgcacuggaaagaagcaaagauguuacuggauaacaucaauacucccgaggggauaauuccuuccauguucgaacccgagagagaaaaaguugacgccaucgauggagaguacaggcuucggggcgaggcucguaagacauuuguggaccugaugcgccgaggugaucucccagucugguuggccuauaaaguggcugcagaagggauuaacuacgccgacagaaagugguguuucgauggcaucaagaauaaccagauacuggaggaaaacauggagguugagaucuggaccaaagaaggagagaggaagaaacucaagccucgguggcuggacgcucgcauuuauagugauccccuugcccuaaaagaauuuaaggaguucgcagcgggcagaaagagccugacauugaauuuaaucacugaaauggggaggcugccaacguucaugacccagaaagcccggaacgcucucgacaaucuggccgugcuucauacagcagaggcuggaggucgagccuacaaccacgcacugucggagcucccugaaacuuuggagacccugcuacugcucacacuucuggccaccgucacuggcgggauauuuuuauucuugaugucuggaaagggcaucgguaaaaugacgcuggggaugugcugcauaauuaccgcuuccauccuccugugguaugcgcaaauccagccgcacuggauugccgcaagcaucauacuugaauuuuuccugauugugcucuugauccccgagccagaaaagcagagaacaccucaggauaaucaacugacuuacguagugauugcuaucuuaaccguugucgccgccacaauggcaaacgagaugggcuuucuagagaaaaccaagaaggaccugggacucggcucaauaacuacacaggaaagugagucuaauauccuugacauugaucugcgccccgcuuccgccuggacguuguaugcgguggcuaccacuuucgugacaccaaugcugaggcauagcaucgaaaacucaagugucaauguuagccucaccgccauugcaaaccaggccaccgugcugauggggcuuggaaaagguuggccucucuccaagauggacaucggcguaccccuguuggcuauuggguguuacucucaggugaauccgaucacacugacugcagccuuacuacugcucgucgcgcacuacgcuauaauuggaccaggccuucaagccaaagcaacgcgggaggcccagaagcgugcugccgcagguaucaugaaaaacccuaccguggaugggaucacaguuauugaccuggaacccauaccauaugaucccaaguuugagaagcaguugggccaggugaugcugcucauccugugcgucacucaaguacuuaugaugagaaccacaugggcuuuaugugaggcccugacccucgcgacuggaccuauuagcacguugugggaaggcaauccggggagguucuggaacacaaccaucgccguguccauggcaaauauuuuucgcggaucauaccuggcuggcgccggucuacuguucucuaucaugaaaaacacuaccaauacacggcgagggacuggaaacauaggcgagacccucggugaaaaguggaaaaguagacuuaacgcacugggcaagucggaguuucagaucuauaaaaagagcgggauucaggagguugacaggacauuggcuaaagaaggaaucaagcgcggcgagacggaucaucacgccgugucccgggggucugccaagcugagaugguucgucgaacguaauauggugacccccgagggaaaagucguggaccucggcugcgguagagggggauggucauacuauuguggcggucugaagaacguucgggaagugaaaggcuuaacuaaagggggaccaggccaugaggagccuauucccaugagcacauacggguggaaucuuguacgccugcaauccggaguggaugucuuuuucaccccuccagaaaaaugcgacacucuccuaugugauaucggcgagaguucucccaacccuacaauagaagcgggucgaacccugagaguuuugaaucugguggagaacuggcucaauaacaauacgcaguucugcauuaagguccuuaacccauauaugcccagcgugaucgaaaagauggaggcucugcagaggaaauacgggggagcauugguacggaauccgcugucacgcaacuccacccacgagauguacugggugaguaaugccacaggcaacaucguuagcucugugaauaugauuuccagaaugcucauaaacagguuuacuaugaagcacaaaaaggcuaccuaugaaccugacgucgauuuaggcucagggacacgaaacaucggaauugagagcgaaaucccaaaucuggacauuaucgguaaacggauagagaagaucaagcaggaacaugagacuucguggcacuacgaccaagaucaucccuauaaaaccugggccuaccacggcucuuaugagacaaagcagaccgggagugcauccagcauggugaacggagucgugcgucuucugacuaaaccuugggacguuguaccaauggugacgcagauggccaugacagauaccacucccuucggccagcaaagagucuuuaaggaaaaaguggacacccgcacacaggagccgaaggaagguacgaagaaacuaaugaagauuaccgcugaguggcucuggaaagagcuggggaagaaaaagacuccuaggauguguacacgggaagaguucaccagaaaaguucgcucaaaugcggccuugggagcaaucuuuacugaugaaaacaaguggaaguccgcuagggaggccguggaagacggccgauucugggagcuggucgaucgggagagaaaucuccaccuugaaggcaaaugcgagacauguguguacaacaugauggggaagagggagaagaagcugggagaguuugguaaagcaaagggcucucgcgccauuugguauaugugguuaggggcucguuuccuggaauuugaggccuugggauuccucaaugaggaccauugguuuagccggggcaacagucuguccgguguagaaggggagggacuacacagacuuggcuacauccugagggaugugggcaagaaagaagggggagcgauguacgcagacgauaccgccgguugggacacacgcauuacucucgaggaccugaagaaugaagagaugguuaccaaccauaugaaaggcgagcacaagaaauuggcugaagccauauucaagcugacguaucagaauaaggucgugcgagugcagcggcccaccccaagagggacagucauggauaucauuagcaggcgcgaccaaagaggaucuggccagguugguacuuacgggcucaacaccuuuacaaauauggaggcacagcuuauccggcaaauggaaggagagggcaucuucaaaucaauucagcaucugacugcuaccgaggaaauagccgugcagaacugguuagcuaggguaggccgugagcgacugagucgcauggccaucuccggggaugacugcguggucaagccuauugaugacagauucgcaagcgcguugacggcccucaaugauaugggaaaagugcggaaggacauccagcaaugggaacccucuagggguuggaacgauuggacacagguuccauuuugcucgcaccacuuccaugagcuggugaugaaagacggccgcguccuagugguacccuguagaaaccaggaugaacuuauugggcgggcuaggaucucacagggagccggcuggagccugaaggagaccgcaugccucgguaaguccuaugcucaaauguggacucugauguacuuucaccgacgugacuugagauuagccgcaaaugccauauguagugcgguuccuucucauugggugccaacaagccgcaccacuugguccauccacgcuaaacacgaguggaugaccacagaagauaugcuggccgucuggaaccggguguggauucaggagaauccguggauggaagacaagacgcccguggagucaugggaagaggucccuuaucucgggaaaagggaggaccaguggugcggaaguaugaucggccuuaccucuagagcaacuugggccaagaacauucagacagcuaucaaucaaguucgcagccugauaggcaacgaagaguacaccgauuauaugccauccaugaaacgguucaggcgagaagaggaagaggccggggugcuaugguga

SEQ ID NO: 14540 - RNA, 9876 nt, Artificial Sequence
  derived and/or modified CDS sequence (opt3) from DENV-2__EU482680__SS-prME
accgccggcgugaucgucaugcugauucccacagcuauggcauuccaccucacuacgagaaacggggagccucauaugauaguuggaaggcaggaaaaggguaaaagccuucuguuuaagaccgaggacggcgugaauaugugcacauugauggccaucgauuuaggggaacugugugaggacacuauuaccuacaaaugcccacuacuccggcaaaacgaaccggaggauaucgacuguuggugcaauuccacaucuaccuggguaacuuauggaacauguaccacgacuggcgagcaccgccgagaaaagcguucaguggcgcuggucccccauguggguauggggcuugagaccagaacagaaacuuggaugaguagcgagggagcuuggaaacacguucagaggauugagaccuggauccugcggcauccuggcuucacaauaauggccgcaaucuuggccuacaccauuggcacgacucacuuucagcgcgcucucaucuucauucugcugacagcaguggccccauccaugaccaugagaugcaucgggauaucuaacagggauuuugucgaaggagugucggguggcucauggguagacauuguucucgagcacgggagcugugugacuacaauggcuaagaauaagcccaccuuagauuucgaacugaucaaaacggaggccaagcagccugcgacccuucggaaauauugcauugaagcaaaguugacaaacacuaccacagagagucgcuguccaacucaaggagagcccucccugaaugaagagcaggacaaacgauuuaucugcaagcauucuauggucgauagaggcugggguaacggguguggacuauucggcaagggcgggaucgugaccugcgccauguuuacaugcaaaaagaauauggaaggaaaaauugugcagccugagaaccucgaauacaccauagucaucacuccacacagcggugaggagcaugcuguuggcaaugacacggggaagcacggaaaagaaauuaagaucacaccgcaguccucaauaaccgaggccgaacugacuggcuaugguaccgugacaauggaguguagucccaggaccgggcuugauuucaacgaaaugguacuguugcaaauggaggacaaagcauggcucgugcaccggcagugguuucuggauuuaccucugccauggcuccccggcgcugacacucagggaagcaauuggauucagaaggagacacuugucacguucaagaacccucaugccaaaaagcaagacgugguugugcugggcucucaggaaggggcgaugcacaccgccuugacuggagcaacagagauccagauguccucagguaaucuacuguuuaccggccaucucaaaugccgucugcgcauggauaagcuucaacugaaagggaugagcuacaguauguguacaggaaaguucaagaucgucaaagaaauugcugagacucagcacggcaccaucgugauuagaguacaguaugagggugacgggucuccaugcaagauacccuucgaaaucacggauuuggagaaaaggcauguucucggccggcugauuaccgugaacccgaucgucacagaaaaggacuccccugugaacaucgaggccgaacccccauuuggagauagcuacauuauaaucggcgucgagccugggcaguuaaaacugaauugguucaagaagggaucgucuauuggucaaauguuugagacuaccaugcgaggcgcuaaacgcauggccauccuaggggacacagcaugggauuucggaucccucggcgguguguuuacuucaauugggaaggcccugcaccagguuuucggcgcuaucuacggagcggcauuuaguggcgugagcuggaccaugaaaauacuuaucgggguaauuaucacguggauuggaaugaacuccagaucuacaagcuugucagucagucuggugcucguuggcguggucacccuguaucuuggugccauggugcaggcugacuccggguguguagugagcuggaagaauaaagaacugaagugcggaucuggcaucuucauaacugauaacguucacacauggaccgagcaguacaaguuucaacccgaaucaccaaguaaauuggccagcgcaauucagaaggcccaugaggaagguaucuguggcauuagguccgucacucggcucgagaaucugauguggaaacagaucacccccgaguuaaaccacauacugucugaaaaugaggugaagcuaacaaucaugacgggggacauucgcggaaucaugcaggcuggcaaaagaucgcucaggccucaaccaaccgaacugaaguauagcuggaaaacuugggggaaggccaagaugcuuuccacagagucacauaaccagaccuucuugauugauggaccggaaacagcagagugccccaauacuaaccgugcguggaauagucuggagguggaagacuacggcuuuggugucuucaccacgaacaucuggcucaaacugcgggagaagcaggacguuuuuugugauucuaaauuaaugagcgcugccauaaaggacaaucgagcagugcacgccgauaugggguauuggauugaauccgcucugaacgacacauggaaaauggagaaggccucauucaucgaggugaagagcugccacuggccuaaaucucauacccuuugguccaauggaguauuggaaagugagaugaucauuccaaagaacuucgcaggccccgucagccagcacaacuacagaccugguuaucauacucaaaccgcuggcccauggcaccucgggaaacuggaaauggauuuugaccuaugugagggaacaacugugguugugaccgaagauugcggcaauagggggcccucucugcgcacaacgaccgccuccggaaagcucaucacugaguggugcugucggucaugcacacugccgccucuuagauacaggggcgaggacgguuguugguacgggauggaaauucgcccauugaaagagaaggaagagaaccuggucaauaguuuagugaccgcgggacauggccagauagauaacuucagccucgguguucugggcauggcccuuuuucuggaagagauguugcgaacucggaucgggacaaagcacgcuauucuccugguggcaguaucguucgucacccuaaucacgggaaauauguccuuucgugaccugggcagagugauggugauggucggggccacuaugaccgaugacauuggaacaggcguuaccuaucucgcucugcuugccgcauucaaagugaggcccacuuuugcggccgguuugcuguuacgcaagcucacaucuaaagagcugaugauggcuaccaucgggauagcccuucugagccagucaacaaucccugaaacuauucuagagcucaccgaugcacuggcuuugggaaugaugguacugaagaucgugcggaacauggaaaaauaccaauuagccgucacgauuauggcaaucaguugcgugcccaaugccguuauacuccagaacgcuuggaagguguccuguacaauucuggcggccgucucugugagcccacuucuguugaccuccucacagcagaaggcagacuggaucccucucgcucugacuaucaaaggccuaaaucccaccgccauuuuccugacaacucuuagcagaaccaguaagaaaaggucuuggccacucaacgaggccauaauggcuguuggcaugguguccauccuggcaagcucguugcugaagaaugacauuccgaugacggggccuuuagucgccggaggucuccugacaguaugcuaugugcuuaccggccgaucagcggaucuggaauuggagcgcgcugccgacguuaaaugggaggaucaagcagaaaucucugggaguucccccauucucagcaucacuauaucugaggacggaagcauguccaucaagaacgaagaggaggaacagacacugaccauucuaauccggacuggccugcuugugauuucaggugucuuuccagugaguauccccauaacagccgcugcaugguaccucugggagguaaaaaagcagagagccggggugcugugggaugucccuagcccacccccuguugaaaaggcggaguuggaagacggagcuuauaggauuaaacagcguggcaucuuaggcuacucucaaaucggggccggaguguauaaggaggguaccuuccacacgauguggcaugugacucgcggcgcaguccugaugcaccgggggaaaagaauugagccguccugggccgaugugaagaaagaccucaucucauacggaggcgguuggaagcuggaaggggaguggaaggaaggagaggaaguucagguacuugcucuggagccaggcaaaaaucccagggccgugcagaccaagccuggcauauuuaaaacaaacaccgggacaauuggagcagucaguuuggauuucagcccagguacuuccggcucucccaucguggaccgaaaggggaaaguugugggacuauacggcaauggugucgugacccggucgggggcuuauguaagcgccauugcgcagacggagaagucaaucgaagauaacccugagauagaagacgauauuuuucgcaagaaaagacugacaaucauggaccuccauccgggagccggcaagacuaaaagguaccugcccgcaaucguccgggaggcuauuaagcgaggccuuagaaccuuaauccuggccccaacacgcgugguugcugcagaaauggaggaggcccucaggggguugccuauucguuaucaaaccacugccauaaaaaccgaacacacaggacgggagaucguggaccugaugugucaugcuacguucacuaugagacuccugucccccgucagggugccaaacuacaaucuuauuaucauggaugaagcgcacuucaccgacccugcaaguaucgccgcucgcgguuauauuucuacacgaguugagaugggcgaggccgcagggauauuuaugaccgccacucccccaggaagcagagauccguucccucaguccaacgcucccaucauggacgaagagcgggaaauuccagagaggucauggaauucuggccacgaaugggugacagauuuuaaggguaagaccgucugguucgugcccagcaucaaagcggggaacgacauugccgcaugccugcgcaagaauggaaaaaagguaauccaguugagucguaaaacguuugauuccgaguacgugaagacuagagcuaacgacugggauuucguugucacaaccgacauaagcgagaugggcgccaauuuuaaggcagaacgggugaucgauccuaggcgcuguaugaaaccagugauucuaaccgacggcgaggaacgagucauccuggccgggcccaugccuguaacucauucuucagcugcccaaagacggggaaggauuggucgcaacccgaagaaugagaacgaccaguauaucuacaugggcgaaccacucgagaaugaugaggacugcgcgcacuggaaagaagcaaagauguuacuggauaacauaaauacacccgaggggauuaucccuuccauguucgaacccgagagagaaaaaguggacgccauugauggagaguacaggcuucggggcgaggcucguaagaccuuuguugaccugaugcgccgaggugaucucccagugugguuggccuauaaagucgcugcagaagggaucaacuacgccgacagaaagugguguuucgauggcauaaagaauaaccagauccuggaggaaaacauggagguggagauuuggacaaaagaaggagagaggaagaaacucaagccucgguggcuggacgcucgcaucuauagugauccccuugcccuaaaagaauuuaaggaguucgcagcgggcagaaagagccugacuuugaauuuaauuacggaaauggggaggcugccaaccuucaugacacagaaagcccggaacgcucucgacaaucuggccguucuucauacugcagaggcuggaggucgagccuacaaccacgcacugucggagcucccugaaaccuuggagacacugcuacugcucacccuucuggccacugugacgggcgggaucuuuuuauucuugaugucuggaaagggcauagguaaaaugacccuggggaugugcugcauuaucacagcuuccauccuccugugguaugcgcaaauucagccgcacuggaucgccgcaagcauaauucuugaauuuuuccugaucguccucuugauucccgagccagaaaagcagagaacuccucaggauaaucaacugaccuacgugguaaucgcuauauuaacagugguugccgccaccauggcaaacgagaugggcuuucuagagaaaacuaagaaggaccugggacucggcucaaucacaacgcaggaaagugagucuaauauucuugacaucgaucugcgccccgcuuccgccuggaccuuguaugcggucgcuacuacauucgugaccccaaugcugaggcauagcauugaaaacucaagugugaaugucagccucaccgccaucgcaaaccaggccacaguucugauggggcuuggaaaagguuggccucucuccaagauggacauuggcgugccccuguuggcuaucggguguuacucucagguaaauccgauaacucugacggcagccuuacuacugcucguggcgcacuacgcuauuaucggaccaggccuucaagccaaagcaacccgggaggcccagaagcgugcugccgcagguaucaugaaaaacccuacagucgaugggauuacugugauagaccuggaacccaucccauaugaucccaaguuugagaagcaguugggccagguuaugcugcucauucugugcgugacccaaguccuuaugaugagaacaaccugggcuuuaugugaggcccugacucucgcgacgggaccuaucagcacauugugggaaggcaauccggggagguucuggaacaccacuauugccguauccauggcaaauaucuuucgcggaucauaccuggcuggcgccggucuacuguucucuauaaugaaaaacaccacaaauacucggcgagggaccggaaacaucggcgagacacucggugaaaaguggaaaaguagacuuaacgcacugggcaagucggaguuucagauuuauaaaaagagcgggauccaggagguggacaggacguuggcuaaagaaggaauuaagcgcggcgagaccgaucaucacgccguuucccgggggucugccaagcugagaugguucguggaacguaauauggucacucccgagggaaaaguggucgaccucggcugcgguagggggggauggucauacuauuguggcggucugaagaacgugcgggaaguuaaaggcuuaacaaaggggggaccaggccaugaggagccuauccccaugagcaccuacggguggaaucuugugcgccugcaauccggaguagauguguuuuucacuccuccagaaaaaugcgacacacuccuaugugauauaggcgagaguucucccaacccuaccauugaagcgggucgaacgcugagagucuugaaucugguugagaacuggcucaauaacaauacccaguucugcaucaaggugcuuaacccauauaugcccagcgucaucgaaaagauggaggcucugcagaggaaauacgggggagcauuggugcggaauccgcugucacgcaacuccacacacgagauguacuggguaaguaaugccacuggcaacauugugagcucuguuaauaugauauccagaaugcucaucaacagguuuaccaugaagcacaaaaaggcuacauaugaaccugacguggauuuaggcucagggacucgaaacauuggaaucgagagcgaaaaaccaaaucuggacauuaucgguaagcggauagagaagaucaaacaggaacaugagaccucguggcacuacgaccaagaucaucccuauaagacaugggccuaccacggcucuuaugagaccaaacagacugggagugcauccagcauggucaacggagugguccgucuucugacgaagccuugggacgugguuccaaugguaacacagauggccaugaccgauacuacccccuucggccagcaaagaguguuuaaagaaaaggucgacacacgcacgcaggagccgaaggaagguaccaaaaagcuaaugaaaauuacugcugaguggcucuggaaggagcuggggaaaaagaaaacaccuaggauguguacccgggaagaguucacuagaaaggugcgcucaaaugcggccuugggagcaaucuuuacagaugaaaacaaguggaaauccgcuagggaggccguugaagacggccgauucugggagcugguggaucgggagagaaaucuccaccuugaaggcaagugcgagaccugugucuacaacaugauggggaaaagggaaaagaaacugggagaguuugguaaggcaaagggcucucgcgccauuugguauaugugguuaggggcucguuuccuggaauuugaggccuugggauuccucaaugaggaccauugguuuagccggggcaacagucuguccgguguggaaggggagggacuacacagacuuggcuacauccugagggauguaggcaaaaaggaagggggagcgauguacgcagacgauacagccgguugggacacucgcauuacccucgaggaccugaaaaaugaagagauggugacgaaccauaugaagggcgagcacaaaaaguuggcugaagccauauucaagcugaccuaucagaauaaaguuguccgagugcagcggcccacaccaagagggacugugauggauaucauuagcaggcgcgaccaaagaggaucuggccaggucgguaccuacgggcucaacacauuuacuaauauggaggcacagcuuauccggcaaauggaaggagagggcaucuucaagucaauucagcaucugaccgcuacggaggaaauagccguucagaacugguuagcuagggugggccgugagcgacugagucgcauggccaucuccggggaugacugcguagugaaaccuauugaugacagauucgcaagcgcguugacagcccucaaugauaugggaaagguccggaaagacauccagcaaugggaacccucuagggguuggaacgauuggacccaggugccauuuugcucgcaccacuuccaugagcugguuaugaaggacggccgcgugcuagucgugcccuguagaaaccaggaugaacuuauugggcgggcuaggaucucacagggagccggcuggagccugaaggagacugcaugccucgguaaauccuaugcucaaauguggacacugauguacuuucaccgacgugacuugagauuagccgcaaaugccauauguagugcgguaccuucucauuggguuccaaccagccgcacuaccugguccauccacgcuaagcacgaguggaugacaacggaagauaugcuggccguguggaaccgggucuggauucaggagaauccguggauggaagacaaaacccccguggagucaugggaagaggugccuuaucucgggaagagggaggaccaguggugcggaagucuuaucggccugacuucuagagcaacaugggccaaaaacauucagaccgcuaucaaucaaguccgcagccuaauaggcaacgaagaguacacugauuauaugccauccaugaagcgguucaggcgagaagaggaagaggccgggguucugugguga

SEQ ID NO: 14541 - RNA, 9876 nt, Artificial Sequence
  derived and/or modified CDS sequence (opt3) from DENV-2__EU482754__SS-prME
accgccggagugaucguaaugcugauucccacagcuauggcauuccaccucacuacgagaaauggggagccucauaugauaguuggaaggcaggaaaaggguaaaagccuucuguuuaagaccgaggacggcgugaauaugugcaccuugauggccauggauuuaggggaacugugugaggacacuaucaccuacaaaugcccacuacuccggcaaaacgaaccggaggauauugacuguuggugcaauuccacaucuaccuggguuacuuauggaacauguaccacgacuggcgagcaccgccgagaaaagcguucaguggcgcuggucccccauguggguauggggcuugagaccaggacagaaacuuggaugaguagcgagggagcuuggaaacacguucagaggaucgagaccuggauucugcggcauccuggcuucacaaucauggccgcaauuuuggccuacaccaucggcacgacucacuuucagcgcgcucucauuuucauccugcugacagcaguggccccauccaugaccaugagaugcauugggaucucuaacagggauuuugucgaaggagugucggguggcucauggguggacauaguucucgagcacgggagcugugugacuacaauggcuaagaauaagcccaccuuagauuucgaacugauuaaaacggaggccaagcagccugcgacccuucggaaauauugcaucgaagcaaaguugacaaacacuaccacagagagucgcuguccaacucaaggagagcccucccugaaugaggaacaggacaaacgauuuauuugcaagcauucuauggucgauagaggcugggguaacggguguggacuauucggcaagggcgggaucgugaccugcgccauguuuacaugcaaaaagaauauggaaggaaaagugguccagccugagaaccucgaauacaccaucguuauuacuccacacagcggugaggagcaugcugugggcaaugacacggggaagcacggaaaagaaauaaagaucacaccgcaguccucaauuaccgaggccgaacugacuggcuaugguaccguaacaauggaguguagucccaggaccgggcuugauuucaacgaaauggugcuguugcaaauggaggacaaagcauggcucguccaccggcagugguuucuggauuuaccucugccauggcuccccggcgcugacacucagggaagcaauuggauccagaaggagacacuugugacguucaagaacccucaugccaaaaagcaagacguugugguccugggcucucaggaaggggcgaugcacaccgccuugacuggagcaacagagauacagauguccucagguaaucuacuguuuaccggccaucucaaaugccgucugcgcauggauaaacuucaacugaaagggaugagcuacaguauguguacaggaaaguucaagauugugaaagaaaucgcugagacucagcacggcaccaucguaauuagaguucaguaugagggugacgggucuccaugcaagauccccuucgaaauuacggauuuggagaaaaggcaugugcucggccggcugauaaccgucaacccgaucgugacagaaaaggacuccccugucaacauugaggccgaacccccauuuggagauagcuacaucaucauuggcguggagccugggcaguuaaaacugaauugguucaagaagggaucgucuauaggucaaauguuugagacuaccaugcgaggcgcuaaacgcauggccauccuaggggacacagcaugggauuucggaucccucggcgguguuuuuacuucaauugggaaggcccugcaccagguguucggcgcuaucuacggagcggcauuuaguggcguaagcuggaccaugaaaauucuuaucggggucauaaucacguggauuggaaugaacuccagaucuacuagcuugucagugagucugguucucgugggcgucgugacccuguaucuuggugccaugguacaggcugacuccgggugugugguuagcuggaagaauaaagaacugaagugcggaucuggcaucuucauuacugauaacauccacacauggaccgagcaguacaaguuucaacccgaaucaccaaguaaauuggccagcgcaauacagaaggcccaugaggaagguauuuguggcaucagguccgucacucggcucgagaaucugauguggaaacagauuacccccgaguuaaaccacauccugucugaaaaugaggugaagcuaacaauaaugacgggggacauccgcggaauuaugcaggcuggcaaaagaucgcucaggccucaaccaaccgaacugaaguauagcuggaaaacuugggggaaggccaagaugcuuuccacagagucacauaaccagaccuucuugaucgauggaccggaaacagcagagugccccaauacuaaccgugcguggaauagucuggagguggaagacuacggcuuuggugucuucaccacgaacauuuggcucaaacugcgggagaagcaggacguauuuugugauucuaaauuaaugagcgcugccaucaaggacaaucgagcagugcacgccgauaugggguauuggauagaauccgcucugaacgacacauggaaaauggagaaggccucauucauugagguaaagagcugccacuggccuaaaucucauacccuuugguccaauggaguauuggaaagugagaugaucaucccaaagaacuucgcaggccccgucagccagcacaacuacagaccugguuaucauacucaaaccgcuggcccauggcaccucgggaaacuggaaauggauuuugaccuaugugagggaacaacugugguugugaccgaagauugcggcaauagggggcccucucugcgcacaacgaccgccuccggaaagcucauuacugaguggugcugucggucaugcacacugccgccucuuagauacaggggcgaggacgguuguugguacgggauggaaauccgcccauugaaagagaaggaagagaaccuggucaauaguuuagugaccgcgggacauggccagauugauaacuucagccucgguguucugggcauggcccuuuuucuggaagagauguugcgaacucggauagggacaaagcacgcuauccuccugguggcaguaucguucgucacccuaauuacgggaaauauguccuuucgugaccugggcagagugauggugauggucggggccacuaugaccgaugacaucggaaugggcguuacauaucucgcucugcuugccgcauucaaagugaggcccaccuuugcggccgguuugcuguuacgcaagcucacuucuaaagagcugaugauggcuacaauugggaucgcccuucugagccagucaaccauaccugaaacaauccuagagcucacugaugcacuggcuuugggaaugaugguacugaagauugugcggaacauggaaaaauaccaauuagccgucaccaucauggcaauuaguugcgugcccaaugccguuauccuccagaacgcuuggaagguguccuguacgauacuggcggccgucucugugagcccacuucuguugacauccucacagcagaaggcagacuggauuccucucgcucugaccaucaaaggccuaaaucccacugccaucuuccugaccacacuuagcagaacaaguaagaaaaggucuuggccacucaacgaggccauuauggcuguuggcaugguguccauacuggcaagcucguugcugaagaaugacaucccgaugaccgggccuuuagucgccggaggucuccugacgguaugcuaugugcuuacaggccgaucagcggaucuggaauuggagcgcgcugccgacguuaaaugggaggaucaagcagaaauuucugggaguucccccauccucagcauuaccaucucugaggacggaagcauguccauaaagaacgaagaggaggaacagacucugacaauccuaauucggaccggccugcuugugaucucaggugucuuuccagugaguauucccaucacugccgcugcaugguaccucugggaggucaagaagcagagagccggggugcugugggaugucccuagcccacccccuguugaaaaggcggaguuggaagacggagcuuauaggauaaaacagcguggcauuuuaggcuacucucaaaucggggccggaguguauaaggaggguacauuccacaccauguggcaugugacgcgcggcgcaguccugaugcaccgggggaaaagaaucgagccguccugggccgaugugaagaaagaccucauuucauacggaggcgguuggaagcuggaaggggaguggaaggaaggagaggaaguucagguacuugcucuggagccaggcaaaaaucccagggccgugcagacuaagccuggcaucuuuaaaaccaacacagggaccauaggagcagucaguuuggauuucagcccagguacauccggcucucccauuguggaccgaaaggggaaaguugugggacuauacggcaauggugucgugacucggucgggggcuuauguaagcgccaucgcgcagaccgagaagucaauugaagauaacccugagaucgaagacgauauauuucgcaagaaaagacugacgauuauggaccuccauccgggagccggcaagacaaaaagguaccugcccgcaaucguccgggaggcuaucaagcgaggccuuagaacuuuaauucuggccccaacccgcgugguugcugcagaaauggaggaggcccucaggggguugccuauccguuaucaaacaaccgccauuaaaacugaacacaccggacgggagauaguggaccugaugugucaugcuacauucacgaugagacuccugucccccgucagggugccaaacuacaaucuuaucauuauggaugaagcgcacuucacugacccugcaaguaucgccgcucgcgguuauaucucuacccgaguugagaugggcgaggccgcagggauuuuuaugacagccacacccccaggaagcagagauccguucccucaguccaacgcucccauaauggacgaagaacgggaaaucccagagaggucauggaacucuggccacgaaugggugacugauuuuaaggguaagacagucugguucgugcccagcauuaaagcggggaacgacaucgccgcaugccugcgcaagaauggcaagaagguaauucaguugagucguaaaaccuuugauuccgaguacgugaagacgagagcuaacgacugggauuucguugucacuacagacaucagcgagaugggcgccaauuuuaaggcagaacgggugauagauccuaggcgcuguaugaaaccagugauccuaaccgacggcgaggaacgagucauucuggccgggcccaugccuguaacccauucuucagcugcccaaagacggggaaggaucggucgcaacccgaagaaugagaacgaccaguauauuuacaugggcgaaccacucgagaaugaugaggacugcgcgcacuggaaagaagcaaagauguuacuggauaacaucaauacucccgaggggauaauuccuuccauguucgaacccgagagagaaaaaguggacgccaucgauggagaguacaggcuucggggcgaggcucguaagacauuuguugaccugaugcgccgaggugaucucccagugugguuggccuauaaagucgcugcagaagggauuaacuacgccgacagaaagugguguuucgauggcaucaagaauaaccagauacuggaggaaaacauggagguggagaucuggaccaaagaaggagagaggaagaaacucaagccucgguggcuggacgcucgcauuuauagugauccccuugcccuaaaagaauuuaaggaguucgcagcgggcagaaagagccugacauugaauuuaaucacugaaauggggaggcugccaacguucaugacccagaaagcccggaacgcucucgacaaucuggccguucuucauacagcagaggcuggaggucgagccuacaaccacgcacugucggagcucccugaaacuuuggagacccugcuacugcucacacuucuggccaccgugacuggcgggauauuuuuauucuugaugucuggaaagggcaucgguaaaaugacgcuggggaugugcugcauaauuaccgcuuccauccuccugugguaugcgcaaauccagccgcacuggauugccgcaagcaucauacuugaauuuuuccugauuguccucuugauccccgagccagaaaagcagagaacaccucaggauaaucaacugacuuacgugguaauugcuaucuuaaccgugguugccgccacaauggcaaacgagaugggcuuucuagagaaaaccaagaaggaccugggacucggcucaauaacuacacaggaaagugagucuaauauccuugacauugaucugcgccccgcuuccgccuggacguuguaugcggucgcuaccacuuucgugacaccaaugcugaggcauagcaucgaaaacucaagugugaaugucagccucaccgccauugcaaaccaggccaccguucugauggggcuuggaaaagguuggccucucuccaagauggacaucggcgugccccuguuggcuauuggguguuacucucagguaaauccgaucacacugacugcagccuuacuacugcucguggcgcacuacgcuauaauuggaccaggccuucaagccaaagcaacgcgggaggcccagaagcgugcugccgcagguaucaugaaaaacccuaccgucgaugggaucacagugauugaccuggaacccauaccauaugaucccaaguuugagaagcaguugggccagguuaugcugcucauccugugcgugacucaaguccuuaugaugagaaccacaugggcuuuaugugaggcccugacccucgcgacuggaccuauuagcacguugugggaaggcaauccggggagguucuggaacacaaccaucgccguauccauggcaaauauuuuucgcggaucauaccuggcuggcgccggucuacuguucucuaucaugaaaaacacuaccaauacacggcgagggacuggaaacauaggcgagacccucggugaaaaguggaaaaguagacuuaacgcacugggcaagucggaguuucagaucuauaaaaagagcgggauucaggagguggacaggacauuggcuaaagaaggaaucaagcgcggcgagacggaucaucacgccguuucccgggggucugccaagcugagaugguucguggaacguaauauggucacccccgagggaaaaguggucgaccucggcugcgguagagggggauggucauacuauuguggcggucugaagaacgugcgggaaguuaaaggcuuaacuaaagggggaccaggccaugaggagccuauucccaugagcacauacggguggaaucuugugcgccugcaauccggaguagauguguuuuucaccccuccagaaaaaugcgacacucuccuaugugauaucggcgagaguucucccaacccuacaauagaagcgggucgaacccugagagucuugaaucugguugagaacuggcucaauaacaauacgcaguucugcauuaaggugcuuaacccauauaugcccagcgucaucgaaaagauggaggcucugcagaggaaauacgggggagcauuggugcggaauccgcugucacgcaacuccacccacgagauguacuggguaaguaaugccacaggcaacaucgugagcucuguuaauaugauuuccagaaugcucauaaacagguuuacuaugaagcacaaaaaggcuaccuaugaaccugacguggauuuaggcucagggacacgaaacaucggaauugagagcgaaaucccaaaucuggacauuaucgguaaacggauagagaagaucaagcaggaacaugagacuucguggcacuacgaccaagaucaucccuauaaaaccugggccuaccacggcucuuaugagacaaagcagaccgggagugcauccagcauggucaacggagugguccgucuucugacuaaaccuugggacgugguuccaaugguaacgcagauggccaugacagauaccacucccuucggccagcaaagaguguuuaaggaaaaagucgacacccgcacacaggagccgaaggaagguacgaagaaacuaaugaagauuaccgcugaguggcucuggaaagagcuggggaagaaaaagacuccuaggauguguacacgggaagaguucaccagaaaagugcgcucaaaugcggccuugggagcaaucuuuacugaugaaaacaaguggaaguccgcuagggaggccguugaagacggccgauucugggagcugguggaucgggagagaaaucuccaccuugaaggcaaaugcgagacaugugucuacaacaugauggggaagagggagaaaaagcugggagaguuugguaaagcaaagggcucucgcgccauuugguauaugugguuaggggcucguuuccuggaauuugaggccuugggauuccucaaugaggaccauugguuuagccggggcaacagucuguccgguguggaaggggagggacuacacagacuuggcuacauccugagggauguaggcaagaaagaagggggagcgauguacgcagacgauaccgccgguugggacacacgcauuacucucgaggaccugaagaaugaagagauggugaccaaccauaugaaaggcgagcacaagaaauuggcugaagccauauucaagcugacguaucagaauaagguuguccgagugcagcggcccaccccaagagggacagugauggauaucauuagcaggcgcgaccaaagaggaucuggccaggucgguacuuacgggcucaacaccuuuacaaauauggaggcacagcuuauccggcaaauggaaggagagggcaucuucaaaucaauucagcaucugacugcuaccgaggaaauagccguucagaacugguuagcuagggugggccgugagcgacugagucgcauggccaucuccggggaugacugcguagugaagccuauugaugacagauucgcaagcgcguugacggcccucaaugauaugggaaaaguccggaaggacauccagcaaugggaacccucuagggguuggaacgauuggacacaggugccauuuugcucgcaccacuuccaugagcugguuaugaaagacggccgcgugcuagucgugcccuguagaaaccaggaugaacuuauugggcgggcuaggaucucacagggagccggcuggagccugaaggagaccgcaugccucgguaaguccuaugcucaaauguggacucugauguacuuucaccgacgugacuugagauuagccgcaaaugccauauguagugcgguaccuucucauuggguuccaacaagccgcaccacuugguccauccacgcuaaacacgaguggaugaccacagaagauaugcuggccguguggaaccgggucuggauucaggagaauccguggauggaagacaagacgcccguggagucaugggaagaggugccuuaucucgggaaaagggaggaccaguggugcggaagucuuaucggccugaccucuagagcaacuugggccaagaacauucagacagcuaucaaucaaguccgcagccuaauaggcaacgaagaguacaccgauuauaugccauccaugaaacgguucaggcgagaagaggaagaggccgggguucugugguga

SEQ ID NO: 14542 - RNA, 9876 nt, Artificial Sequence
  derived and/or modified CDS sequence (opt3) from DENV-2__FJ478455__SS-prME
accgccggcgugauagucaugcugauuccaacugcuauggcauuccaccucacuacgagaaacggggaaccucauaugauaguuggaaggcaggaaaaggguaaaagccuucuguuuaagaccgaagacggcgugaauaugugcacauugauggccaucgauuuaggggaacugugugaagacacuauuaccuacaaaugcccacuacuccggcaaaacgaaccggaagauaucgacuguuggugcaauuccacaucuaccuggguaacuuauggaacauguaccacgacuggcgagcaccgccgagaaaagcguucaguggcgcuggucccccauguggguauggggcuugagaccagaacagaaacuuggaugaguagcgagggagcuuggaaacacguucagaggauugagaccuggauccugcggcauccuggcuucacaauaauggccgcaaucuuggccuacaccauuggcacgacucacuuucagcgcgcucucaucuucauucugcugacagcaguggccccauccaugaccaugagaugcaucgggauaucuaacagggauuuugucgaaggagugucggguggcucauggguagacauuguucucgagcacgggagcugugugacuacaauggcuaagaauaagcccaccuuagauuucgaacugaucaaaacggaggccaagcagccugcgacccuucggaaauauugcauugaagcaaaguugacaaacacuaccacagagagucgcuguccaacucaaggagagcccucccugaaugaagaacaggacaaacgauuuaucugcaagcauucuauggucgauagaggcugggguaacggguguggacuauucggcaagggcgggaucgugaccugcgccauguuuacaugcaaaaagaauauggaaggaaaagugguccagccugagaaccucgaauacaccauuguuauaacuccacacagcggugaggagcaugcugugggcaaugacacggggaagcacggaaaagaaaucaagauuacaccgcaguccucaaucaccgaggccgaacugacuggcuaugguaccguaacaauggaguguagucccaggaccgggcuugauuucaacgaaauggugcuguugcaaauggaggacaaagcauggcucguccaccggcagugguuucuggauuuaccucugccauggcuccccggcgcugacacucagggaagcaauuggauacagaaggagacacuugugacguucaagaacccucaugccaaaaagcaagacguugugguccugggcucucaggaaggggcgaugcacaccgccuugacuggagcaacagagauucagauguccucagguaaucuacuguuuaccggccaucucaaaugccgucugcgcauggauaaacuucaacugaaagggaugagcuacaguauguguacaggaaaguucaagaucgugaaagaaaucgcugagacucagcacggcaccauuguaaucagaguucaguaugagggugacgggucuccaugcaagauucccuucgaaauaacggauuuggagaaaaggcaugugcucggccggcugaucaccgucaacccgauugugacagaaaaggacuccccugucaacaucgaggccgaacccccauuuggagauagcuacaucauuauaggcguggagccugggcaguuaaaacugaauugguucaagaagggaucgucuaucggucaaauguuugagacuaccaugcgaggcgcuaaacgcauggccauucuaggggacacagcaugggauuucggaucccucggcgguguuuuuacuucaaucgggaaggcccugcaccagguguucggcgcuauuuacggagcggcauuuaguggcguaagcuggaccaugaaaauccuuauaggggucaucauuacguggaucggaaugaacuccagaucuacuagcuugucagugagucugguucucgugggcgucgugacccuguaucuuggugccguagugcaggcugacuccggguguguugucagcuggaagaauaaagaacugaagugcggaucuggcauuuucaucacugauaacgugcacacauggaccgagcaguacaaguuucaacccgaaucaccaaguaaauuggccagcgcaauacagaaggcccaugaggaagguauuuguggcaucagguccgugacucggcucgagaaucugauguggaaacagauuacccccgaguuaaaccacauccugucugaaaaugaggucaagcuaacaauaaugacgggggacaucaaaggaauuaugcaggcuggcaagcgcucgcucagaccucaaccaaccgaacugaaauauagcuggaagacuugggggaaggccaaaaugcuuuccacagagucacauaaccagaccuucuugaucgauggaccggaaacaguugagugccccaauacuaacagggcauggaauagucuggagguggaagacuacggcuuugguguguucaccacgaacauuuggcucaagcugcgugagaaacaggacguauuuugugauucuaaguuaaugagcgcggcuaucaaagacaaucgggccguccacgcagauaugggguauuggauagaauccgcccugaacgacacauggaagauggagaaggcuucauucauugaggugaaaagcugccacuggccuaagucucauacccuuugguccaauggaguuuuggaaagugagaugaucauccccaagaauuucgccggccccgugagccagcacaacuaccgaccugguuaucauacucaaaccgcaggcccauggcaccucgggaagcuggaaauggauuuugacuucugugagggaacaacugucgugguuaccgaagauugcggcaauagagggcccucucuaaggacaacgaccgcuuccggaaaacugauuacugaguggugcugucgcucaugcacacucccgccucugcgguacagaggcgaggacgguuguugguacgggauggaaaucaggccacuuaaggagaaggaagagaacuuggugaauagucugguaaccgccggacauggccagauugauaacuuuagcuuagguguccucggcauggcgcuguuccuugaagagaugcugcgcacucgaauagggacaaaacacgccaucuugcucguggcugugucguuugucacccugauuacgggaaauauguccuuccgggaccuaggccguguuauggugaugguaggggcaacuaugaccgaugacaucggaaugggcgugacauaucuggcccuccuggcugccuuuaaggucagacccaccuucgcagcgggucuuuugcugaggaaauuaacuucuaaggagcucaugauggccacaauugggaucgcucugcuuagccagucaaccauaccugaaacaauccuggagcuaacugaugcccucgcacugggaaugaugguguugaaaauuguucgcaacauggaaaaguaccaacuggcugugaccaucauggccauuaguugcguccccaaugcagugaucuuacagaacgccuggaagguuuccuguacgauacucgcugcggugucugucagcccacugcuucugacauccucacagcagaaagccgacuggauuccuuuggcacucaccaucaagggccugaaucccacugcuaucuuucuaaccacacugagccggacaaguaaaaagagaucuuggccacuuaacgaggccauuauggccguaggcaugguguccauacucgcuagcucgcuguugaaaaaugacaucccgaugaccgggccucugguugcaggagguuuacucacggugugcuauguccugacaggcaggucagccgaucuugaacuggagcgagcggcugacgugaagugggaggaucaagccgaaauuucugggaguucccccaucuugagcauuaccaucucugaggacggaagcauguccaucaagaacgaagaggaggaacagacucucacaauccugauucgcaccggccuacugguaaucucagguguguucccagucaguauucccaucacugcagccgcuugguaccuuugggagguuaagaagcagcgggcaggggugcucugggaugugccuagcccacccccugucgaaaaagccgagcuggaagacggagcguauagaauaaagcagaggggcauuuugggcuacucucaaaucggggcuggaguguauaaagaggguacauuucacaccauguggcauguuacgcguggcgccguauuaaugcaccgcgggaagcggaucgagccguccugggcagaugugaaaaaggaccugauuucauacggaggcgguuggaagcucgaaggggaguggaaagaaggagaggaaguccaggugcuggcccuugagccaggcaagaaucccagagcuguucagacuaaaccuggcaucuucaagaccaacacagggaccauaggagccgugagucuggauuuuagcccagguacauccggcucucccauugucgacaggaaagggaaggugguaggauuguacggcaauggugucgugacucgaucgggggcauauguuagcgcuaucgcccagaccgagaagucaauugaagauaacccugagaucgaagacgauauauuccggaaaaagcgccuaacgauuauggaccugcauccgggagcgggcaaaacaaagagauaccuccccgccaucgugagggaggcaaucaaacggggccugcgaacucuuauuuuagcuccaaccagagucguggccgcugaaauggaggaggcacugcgcgggcucccuaucagguaucaaacacccgccauuaagaccgaacacacuggacgugagauaguugacuugaugugucaugccaccuucacaaugcggcugcucuccccagugagagucccuaacuacaaucugaucauuauggaugaagcucacuuuacggaccccgcgaguaucgcagccagggguuauaucucuacucgcguggagaugggcgaggcugccgggauuuucaugaccgcaacaccaccgggaagccgagauccuuuuccccaguccaacgccccaauaauggacgaagagagagaaauccccgagcggucauggaacucuggccacgaauggguaaccgauuucaaggguaaaacugugugguuuguuccuagcauuaaggcugggaacgacaucgcggccugccuuaggaaaaauggaaagaaagucauucagcugagucgcaagacauucgauuccgaguacgugaagacccgugcaaacgacugggauuuuguggucacgacugacaucagcgagaugggcgcuaauuucaaagccgaaagaguaauagauccacggagguguaugaagcccgugaucuugacagacggcgaggaacgcguuauucuagcagggccuaugccggugacccauucuucagccgcucaacgaagaggacggaucgguaggaaccccaaaaaugagaacgaccaguauauuuacaugggcgaaccccuggagaaugaugaggacugcgcccacuggaaggaagcgaaaaugcucuuagauaacaucaauaccccugaggggauaauucccuccauguuugaaccagagcgcgaaaaggucgacgcaaucgauggagaguacagacugaggggcgaggcccggaaaacuuucguggaccuuaugcgucgcggugaucugccuguuuggcucgcuuauaagguggccgcugaagggauuaacuacgcagaccgaaagugguguuuugauggcaucaaaaauaaccagauauuggaggaaaacauggaggucgagaucuggacaaaggaaggagagaggaaaaagcugaaacccagauggcucgacgcccggauuuauagugauccacuggcucuuaaggaguucaaggaguucgccgcaggccgcaaaagccuaacccugaauuugaucacagaaauggggagauuaccuacuuuuaugacgcagaaggcgaggaacgcccuggacaaucucgcugugcugcauaccgccgaggcaggaggucgggcuuacaaccacgcccuuucggagcugccggaaacacucgagacuuugcugcuacugacccuccuugcaacaguaaccggcgggauuuuccuguuuuuaaugucuggaaaaggcaucgguaagaugacuuuggggaugugcugcauaauuacggccuccauccugcucugguaugcucaaauccagccccacuggauugcggccagcaucauacuggaguucuuucuuauugugcugcucaucccagagccugaaaaacagcgaaccccacaggauaaucaauugacauacguugucauugcaauccugacugugguggcugccaccauggccaacgagaugggcuucuuagagaagacaaagaaagaccuaggacugggcucaauaaccacucaggaaagugagucuaauauccucgacauugaucuuagaccagcauccgcuuggacacuguaugccgucgcgacgaccuuuguuacuccuauguugcgccauagcaucgaaaacucaagugugaauguaagccugacagcuauugccaaccaggcaaccgugcucauggggcugggaaaggguuggccccuuuccaaaauggacaucggcgucccgcuccuggccauuggguguuacucucaggugaauccaaucaccuugacagcugcacuguuacuacugguugcccacuacgcgauaauuggaccuggccuccaagcuaaggccacuagggaggcacagaaacgggccgcugccgguaucaugaagaaccccacgguggaugggaucaccgucauugaccuugaaccaauacccuaugauccuaaguucgagaaacagcugggccagguaauguugcugauccucugcgugacacaaguucugaugaugcguacuaccugggcacuuugugaggcuuuaacacuggccaccggaccgauuagcacucucugggaaggcaaucccgggagauuuuggaacacgacaaucgcgguguccauggccaauauuuucaggggaucauacuuggcaggcgcuggucugcuauuuucuaucaugaagaacaccacaaguacccgccgggggacaggaaauauaggcgagacucugggugaaaaauggaagucgcgacucaacgcccuuggcaaaagcgaguuccagaucuauaagaaauccgggauucaggaggucgacagaacccuggcaaaggaaggaaucaagaggggcgagacagaucaucacgcugugucucgcgggucagccaaauugcggugguuugucgaaagaaacauggugacgccagagggaaagguuguggaccugggcugcggucgugggggauggagcuacuauuguggcggucucaaaaauguaagggaagugaagggccugaccaaagggggaccuggccaugaggagcccauuccuauguccacuuacggguggaacuuaguccggcuucaaaguggaguugauguguucuucacaccacccgaaaagugcgacacccugcucugugauaucggcgagucuagcccuaauccaacuauagaagccggucgcacacuacgaguccugaacuugguggagaauuggcugaacaauaacacccaguuuugcauuaagguacucaaucccuauaugccgucagugaucgagaaaauggaggcgcuucagagacaguacgggggagcucugguuaggaacccuuugucccggaauaguacgcacgagauguacugggugagcaacgcaaccggcaauaucgucucuuccgugaacaugauuucacgcaugcugauaaauagauucacaaugaagcacaaaaaggccacuuaugaaccagacgucgaucucggcagcgggaccaggaacaucggaauugagucggaaauccccaacuuagacauuaucgguaaacgaauagagaagaucaagcaagaacaugagauuucuuggcacuacgaccaggaucauccuuauaaaacaugggcuuaccacggcaguuaugagacuaagcagaccggguccgccagcucaauggugaauggaguuguacggcugcuuacaaaaccaugggacgugguccccauggugacccagauggcaaugacugauacgacaccguuuggccaacagcguguuuucaaggaaaaaguggacaccagaacucaggagccuaaggaagguaccaagaaacugaugaagaucacagccgaguggcuauggaaagagcucgggaagaaaaagacgccccgcauguguaccagggaagaguuuacucggaaagucagauccaacgcugcgcugggagccauuuucacagaugaaaauaaguggaagucugcacgcgaggcuguggaagacggcagguuuugggaguugguagaucgagagcggaaccugcaccucgaaggcaaaugcgagaccuguguguacaauaugauggggaagagagagaagaaacuuggagaguucgguaaagccaaaggcagcagggcaaucugguauauguggcugggggcccgcuuuuuagaguucgaggcucugggauuuuugaacgaggaccauugguucagucguggcaauucccucagcgguguugaaggggagggacugcaccggcuaggcuacauucuuagagaugucggcaagaaagaagggggagccauguacgcggacgauacugcagguugggacacaaggauaacccuggaggaccucaagaacgaagagauggugacaaaucauaugaaaggcgagcacaagaaacuggccgaagcuaucuuuaaguugacuuaucagaacaaggugguccgcguucaacgaccaaccccucgggggacggugauggauauuaucucuagaagggaccagcgcggaucaggccagguagguaccuacgggcugaauacauucacuaacauggaggcccaacucaucagacagauggaaggagagggcauuuucaaaaguauacagcaucuuaccgcaacagaggaaaucgcugugcagaauuggcuggcccgggucggcagggagcguuuaucccgaauggcuauuagcggggaugacugcgugguuaagcccaucgaugaccgcuuugccucugcacugacugcguugaacgauaugggaaaagugagaaaggacauucaacagugggaaccaucgcgggguuggaaugauuggacccagguccccuucugcucacaccacuuucaugagcucgugaugaaagacggcaggguacugguugugccuugucgcaaccaggaugaacuaaucgggagagcccggauaagccaaggagcuggcuggucccuuaaggagacggccugccuggguaagaguuaugcacagauguggacacucauguacuuccacaggcgagaccugcguuuggcugccaacgcaaucuguucugccgucccaagccauugggugccgaccuccagaacuacauggucaauucacgcgaaacacgaguggaugaccacugaagauauguuagcuguguggaaucgcgucuggauccaggagaaccccuggauggaagacaagaccccuguugagaguugggaagaggugccauaucuggggaaacgggaggaccaguggugcggaucucucauuggccuuacaagcagggccacgugggcaaagaauauccaagccgcuauaaaccagguaagaucccugauuggcaaugaagaguacaccgauuauaugcccucaaugaaacgcuuucggagggaagaggaagaggccggggugcuaugguga

SEQ ID NO: 14543 - RNA, 9876 nt, Artificial Sequence
  derived and/or modified CDS sequence (opt3) from DENV-2__EU482756__SS-prME
accgccggagugaucgucaugcugauucccacagcuauggcauuccaccucacuacgagaaauggggagccucauaugauaguuggaaggcaggaaaaggguaaaagccuucuguuuaagaccgaggacggcgugaauaugugcaccuugauggccaucgauuuaggggaacugugugaggacacuauuaccuacaaaugcccacuacuccggcaaaacgaaccggaggauaucgacuguuggugcaauuccacaucuaccuggguaacuuauggaacauguaccacgacuggcgagcaccgccgagaaaagcguucaguggcgcuggucccccauguggguauggggcuugagaccaggacagaaacuuggaugaguagcgagggagcuuggaaacacguucagaggauugagaccuggauccugcggcauccuggcuucacaauuauggccgcaaucuuggccuacaccauuggcacgacucacuuucagcgcgcucucaucuucauucugcugacagcaguggccccauccaugaccaugagaugcaucgggauaucuaacagggauuuugucgaaggagugucggguggcucauggguagacauuguucucgagcacgggagcugugugacuacaauggcuaagaauaagcccaccuuagauuucgaacugaucaaaacggaggccaagcagccugcgacccuucggaaauauugcauugaagcaaaguugacaaacacuaccacagagagucgcuguccaacucaaggagagcccucccugaaugaggaacaggacaaacgauuuaucugcaagcauucuauggucgauagaggcugggguaacggguguggacuauucggcaagggcgggaucgugaccugcgccauguuuacaugcaaaaagaauauggaaggaaaagugguccagccugagaaccucgaauacaccauuguuauaacuccacacagcggugaggagcaugcugugggcaaugacacggggaagcacggaaaagaaaucaagauuacaccgcaguccucaaucaccgaggccgaacugacuggcuaugguaccguaacaauggaguguagucccaggaccgggcuugauuucaacgaaauggugcuguugcaaauggaggacaaagcauggcucguccaccggcagugguuucuggauuuaccucugccauggcuccccggcgcugacacucagggaagcaauuggauacagaaggagacacuugugacguucaagaacccucaugccaaaaagcaagacguugugguccugggcucucaggaaggggcgaugcacaccgccuugacuggagcaacagagauucagauguccucagguaaucuacuguuuaccggccaucucaaaugccgucugcgcauggauaaacuucaacugaaagggaugagcuacaguauguguacaggaaaguucaagaucgugaaagaaaucgcugagacucagcacggcaccauuguaaucagaguucaguaugagggugacgggucuccaugcaagauucccuucgaaauaacggauuuggagaaaaggcaugugcucggccggcugaucaccgucaacccgauugugacagaaaaggacuccccugucaacaucgaggccgaacccccauuuggagauagcuacaucauuauaggcguggagccugggcaguuaaaacugaauugguucaagaagggaucgucuaucggucaaauguuugagacuaccaugcgaggcgcuaaacgcauggccauucuaggggacacagcaugggauuucggaucccucggcgguguuuuuacuucaaucgggaaggcccugcaccagguguucggcgcuauuuacggagcggcauuuaguggcguaagcuggaccaugaaaauccuuauaggggucaucauuacguggaucggaaugaacuccagaucuacuagcuugucagugagucugguucucgugggcgucgugacccuguaucuuggugccaugguacaggcugacuccgggugugugguuagcuggaagaauaaagaacugaagugcggaucuggcauuuucaucacugauaacguccacacauggaccgagcaguacaaguuucaacccgaaucaccaaguaaauuggccagcgcaauacagaaggcccaugaggaagguauuuguggcaucagguccgugacucggcucgagaaucugauguggaaacagauuacccccgaguuaaaccacauccugucugaaaaugaggugaagcuaacaauaaugacgggggacauccgcggaauuaugcaggcuggcaaaagaucgcucaggccucaaccaaccgaacugaaguauagcuggaaaacuugggggaaggccaagaugcuuuccacagagucacauaaccagaccuucuugaucgauggaccggaaacagcagagugccccaauacuaaccgugcguggaauagucuggaggucgaagacuacggcuuugguguuuucaccacgaacauuuggcucaaacugcgggagaagcaggacguguuuugugauucuaaauuaaugagcgcugccaucaaggacaaucgagcagugcacgccgauaugggguauuggauagaauccgcucugaacgacacauggaaaauggagaaggccucauucauugagguaaagagcugccacuggccuaaaucucauacccuuugguccaauggagucuuggaaagugagaugaucaucccaaagaacuucgcaggccccgugagccagcacaacuacagaccugguuaucauacucaaaccgcuggcccauggcaccucgggaaacuggaaauggauuuugaccuaugugagggaacaacuguuguggucaccgaagauugcggcaauagggggcccucucugcgcacaacgaccgccuccggaaagcucauuacugaguggugcugucggucaugcacacugccgccucuuagauacaggggcgaggacgguuguugguacgggauggaaauccgcccauugaaagagaaggaagagaaccuggugaauaguuuaguuaccgcgggacauggccagauugauaacuucagccucggugugcugggcauggcccuuuuucuggaagagauguugcgaacucggauagggacaaaguaugcuauccuccugguagcagucucguucgugacccuaauuacgggaaauauguccuuucgugaccugggcagagugauggucaugguuggggccacuaugaccgaugacaucggaaugggcgugacauaccucgcucugcuugccgcauucaaaguaaggcccaccuuugcggccgguuugcuguuacgcaagcucacuucuaaagagcugaugauggcuacaauugggaucgcccuucugagccagucaaccauaccugaaacaauccuagagcucacugaugcacuggcuuugggaaugauggugcugaagauuguccggaacauggaaaaauaucaauuagccgugaccaucauggcaauuaguugcguucccaaugccgugauccuccagaacgcuuggaaggucuccuguacgauacuggcggccgugucuguuagcccacuucuguugacauccucacagcagaaggcagacuggauuccucucgcucugaccaucaaaggccuaaaucccacugccaucuuccugaccacacuuagcagaacaaguaagaaaaggucuuggccacucaacgaggccauuauggcugugggcauggucuccauacuggcaagcucguugcugaagaaugacaucccgaugaccgggccuuuaguagccggaggucuccugacggugugcuacguucuuacaggccgaucagcggaucuggaauuggagcgcgcugccgacgugaaaugggaggaucaagcagaaauuucugggaguucccccauccucagcauuaccaucucugaggacggaagcauguccauaaagaacgaagaggaggaacagacucugacaauccuaauucggaccggccugcuugucaucucagguguguuuccaguaaguauucccaucacugccgcugcaugguaucucugggaggugaaaaagcagagagccgggguccugugggauguuccuagcccacccccuguggaaaaggcggaguuggaagacggagcuuacaggauaaaacagcguggcauuuuaggcuauucucaaaucggggccggaguguacaaggaggguacauuccacaccauguggcacgucacgcgcggcgcagugcugaugcaucgggggaaaagaaucgagccguccugggccgauguuaagaaagaccucauuucauacggaggcgguuggaagcuggaaggggaguggaaggaaggagaggaaguacaggugcuugcucuggagccaggcaaaaaucccagggccguccagacuaagccuggcaucuuuaaaaccaacacagggaccauaggagcagugaguuuggauuucagcccagguacauccggcucucccauuguugaccgaaaggggaaaguggucggacuauauggcaauggugugguaacucggucgggggcuuacgucagcgccaucgcgcagaccgagaagucaauugaagauaacccugagaucgaagacgauauauuucgcaagaaaagacugacgauuauggaccuccacccgggagccggcaagacaaaaagguaucugcccgcaaucgugcgggaggcuaucaagcgaggccuuagaacuuuaauucuggccccaacccgcguuguggcugcagaaauggaggaggcccucaggggguugccuauccguuaccaaacaaccgccauuaaaacugaacauaccggacgggagauagucgaccugaugugucacgcuacauucacgaugagacuccugucccccgugaggguuccaaacuauaaucuuaucauuauggaugaagcgcauuucacugacccugcaaguaucgccgcucgcgguuacaucucuacccgaguggagaugggcgaggccgcagggauuuuuaugacagccacacccccaggaagcagagauccguucccucaguccaacgcucccauaauggacgaagaacgggaaaucccagagaggucauggaacucuggccacgaaugggucacugauuuuaaggguaagacagugugguucguacccagcauuaaagcggggaacgacaucgccgcaugccugcgcaagaauggcaagaaggugauucaguugagucguaaaaccuuugauuccgaguauguuaagacgagagcuaacgacugggauuucgucgugacuacagacaucagcgagaugggcgccaauuuuaaggcagaacgggugauagauccuaggcgcuguaugaaaccagucauccuaaccgacggcgaggaacgaguaauucuggccgggcccaugccugugacccacucuucagcugcccaaagacggggaaggaucggucgcaacccgaagaaugagaacgaccaguacauuuacaugggcgaaccacucgagaaugaugaggacugcgcgcauuggaaagaagcaaagauguuacuggauaacaucaauacucccgaggggauaauuccuuccauguucgaacccgagagagaaaaaguugacgccaucgauggagaguauaggcuucggggcgaggcucguaagacauuuguggaccugaugcgccgaggugaucucccagucugguuggccuacaaaguggcugcagaagggauuaacuaugccgacagaaagugguguuucgauggcaucaagaauaaccagauacuggaggaaaacauggagguugagaucuggaccaaagaaggagagaggaagaaacucaagccucgguggcuggacgcucgcauuuacagugauccccuugcccuaaaagaauuuaaggaguucgcagcgggcagaaagagccugacauugaauuuaaucacugaaauggggaggcugccaacguucaugacccagaaagcccggaacgcucucgacaaucuggccgugcuucacacagcagaggcuggaggucgagccuauaaccaugcacugucggagcucccugaaacuuuggagacccugcuacugcucacacuucuggccaccgucacuggcgggauauuuuuauucuugaugucuggaaagggcaucgguaaaaugacgcuggggaugugcugcauaauuaccgcuuccauccuccugugguacgcgcaaauccagccgcacuggauugccgcaagcaucauacuugaauuuuuccugauugugcucuugauccccgagccagaaaagcagagaacaccucaggauaaucaacugacuuauguagugauugcuaucuuaaccguugucgccgccacaauggcaaacgagaugggcuuucuagagaaaaccaagaaggaccugggacucggcucaauaacuacacaggaaagugagucuaauauccuugacauugaucugcgccccgcuuccgccuggacguuguacgcgguggcuaccacuuucgugacaccaaugcugaggcacagcaucgaaaacucaagugucaauguuagccucaccgccauugcaaaccaggccaccgugcugauggggcuuggaaaagguuggccucucuccaagauggacaucggcguaccccuguuggcuauuggguguuacucucaggugaauccgaucacacugacugcagccuuacuacugcucgucgcgcauuaugcuauaauuggaccaggccuucaagccaaagcaacgcgggaggcccagaagcgugcugccgcagguaucaugaaaaacccuaccguggaugggaucacaguuauugaccuggaacccauaccauacgaucccaaguuugagaagcaguugggccaggugaugcugcucauccugugcgucacucaaguacuuaugaugagaaccacaugggcuuuaugugaggcccugacccucgcgacuggaccuauuagcacguugugggaaggcaauccggggagguucuggaacacaaccaucgccguguccauggcaaauauuuuucgcggaucauaucuggcuggcgccggucuacuguucucuaucaugaaaaacacuaccaauacacggcgagggacuggaaacauaggcgagacccucggugaaaaguggaaaaguagacuuaacgcacugggcaagucggaguuucagaucuacaaaaagagcgggauucaggagguugacaggacauuggcuaaagaaggaaucaagcgcggcgagacggaucaccaugccgugucccgggggucugccaagcugagaugguucgucgaacguaauauggugacccccgagggaaaagucguggaccucggcugcgguagagggggauggucauauuacuguggcggucugaagaacguucgggaagugaaaggcuuaacuaaagggggaccaggccacgaggagccuauucccaugagcacauauggguggaaucuuguacgccugcaauccggaguggaugucuuuuucaccccuccagaaaaaugcgacacucuccuaugugauaucggcgagaguucucccaacccuacaauagaagcgggucgaacccugagaguuuugaaucugguggagaacuggcucaauaacaauacgcaguucugcauuaagguccuuaacccauacaugcccagcgugaucgaaaagauggaggcucugcagaggaaauacgggggagcauugguacggaauccgcugucacgcaacuccacccaugagauguauugggugaguaaugccacaggcaacaucguuagcucugugaauaugauuuccagaaugcucauaaacagguuuacuaugaagcacaaaaaggcuaccuacgaaccugacgucgauuuaggcucagggacacgaaacaucggaauugagagcgaaaucccaaaucuggacauuaucgguaaacggauagagaagaucaagcaggaacacgagacuucguggcauuaugaccaagaucaccccuacaaaaccugggccuaucauggcucuuacgagacaaagcagaccgggagugcauccagcauggugaacggagucgugcgucuucugacuaaaccuugggacguuguaccaauggugacgcagauggccaugacagauaccacucccuucggccagcaaagagucuuuaaggaaaaaguggacacccgcacacaggagccgaaggaagguacgaagaaacuaaugaagauuaccgcugaguggcucuggaaagagcuggggaagaaaaagacuccuaggauguguacacgggaagaguucaccagaaaaguucgcucaaaugcggccuugggagcaaucuuuacugaugaaaacaaguggaaguccgcuagggaggccguggaagacggccgauucugggagcuggucgaucgggagagaaaucuccaccuugaaggcaaaugcgagacauguguguauaacaugauggggaagagggagaagaagcugggagaguuugguaaagcaaagggcucucgcgccauuugguacaugugguuaggggcucguuuccuggaauuugaggccuugggauuccucaaugaggaccacugguuuagccggggcaacagucuguccgguguagaaggggagggacuacauagacuuggcuacauccugagggaugugggcaagaaagaagggggagcgauguaugcagacgauaccgccgguugggacacacgcauuacucucgaggaccugaagaaugaagagaugguuaccaaccacaugaaaggcgagcauaagaaauuggcugaagccauauucaagcugacguaccagaauaaggucgugcgagugcagcggcccaccccaagagggacagucauggauaucauuagcaggcgcgaccaaagaggaucuggccagguugguacuuaugggcucaacaccuuuacaaauauggaggcacagcuuauccggcaaauggaaggagagggcaucuucaaaucaauucagcaccugacugcuaccgaggaaauagccgugcagaacugguuagcuaggguaggccgugagcgacugagucgcauggccaucuccggggaugacugcguggucaagccuauugaugacagauucgcaagcgcguugacggcccucaaugauaugggaaaagugcggaaggacauccagcaaugggaacccucuagggguuggaacgauuggacacagguuccauuuugcucgcaucacuuccacgagcuggugaugaaagacggccgcguccuagugguacccuguagaaaccaggaugaacuuauugggcgggcuaggaucucacagggagccggcuggagccugaaggagaccgcaugccucgguaaguccuacgcucaaauguggacucugauguauuuucaucgacgugacuugagauuagccgcaaaugccauauguagugcgguuccuucucacugggugccaacaagccgcaccacuugguccauccaugcuaaacacgaguggaugaccacagaagauaugcuggccgucuggaaccggguguggauucaggagaauccguggauggaagacaagacgcccguggagucaugggaagaggucccuuaccucgggaaaagggaggaccaguggugcggaagucuuaucggccugaccucuagagcaacuugggccaagaacauucagacagcuaucaaucaaguucgcagccuaauaggcaacgaagaguauaccgauuacaugccauccaugaaacgguucaggcgagaagaggaagaggccggggugcugugguga

SEQ ID NO: 14544 - RNA, 9876 nt, Artificial Sequence
  derived and/or modified CDS sequence (opt3) from DENV-2__EU482757__SS-prME
accgcaggcgugauagucaugcugauucccacugcuauggcauuccaccucacuacgagaaacggggagccucauaugauaguuggaaggcaggaaaaggguaaaagccuucuguuuaagaccgaggacggcgugaauaugugcacguugauggccaucgauuuaggggaacugugugaggacacuauuaccuacaaaugcccacuacuccggcaaaacgaaccggaggauaucgacuguuggugcaauuccacaucuaccuggguaacuuauggaacauguaccacgacuggcgagcaccgccgagaaaagcguucaguggcgcuggucccccauguggguauggggcuugagaccagaacagaaacuuggaugaguagcgagggagcuuggaaacacguucagaggauugagaccuggauccugcggcauccuggcuucacaauuauggccgcaaucuuggccuacaccauuggcacgacucacuuucagcgcgcucucaucuucauucugcugacagcaguggccccauccaugaccaugagaugcaucgggauaucuaacagggauuuugucgaaggagugucggguggcucauggguagacauuguucucgagcacgggagcugugugacuacaauggcuaagaauaagcccaccuuagauuucgaacugaucaaaacggaggccaagcagccugcgacccuucggaaauauugcauugaagcaaaguugacaaacacuaccacagagagucgcuguccaacucaaggagagcccucccugaaugaagaacaggacaaacgauuuaucugcaagcauucuauggucgauagaggcugggguaacggguguggacuauucggcaagggcgggaucgugaccugcgccauguuuacaugcaaaaagaauauggaaggaaaagugguccagccugagaaccucgaauacaccauuguuauaacuccacacagcggugaggagcaugcugugggcaaugacacggggaagcacggaaaagaaaucaagauuacaccgcaguccucaaucaccgaggccgaacugacuggcuaugguaccguaacaauggaguguagucccaggaccgggcuugauuucaacgaaauggugcuguugcaaauggaggacaaagcauggcucguccaccggcagugguuucuggauuuaccucugccauggcuccccggcgcugacacucagggaagcaauuggauacagaaggagacacuugugacguucaagaacccucaugccaaaaagcaagacguugugguccugggcucucaggaaggggcgaugcacaccgccuugacuggagcaacagagauucagauguccucagguaaucuacuguuuaccggccaucucaaaugccgucugcgcauggauaaacuucaacugaaagggaugagcuacaguauguguacaggaaaguucaagaucgugaaagaaaucgcugagacucagcacggcaccauuguaaucagaguucaguaugagggugacgggucuccaugcaagauucccuucgaaauaacggauuuggagaaaaggcaugugcucggccggcugaucaccgucaacccgauugugacagaaaaggacuccccugucaacaucgaggccgaacccccauuuggagauagcuacaucauuauaggcguggagccugggcaguuaaaacugaauugguucaagaagggaucgucuaucggucaaauguuugagacuaccaugcgaggcgcuaaacgcauggccauucuaggggacacagcaugggauuucggaucccucggcgguguuuuuacuucaaucgggaaggcccugcaccagguguucggcgcuauuuacggagcggcauuuaguggcguaagcuggaccaugaaaauccuuauaggggucaucauuacguggaucggaaugaacuccagaucuacuagcuugucagugagucugguucucgugggcgucgugacccuguaucuuggugccaugguacaggcugacuccgggugugugguuagcuggaagaauaaagaacugaagugcggaucuggcauuuucaucacugauaacguccacacauggaccgagcaguacaaguuucaacccgaaucaccaaguaaauuggccagcgcaauacagaaggcccaugaggaagguauuuguggcaucagguccgugacucggcucgagaaucugauguggaaacagauuacccccgaguuaaaccacauccugucugaaaaugaggugaagcuaacaauaaugacgggggacaucaaaggaauuaugcaggcuggcaagcgcucgcucagaccucaaccaaccgaacugaaauauagcuggaagacuugggggaaggccaaaaugcuuuccacagagucacauaaccagaccuucuugaucgauggaccggaaacagcagagugccccaauacuaacagggcguggaauagucuggaggucgaagacuacggcuuugguguuuucaccacgaacauuuggcucaagcugcgugagaaacaggacguguuuugugauucuaaguuaaugagcgcugccaucaaagacaaucgggcagugcacgccgauaugggguauuggauagaauccgcucugaacgacacauggaagauggagaaggccucauucauugagguaaaaagcugccacuggccuaagucucauacccuuugguccaauggagucuuggaaagugagaugaucauccccaagaauuucgcaggccccgugagccagcacaacuaccgaccugguuaucauacucaaaccgcuggcccauggcaccucgggaagcuggaaauggauuuugaccuaugugagggaacaacuguuguggucaccgaagauugcggcaauagagggcccucucugaggacaacgaccgccuccggaaaacucauuacugaguggugcugucgcucaugcacacugccgccucuucgguacagaggcgaggacgguuguugguacgggauggaaaucaggccauugaaggagaaggaagagaaccuggugaauaguuuaguuaccgcgggacauggccagauugauaacuucagccucggugugcugggcauggcccuuuuucuggaagagauguugcgcacucgaauagggacaaaacacgcuauccuccugguagcagucucguucgugacccuaauuacgggaaauauguccuuucgggaccugggccgugugauggucaugguuggggccacuaugaccgaugacaucggaaugggcgugacauaucucgcucugcuugccgcauucaagguaagacccaccuuugcggccgguuugcuguuaaggaaacucacuucuaaggagcugaugauggcuacaauugggaucgcccuucugagccagucaaccauaccugaaacaauccuagagcucacugaugcacuggcuuugggaaugauggugcugaaaauuguccgcaacauggaaaaguaccaauuagccgugaccaucauggcaauuaguugcguucccaaugccgugauccuccagaacgcuuggaaggucuccuguacgauacuggcggccgugucuguuagcccacuucuguugacauccucacagcagaaagcagacuggauuccucucgcucugaccaucaagggccuaaaucccacugccaucuuccugaccacacuuagccggacaaguaaaaagagaucuuggccacucaacgaggccauuauggcugugggcauggucuccauacuggcaagcucguugcugaaaaaugacaucccgaugaccgggccuuuaguagccggaggucuccugacggugugcuauguucuuacaggcaggucagcggaucuggaauuggagcgagcugccgacgugaagugggaggaucaagcagaaauuucugggaguucccccauccucagcauuaccaucucugaggacggaagcauguccaucaaaaacgaagaggaggaacagacucugacaauccuaauucgcaccggccugcuugucaucucagguguguuuccaguaaguauucccaucacugccgcugcaugguaccucugggaggugaagaagcagcgggccgggguccugugggauguuccuagcccacccccuguggaaaaagcggaguuggaagacggagcuuauagaauaaagcagaggggcauuuuaggcuacucucaaaucggggccggaguguauaaagaggguacauuccacaccauguggcaugucacgcguggcgcagugcugaugcaccgcgggaagcggaucgagccguccugggccgauguuaaaaaggaccucauuucauacggaggcgguuggaagcuggaaggggaguggaaagaaggagaggaaguacaggugcuugcucuggagccaggcaagaaucccagagccguccagacuaaaccuggcaucuuuaagaccaacacagggaccauaggagcagugaguuuggauuucagcccagguacauccggcucucccauuguugacaggaaagggaagguggucggacuauacggcaauggugugguaacucgaucgggggcuuaugucagcgccaucgcgcagaccgagaagucaauugaagauaacccugagaucgaagacgauauauuucggaaaaagcgccugacgauuauggaccuccauccgggagccggcaaaacaaagagauaccugcccgcaaucgugagggaggcuaucaaacggggccuucgaacuuuaauucuggccccaaccagaguuguggcugcagaaauggaggaggcccuccgcggguugccuaucagguaucaaacacccgccauuaagaccgaacacacuggacgugagauagucgaccugaugugucaugcuaccuucacaaugcggcuccuguccccagugagaguuccuaacuacaaucuuaucauuauggaugaagcgcacuucacggaccccgcaaguaucgccgcuagggguuauaucucuacucgcguggagaugggcgaggccgcagggauuuuuaugaccgccacaccaccgggaagccgagauccuuucccccaguccaacgcuccaauaauggacgaagagagagaaauccccgagcggucauggaacucuggccacgaaugggucaccgauuuuaaggguaaaacugugugguucguaccuagcauuaaggcggggaacgacaucgccgcaugccugaggaaaaauggaaagaaagugauucaguugagucgcaagacauuugauuccgaguacguuaagacccgugcuaacgacugggauuucgucgugacgacugacaucagcgagaugggcgccaauuuuaaagcagaaagagugauagauccacggagguguaugaagcccgucauccuaacagacggcgaggaacgcguaauucuggccgggccuaugccggugacccauucuucagcugcccaacgaagaggacggaucgguaggaaccccaaaaaugagaacgaccaguauauuuacaugggcgaaccccucgagaaugaugaggacugcgcgcacuggaaggaagcaaaaauguuacuggauaacaucaauaccccugaggggauaauucccuccauguucgaaccagagcgcgaaaagguugacgccaucgauggagaguacagacuuaggggcgaggcucggaaaacuuuuguggaccugaugcgucgcggugaucucccugucugguuggccuauaagguggcugcagaagggauuaacuacgccgaccgaaagugguguuucgauggcaucaaaaauaaccagauacuggaggaaaacauggagguugagaucuggacaaaggaaggagagaggaaaaagcucaaacccagauggcuggacgcucggauuuauagugauccacuugcccuaaaggaauuuaaggaguucgcagcgggccgcaaaagccugaccuugaauuuaaucacagaaauggggagacugccuacuuucaugacgcagaaggccaggaacgcucucgacaaucuggccgugcuucauaccgcagaggcuggaggucgggccuacaaccacgcacugucggagcucccggaaacauuggagacucugcuacugcucacccuucuggccacagucaccggcgggauauuuuuauucuugaugucuggaaaaggcaucgguaagaugacucuggggaugugcugcauaauuacggcuuccauccuccugugguaugcgcaaauccagccccacuggauugccgcaagcaucauacuugaauuuuuccugauugugcucuugaucccagagccugaaaaacagcgaaccccacaggauaaucaacugacauacguagugauugcuaucuuaacuguugucgccgccaccauggcaaacgagaugggcuuucuagagaagacaaagaaagaccugggacucggcucaauaaccacucaggaaagugagucuaauauccuugacauugaucugagaccagcuuccgccuggacauuguaugcgguggcuacgaccuucgugacuccuaugcugcgccauagcaucgaaaacucaagugucaauguuagccucacagccauugcaaaccaggccaccgugcugauggggcuuggaaaggguuggccccucuccaaaauggacaucggcguaccgcuguuggcuauuggguguuacucucaggugaauccaaucacccugacagcagccuuacuacugcucgucgcgcacuacgcuauaauuggaccuggccuucaagccaaggcaacuagggaggcccagaaacgggcugccgcagguaucaugaagaaccccacgguggaugggaucaccguuauugaccuggaaccaauacccuaugauccuaaguuugagaaacaguugggccaggugaugcugcucauccugugcgucacacaaguacuuaugaugcguacuaccugggcuuuaugugaggcccugacacucgcgaccggaccgauuagcacuuugugggaaggcaaucccgggagauucuggaacacgacaaucgccguguccauggcaaauauuuuuaggggaucauaccuggcuggcgccggucuacuguucucuaucaugaagaacaccacaaguacccgccgggggacaggaaauauaggcgagacucucggugaaaaauggaagucgcgacuuaacgcacugggcaaaagcgaguuucagaucuauaagaaauccgggauucaggagguugacagaaccuuggcuaaggaaggaaucaagaggggcgagacagaucaucacgccgugucucgcgggucagccaaacugcggugguucgucgaaagaaacauggugacgccagagggaaaggucguggaccucggcugcggucgugggggauggagcuacuauuguggcggucugaaaaauguuagggaagugaagggcuuaaccaaagggggaccuggccaugaggagcccauuccuauguccacuuacggguggaaccuuguacggcugcaaaguggaguggaugucuuuuucacaccacccgaaaagugcgacacccuccuaugugauaucggcgagucuagcccuaauccaacuauagaagcgggucgcacacugcgaguuuugaaccugguggagaauuggcucaacaauaacacccaguucugcauuaagguccuuaaucccuauaugccgucagugaucgagaaaauggaggcucugcagagaaaguacgggggagcauugguaaggaacccucugucccggaauaguacgcacgagauguacugggugagcaacgccaccggcaauaucguuucuuccgugaacaugauuucacgcaugcucauaaauagauuuacaaugaaacacaagaaagcuacuuaugaaccagacgucgauuuaggcagcgggaccaggaacaucggaauugagucggaaauccccaaccuggacauuaucgguaagcgaauagagaagaucaaacaggaacaugagacaucuuggcacuacgaccaagaucauccuuauaagacuugggccuaccacggcaguuaugagaccaaacagacaggguccgcaagcucaauggugaauggagucgugcggcuucugaccaagccaugggacguuguacccauggugacucagauggccaugacggauacaaccccguucggccagcaacgugucuuuaaagaaaagguggacacuagaacccaggagccuaaggaagguacgaaaaagcuaaugaaaauuacagcugaguggcucuggaaggagcuggggaaaaagaaaaccccacgcauguguacuagggaagaguucacacggaagguuagauccaacgcggccuugggagcaaucuuuaccgaugaaaauaaguggaaaucugcucgcgaggccguggaagacggcagguucugggagcuggucgaucgagagcggaaccuccaccuugaaggcaagugcgagacuuguguguacaauaugauggggaaaagagaaaagaaacugggagaguuugguaaggcaaagggcagcagggccauuugguauaugugguuaggggcucgcuuccuggaauuugaggccuugggauuccucaacgaggaccauugguuuagucguggcaauucccugagcgguguagaaggggagggacuacaccggcuuggcuacauccugagagaugugucuaaaaaggaaggcggggcgauguacgcagacgauacagccggaugggacaccaggauuacacucgaggaccugaaaaacgaagagaugguuacuaaucauaugaagggugagcacaaaaaguuggcugaagccauauucaagcugaccuaucagaacaaagucgugcgcgugcagcgaccaacgccucggggcaccgucauggauaucauuucaagaagggaccaacgcgggaguggacagguuggcacauacggucucaauacuuuuaccaacauggaggcacagcuuaucagacaaauggaaggggagggaaucuucaaguccauucagcaucugacagcuacugaggaaauagugguacagaauugguuagcccgggugggcagggagcgucugagccgaauggcuaucucuggcgaugacugcgucgugaaacccauugaugaccgcuucgccucggcauugaccgcgcucaacgauauggggaagguuagaaaagacauccagcaaugggaaccaucacggggauggaaugauuggacacaggugcccuuuugcagccaccacuuccaugagcuggucaugaaggacgguagggugcuaguaguuccuugucgcaaccaggaugaacuuauuggcagagcccggaucucccagggggcuggauggagucugaaggagacagccugccucggcaaaucuuaugcacaaauguggacccugauguacuuucacaggcgagacuugcguuuagcugccaacgcaauauguagcgccgugccaucccauugggucccgacuucaagaacaaccuggaguauccacgcgaagcacgaguggaugacuaccgaagauaugcuggcuguguggaaucgcguguggauucaggagaaccccuggauggaagacaaaacaccugucgagucuugggaagagguuccauaucucgguaagcgggaggaccaguggugcgggagccuuaucggacugacguccagggccaccugggccaaaaauauucagacugccaucaaccaagugagaucacuaauaggcaaugaagaguacacagauuauaugcccagcaugaagcgcuuccggagggaagaggaagaggcuggcguacugugguga

SEQ ID NO: 14545 - RNA, 9876 nt, Artificial Sequence
  derived and/or modified CDS sequence (opt3) from DENV-2__FJ906956__SS-prME
accgccggcgugaucgucaugcugauucccacagcuauggcauuccaccucacuacgagaaacggggagccucauaugauaguuggaaagcaggaaaaagguaagagccuucuguuuaaaaccgaggacggcgugaauaugugcacauugauggccaucgauuuaggggaacugugugaggacacuauuaccuacaagugcccacuacucaggcaaaacgaaccggaggauaucgacuguuggugcaauuccacaucuaccuggguaacuuauggaacauguaccacgacuggcgagcaccggcgcgaaaaacgaucaguggcgcuggucccccauguggguauggggcuugagacccguacagaaacuuggaugaguagcgagggagcuuggaagcacguucagagaauugagaccuggauccugaggcauccuggcuucacaauaauggccgcaaucuuggccuacaccauuggcacgacucacuuucagcgggcucucaucuucauucugcugacagcaguggccccauccaugaccaugcgcugcaucgggauaucuaacagagauuuugucgaaggagugucggguggcucauggguagacauuguucucgagcacgggagcugugugacuacaauggcuaagaauaaacccaccuuagauuucgaacugaucaagacggaggccaaacagccugcgacccuuaggaaguauugcauugaagcaaaauugacaaacacuaccacagagagucgguguccaacucaaggagagcccucccugaaugaagagcaggacaagcgcuuuaucugcaagcauucuauggucgaucgaggcugggguaacggguguggacuauucggcaaaggcgggaucgugaccugcgccauguuuacaugcaagaaaaauauggaaggaaaggugguccagccugagaaccucgaauacaccauuguuauaacuccacacagcggugaggagcaugcugugggcaaugacacggggaaacacggaaaggaaaucaaaauuacaccgcaguccucaaucaccgaggccgaacugacuggcuaugguaccguaacaauggaguguagucccagaaccgggcuugauuucaacgaaauggugcuguugcaaauggaggacaaggcauggcucguccacaggcagugguuucuggauuuaccucugccauggcuccccggcgcugacacucagggaagcaauuggauacagaaggagacacuugugacguucaaaaacccucaugccaagaaacaagacguugugguccugggcucucaggaaggggcgaugcacaccgccuugacuggagcaacagagauucagauguccucagguaaucuacuguuuaccggccaucucaagugccggcugcguauggauaaacuucaacugaaggggaugagcuacaguauguguacaggaaaguucaaaaucgugaaggaaaucgcugagacucagcacggcaccauuguaauccgcguucaguaugagggugacgggucuccaugcaaaauucccuucgaaauaacggauuuggagaagagacaugugcucggcaggcugaucaccgucaacccgauugugacaggaaaagacuccccugucaacaucgaagccgagcccccauuuggcgauagcuacaucauuauagggguggaaccuggacaguuaaagcugaauugguucaagaaagguucgucuaucggccaaauguuugagacuaccaugcggggggcuaagcgaauggccauucuaggagacacagcaugggauuucggcucccucggugggguuuuuacuucaaucggcaaagcccugcaccagguguucggagcuauuuacggcgcggcauuuagugggguaagcuggaccaugaagauccuuauaggagucaucauuacguggaucggcaugaacucccgcucuacaagcuugucagugagucugguucucgugggugucgugacccuguaucuuggggccaugguacaggcugacuccggaugugugguuagcuggaaaaauaaggagcugaagugcggcucugguauuuucaucacugauaacguccacacauggaccgaacaguacaaauuucaacccgagucaccaaguaaguuggccagcgcaauacagaaagcccaugaagagggcauuugugggaucagauccgugacuaggcucgaaaaucugauguggaagcagauuacccccgaguuaaaccacauccugucugagaaugaagugaaacuaacaauaaugacgggagacauccggggcauuaugcaggcugggaagcgcucgcucagaccucaaccaaccgagcugaaauauagcuggaagacuuggggaaaggccaaaaugcuuuccacagaaucacauaaccagaccuucuugaucgauggcccggagacagcagaaugccccaauacuaacagggcguggaauagucuggaggucgaggacuacgguuuugggguuuucaccacgaacauuuggcucaagcugcgugaaaaacaggacguguuuugugauucuaaguuaaugagcgcugccaucaaagacaaucgggcagugcacgccgauaugggauauuggauagaguccgcucugaacgacacauggaagauggaaaaggccucauucauugagguaaaaagcugccacuggccuaagucucauacccuuugguccaauggcgucuuggagagugaaauggugaucccaaaaaacuucgcaggucccguuagccagcacaacuaccgaccuggcuaucauacucaaaccgcugggccauggcaccucggaaagcuggagauggauuuugaccuaugugaaggcacaacuguggucgugaccgaggauugcgggaauagaggacccucucugaggacaacgaccgccuccggcaaacucaucacugaauggugcugucgcucaugcacacugccgccucuucgguacagaggugaggacggguguugguacggaauggagauuaggccauugaaggaaaaggaggaaaaccugguuaauaguuuagugaccgcgggccauggucagaucgauaacuucagccucggcguacuggggauggcccuuuuucuggaggaaauguugcgcacucgaauuggaacaaaacacgcuauacuccuggucgcagugucguucgugacccuaaucacgggcaauauguccuuucgggaccuggggcgugucaugguuauggugggagccacuaugaccgaugacauuggcauggguguaacauaucucgcucugcuugccgcauucaaggugagacccaccuuugcggccggguugcuguuaaggaaacucacuucuaaggagcugaugauggcuacaaucggaauugcccuucugagccagucaaccaucccugagacaauacuagaacucacugaugcacuggcuuugggcaugaugguccugaaaaucgugcgcaacauggagaaguaccaauuagccguuaccauuauggcaaucaguugcgugcccaaugccgucauucuccagaacgcuuggaagguguccuguacgauccuggcggccguuucugugagcccacuucuguugacauccucacagcagaaagcagacuggauaccucucgcucugaccauuaagggccuaaaucccacugccaucuuccugaccacacuuagccggacuaguaaaaagagaucuuggccacucaacgaagccaucauggcugucgggaugguauccauucuggcaagcucguugcugaaaaaugacauaccgaugaccggaccuuuaguggccgguggccuccugacgguuugcuaugugcuuacagggaggucagcggaucuggaguuggaacgagcugccgacgucaagugggaggaucaagcagagaucucuggaaguucccccauucucagcaucaccauuucugaagacggcagcauguccaucaaaaacgaggaagaggagcagacucugacaauacuaauccgcaccggucugcuugugauuucagggguauuuccagugaguauccccauuacugccgcugcaugguaccucugggaagucaagaagcagcgggccggaguucugugggaugugccuagcccacccccuguggagaaagcggaauuggaggacggcgcuuauagaaucaagcagaggggcauauuaggguacucucaaauuggagccggugucuauaaagaaggcacauuccacaccauguggcaugugacgcguggggcaguucugaugcaccgcggaaagcggaucgagccguccugggccgauguaaaaaaggaccucaucucauacggcgguggguggaagcuggagggagaauggaaagagggcgaagaggugcagguccuugcucuggaaccaggcaagaaucccagagccgugcagacuaaaccugggauuuuuaagaccaacacaggaaccaucggugcaguuaguuuggauuucagcccaggcacauccgggucucccauaguggacaggaaaggaaaggucgugggccuauacgguaaugggguagucacucgaucgggagcuuaugugagcgccauugcgcagaccgagaagucaaucgaggauaacccugaaauugaggacgauaucuuucggaaaaagcgccugacgauaauggaccuccauccgggcgccggcaaaacaaagagauaccugcccgcaauuguuagggaagcuaucaaacgggggcuucgaacuuuaauccuggccccaaccagaguggucgcugcagagauggaagaggcccuccgcggauugccuauuagguaucaaacaaccgccaucaagacugagcacaccggucgugaaauuguggaccugaugugucaugcuacauucacgaugcggcuccugucccccguuagagugccaaacuacaaucuuauaaucauggaugaggcgcacuucacugacccugcaaguauugccgcuaggggcuauaucucuacccgcgucgaaaugggggaggccgcaggaaucuuuaugacagccacccccccaggcagccgagauccguucccucaguccaacgcucccauuauggacgaggaaagagagauaccagaacggucauggaauucuggucacgagugggugacugauuuuaaggggaaaacaguaugguucgugcccagcaucaaggcgggaaacgacauugccgcaugccugaggaaaaauggcaagcgcguuauccaguugagucguaaaaccuuugauuccgaauacgucaagacgagagcuaacgacugggauuucguggugacuacagacauuagcgagaugggcgccaauuuuaaggcagagcgggucaucgauccuaggcgcuguaugaaaccaguaauacuaaccgacggggaagagcgagugauccuggccggacccaugccuguuacccauucuucagcugcccaaagacgggguaggauuggccgcaacccgaagaaugaaaacgaccaguauaucuacaugggggagccacucgaaaaugaugaggacugcgcgcacuggaaagaggcaaagauguuacuggauaacauuaauacucccgaaggaaucauaccuuccauguucgagcccgaaagagagaaaguggacgccauugauggcgaauacaggcuucggggugaggcucguaagacauuugucgaccugaugcgccgaggggaucucccagugugguuggccuauaaaguugcugcagagggcaucaacuacgccgacagaaagugguguuucgauggaauuaagaauaaccagauccuggaagagaacauggaaguggagauauggaccaaagagggcgaaaggaagaaacucaagccucgguggcuggacgcucgcaucuauagugauccccuugcccuaaaagaguuuaaggaauucgcagcggggagaaagagccugacauugaauuuaauuacugagaugggaaggcugccaacguucaugacccagaaagcccggaacgcucucgacaaucuggccguccuucauacagcagaagcugguggccgagccuacaaccacgcacugucggagcucccugagacuuuggaaacccugcuacugcucacacuucuggccaccgugacugggggaaucuuuuuauucuugaugucuggcaaggguauugggaaaaugacgcugggcaugugcugcaucauaaccgcuuccauucuccugugguaugcgcaaauccagccgcacuggaucgccgcaagcauuauccuugaguuuuuccugauaguacucuugauucccgaaccagagaagcagagaacaccucaggauaaucaacugacuuacgugguuaucgcuauuuuaaccgucguggccgccacaauggcaaacgaaaugggauuucuagagaaaaccaagaaggaccugggccucgggucaaucacuacacaggagagugaaucuaauauacuugacaucgaucugcgccccgcuuccgccuggacguuguaugcgguggcuaccacuuucgucacaccaaugcugaggcauagcauugagaacucaaguguuaaugugagccucaccgccaucgcaaaccaggccaccguacugaugggacuugguaaaggcuggccucucuccaagauggacauuggggugccccuguuggcuaucggauguuacucucaggucaauccgauuacacugacugcagccuuacuacugcucguggcgcacuacgcuaucauaggcccaggucuucaagccaaagcaacgcgggaagcccagaagcgugcugccgcagggauuaugaaaaacccuaccguugauggcaucacagugaucgaccuggagcccauuccauaugaucccaaguuugaaaagcaguugggacaggucaugcugcucauacugugcguaacucaagugcuuaugaugagaaccacaugggcuuuaugugaggcccugacccucgcgacuggcccuaucagcacguugugggaggggaauccgggaagguucuggaacacaaccauugccguuuccauggcaaauaucuuucgcggcucauaccuggcuggugccgggcuacuguucucuauuaugaaaaacacuaccaauacacggcgaggaacuggcaacaucggugaaacccucggcgagaaguggaaaaguagacuuaacgcacuggggaagucggaauuucagauauauaaaaagagcggaauccaggagguggacaggacauuggcuaaagagggcauuaagcgcggggaaacggaucaucacgccgucucccggggaucugccaagcugagaugguucguggagcguaauauggucacccccgaaggcaaagugguugaccucgguugcgggaggggaggcuggucauacuauugugguggccugaagaacgugcgggagguaaaaggguuaacuaagggaggcccagggcaugaagagccuauccccaugagcacauacggauggaaucuugugcgccugcaauccggcgucgauguuuuuuucaccccuccagagaaaugcgacacucuccuaugugauauuggugaaaguucucccaacccuacaaucgaggcggggcgaacccugagaguguugaaucuggucgaaaacuggcucaauaacaauacgcaguucugcauaaaggugcuuaacccauauaugcccagcguaauugagaagauggaagcucugcagaggaaauacggaggcgcauuggugcggaauccgcugucacgcaacuccacccacgagauguacuggguuaguaaugccacaggcaacaucgugagcucugucaauaugaucuccagaaugcucauuaacagguuuacuaugaagcacaaaaaggcuaccuaugagccugacguggauuuagggucaggaacacgaaacauagguaucgaaagcgagauuccaaaucuggacaucauuggcaaacggaucgaaaagauaaagcaggagcaugaaacuucguggcacuacgaccaagaucaucccuauaaaaccugggccuaccacgggucuuaugagacaaagcagaccggaagugcauccagcauggucaacggcgugguucgucuucugacuaaaccuugggacguagugccaauggucacgcagauggccaugacagauaccacucccuucggucagcaaagaguguuuaaggagaaaguugacacccgcacacaggaaccgaaggaggggacgaagaaacuaaugaagaucaccgcugaauggcucuggaaagagcugggaaagaaaaagacuccuaggauguguacacgggaggaauucaccagaaaagugcgcucaaaugcggccuugggcgcaauuuuuacugaugagaacaaguggaaguccgcuagggaagccgucgaggacggccgauucugggaacugguggaucgggagagaaaucuccaccuugaggggaaaugcgaaacauguguauacaacaugaugggaaagagggagaaaaagcugggugaauuuggcaaagcaaaggggucucgcgccaucugguauaugugguuaggagcucguuuccuggaguuugaagccuugggcuuccucaaugaggaccauugguuuagccgggguaacagucuguccgggguggagggagaaggccuacacagacuuggcuacauucugagggauguugggaagaaagagggaggugcgauguacgcagacgauaccgccggcugggacacacgcaucacucucgaagaccugaagaaugaggaaauggucaccaaccauaugaaaggggagcacaagaaauuggcugaggccauuuucaagcugacguaucagaauaagguggugcgaguccagcggcccaccccaagaggaacaguuauggauauaaucagcaggcgcgaccaaagaggcucuggucagguggggacuuacggacucaacaccuuuacaaauauggaagcacagcuuauucggcaaauggagggcgaaggcaucuucaaaucaauccagcaucugacugcuaccgaggagauugccguacagaacugguuagcuaggguggggcgugaacgacugagucgcauggccauauccggagaugacugcgucgugaagccuaucgaugacagauucgcaagcgcguugacggcccucaaugauauggguaaaguucggaaggacauucagcaaugggagcccucuaggggcuggaacgauuggacacaggugccauuuugcucgcaccacuuccaugaacuggucaugaaagacgggcgcgugcuaguaguucccuguagaaaccaggaugagcuuaucggacgggcuaggauuucacagggcgccgguuggagccugaaggaaaccgcaugccucgggaaguccuaugcucaaauguggacucugauguacuuucaccgacgugacuugagauuagccgcaaaugccaucuguagugcggugccuucucauugggucccaacaagccgcaccacuugguccauacacgcuaaccacgaguggaugaccacagaggauaugcuggccguguggaaucggguguggauccaggaaaacccguggauggaggacaaaacgcccgucgaaucaugggaggaaguuccuuaucucggaaagagggaggaccaguggugcggcagucuuauuggccugaccucuagagcaacuugggccaaaaauauccagacagcuauuaaccaagugcgcagccuaaucgggaaugaggaauacaccgauuauaugccauccaugaagcgguucaggcgagaggaagaggaagccggaguacugugguga

SEQ ID NO: 14546 - RNA, 9876 nt, Artificial Sequence
  derived and/or modified CDS sequence (opt3) from DENV-2__EU482759__SS-prME
accgccggcgugaucgucaugcugauucccacagcuauggcauuccaccucacuacgagaaacggggagccucauaugauaguuggaaggcaggaaaaggguaaaagccuucuguuuaagaccgaggacggcgugaauaugugcacauugauggccaucgauuuaggggaacugugugaggacacuauuaccuacaaaugcccacuacuccggcaaaacgaaccggaggauaucgacuguuggugcaauuccacaucuaccuggguaacuuauggaacauguaccacgacuggcgagcaccgccgagaaaagcguucaguggcgcuggucccccauguggguauggggcuugagaccagaacagaaacuuggaugaguagcgagggagcuuggaaacacguucagaggauugagaccuggauccugcggcauccuggcuucacaauaauggccgcaaucuuggccuacaccauuggcacgacucacuuucagcgcgcucucaucuucauucugcugacagcaguggccccauccaugaccaugagaugcaucgggauaucuaacagggauuuugucgaaggagugucggguggcucauggguagacauuguucucgagcacgggagcugugugacuacaauggcuaagaauaagcccaccuuagauuucgaacugaucaaaacggaggccaagcagccugcgacccuucggaaauauugcauugaagcaaaguugacaaacacuaccacagagagucgcuguccaacucaaggagagcccucccugaaugaagagcaggacaaacgauuuaucugcaagcauucuauggucgauagaggcugggguaacggguguggacuauucggcaagggcgggaucgugaccugcgccauguuuacaugcaaaaagaauauggaaggaaaagugguccagccugagaaccucgaauacaccauuguuauaacuccacacagcggugaggagcaugcugugggcaaugacacggggaagcacggaaaagaaaucaagauuacaccgcaguccucaaucaccgaggccgaacugacuggcuaugguaccguaacaauggaguguagucccaggaccgggcuugauuucaacgaaauggugcuguugcaaauggaggacaaagcauggcucguccaccggcagugguuucuggauuuaccucugccauggcuccccggcgcugacacucagggaagcaauuggauacagaaggagacacuugugacguucaagaacccucaugccaaaaagcaagacguugugguccugggcucucaggaaggggcgaugcacaccgccuugacuggagcaacagagauucagauguccucagguaaucuacuguuuaccggccaucucaaaugccgucugcgcauggauaagcuucaacugaaagggaugagcuacaguauguguacaggaaaguucaagaucgugaaagaaaucgcugagacucagcacggcaccauuguaaucagaguucaguaugagggugacgggucuccaugcaagauucccuucgaaauaacggauuuggagaaaaggcaugugcucggccggcugaucaccgucaacccgauugugacagaaaaggacuccccugucaacaucgaggccgaacccccauuuggagauagcuacaucauuauaggcguggagccugggcaguuaaaacugaauugguucaagaagggaucgucuaucggucaaauguuugagacuaccaugcgaggcgcuaaacgcauggccauucuaggggacacagcaugggauuucggaucccucggcgguguuuuuacuucaaucgggaaggcccugcaccagguguucggcgcuauuuacggagcggcauuuaguggcguaagcuggaccaugaaaauccuuauaggggucaucauuacguggaucggaaugaacuccagaucuacaagcuugucagugagucugguucucgugggcgucgugacccuguaucuuggugccaugguacaggcugacuccgggugugugguuagcuggaagaauaaagaacugaagugcggaucuggcauuuucaucacugauaacguccacacauggaccgagcaguacaaguuucaacccgaaucaccaaguaaauuggccagcgcaauacagaaggcccaugaggaagguauuuguggcaucagguccgugacucggcucgagaaucugauguggaaacagauuacccccgaguuaaaccacauccugucugaaaaugaggugaagcuaacaauaaugacgggggacauccgcggaauuaugcaggcuggcaaaagaucgcucaggccucaaccaaccgaacugaaguauagcuggaaaacuugggggaaggccaagaugcuuuccacagagucacauaaccagaccuucuugaucgauggaccggaaacagcagagugccccaauacuaaccgugcguggaauagucuggaggucgaagacuacggcuuugguguuuucaccacgaacauuuggcucaaacugcgggagaagcaggacguguuuugugauucuaaauuaaugagcgcugccaucaaggacaaucgagcagugcacgccgauaugggguauuggauagaauccgcucugaacgacacauggaaaauggagaaggccucauucauugagguaaagagcugccacuggccuaaaucucauacccuuugguccaauggagucuuggaaagugagaugaucaucccaaagaacuucgcaggccccgugagccagcacaacuacagaccugguuaucauacucaaaccgcuggcccauggcaccucgggaaacuggaaauggauuuugaccuaugugagggaacaacuguuguggucaccgaagauugcggcaauagggggcccucucugcgcacaacgaccgccuccggaaagcucauuacugaguggugcugucggucaugcacacugccgccucuuagauacaggggcgaggacgguuguugguacgggauggaaauccgcccauugaaagagaaggaagagaaccuggugaauaguuuaguuaccgcgggacauggccagauugauaacuucagccucggugugcugggcauggcccuuuuucuggaagagauguugcgaacucggauagggacaaagcacgcuauccuccugguagcagucucguucgugacccuaauuacgggaaauauguccuuucgugaccugggcagagugauggucaugguuggggccacuaugaccgaugacaucggaaugggcgugacauaucucgcucugcuugccgcauucaaaguaaggcccaccuuugcggccgguuugcuguuacgcaagcucacuucuaaagagcugaugauggcuacaauugggaucgcccuucugagccagucaaccauaccugaaacaauccuagagcucacugaugcacuggcuuugggaaugauggugcugaagauuguccggaacauggaaaaauaccaauuagccgugaccaucauggcaauuaguugcguucccaaugccgugauccuccagaacgcuuggaaggucuccuguacgauacuggcggccgugucuguuagcccacuucuguugacauccucacagcagaaggcagacuggauuccucucgcucugaccaucaaaggccuaaaucccacugccaucuuccugaccacacuuagcagaacuaguaagaaaaggucuuggccacucaacgaggccauuauggcugugggcauggucuccauacuggcaagcucguugcugaagaaugacaucccgaugaccgggccuuuaguagccggaggucuccugacggugugcuauguucuuacaggccgaucagcggaucuggaauuggagcgcgcugccgacgugaaaugggaggaucaagcagaaauuucugggaguucccccauccucagcauuaccaucucugaggacggaagcauguccauaaagaacgaagaggaggaacagacucugacaauccuaauucggaccggccugcuugucaucucagguguguuuccaguaaguauucccaucacugccgcugcaugguaccucugggaggugaaaaagcagagagccgggguccugugggauguuccuagcccacccccuguggaaaaggcggaguuggaagacggagcuuauaggauaaaacagcguggcauuuuaggcuacucucaaaucggggccggaguguauaaggaggguacauuccacaccauguggcaugucacgcgcggcgcagugcugaugcaccgggggaaaagaaucgagccguccugggccgauguuaagaaagaccucauuucauacggaggcgguuggaagcuggaaggggaguggaaggaaggagaggaaguacaggugcuugcucuggagccaggcaaaaaucccagggccguccagacuaagccuggcaucuuuaaaaccaacacagggaccauaggagcagugaguuuggauuucagcccagguacauccggcucucccauuguugaccgaaaggggaaaguggucggacuauacggcaauggugugguaacucggucgggggcuuaugucagcgccaucgcgcagaccgagaagucaauugaagauaacccugagaucgaagacgauauauuucgcaagaaaagacugacgauuauggaccuccauccgggagccggcaagacaaaaagguaccugcccgcaaucgugcggggcgcuaucaagcgagggcuuagaacuuuaauucuggccccaacccgcguuguggcugcagagauggaagaggcccucaggggauugccuauccguuaucaaacaaccgccauuaaaacugagcacaccggucgggaaauagucgaccugaugugucaugcuacauucacgaugagacuccugucccccgugaggguuccaaacuacaaucuuaucauuauggaugaggcgcacuucacugacccugcaaguaucgccgcucgcggcuauaucucuacccgaguggaaaugggggaggccgcaggaauuuuuaugacagccacccccccaggcagcagagauccguucccucaguccaacgcucccauaauggacgaggaacgggagaucccagaaaggucauggaauucuggucacgagugggucacugauuuuaaggggaagacagugugguucguacccagcauuaaagcgggaaacgacaucgccgcaugccugcgcaagaauggcaaaaaggugauucaguugagucguaaaaccuuugauuccgaauacguuaagacgagagcuaacgacugggauuucgucgugacuacagacaucagcgagaugggcgccaauuuuaaggcagagcgggugauagauccuaggcgcuguaugaaaccagucauccuaaccgacggggaagagcgaguaauucuggccggacccaugccugugacccauucuucagcugcccaaagacgggguaggaucggccgcaacccgaagaaugaaaacgaccaguauauuuacaugggggagccacucgaaaaugaugaggacugcgcgcacuggaaagaggcaaagauguuacuggauaacaucaauacucccgaaggaauaauuccuuccauguucgagcccgaaagagagaaaguugacgccaucgauggcgaauacaggcuucggggugaggcucguaagacauuuguggaccugaugcgccgaggggaucucccagucugguuggccuauaaaguggcugcagagggcauuaacuacgccgacagaaagugguguuucgauggaaucaagaauaaccagauacuggaagagaacauggaaguugagaucuggaccaaagagggcgaaaggaagaaacucaagccucgguggcuggacgcucgcauuuauagugauccccuugcccuaaaagaguuuaaggaauucgcagcggggagaaagagccugacauugaauuuaaucacugagaugggaaggcugccaacguucaugacccagaaagcccggaacgcucucgacaaucuggccgugcuucauacagcagaagcugguggccgagccuacaaccacgcacugucggagcucccugagacuuuggaaacccugcuacugcucacacuucuggccaccgucacugggggaauuuuuuuauucuugaugucuggcaaggguaucgggaaaaugacgcugggcaugugcugcauaauuaccgcuuccauccuccugugguaugcgcaaauccagccgcacuggauugccgcaagcaucauacuugaguuuuuccugauugugcucuugauccccgaaccagagaagcagagaacaccucaggauaaucaacugacuuacguagugauugcuaucuuaaccguugucgccgccacaauggcaaacgaaaugggauuucuagagaaaaccaagaaggaccugggccucgggucaauaacuacacaggagagugaaucuaauauccuugacauugaucugcgccccgcuuccgccuggacguuguaugcgguggcuaccacuuucgugacaccaaugcugaggcauagcaucgagaacucaagugucaauguuagccucaccgccauugcaaaccaggccaccgugcugaugggacuugguaaaggcuggccucucuccaagauggacaucgggguaccccuguuggcuauuggauguuacucucaggugaauccgaucacacugacugcagccuuacuacugcucgucgcgcacuacgcuauaauuggcccaggucuucaagccaaagcaacgcgggaagcccagaagcgugcugccgcagggaucaugaaaaacccuaccguggauggcaucacaguuauugaccuggagcccauaccauaugaucccaaguuugaaaagcaguugggacaggugaugcugcucauccugugcgucacucaaguacuuaugaugagaaccacaugggcuuuaugugaggcccugacccucgcgacuggcccuauuagcacguugugggaggggaauccgggaagguucuggaacacaaccaucgccguguccauggcaaauauuuuucgcggcucauaccuggcuggugccgggcuacuguucucuaucaugaaaaacacuaccaauacacggcgaggaacuggcaacauaggugaaacccucggcgagaaguggaaaaguagacuuaacgcacuggggaagucggaauuucagaucuauaaaaagagcggaauucaggagguugacaggacauuggcuaaagagggcaucaagcgcggggaaacggaucaucacgccgugucccggggaucugccaagcugagaugguucgucgagcguaauauggugacccccgaaggcaaagucguggaccucgguugcgggaggggaggcuggucauacuauugugguggccugaagaacguucgggaggugaaaggguuaacuaagggaggcccagggcaugaagagccuauucccaugagcacauacggauggaaucuuguacgccugcaauccggcguggaugucuuuuucaccccuccagagaaaugcgacacucuccuaugugauaucggugaaaguucucccaacccuacaauagaggcggggcgaacccugagaguuuugaaucugguggaaaacuggcucaauaacaauacgcaguucugcauuaagguccuuaacccauauaugcccagcgugaucgagaagauggaagcucugcagaggaaauacggaggcgcauugguacggaauccgcugucacgcaacuccacccacgagauguacugggugaguaaugccacaggcaacaucguuagcucugugaauaugauuuccagaaugcucauaaacagguuuacuaugaagcacaaaaaggcuaccuaugagccugacgucgauuuagggucaggaacacgaaacaucgguauugaaagcgagaucccaaaucuggacauuaucggcaaacggauagaaaagaucaagcaggagcaugaaacuucguggcacuacgaccaagaucaucccuauaaaaccugggccuaccacgggucuuaugagacaaagcagaccggaagugcauccagcauggugaacggcgucgugcgucuucugacuaaaccuugggacguuguaccaauggugacgcagauggccaugacagauaccacucccuucggucagcaaagagucuuuaaggagaaaguggacacccgcacacaggaaccgaaggaggggacgaagaaacuaaugaagauuaccgcugaauggcucuggaaagagcugggaaagaaaaagacuccuaggauguguacacgggaggaauucaccagaaaaguucgcucaaaugcggccuugggcgcaaucuuuacugaugagaacaaguggaaguccgcuagggaagccguggaggacggccgauucugggaacuggucgaucgggagagaaaucuccaccuugaggggaaaugcgaaacauguguguacaacaugaugggaaagagggagaaaaagcugggugaauuuggcaaagcaaaggggucucgcgccauuugguauaugugguuaggagcucguuuccuggaguuugaagccuugggcuuccucaaugaggaccauugguuuagccgggguaacagucuguccgggguagagggagaaggccuacacagacuuggcuacauccugagggauguggggaagaaagagggaggugcgauguacgcagacgauaccgccggcugggacacacgcauuacucucgaagaccugaagaaugaggaaaugguuaccaaccauaugaaaggggagcacaagaaauuggcugaggccauauucaagcugacguaucagaauaaggucgugcgagugcagcggcccaccccaagaggaacagucauggauaucauuagcaggcgcgaccaaagaggcucuggucagguugggacuuacggacucaacaccuuuacaaauauggaagcacagcuuauccggcaaauggagggcgaaggcaucuucaaaucaauucagcaucugacugcuaccgaggagauagccgugcagaacugguuagcuaggguagggcgugaacgacugagucgcauggccaucuccggagaugacugcguggucaagccuauugaugacagauucgcaagcgcguugacggcccucaaugauauggguaaagugcggaaggacauccagcaaugggagcccucuaggggcuggaacgauuggacacagguuccauuuugcucgcaccacuuccaugaacuggugaugaaagacgggcgcguccuagugguacccuguagaaaccaggaugagcuuauuggacgggcuaggaucucacagggcgccgguuggagccugaaggaaaccgcaugccucgggaaguccuaugcucaaauguggacucugauguacuuucaccgacgugacuugagauuagccgcaaaugccauauguagugcgguuccuucucauugggugccaacaagccgcaccacuugguccauccacgcuaaacacgaguggaugaccacagaggauaugcuggccgucuggaaccggguguggauucaggaaaauccguggauggaggacaagacgcccguggaaucaugggaggaagucccuuaucucggaaaaagggaggaccaguggugcggcagucuuaucggccugaccucuagagcaacuugggccaagaacauucagacagcuaucaaucaaguucgcagccuaauagggaacgaggaauacaccgauuauaugccauccaugaaacgguucaggcgagaggaagaggaagccggagugcugugguga

SEQ ID NO: 14547 - RNA, 9876 nt, Artificial Sequence
  derived and/or modified CDS sequence (opt3) from DENV-2__EU482760__SS-prME
accgccggagugaucgucaugcugauucccacggcuauggcauuccaccucacuacgagaaauggggagccucauaugauaguuggaaggcaggaaaaggguaaaagccuucuguuuaagaccgaggacggcgugaauaugugcacauugauggccaucgauuuaggggaacugugugaggacacuauuaccuacaaaugcccacuacuccggcaaaacgaaccggaggauaucgacuguuggugcaauuccacaucuaccuggguaacuuauggaacaugugcgaccacgggcgagcaccgccgagaaaagcguucaguggcucuggucccccauguggguauggggcuugagacuaggaccgaaacauggaugaguagcgagggagccuggaaacacguucagaggauugagacuuggauccugcggcauccuggcuucaccauuauggcagccaucuuggcuuacacaauuggcaccacgcacuuucagcgcgcacucaucuucauucugcugacugccguggcuccauccaugacaaugagaugcaucgggauaucuaacagggauuuugucgaaggagugucggguggcucauggguagacauuguucucgagcacgggagcugugugaccacuauggccaagaauaagcccacauuagauuucgaacugaucaaaaccgaggcgaagcagccugcaacgcuucggaaauauugcauugaagccaaguugaccaacacaacuaccgagagucgcuguccaacacaaggagagcccucccugaaugaggaacaggacaaacgauuuaucugcaagcauucuauggucgauagaggcugggguaacggguguggacuauucggcaagggcgggaucgugacuugcgcuauguuuaccugcaaaaagaauauggaaggaaaagugguccagccugagaaccucgaauacacaauuguuauaaccccacacagcggugaggagcaugccgugggcaaugacacugggaagcacggaaaagaaaucaagauuacgccgcaguccucaaucacagaggcagaacugaccggcuaugguacuguaaccauggaguguagucccaggacagggcuugauuucaacgaaauggugcuguugcaaauggaggacaaggcuuggcucguccaccggcagugguuucuggauuuaccucugccauggcuccccggcgccgacacccagggaagcaauuggauacagaaggagacucuugugacauucaagaacccucaugcgaaaaagcaagacguugugguccugggcucucaggaaggggccaugcacacggcauugaccggagcuacugagauucagauguccucagguaaucuacuguuuacaggccaucucaaaugccgucugcgcauggauaaacuucaacugaaagggaugagcuacaguauguguaccggaaaguucaagaucgugaaagaaaucgccgagacacagcacggcacuauuguaaucagaguucaguaugagggugacgggucuccaugcaagauucccuucgaaauaaccgauuuggagaaaaggcaugugcucggccggcugaucacggucaacccgauugugaccgaaaaggacuccccugucaacaucgaggcugaacccccauuuggagauagcuacaucauuauaggcguggagccugggcaguuaaaacugaauugguucaagaagggaucgucuaucggucaaauguuugagacaacuaugcgaggcgccaaacgcauggcaauucuaggggacaccgccugggauuucggaucccucggcgguguuuuuacaucaaucgggaaggcucugcaccagguguucggcgcgauuuacggagcagccuuuaguggcguaagcuggacuaugaaaauccuuauaggggucaucauuaccuggaucggaaugaacuccagaucuacgagcuugucagugagucugguucucgugggcgucgugacacuguaucuuggugcuaugguacaggccgacuccgggugugugguuagcuggaagaauaaagaacugaagugcggaucuggcauuuucaucaccgauaacguccacacuuggacagagcaguacaaguuucaacccgaaucaccaaguaaauuggcaagcgccauacagaaggcucaugaggaagguauuuguggcaucagguccgugacccggcucgagaaucugauguggaaacagauuacucccgaguuaaaccacauccugucugaaaaugaggugaagcuaaccauaaugacaggggacauccgcggaauuaugcaggccggcaaaagaucgcucaggccucaaccaacggaacugaaguauagcuggaaaaccugggggaaggcaaagaugcuuuccacugagucacauaaccagacauucuugaucgauggaccggaaaccgcggagugccccaauacaaaccgugcuuggaauagucuggaggucgaagacuacggcuuugguguuuucacuaccaacauuuggcucaaacugcgggagaagcaggacguguuuugugauucuaaauuaaugagcgccgcaaucaaggacaaucgagccgugcacgcugauaugggguauuggauagaauccgcccugaacgacacguggaaaauggagaaggcaucauucauugagguaaagagcugccacuggccuaaaucucauacacuuugguccaauggagucuuggaaagugagaugaucaucccaaagaacuucgcuggccccgugagccagcacaacuacagaccugguuaucauacccaaacugccggcccauggcaccucgggaaacuggaaauggauuuugaccuaugugagggaaccacaguuguggucacugaagauugcggcaauagggggcccucucugcgcaccacaacggcguccggaaagcucauuaccgaguggugcugucggucaugcacucugccgccucuuagauacaggggcgaggacgguuguugguacgggauggaaauccgcccauugaaagagaaggaagagaaccuggugaauaguuuaguuacagccggacauggccagauugauaacuucagccucggugugcugggcauggcucuuuuucuggaagagauguugcgaacccggauagggacuaagcacgcaauccuccugguagccgucucguucgugacacuaauuaccggaaauauguccuuucgugaccugggcagagugauggucaugguuggggcuacgaugacugaugacaucggaaugggcgugaccuaucucgcccugcuugcagcguucaaaguaaggcccacauuugccgcugguuugcuguuacgcaagcucaccucuaaagagcugaugauggccacuauugggaucgcacuucugagccagucaacaauaccugaaaccauccuagagcucacagaugcucuggccuugggaaugauggugcugaagauuguccggaacauggaaaaauaccaauuagcagugacuaucauggccauuaguugcguucccaaugcugugauccuccagaacgcguggaaggucuccuguaccauacuggccgcagugucuguuagcccacuucuguugacguccucacagcagaaggcugacuggauuccucucgcccugacaaucaaaggccuaaaucccaccgccaucuuccugacuacccuuagcagaacaaguaagaaaaggucuuggccacucaacgaggcuauuauggcagugggcauggucuccauacuggccagcucguugcugaagaaugacaucccgaugacugggccuuuaguagcgggaggucuccugaccgugugcuauguucuuacgggccgaucagcugaucuggaauuggagcgcgccgcagacgugaaaugggaggaucaagccgaaauuucugggaguucccccauccucagcauuacaaucucugaggacggaagcauguccauaaagaacgaagaggaggaacagacccugacuauccuaauucggacaggccugcuugucaucucagguguguuuccaguaaguauucccaucaccgcugcagccugguaccucugggaggugaaaaagcagagagcggggguccugugggauguuccuagcccacccccuguggaaaaggcugaguuggaagacggagccuauaggauaaaacagcguggcauuuuaggcuacucucaaaucggggcaggaguguauaaggaggguacuuuccacacaauguggcaugucacccgcggcgccgugcugaugcaccgggggaaaagaaucgagccguccugggcugauguuaagaaagaccucauuucauacggaggcgguuggaagcuggaaggggaguggaaggaaggagaggaaguacaggugcuugcccuggagccaggcaaaaaucccagggcaguccagacgaagccuggcaucuuuaaaacuaacaccgggacaauaggagcugugaguuuggauuucagcccagguaccuccggcucucccauuguugaccgaaaggggaaaguggucggacuauacggcaauggugugguaacacggucgggggccuaugucagcgcgaucgcccagacugagaagucaauugaagauaacccugagaucgaagacgauauauuucgcaagaaaagacugaccauuauggaccuccauccgggagcaggcaagacgaaaagguaccugcccgcuaucgugcgggaggccaucaagcgaggccuuagaacauuaauucuggcuccaacucgcguuguggcagccgaaauggaggaggcccucaggggguugccuauccguuaucaaaccacagcuauuaaaaccgaacacacuggacgggagauagucgaccugaugugucaugcgaccuucacaaugagacuccugucccccgugaggguuccaaacuacaaucuuaucauuauggaugaagcacacuucacggacccugccaguaucgcugcccgcgguuauaucucuacucgaguggagaugggcgaggcagccgggauuuuuaugaccgcuacacccccaggaagcagagauccguucccucaguccaacgcgcccauaauggacgaagaacgggaaaucccagagaggucauggaacucuggccacgaaugggucaccgauuuuaaggguaagacugugugguucguacccagcauuaaagccgggaacgacaucgcagcuugccugcgcaagaauggcaagaaggugauucaguugagucguaaaacauuugauuccgaguacguuaagaccagagccaacgacugggauuucgucgugacgacugacaucagcgagaugggcgcaaauuuuaaggccgaacgggugauagauccuaggcgcuguaugaaaccagucauccuaacagacggcgaggaacgaguaauucuggcugggcccaugccugugacccauucuucagccgcgcaaagacggggaaggaucggucgcaacccgaagaaugagaacgaccaguauauuuacaugggcgaaccacucgagaaugaugaggacugcgcacacuggaaagaagccaagauguuacuggauaacaucaauacccccgaggggauaauuccuuccauguucgaacccgagagagaaaaaguugacgcuaucgauggagaguacaggcuucggggcgaggcccguaagacuuuuguggaccugaugcgccgaggugaucucccagucugguuggcuuauaaaguggcagccgaagggauuaacuacgcugacagaaagugguguuucgauggcaucaagaauaaccagauacuggaggaaaacauggagguugagaucuggacaaaagaaggagagaggaagaaacucaagccucgguggcuggacgcccgcauuuauagugauccccuugcacuaaaagaauuuaaggaguucgcggccggcagaaagagccugaccuugaauuuaaucacagaaauggggaggcugccaacuuucaugacgcagaaagcucggaacgcccucgacaaucuggcagugcuucauaccgcugaggccggaggucgagcauacaaccacgcccugucggagcucccugaaacauuggagacucugcuacugcucacccuucuggcuacagucaccggcgggauauuuuuauucuugaugucuggaaagggcaucgguaaaaugacucuggggaugugcugcauaauuacggcguccauccuccugugguaugcccaaauccagccgcacuggauugcagcuagcaucauacuugaauuuuuccugauugugcucuugauccccgagccagaaaagcagagaaccccucaggauaaucaacugacauacguagugauugccaucuuaacuguugucgccgcaaccauggcuaacgagaugggcuuucuagagaaaacaaagaaggaccugggacucggcucaauaaccacucaggaaagugagucuaauauccuugacauugaucugcgccccgccuccgcguggacauuguaugcuguggccacgaccuucgugacuccaaugcugaggcauagcaucgaaaacucaagugucaauguuagccucacagcaauugccaaccaggcuaccgugcugauggggcuuggaaaagguuggccucucuccaagauggacaucggcguaccccuguuggcaauuggguguuacucucaggugaauccgaucacccugacagccgcguuacuacugcucgucgcucacuacgccauaauuggaccaggccuucaagcaaaagccacucgggaggcucagaagcgugccgcagcugguaucaugaaaaacccuacgguggaugggaucaccguuauugaccuggaacccauaccauaugaucccaaguuugagaagcaguugggccaggugaugcugcucauccugugcgucacacaaguacuuaugaugagaacuaccugggccuuaugugaggcgcugacacucgccaccggaccuauuagcacuuugugggaaggcaauccggggagguucuggaacacgacaaucgcaguguccauggcuaauauuuuucgcggaucauaccuggccggcgcaggucuacuguucucuaucaugaaaaacaccacuaauacccggcgagggacaggaaacauaggcgagacucucggugaaaaguggaaaaguagacuuaacgcucugggcaagucggaguuucagaucuauaaaaagagcgggauucaggagguugacaggaccuuggccaaagaaggaaucaagcgcggcgagacagaucaucacgccgugucccgggggucugcgaagcugagaugguucgucgaacguaauauggugacgcccgagggaaaagucguggaccucggcugcgguagagggggauggucauacuauuguggcggucugaagaacguucgggaagugaaaggcuuaaccaaagggggaccaggccaugaggagccuauucccaugagcacuuacggguggaaucuuguacgccugcaauccggaguggaugucuuuuucacaccuccagaaaaaugcgacacccuccuaugugauaucggcgagaguucucccaacccuacuauagaagcuggucgaacacugagaguuuugaaucugguggagaacuggcucaauaacaauacccaguucugcauuaagguccuuaacccauauaugcccagcgugaucgaaaagauggaggcacugcagaggaaauacgggggagccuugguacggaauccgcugucacgcaacuccacgcacgagauguacugggugaguaaugcuaccggcaacaucguuagcucugugaauaugauuuccagaaugcucauaaacagguuuacaaugaagcacaaaaaggccacuuaugaaccugacgucgauuuaggcucagggacccgaaacaucggaauugagagcgaaaucccaaaucuggacauuaucgguaaacggauagagaagaucaagcaggaacaugagacaucguggcacuacgaccaagaucaucccuauaaaacuugggcauaccacggcucuuaugagaccaagcagacagggagugccuccagcauggugaacggagucgugcgucuucugaccaaaccuugggacguuguaccaauggugacucagauggcuaugacggauacaacccccuucggccagcaaagagucuuuaaggaaaaaguggacacucgcacccaggagccgaaggaagguacaaagaaacuaaugaagauuacggcggaguggcucuggaaagagcuggggaagaaaaagaccccuaggauguguacucgggaagaguucacaagaaaaguucgcucaaaugccgcauugggagcuaucuuuaccgaugaaaacaaguggaaguccgccagggaggcaguggaagacggccgauucugggagcuggucgaucgggagagaaaucuccaccuugaaggcaaaugcgagacuuguguguacaacaugauggggaagagggagaaaaagcugggagaguuugguaaagccaagggcucucgcgcuauuugguauaugugguuaggggcccguuuccuggaauuugaggcguugggauuccucaaugaggaccauugguuuagccggggcaacagucuguccgguguagaaggggagggacuacacagacuuggcuacauccugagggaugugggcaagaaagaagggggagcaauguacgccgacgauacagcugguugggacacccgcauuacacucgaggaccugaagaaugaagagaugguuacuaaccauaugaaaggcgagcacaagaaauuggccgaagcaauauucaagcugaccuaucagaauaaggucgugcgagugcagcggcccacgccaagagggaccgucauggauaucauuagcaggcgcgaccaaagaggaucuggccagguugguacauacgggcucaacacuuuuaccaauauggaggcucagcuuauccggcaaauggaaggagagggcaucuucaaaucaauucagcaucugacagccacugaggaaauagcugugcagaacugguuagccaggguaggccgugagcgacugagucgcauggcaaucuccggggaugacugcguggucaagccuauugaugacagauucgcgagcgccuugaccgcucucaaugauaugggaaaaauccggaaggacauucagcaaugggaacccucuagggguuggaacgauuggacacaggugccauuuugcucgcaccacuuccaugagcugguuaugaaagacggccgcgugcuagucgugcccuguagaaaccaggaugaacuuaucgggcgggccaggauaucacagggagcaggcuggagccugaaggagacagcuugccucgguaaguccuaugcccaaauguggacccugauguacuuucaccgacgugacuugagauuagcagccaaugcgaucuguagugcuguaccuucucauuggguuccaacuagccgcacaaccugguccauucacgccaaacacgaguggaugacuaccgaagauaugcuggcaguguggaaccgggucuggauccaggagaauccguggauggaagacaagacacccguggagucaugggaagaggugccuuaucucgggaaaagggaggaccaguggugcggaagucuuauuggccugacgucuagagccaccugggcuaagaacauccagacugccauaaaucaaguccgcagccuaauuggcaacgaagaguacacagauuauaugccauccaugaaacgguucaggcgagaagaggaagaggcagggguucugugguga

SEQ ID NO: 14548 - RNA, 9876 nt, Artificial Sequence
  derived and/or modified CDS sequence (opt3) from DENV-2__EU482762__SS-prME
accgccggagugaucgucaugcugauucccacagcuauggcauuccaccucacuacgagaaauggggagccucauaugauaguuggaaggcaggaaaaggguaaaagccuucuguuuaagaccgaggacggcgugaauaugugcaccuugauggccaucgauuuaggggaacugugugaggacacuauuaccuacaaaugcccacuacuccggcaaaacgaaccggaggauaucgacuguuggugcaauuccacaucuaccuggguaacuuauggaacauguaccacgacuggcgagcaccgccgagaaaagcguucaguggcgcuggucccccauguggguauggggcuugagaccaggacagaaacuuggaugaguagcgagggagcuuggaaacacguucagaggauugagaccuggauccugcggcauccuggcuucacaauuauggccgcaaucuuggccuacaccauuggcacgacucacuuucagcgcgcucucaucuucauucugcugacagcaguggccccauccaugaccaugagaugcaucgggauaucuaacagggauuuugucgaaggagugucggguggcucauggguagacauuguucucgagcacgggagcugugugacuacaauggcuaagaauaagcccaccuuagauuucgaacugaucaaaacggaggccaagcagccugcgacccuucggaaauauugcauugaagcaaaguugacaaacacuaccacagagagucgcuguccaacucaaggagagcccucccugaaugaggaacaggacaaacgauuuaucugcaagcauucuauggucgauagaggcugggguaacggguguggacuauucggcaagggcgggaucgugaccugcgccauguuuacaugcaaaaagaauauggaaggaaaagugguccagccugagaaccucgaauacaccauuguuauaacuccacacagcggugaggagcaugcugugggcaaugacacggggaagcacggaaaagaaaucaagauuacaccgcaguccucaaucaccgaggccgaacugacuggcuaugguaccguaacaauggaguguagucccaggaccgggcuugauuucaacgaaauggugcuguugcaaauggaggacaaagcauggcucguccaccggcagugguuucuggauuuaccucugccauggcuccccggcgcugacacucagggaagcaauuggauacagaaggagacacuugugacguucaagaacccucaugccaaaaagcaagacguugugguccugggcucucaggaaggggcgaugcacaccgccuugacuggagcaacagagauucagauguccucagguaaucuacuguuuaccggccaucucaaaugccgucugcgcauggauaaacuucaacugaaagggaugagcuacaguauguguacaggaaaguucaagaucgugaaagaaaucgcugagacucagcacggcaccauuguaaucagaguucaguaugagggugacgggucuccaugcaagauucccuucgaaauaacggauuuggagaaaaggcaugugcucggccggcugaucaccgucaacccgauugugacagaaaaggacuccccugucaacaucgaggccgaacccccauuuggagauagcuacaucauuauaggcguggagccugggcaguuaaaacugaauugguucaagaagggaucgucuaucggucaaauguuugagacuaccaugcgaggcgcuaaacgcauggccauucuaggggacacagcaugggauuucggaucccucggcgguguuuuuacuucaaucgggaaggcccugcaccagguguucggcgcuauuuacggagcggcauuuaguggcguaagcuggaccaugaaaauccuuauaggggucaucauuacguggaucggaaugaacuccagaucuacuagcuugucagugagucugguucucgugggcgucgugacccuguaucuuggugccaugguacaggcugacuccgggugugugguuagcuggaagaauaaagaacugaagugcggaucuggcauuuucaucacugauaacguccacacauggaccgagcaguacaaguuucaacccgaaucaccaaguaaauuggccagcgcaauacagaaggcccaugaggaagguauuuguggcaucagguccgugacucggcucgagaaucugauguggaaacagauuacccccgaguuaaaccacauccugucugaaaaugaggugaagcuaacaauaaugacgggggacauccgcggaauuaugcaggcuggcaaaagaucgcucaggccucaaccaaccgaacugaaguauagcuggaaaacuugggggaaggccaagaugcuuuccacagagucacauaaccagaccuucuugaucgauggaccggaaacagcagagugccccaauacuaaccgugcguggaauagucuggaggucgaagacuacggcuuugguguuuucaccacgaacauuuggcucaaacugcgggagaagcaggacguguuuugugauucuaaauuaaugagcgcugccaucaaggacaaucgagcagugcacgccgauaugggguauuggauagaauccgcucugaacgacacauggaaaauggagaaggccucauucauugagguaaagagcugcuacuggccuaaaucucacacccuuugguccaauggagucuuggaaagugagaugaucaucccaaagaacuucgcaggccccgugagccagcauaacuauagaccugguuaccacacucaaaccgcuggcccauggcaucucgggaaacuggaaauggauuuugaccuaugugagggaacaacuguuguggucaccgaagauugcggcaauagggggcccucucugcgcacaacgaccgccuccggaaagcucauuacugaguggugcugucggucaugcacacugccgccucuuagauacaggggcgaggacgguuguugguaugggauggaaauccgcccauugaaagagaaggaagagaaccuggugaauaguuuaguuaccgcgggacacggccagauugauaacuucagccucggugugcugggcauggcccuuuuucuggaagagauguugcgaacucggauagggacaaagcaugcuauccuccugguagcagucucguucgugacccuaauuacgggaaauauguccuuucgugaccugggcagagugauggucaugguuggggccacuaugaccgaugacaucggaaugggcgugacauaccucgcucugcuugccgcauucaaaguaaggcccaccuuugcggccgguuugcuguuacgcaagcucacuucuaaagagcugaugauggcuacaauugggaucgcccuucugagccagucaaccauaccugaaacaauccuagagcucacugaugcacuggcuuugggaaugauggugcugaagauuguccggaacauggaaaaauaucaauuagccgugaccaucauggcaauuaguugcguucccaaugccgugauccuccagaacgcuuggaaggucuccuguacgauacuggcggccgugucuguuagcccacuucuguugacauccucacagcagaaggcagacuggauuccucucgcucugaccaucaaaggccuaaaucccacugccaucuuccugaccacacuuagcagaacaaguaagaaaaggucuuggccacucaacgaggccauuauggcugugggcauggucuccauacuggcaagcucguugcugaagaaugacaucccgaugaccgggccuuuaguagccggaggucuccugacggugugcuacguucuuacaggccgaucagcggaucuggaauuggagcgcgcugccgacgugaaaugggaggaucaagcagaaauuucugggaguucccccauccucagcauuaccaucucugaggacggaagcauguccauaaagaacgaagaggaggaacagacucugacaauccuaauucggaccggccugcuugucaucucagguguguuuccaguaaguauucccaucacugccgcugcaugguaucucugggaggugaaaaagcagagagccgggguccugugggauguuccuagcccacccccuguggaaaaggcggaguuggaagacggagcuuacaggauaaaacagcguggcauuuuaggcuauucucaaaucggggccggaguguacaaggaggguacauuccacaccauguggcacgucacgcgcggcgcagugcugaugcaucgggggaaaagaaucgagccguccugggccgauguuaagaaagaccucauuucauacggaggcgguuggaagcuggaaggggaguggaaggaaggagaggaaguacaggugcuugcucuggagccaggcaaaaaucccagggccguccagacuaagccuggcaucuuuaaaaccaacacagggaccauaggagcagugaguuuggauuucagcccagguacauccggcucucccauuguugaccgaaaggggaaaguggucggacuauauggcaauggugugguaacucggucgggggcuuacgucagcgccaucgcgcagaccgagaagucaauugaagauaacccugagaucgaagacgauauauuucgcaagaaaagacugacgauuauggaccuccacccgggagccggcaagacaaaaagguaucugcccgcaaucgugcgggaggcuaucaagcgaggccuuagaacuuuaauucuggccccaacccgcguuguggcugcagaaauggaggaggcccucaggggguugccuauccguuaccaaacaaccgccauuaaaacugaacauaccggacgggagauagucgaccugaugugucacgcuacauucacgaugagacuccugucccccgugaggguuccaaacuauaaucuuaucauuauggaugaagcgcauuucacugacccugcaaguaucgccgcucgcgguuacaucucuacccgaguggagaugggcgaggccgcagggauuuuuaugacagccacacccccaggaagcagagauccguucccucaguccaacgcucccauaauggacgaagaacgggaaaucccagagaggucauggaacucuggccacgaaugggucacugauuuuaaggguaagacagugugguucguacccagcauuaaagcggggaacgacaucgccgcaugccugcgcaagaauggcaagaaggugauucaguugagucguaaaaccuuugauuccgaguauguuaagacgagagcuaacgacugggauuucgucgugacuacagacaucagcgagaugggcgccaauuuuaaggcagaacgggugauagauccuaggcgcuguaugaaaccagucauccuaaccgacggcgaggaacgaguaauucuggccgggcccaugccugugacccacucuucagcugcccaaagacggggaaggaucggucgcaacccgaagaaugagaacgaccaguacauuuacaugggcgaaccacucgagaaugaugaggacugcgcgcauuggaaagaagcaaagauguuacuggauaacaucaauacucccgaggggauaauuccuuccauguucgaacccgagagagaaaaaguugacgccaucgauggagaguauaggcuucggggcgaggcucguaagacauuuguggaccugaugcgccgaggugaucucccagucugguuggccuacaaaguggcugcagaagggauuaacuaugccgacagaaagugguguuucgauggcaucaagaauaaccagauacuggaggaaaacauggagguugagaucuggaccaaagaaggagagaggaagaaacucaagccucgguggcuggacgcucgcauuuacagugauccccuugcccuaaaagaauuuaaggaguucgcagcgggcagaaagagccugacauugaauuuaaucacugaaauggggaggcugccaacguucaugacccagaaagcccggaacgcucucgacaaucuggccgugcuucacacagcagaggcuggaggucgagccuauaaccaugcacugucggagcucccugaaacuuuggagacccugcuacugcucacacuucuggccaccgucacuggcgggauauuuuuauucuugaugucuggaaagggcaucgguaaaaugacgcuggggaugugcugcauaauuaccgcuuccauccuccugugguacgcgcaaauccagccgcacuggauugccgcaagcaucauacuugaauuuuuccugauugugcucuugauccccgagccagaaaagcagagaacaccucaggauaaucaacugacuuauguagugauugcuaucuuaaccguugucgccgccacaauggcaaacgagaugggcuuucuagagaaaaccaagaaggaccugggacucggcucaauaacuacacaggaaagugagucuaauauccuugacauugaucugcgccccgcuuccgccuggacguuguacgcgguggcuaccacuuucgugacaccaaugcugaggcacagcaucgaaaacucaagugucaauguuagccucaccgccauugcaaaccaggccaccgugcugauggggcuuggaaaagguuggccucucuccaagauggacaucggcguaccccuguuggcuauuggguguuacucucaggugaauccgaucacacugacugcagccuuacuacugcucgucgcgcauuaugcuauaauuggaccaggccuucaagccaaagcaacgcgggaggcccagaagcgugcugccgcagguaucaugaaaaacccuaccguggaugggaucacaguuauugaccuggaacccauaccauacgaucccaaguuugagaagcaguugggccaggugaugcugcucauccugugcgucacucaaguacuuaugaugagaaccacaugggcuuuaugugaggcccugacccucgcgacuggaccuauuagcacguugugggaaggcaauccggggagguucuggaacacaaccaucgccguguccauggcaaauauuuuucgcggaucauaucuggcuggcgccggucuacuguucucuaucaugaaaaacacuaccaauacacggcgagggacuggaaacauaggcgagacccucggugaaaaguggaaaaguagacuuaacgcacugggcaagucggaguuucagaucuacaaaaagagcgggauucaggagguugacaggacauuggcuaaagaaggaaucaagcgcggcgagacggaucaccaugccgugucccgggggucugccaagcugagaugguucgucgaacguaauauggugacccccgagggaaaagucguggaccucggcugcgguagagggggauggucauauuacuguggcggucugaagaacguucgggaagugaaaggcuuaacuaaagggggaccaggccacgaggagccuauucccaugagcacauauggguggaaucuuguacgccugcaauccggaguggaugucuuuuucaccccuccagaaaaaugcgacacucuccuaugugauaucggcgagaguucucccaacccuacaauagaagcgggucgaacccugagaguuuugaaucugguggagaacuggcucaauaacaauacgcaguucugcauuaagguccuuaacccauacaugcccagcgugaucgaaaagauggaggcucugcagaggaaauacgggggagcauugguacggaauccgcugucacgcaacuccacccaugagauguauugggugaguaaugccacaggcaacaucguuagcucugugaauaugauuuccagaaugcucauaaacagguuuacuaugaagcacaaaaaggcuaccuacgaaccugacgucgauuuaggcucagggacacgaaacaucggaauugagagcgaaaucccaaaucuggacauuaucgguaaacggauagagaagaucaagcaggaacacgagacuucguggcauuaugaccaagaucaccccuacaaaaccugggccuaucauggcucuuacgagacaaagcagaccgggagugcauccagcauggugaacggagucgugcgucuucugacuaaaccuugggacguuguaccaauggugacgcagauggccaugacagauaccacucccuucggccagcaaagagucuuuaaggaaaaaguggacacccgcacacaggagccgaaggaagguacgaagaaacuaaugaagauuaccgcugaguggcucuggaaagagcuggggaagaaaaagacuccuaggauguguacacgggaagaguucaccagaaaaguucgcucaaaugcggccuugggagcaaucuuuacugaugaaaacaaguggaaguccgcuagggaggccguggaagacggccgauucugggagcuggucgaucgggagagaaaucuccaccuugaaggcaaaugcgagacauguguguauaacaugauggggaagagggagaagaagcugggagaguuugguaaagcaaagggcucucgcgccauuugguacaugugguuaggggcucguuuccuggaauuugaggccuugggauuccucaaugaggaccacugguuuagccggggcaacagucuguccgguguagaaggggagggacuacauagacuuggcuacauccugagggaugugggcaagaaagaagggggagcgauguaugcagacgauaccgccgguugggacacacgcauuacucucgaggaccugaagaaugaagagaugguuaccaaccacaugaaaggcgagcauaagaaauuggcugaagccauauucaagcugacguaccagaauaaggucgugcgagugcagcggcccaccccaagagggacagucauggauaucauuagcaggcgcgaccaaagaggaucuggccagguugguacuuaugggcucaacaccuuuacaaauauggaggcacagcuuauccggcaaauggaaggagagggcaucuucaaaucaauucagcaccugacugcuaccgaggaaauagccgugcagaacugguuagcuaggguaggccgugagcgacugagucgcauggccaucuccggggaugacugcguggucaagccuauugaugacagauucgcaagcgcguugacggcccucaaugauaugggaaaagugcggaaggacauccagcaaugggaacccucuagggguuggaacgauuggacacagguuccauuuugcucgcaucacuuccacgagcuggugaugaaagacggccgcguccuagugguacccuguagaaaccaggaugaacuuauugggcgggcuaggaucucacagggagccggcuggagccugaaggagaccgcaugccucgguaaguccuacgcucaaauguggacucugauguauuuucaucgacgugacuugagauuagccgcaaaugccauauguagugcgguuccuucucacugggugccaacaagccgcaccacuugguccauccaugcuaaacacgaguggaugaccacagaagauaugcuggccgucuggaaccggguguggauucaggagaauccguggauggaagacaagacgcccguggagucaugggaagaggucccuuaccucgggaaaagggaggaccaguggugcggaagucuuaucggccugaccucuagagcaacuugggccaagaacauucagacagcuaucaaucaaguucgcagccuaauaggcaacgaagaguauaccgauuacaugccauccaugaaacgguucaggcgagaagaggaagaggccggggugcugugguga

SEQ ID NO: 14549 - RNA, 9876 nt, Artificial Sequence
  derived and/or modified CDS sequence (opt3) from DENV-2__EU482763__SS-prME
accgccggagugaucgucaugcugauucccacagcuauggcauuccaccucacuacgagaaauggggagccucauaugauaguuggaaggcaggaaaaggguaaaagccuucuguuuaagaccgaggacggcgugaauaugugcaccuugauggccauggauuuaggggaacugugugaggacacuaucaccuacaaaugcccacuacuccggcaaaacgaaccggaggauauugacuguuggugcaauuccacaucuaccuggguaacuuauggaacauguaccacgacuggcgagcaccgccgagaaaagcguucaguggcgcuggucccccauguggguauggggcuugagaccaggacagaaacuuggaugaguagcgagggagcuuggaaacacguucagaggaucgagaccuggauucugcggcauccuggcuucacaaucauggccgcaauauuggccuacaccaucggcacgacucacuuucagcgcgcucucauuuucauccugcugacagcaguggccccauccaugaccaugagaugcauugggaucucuaacagggauuuugucgaaggagugucggguggcucauggguagacauaguucucgagcacgggagcugugugacuacaauggcuaagaauaagcccaccuuagauuucgaacugauuaaaacggaggccaagcagccugcgacccuucggaaauauugcaucgaagcaaaguugacaaacacuaccacagagagucgcuguccaacucaaggagagcccucccugaaugaggaacaggacaaacgauuuauuugcaagcauucuauggucgauagaggcugggguaacggguguggacuauucggcaagggcgggaucgugaccugcgccauguuuacaugcaaaaagaauauggaaggaaaagugguccagccugagaaccucgaauacaccaucguuauuacuccacacagcggugaggagcaugcugugggcaaugacacggggaagcacggaaaagaaauaaagaucacaccgcaguccucaauuaccgaggccgaacugacuggcuaugguaccguaacaauggaguguagucccaggaccgggcuugauuucaacgaaauggugcuguugcaaauggaggacaaagcauggcucguccaccggcagugguuucuggauuuaccucugccauggcuccccggcgcugacacucagggaagcaauuggauccagaaggagacacuugugacguucaagaacccucaugccaaaaagcaagacguugugguccugggcucucaggaaggggcgaugcacaccgccuugacuggagcaacagagauacagauguccucagguaaucuacuguuuaccggccaucucaaaugccgucugcgcauggauaaacuucaacugaaagggaugagcuacaguauguguacaggaaaguucaagauugugaaagaaaucgcugagacucagcacggcaccaucguaauuagaguucaguaugagggugacgggucuccaugcaagauccccuucgaaauuacggauuuggagaaaaggcaugugcucggccggcugauaaccgucaacccgaucgugacagaaaaggacuccccugucaacauugaggccgaacccccauuuggagauagcuacaucaucauuggcguggagccugggcaguuaaaacugaauugguucaagaagggaucgucuauaggucaaauguuugagacuaccaugcgaggcgcuaaacgcauggccauccuaggggacacagcaugggauuucggaucccucggcgguguuuuuacuucaauugggaaggcccugcaccagguguucggcgcuaucuacggagcggcauuuaguggcguaagcuggaccaugaaaauucuuaucggggucauaaucacguggauuggaaugaacuccagaucuacuagcuugucagugagucugguucucgugggcgucgugacccuguaucuuggugccaugguacaggcugacuccgggugugugguuagcuggaagaauaaagaacugaagugcggaucuggcaucuucauuacugauaacguccacacauggaccgagcaguacaaguuucaacccgaaucaccaaguaaauuggccagcgcaauccagaaggcccaugaggaagguauauguggcauuagguccgugacucggcucgagaaucugauguggaaacagaucacccccgaguuaaaccacauucugucugaaaaugaggugaagcuaacaaucaugacgggggacauacgcggaaucaugcaggcuggcaaaagaucgcucaggccucaaccaaccgaacugaaguauagcuggaaaacuugggggaaggccaagaugcuuuccacagagucacauaaccagaccuucuugauugauggaccggaaacagcagagugccccaauacuaaccgugcguggaauagucuggaggucgaagacuacggcuuugguguuuucaccacgaacaucuggcucaaacugcgggagaagcaggacguguuuugugauucuaaauuaaugagcgcugccauuaaggacaaucgagcagugcacgccgauaugggguauuggaucgaauccgcucugaacgacacauggaaaauggagaaggccucauucauagagguaaagagcugccacuggccuaaaucucauacccuuugguccaauggagucuuggaaagugagaugauuaucccaaagaacuucgcaggccccgugagccagcacaacuacagaccugguuaucauacucaaaccgcuggcccauggcaccucgggaaacuggaaauggauuuugaccuaugugagggaacaacuguuguggucaccgaagauugcggcaauagggggcccucucugcgcacaacgaccgccuccggaaagcucaucacugaguggugcugucggucaugcacacugccgccucuuagauacaggggcgaggacgguuguugguacgggauggaaauucgcccauugaaagagaaggaagagaaccuggugaauaguuuaguuaccgcgggacauggccagaucgauaacuucagccucggugugcugggcauggcccuuuuucuggaagagauguugcgaacucggauugggacaaagcacgcuauacuccugguagcagucucguucgugacccuaaucacgggaaauauguccuuucgugaccugggcagagugauggucaugguuggggccacuaugaccgaugacauuggaaugggcgugacauaucucgcucugcuugccgcauucaaaguaaggcccaccuuugcggccgguuugcuguuacgcaagcucacuucuaaagagcugaugauggcuacaaucgggauugcccuucugagccagucaaccaucccugaaacaauacuagagcucacugaugcacuggcuuugggaaugauggugcugaagaucguccggaacauggaaaaauaccaauuagccgugaccauuauggcaaucaguugcguucccaaugccgugauucuccagaacgcuuggaaggucuccuguacgauccuggcggccgugucuguuagcccacuucuguugacauccucacagcagaaggcagacuggauaccucucgcucugaccauuaaaggccuaaaucccacugccaucuuccugaccacacuuagcagaacaaguaagaaaaggucuuggccacucaacgaggccaucauggcugugggcauggucuccauucuggcaagcucguugcugaagaaugacauaccgaugaccgggccuuuaguagccggaggucuccugacggugugcuauguucuuacaggccgaucagcggaucuggaauuggagcgcgcugccgacgugaaaugggaggaucaagcagaaaucucugggaguucccccauucucagcaucaccauuucugaggacggaagcauguccaucaagaacgaagaggaggaacagacucugacaauacuaauccggaccggccugcuugucauuucagguguguuuccaguaaguauccccauuacugccgcugcaugguaccucugggaggugaaaaagcagagagccgggguccugugggauguuccuagcccacccccuguggaaaaggcggaguuggaagacggagcuuauaggaucaaacagcguggcauauuaggcuacucucaaauuggggccggaguguauaaggaggguacauuccacaccauguggcaugucacgcgcggcgcagugcugaugcaccgggggaaaagaaucgagccguccugggccgauguuaagaaagaccucaucucauacggaggcgguuggaagcuggaaggggaguggaaggaaggagaggaaguacaggugcuugcucuggagccaggcaaaaaucccagggccguccagacuaagccuggcauuuuuaaaaccaacacagggaccaucggagcagugaguuuggauuucagcccagguacauccggcucucccauaguugaccgaaaggggaaaguggucggacuauacggcaauggugugguaacucggucgggggcuuaugucagcgccauugcgcagaccgagaagucaaucgaagauaacccugagauugaagacgauaucuuucgcaagaaaagacugacgauaauggaccuccauccgggagccggcaagacaaaaagguaccugcccgcaauugugcgggaggcuaucaagcgaggccuuagaacuuuaauccuggccccaacccgcguuguggcugcagaaauggaggaggcccucaggggguugccuauucguuaucaaacaaccgccaucaaaacugaacacaccggacgggagauugucgaccugaugugucaugcuacauucacgaugagacuccugucccccgugaggguuccaaacuacaaucuuauaaucauggaugaagcgcacuucacugacccugcaaguauugccgcucgcgguuauaucucuacccgaguggagaugggcgaggccgcagggaucuuuaugacagccacacccccaggaagcagagauccguucccucaguccaacgcucccauuauggacgaagaacgggaaauaccagagaggucauggaacucuggccacgaaugggucacugauuuuaaggguaagacagugugguucguacccagcaucaaagcggggaacgacauugccgcaugccugcgcaagaauggcaagaaggugauccaguugagucguaaaaccuuugauuccgaguacguuaagacgagagcuaacgacugggauuucgucgugacuacagacauuagcgagaugggcgccaauuuuaaggcagaacgggugaucgauccuaggcgcuguaugaaaccagucauacuaaccgacggcgaggaacgaguaauccuggccgggcccaugccugugacccauucuucagcugcccaaagacggggaaggauuggucgcaacccgaagaaugagaacgaccaguauaucuacaugggcgaaccacucgagaaugaugaggacugcgcgcacuggaaagaagcaaagauguuacuggauaacauuaauacucccgaggggaucauaccuuccauguucgaacccgagagagaaaaaguugacgccauugauggagaguacaggcuucggggcgaggcucguaagacauuuguggaccugaugcgccgaggugaucucccagucugguuggccuauaaaguggcugcagaagggaucaacuacaccgacagaaagugguguuucgauggcauuaagaauaaccagauccuggaggaaaacauggagguugagauauggacaaaagaaggagagaggaagaaacucaagccucgguggcuggacgcccgcaucuauagugauccccuugcucuaaaagaauuuaaggaguucgccgcaggcagaaagagccugacuuugaauuuaauuacggaaauggggaggcugccaaccuucaugacacagaaagcgcggaacgcccucgacaaucuggcugugcuucauacugccgaggcaggaggucgagcuuacaaccacgcccugucggagcucccugaaaccuuggagacacugcuacugcucacccuucuggcaacugucacgggcgggaucuuuuuauucuugaugucuggaaagggcauugguaaaaugacccuggggaugugcugcaucauaacagccuccauucuccugugguaugcucaaauccagccgcacuggaucgcggccagcauuauccuugaauuuuuccugauagugcucuugauucccgagccagaaaagcagagaacuccucaggauaaucaacugaccuacguagugaucgcaauuuuaacaguugucgcugccaccauggccaacgagaugggcuuucuagagaaaacuaagaaggaccugggacucggcucaaucacaacgcaggaaagugagucuaauauacuugacaucgaucugcgccccgcauccgcuuggaccuuguaugccguggcgacuacauucgugaccccaaugcugaggcauagcauugaaaacucaagugucaauguuagccucaccgcuaucgccaaccaggcaacagugcugauggggcuuggaaaagguuggccucucuccaagauggacauuggcguaccccuguuggccaucggguguuacucucaggugaauccgauuacucugacggcugcauuacuacugcucgucgcccacuacgcgaucauaggaccaggccuucaagcuaaagccacccgggaggcacagaagcgugccgcugccgguauuaugaaaaacccuacaguggaugggaucacuguuaucgaccuggaacccauuccauaugaucccaaguuugagaagcaguugggccaggugaugcugcucauacugugcgucacccaaguacuuaugaugagaacaaccugggcauuaugugaggcucugacucucgccacgggaccuaucagcacauugugggaaggcaauccggggagguucuggaacaccacuauugcgguguccauggccaauaucuuucgcggaucauaccuggcaggcgcuggucuacuguucucuauuaugaaaaacaccacaaauacucggcgagggaccggaaacaucggcgagacacucggugaaaaguggaaaaguagacuuaacgcccugggcaagucggaguuucagauauauaaaaagagcgggauccaggagguugacaggacguuggcaaaagaaggaauuaagcgcggcgagaccgaucaucacgcugugucccgggggucugccaagcugagaugguucgucgaacguaauauggugacucccgagggaaaagucguggaccucggcugcgguagagggggauggucauacuauuguggcggucugaagaacguucgggaagugaaaggcuuaacaaaagggggaccaggccaugaggagccuauccccaugagcaccuacggguggaaucuuguacgccugcaauccggaguggaugucuuuuucacuccuccagaaaaaugcgacacacuccuaugugauauuggcgagaguucucccaacccuaccaucgaagccggucgaacgcugagaguuuugaaucugguggagaacuggcucaauaacaauacccaguucugcauaaagguccuuaacccauauaugcccagcgugauugaaaagauggaggcgcugcagaggaaauacgggggagcuuugguacggaauccgcugucacgcaacuccacacacgagauguacugggugaguaaugcaacuggcaacaucguuagcucugugaauaugaucuccagaaugcucauuaacagguuuaccaugaagcacaaaaaggccacauaugaaccugacgucgauuuaggcucagggacucgaaacauaggaaucgagagcgaaauuccaaaucuggacaucauugguaaacggaucgagaagauaaagcaggaacaugagaccucguggcacuacgaccaagaucaucccuauaaaacaugggcuuaccacggcucuuaugagaccaagcagacugggagugccuccagcauggugaacggagucgugcgucuucugacgaaaccuugggacguuguaccaauggugacacagauggcaaugaccgauacuacccccuucggccagcaaagagucuuuaaggaaaaaguggacacacgcacgcaggagccgaaggaagguaccaagaaacuaaugaagaucacugccgaguggcucuggaaagagcuggggaagaaaaagacaccuaggauguguacccgggaagaguucacuagaaaaguucgcucaaaugcugcguugggagccauuuuuacagaugaaaacaaguggaaguccgcaagggaggcuguggaagacggccgauucugggagcuggucgaucgggagagaaaucuccaccuugaaggcaaaugcgagaccuguguguacaacaugauggggaagagggagaagaagcugggagaguuugguaaagccaagggcucucgcgcaaucugguauaugugguuaggggcccguuuccuggaauuugaggcuuugggauuccucaaugaggaccauugguuuagccggggcaacagucuguccgguguagaaggggagggacuacacagacuuggcuacauucugagggaugugggcaagaaagaagggggagccauguacgcggacgauacagcagguugggacacucgcaucacccucgaggaccugaagaaugaagagaugguuacgaaccauaugaaaggcgagcacaagaaauuggccgaagcuauuuucaagcugaccuaucagaauaaggucgugcgagugcagcggcccacaccaagagggacugucauggauauaaucagcaggcgcgaccaaagaggaucuggccagguugguaccuacgggcucaacacauuuacuaauauggaggcccagcuuauucggcaaauggaaggagagggcaucuucaaaucaauccagcaucugaccgcaacggaggaaauugcugugcagaacugguuagccaggguaggccgugagcgacugagucgcauggcuauauccggggaugacugcguggucaagccuaucgaugacagauucgccagcgcauugacagcgcucaaugauaugggaaaagugcggaaggacauucagcaaugggaacccucuagggguuggaacgauuggacccagguuccauuuugcucgcaccacuuccaugagcuggugaugaaagacggccgcguccuagugguacccuguagaaaccaggaugaacuuaucgggcgggccaggauuucacagggagcuggcuggagccugaaggagacugccugccucgguaaguccuaugcacaaauguggacacugauguacuuucaccgacgugacuugagauuagcugccaaugcaaucuguagugccguuccuucucauugggugccaaccagccgcacuaccugguccauacacgcgaaacacgaguggaugacaacggaagauaugcuggcugucuggaaccggguguggauccaggagaauccguggauggaagacaagacccccguggagucaugggaagaggucccuuaucucgggaaaagggaggaccaguggugcggaagucuuauuggccugacuucuagagccacaugggcaaagaacauccagaccgccauuaaucaaguucgcagccuaaucggcaacgaagaguacacugauuauaugccauccaugaaacgguucaggcgagaagaggaagaggcuggggugcugugguga

SEQ ID NO: 14550 - RNA, 9876 nt, Artificial Sequence
  derived and/or modified CDS sequence (opt3) from DENV-2__EU482444__SS-prME
accgccggagugaucgucaugcugauucccacggcuauggcauuccaccucacuacgagaaauggggagccucauaugauaguuggaaggcaggaaaaggguaaaagccuucuguuuaagaccgaggacggcgugaauaugugcaccuugauggccauggauuuaggggaacugugugaggacacuaucaccuacaaaugcccacuacuccggcaaaacgaaccggaggauauugacuguuggugcaauuccacaucuaccuggguaacuuauggaacauguaccacgacuggcgagcaccgccgagaaaagcguucaguggcgcuggucccccauguggguauggggcuugagaccaggacagaaacuuggaugaguagcgagggagcuuggaaacacguucagaggaucgagaccuggauucugcggcauccuggcuucacaaucauggccgcaauauuggccuacaccaucggcacgacucacuuucagcgcgcucucauuuucauccugcugacagcaguggccccauccaugaccaugagaugcauugggaucucuaacagggauuuugucgaaggagugucggguggcucauggguagacauaguucucgagcacgggagcugugugacuacaauggcuaagaauaagcccaccuuagauuucgaacugauuaaaacggaggccaagcagccugcgacccuucggaaauauugcaucgaagcaaaguugacaaacacuaccacagagagucgcuguccaacucaaggagagcccucccugaaugaggaacaggacaaacgauuuauuugcaagcauucuauggucgauagaggcugggguaacggguguggacuauucggcaagggcgggaucgugaccugcgccauguuuacaugcaaaaagaauauggaaggaaaagugguccagccugagaaccucgaauacaccaucguuauuacuccacacagcggugaggagcaugcugugggcaaugacacggggaagcacggaaaagaaauaaagaucacaccgcaguccucaauuaccgaggccgaacugacuggcuaugguaccguaacaauggaguguagucccaggaccgggcuugauuucaacgaaauggugcuguugcaaauggaggacaaagcauggcucguccaccggcagugguuucuggauuuaccucugccauggcuccccggcgcugacacucagggaagcaauuggauccagaaggagacacuugugacguucaagaacccucaugccaaaaagcaagacguugugguccugggcucucaggaaggggcgaugcacaccgccuugacuggagcaacagagauacagauguccucagguaaucuacuguuuaccggccaucucaaaugccgucugcgcauggauaaacuucaacugaaagggaugagcuacaguauguguacaggaaaguucaagauugugaaagaaaucgcugagacucagcacggcaccaucguaauuagaguucaguaugagggugacgggucuccaugcaagauccccuucgaaauuacggauuuggagaaaaggcaugugcucggccggcugauaaccgucaacccgaucgugacagaaaaggacuccccugucaacauugaggccgaacccccauuuggagauagcuacaucaucauuggcguggagccugggcaguuaaaacugaauugguucaagaagggaucgucuauaggucaaauguuugagacuaccaugcgaggcgcuaaacgcauggccauccuaggggacacagcaugggauuucggaucccucggcgguguuuuuacuucaauugggaaggcccugcaccagguguucggcgcuaucuacggagcggcauuuaguggcguaagcuggaccaugaaaauucuuaucggggucauaaucacguggauuggaaugaacuccagaucuacuagcuugucagugagucugguucucgugggcgucgugacccuguaucuuggugccaugguacaggcugacuccgggugugugguuagcuggaagaauaaagaacugaagugcggaucuggcaucuucauuacugauaacguccacacauggaccgagcaguacaaguuucaacccgaaucaccaaguaaauuggccagcgcaauccagaaggcccaugaggaagguauauguggcauuagguccgugacucggcucgagaaucugauguggaaacagaucacccccgaguuaaaccacauucugucugaaaaugaggugaagcuaacaaucaugacgggggacauacgcggaaucaugcaggcuggcaaaagaucgcucaggccucaaccaaccgaacugaaguauagcuggaaaacuugggggaaggccaagaugcuuuccacagagucacauaaccagaccuucuugauugauggaccggaaacagcagagugccccaauacuaaccgugcguggaauagucuggaggucgaagacuacggcuuugguguuuucaccacgaacaucuggcucaaacugcgggagaagcaggacguguuuugugauucuaaauuaaugagcgcugccauuaaggacaaucgagcagugcacgccgauaugggguauuggaucgaauccgcucugaacgacacauggaaaauggagaaggccucauucauagagguaaagagcugccacuggccuaaaucucauacccuuugguccaauggagucuuggaaagugagaugauuaucccaaagaacuucgcaggccccgugagccagcacaacuacagaccugguuaucauacucaaaccgcuggcccauggcaccucgggaaacuggaaauggauuuugaccuaugugagggaacaacuguuguggucaccgaagauugcggcaauagggggcccucucugcgcacaacgaccgccuccggaaagcucaucacugaguggugcugucggucaugcacacugccgccucuuagauacaggggcgaggacgguuguugguacgggauggaaauucgcccauugaaagagaaggaagagaaccuggugaauaguuuaguuaccgcgggacauggccagaucgauaacuucagccucggugugcugggcauggcccuuuuucuggaagagauguugcgaacucggauugggacaaagcacgcuauacuccugguagcagucucguucgugacccuaaucacgggaaauauguccuuucgugaccugggcagagugauggucaugguuggggccacuaugaccgaugacauuggaaugggcgugacauaucucgcucugcuugccgcauucaaaguaaggcccaccuuugcggccgguuugcuguuacgcaagcucacuucuaaagagcugaugauggcuacaaucgggauugcccuucugagccagucaaccaucccugaaacaauacuagagcucacugaugcacuggcuuugggaaugauggugcugaagaucguccggaacauggaaaaauaccaauuagccgugaccauuauggcaaucaguugcguucccaaugccgugauucuccagaacgcuuggaaggucuccuguacgauccuggcggccgugucuguuagcccacuucuguugacauccucacagcagaaggcagacuggauaccucucgcucugaccauuaaaggccuaaaucccacugccaucuuccugaccacacuuagcagaacaaguaagaaaaggucuuggccacucaacgaggccaucauggcugugggcauggucuccauucuggcaagcucguugcugaagaaugacauaccgaugaccgggccuuuaguagccggaggucuccugacggugugcuauguucuuacaggccgaucagcggaucuggaauuggagcgcgcugccgacgugaaaugggaggaucaagcagaaaucucugggaguucccccauucucagcaucaccauuucugaggacggaagcauguccaucaagaacgaagaggaggaacagacucugacaauacuaauccggaccggccugcuugucauuucagguguguuuccaguaaguauccccauuacugccgcugcaugguaccucugggaggugaaaaagcagagagccgggguccugugggauguuccuagcccacccccuguggaaaaggcggaguuggaagacggagcuuauaggaucaaacagcguggcauauuaggcuacucucaaauuggggccggaguguauaaggaggguacauuccacaccauguggcaugucacgcgcggcgcagugcugaugcaccgggggaaaagaaucgagccguccugggccgauguuaagaaagaccucaucucauacggaggcgguuggaagcuggaaggggaguggaaggaaggagaggaaguacaggugcuugcucuggagccaggcaaaaaucccagggccguccagacuaagccuggcauuuuuaaaaccaacacagggaccaucggagcagugaguuuggauuucagcccagguacauccggcucucccauaguugaccgaaaggggaaaguggucggacuauacggcaauggugugguaacucggucgggggcuuaugucagcgccauugcgcagaccgagaagucaaucgaagauaacccugagauugaagacgauaucuuucgcaagaaaagacugacgauaauggaccuccauccgggagccggcaagacaaaaagguaccugcccgcaauugugcgggaggcuaucaagcgaggccuuagaacuuuaauccuggccccaacccgcguuguggcugcagaaauggaggaggcccucaggggguugccuauucguuaucaaacaaccgccaucaaaacugaacacaccggacgggagauugucgaccugaugugucaugcuacauucacgaugagacuccugucccccgugaggguuccaaacuacaaucuuauaaucauggaugaagcgcacuucacugacccugcaaguauugccgcucgcgguuauaucucuacccgaguggagaugggcgaggccgcagggaucuuuaugacagccacacccccaggaagcagagauccguucccucaguccaacgcucccauuauggacgaagaacgggaaauaccagagaggucauggaacucuggccacgaaugggucacugauuuuaaggguaagacagugugguucguacccagcaucaaagcggggaacgacauugccgcaugccugcgcaagaauggcaagaaggugauccaguugagucguaaaaccuuugauuccgaguacguuaagacgagagcuaacgacugggauuucgucgugacuacagacauuagcgagaugggcgccaauuuuaaggcagaacgggugaucgauccuaggcgcuguaugaaaccagucauacuaaccgacggcgaggaacgaguaauccuggccgggcccaugccugugacccauucuucagcugcccaaagacggggaaggauuggucgcaacccgaagaaugagaacgaccaguauaucuacaugggcgaaccacucgagaaugaugaggacugcgcgcacuggaaagaagcaaagauguuacuggauaacauuaauacucccgaggggaucauaccuuccauguucgaacccgagagagaaaaaguugacgccauugauggagaguacaggcuucggggcgaggcucguaagacauuuguggaccugaugcgccgaggugaucucccagucugguuggccuauaaaguggcugcagaagggaucaacuacgccgacagaaagugguguuucgauggcauuaagaauaaccagauccuggaggaaaacauggagguugagauauggaccaaagaaggagagaggaagaaacucaagccucgguggcuggacgcucgcaucuauagugauccccuugcccuaaaagaauuuaaggaguucgcagcgggcagaaagagccugacauugaauuuaauuacugaaauggggaggcugccaacguucaugacccagaaagcccggaacgcucucgacaaucuggccgugcuucauacagcagaggcuggaggucgagccuacaaccacgcacugucggagcucccugaaacuuuggagacccugcuacugcucacacuucuggccaccgucacuggcgggaucuuuuuauucuugaugucuggaaagggcauugguaaaaugacgcuggggaugugcugcaucauaaccgcuuccauucuccugugguaugcgcaaauccagccgcacuggaucgccgcaagcauuauccuugaauuuuuccugauagugcucuugauucccgagccagaaaagcagagaacaccucaggauaaucaacugacuuacguagugaucgcuauuuuaaccguugucgccgccacaauggcaaacgagaugggcuuucuagagaaaaccaagaaggaccugggacucggcucaaucacuauacaggaaagugagucuaauauccuugacauugaucugcgccccgcuuccgccuggacauuguaugcgguggcuacgaccuucgugacuccaaugcugaggcauagcaucgaaaacucaagugucaauguuagccucacagccauugcaaaccaggccaccgugcugauggggcuuggaaaagguuggccucucuccaagauggacaucggcguaccccuguuggcuauuggguguuacucucaggugaauccgaucacccugacagcagccuuacuacugcucgucgcgcacuacgcuauaauuggaccaggccuucaagccaaagcaacucgggaggcccagaagcgugcugccgcagguaucaugaaaaacccuacgguggaugggaucaccguuauugaccuggaacccauaccauaugaucccaaguuugagaagcaguugggccaggugaugcugcucauccugugcgucacacaaguacuuaugaugagaacuaccugggcuuuaugugaggcccugacacucgcgaccggaccuauuagcacuuugugggaaggcaauccggggagguucuggaacacgacaaucgccguguccauggcaaauauuuuucgcggaucauaccuggcuggcgccggucuacuguucucuaucaugaaaaacaccacuaauacccggcgagggacaggaaacauaggcgagacucucggugaaaaguggaaaaguagacuuaacgcacugggcaagucggaguuucagaucuauaaaaagagcgggauucaggagguugacaggaccuuggcuaaagaaggaaucaagcgcggcgagacagaucaucacgccgugucccgggggucugccaagcugagaugguucgucgaacguaauauggugacgcccgagggaaaagucguggaccucggcugcgguagagggggauggucauacuauuguggcggucugaagaacguucgggaagugaaaggcuuaaccaaagggggaccaggccaugaggagccuauucccaugagcacuuacggguggaaucuuguacgccugcaauccggaguggaugucuuuuucacaccuccagaaaaaugcgacacccuccuaugugauaucggcgagaguucucccaacccuacuauagaagcgggucgaacacugagaguuuugaaucugguggagaacuggcucaauaacaauacccaguucugcauuaagguccuuaacccauauaugcccagcgugaucgaaaagauggaggcucugcagaggaaauacgggggagcauugguacggaauccgcugucacgcaacuccacgcacgagauguacugggugaguaaugccaccggcaacaucguuagcucugugaauaugauuuccagaaugcucauaaacagguuuacaaugaagcacaaaaaggcuacuuaugaaccugacgucgauuuaggcucagggacccgaaacaucggaauugagagcgaaaucccaaaucuggacauuaucgguaaacggauagagaagaucaagcaggaacaugagacaucguggcacuacgaccaagaucaucccuauaaaacuugggccuaccacggcucuuaugagaccaagcagacagggagugcauccagcauggugaacggagucgugcgucuucugaccaaaccuugggacguuguaccaauggugacucagauggccaugacggauacaacccccuucggccagcaaagagucuuuaaggaaaaaguggacacucgcacccaggagccgaaggaagguacaaagaaacuaaugaagauuacggcugaguggcucuggaaagagcuggggaagaaaaagaccccuaggauguguacucgggaagaguucacaagaaaaguucgcucaaaugcggccuugggagcaaucuuuaccgaugaaaacaaguggaaguccgcuagggaggccguggaagacggccgauucugggagcuggucgaucgggagagaaaucuccaccuugaaggcaaaugcgagacuuguguguacaacaugauggggaagagggagaagaagcugggagaguuugguaaagcaaagggcucucgcgccauuugguauaugugguuaggggcucguuuccuggaauuugaggccuugggauuccucaaugaggaccauugguuuagccggggcaacagucuguccgguguagaaggggagggacuacacagacuuggcuacauccugagggaugugggcaagaaagaagggggaguuauguacgcggacgauacagcagguugggacacccgcauuacacucgaggaccugaagaaugaagaguuggucacuaaccauaugaaaggcgagcacaagaaacuggccgaagcuauauucaagcucaccuaucagaauaagguggugcgaguccagcggcccacgccaagagggaccguuauggauaucauuagcaggcgcgaccaaagaggaucuggccagguggguacauacgggcuuaacacuuuuaccaauauggaggcccagcugauccggcaaauggaaggagagggcaucuucaaaucaauucagcauuuaacagcaacugaggaaauagcuguacagaacuggcuggccagggugggccgugagcgauugagucgcauggcuaucuccggggaugacugcgucgugaagccuauugaugacagauucgccagcgcacucaccgcgcugaaugauaugggaaaaguucggaaggacauccagcaaugggaacccucuagggguuggaacgauuggacacaggugccauuuugcucgcaccacuuccaugagcuagucaugaaagacggccgcgugcuuguaguucccuguagaaaccaggaugaacugauugggcgggccaggaucucacagggagcuggcuggagccucaaggagacagccugccuggguaaguccuaugcacaaauguggaccuugauguacuuucaccgacgugacuuaagacuggcugccaaugcaauauguagugccgugccuucucauugggucccaacuagccgcacaaccugguccauccacgcgaaacacgaguggaugacuaccgaagauaugcucgcuguguggaaccggguguggauucaggagaauccguggauggaagacaagacacccgucgagucaugggaagagguuccuuaucuugggaaaagggaggaccaguggugcggaagucugaucggccuaacgucuagagccaccugggcaaagaacauucagacugccaucaaucaagugcgcagccugauaggcaacgaagaguacacagauuauaugccauccaugaaacgguucaggcgagaagaggaagaggcugggguacucugguga

SEQ ID NO: 14551 - RNA, 9876 nt, Artificial Sequence
  derived and/or modified CDS sequence (opt3) from DENV-2__EU482684__SS-prME
accgccggcgugaucgucaugcugauucccacagcuauggcauuccaccucacuacgagaaacggggagccucauaugauaguuggaaggcaggaaaaggguaaaagccuucuguuuaagaccgaggacggcgugaauaugugcacauugauggccaucgauuuaggggaacugugugaggacacuauuaccuacaaaugcccacuacuccggcaaaacgaaccggaggauaucgacuguuggugcaauuccacaucuaccuggguaacuuauggaacauguaccacgacuggcgagcaccgccgagaaaagcguucaguggcgcuggucccccauguggguauggggcuugagaccagaacagaaacuuggaugaguagcgagggagcuuggaaacacguucagaggauugagaccuggauccugcggcauccuggcuucacaauaauggccaccaucuuggcauacacgauuggcacuacacacuuucagcgcgcccucaucuucauucugcugaccgcuguggcaccauccaugacuaugagaugcaucgggauaucuaacagggauuuugucgaaggagugucggguggcucauggguagacauuguucucgagcacgggagcugugugacaaccauggccaagaauaagcccacguuagauuucgaacugaucaaaaccgaggcuaagcagccugccacacuucggaaauauugcauugaagcgaaguugacuaacaccacaacugagagucgcuguccaacccaaggagagcccucccugaaugaagagcaggacaaacgauuuaucugcaagcauucuauggucgauagaggcugggguaacggguguggacuauucggcaagggcgggaucgugacaugcgcaauguuuaccugcaaaaagaauauggaaggaaaagugguccagccugagaaccucgaauacacuauuguuauaacgccacacagcggugaggagcaugccgugggcaaugacacagggaagcacggaaaagaaaucaagauuaccccgcaguccucaaucacugaggcugaacugaccggcuaugguacaguaaccauggaguguagucccaggacugggcuugauuucaacgaaauggugcuguugcaaauggaggacaaagccuggcucguccaccggcagugguuucuggauuuaccucugccauggcuccccggcgcagacacacagggaagcaauuggauacagaaggagacgcuugugaccuucaagaacccucaugcuaaaaagcaagacguugugguccugggcucucaggaaggggccaugcacacugcguugacaggagccaccgagauucagauguccucagguaaucuacuguuuacaggccaucucaaaugccgucugcgcauggauaagcuucaacugaaagggaugagcuacaguauguguacuggaaaguucaagaucgugaaagaaaucgcagagacccagcacggcacgauuguaaucagaguucaguaugagggugacgggucuccaugcaagauucccuucgaaauaaccgauuuggagaaaaggcaugugcucggccggcugaucacagucaacccgauugugacugaaaaggacuccccugucaacaucgaggcugaacccccauuuggagauagcuacaucauuauaggcguggagccugggcaguuaaaacugaauugguucaagaagggaucgucuaucggucaaauguuugagaccacaaugcgaggcgccaaacgcauggcuauucuaggggacacugccugggauuucggaucccucggcgguguuuuuaccucaaucgggaaggcacugcaccagguguucggcgccauuuacggagcugcguuuaguggcguaagcuggacgaugaaaauccuuauaggggucaucauuacauggaucggaaugaacuccagaucuaccagcuugucagugagucugguucucgugggcgucgugacucuguaucuuggugcaguagugcaggccgacuccggguguguugucagcuggaagaauaaagaacugaagugcggaucuggcauuuucaucacagauaacgugcacaccuggacugagcaguacaaguuucaacccgaaucaccaaguaaauuggcuagcgccauacagaaggcacaugaggaagguauuuguggcaucagguccgugacccggcucgagaaucugauguggaaacagauuacacccgaguuaaaccacauccugucugaaaaugaggucaagcuaacgauaaugaccggggacaucaaaggaauuaugcaggccggcaagcgcucgcucagaccucaaccaacugaacugaaauauagcuggaagacaugggggaaggcuaaaaugcuuuccaccgagucacauaaccagacauucuugaucgauggaccggaaacugccgagugccccaauaccaacagggcauggaauagucuggagguugaagacuacggcuuugguguguucacgacaaacauuuggcucaagcugcgugagaaacaggacguguuuugugauucuaaguuaaugagcgcggcuaucaaagacaaucgggccguacacgcagauaugggguauuggauagaauccgcccugaacgacaccuggaagauggagaaggcuucauucauugaggucaaaagcugccacuggccuaagucucauacucuuugguccaauggaguguuggaaagugagaugaucaucccaaaaaacuucgccggccccguuagccagcacaacuaccgaccugguuaucauacccaaacagcaggcccauggcaccucgggaagcuggaaauggauuuugacuucugugagggaacuaccguggucgugacagaagauugcggcaauagagggcccucucuaaggacgaccacugcuuccggaaaacugauuacagaguggugcugucgcucaugcacccucccgccucugcgguacagaggcgaggacgguuguugguacgggauggaaaucaggccacuuaaggagaaggaagagaacuugguuaauagucuggugacugccggacauggccagauugauaacuuuagcuuagguguacucggcauggcgcuguuccuugaagagaugcugcgcacacgaauagggaccaaacacgccaucuugcucgucgcugugucguuugugacgcugauuacuggaaauauguccuuccgggaccuaggccgugucaugguuauggugggggcaaccaugacagaugacaucggaaugggcguaaccuaucuggcccuccuggcugccuuuaaggugagacccacuuucgcagcgggucuuuugcugaggaaauuaacaucuaaggagcucaugauggccaccauugggaucgcucugcuuagccagucaacaauaccugaaacuauccuggagcuaaccgaugcccucgcacugggaaugauggucuugaaaauugugcgcaacauggaaaaguaccaacuggcuguuacgaucauggccauuaguugcgugcccaaugcagucaucuuacagaacgccuggaagguguccuguacaauacucgcugcgguuucugugagcccacugcuucugaccuccucacagcagaaagccgacuggauuccuuuggcacucacuaucaagggccugaaucccaccgcuaucuuucuaacaacucugagccggaccaguaaaaagagaucuuggccacuuaacgaggccauuauggccgucggcaugguauccauacucgcuagcucgcuguugaaaaaugacaucccgaugacggggccucugguggcaggagguuuacucacaguuugcuaugugcugaccggcaggucagccgaucuugaacuggagcgagcggcugacgucaagugggaggaucaagccgaaauuucugggaguucccccaucuugagcauuacuaucucugaggacggaagcauguccauaaaaaacgaagaggaggaacagacacucaccauccugauucgcacuggccuacuggugaucucagguguauucccagugaguauucccaucacagcagccgcuugguaccuuugggaggucaagaagcagcgggcagggguucucugggaugugccuagcccacccccuguggaaaaagccgagcuggaagacggagcguauagaauaaagcagaggggcauuuugggcuacucucaaaucggggcuggagucuauaaagaggguaccuuucacacgauguggcaugugacucguggcgccguuuuaaugcaccgcgggaagcggaucgagccguccugggcagauguaaaaaaggaccugauuucauacggaggcgguuggaagcucgaaggggaguggaaagaaggagaggaagugcagguccuggcccuugagccaggcaagaaucccagagcugugcagaccaaaccuggcaucuucaagacaaacaccgggacaauaggagccguuagucuggauuuuagcccagguacuuccggcucucccauuguggacaggaaagggaaggucgugggauuguacggcaaugguguagucacccgaucgggggcauaugugagcgcuaucgcccagacggagaagucaauugaagauaacccugagaucgaagacgauauauuccggaaaaagcgccuaacaauuauggaccugcauccgggagcgggcaaaacuaagagauaccuccccgccaucguuagggaggcaaucaaacggggccugcgaacccuuauuuuagcuccaacaagaguggucgccgcugaaauggaggaggcacugcgcgggcucccuaucagguaucaaacccccgccauuaagacugaacacaccggacgugagauaguggacuugaugugucaugccacauucacgaugcggcugcucuccccaguuagagugccuaacuacaaucugaucauuauggaugaagcucacuuuacugaccccgcgaguaucgcagccagggguuauaucucuacccgcgucgagaugggcgaggcugccgggauuuucaugacagcaaccccaccgggaagccgagauccuuuuccccaguccaacgccccaauaauggacgaagagagagaaauccccgagcggucauggaauucuggccacgaaugggugacugauuucaaggguaaaacaguaugguuugugccuagcauuaaggcugggaacgacaucgcggccugccuuaggaaaaauggaaagaaaguuauucagcugagucgcaagaccuucgauuccgaguacgucaagacgcgugcaaacgacugggauuuuguggugacuacagacaucagcgagaugggcgcuaauuucaaagccgaaagagucauagauccacggagguguaugaagcccguaaucuugaccgacggcgaggaacgcgugauucuagcagggccuaugccgguuacccauucuucagccgcucaacgaagaggacggaucgguaggaacccaaaaaaugagaacgaccaguauauuuacaugggcgaaccccuggagaaugaugaggacugcgcccacuggaaggaagcgaaaaugcucuuagauaacaucaauacuccugaggggauaauucccuccauguuugaaccagagcgcgaaaagguggacgcaaucgauggagaguacagacugaggggcgaggcccggaaaacauucgucgaccuuaugcgucgcggugaucugccuguguggcucgcuuauaagguugccgcugaagggauuaacuacgcagaccgaaagugguguuuugauggcaucaaaaauaaccagauauuggaggaaaacauggagguggagaucuggaccaaggaaggagagagaaaaaagcugaaacccagguggcucgacgcccggauuuauagugauccacuggcucuuaaggaauucaaggaguucgccgcaggccgcaaaagccuaacacugaauuugaucacugaaauggggagauuaccuacguuuaugacccagaaggcgaggaacgcccuggacaaucucgcuguccugcauacagccgaggcaggaggucgggcuuacaaccacgcccuuucggagcugccggaaacucucgagaccuugcugcuacugacacuccuugcaaccgugacuggcgggauuuuccuguuuuuaaugucuggaaaaggcaucgguaagaugacguuggggaugugcugcauaauuaccgccuccauccugcucugguaugcucaaauccagccccacuggauugcggccagcaucauacuggaauucuuucuuauuguacugcucaucccagagccugaaaaacagcgaacaccccaggauaaucaauugacuuacgugguuauugcaauccugaccgucguggcugccacaauggccaacgagaugggcuucuuagagaagaccaagaaagaccuaggacugggcucaauaacuacacaggaaagugagucuaauauccucgacauugaucuuagaccagcauccgcuuggacgcuguaugccguggcgaccacuuuugucacaccuauguugcgccauagcaucgaaaacucaaguguuaaugugagccugaccgcuauugccaaccaggcaaccguacucauggggcugggaaaggguuggccccuuuccaaaauggacaucggcgugccgcuccuggccauuggguguuacucucaggucaauccaaucacauugacugcugcacuguuacuacugguggcccacuacgcgauaauuggaccuggccuccaagcuaaggccacgagggaggcacagaaacgggccgcugccgguaucaugaagaaccccaccguugaugggaucacagugauugaccuugaaccaauacccuaugauccuaaguucgagaaacagcugggccaggucauguugcugauccucugcguaacucaagugcugaugaugcguaccacaugggcacuuugugaggcuuuaacccuggccacuggaccgauuagcacgcucugggaaggcaaucccgggagauuuuggaacacaaccaucgcgguuuccauggccaauauuuucaggggaucauacuuggcaggcgcuggucugcuauuuucuaucaugaagaacacuaccaguacacgccgggggacuggaaauauaggcgagacccugggugaaaaauggaagucgcgacucaacgcccuuggcaaaagcgaguuccagaucuauaagaaauccgggauucaggagguggacagaacacuggcaaaggaaggaaucaagaggggcgagacggaucaucacgcugucucucgcgggucagccaaauugcggugguuuguggaaagaaacauggucaccccagagggaaaggugguugaccugggcugcggucgugggggauggagcuacuauuguggcggucucaaaaaugugagggaaguaaagggccugacuaaagggggaccuggccaugaggagcccauuccuauguccacauacggguggaacuuagugcggcuucaaaguggagucgauguuuucuucaccccacccgaaaagugcgacacucugcucugugauaucggcgagucuagcccuaauccaacaauagaagccggucgcacccuacgagugcugaacuuggucgagaauuggcugaacaauaacacgcaguuuugcauuaaggugcucaaucccuauaugccgucaguaaucgaaaaaauggaggcgcuucagagacaguacgggggagcucuggugaggaacccuuugucccggaauaguacccacgagauguacuggguuagcaacgcaacaggcaauaucgugucuuccgucaacaugauuucacgcaugcugauaaauagauucacuaugaagcacaaaaaggccaccuaugaaccagacguggaucucggcagcgggacaaggaacaucggaauugagucggaaauccccaacuuagacauuaucgguaaacgaauagagaagaucaagcaagaacaugagauuucuuggcacuacgaccaggaucauccuuauaaaacuugggcuuaccacggcaguuaugagaccaagcagacaggguccgccagcucaauggucaauggagugguucggcugcuuaccaaaccaugggacguagugcccauggucacucagauggcaaugacggauacaaccccguuuggccaacagcguguguucaaggaaaaaguugacacuagaacccaggagccuaaggaagguacaaagaaacugaugaagaucacggccgaguggcuauggaaagagcucgggaagaaaaagaccccccgcauguguacuagggaagaguuuacaaaaaaggugcgguccaacgcugcgcugggagccauuuucaccgaugaaaauaaguggaaaucugcaagagaggcugucgaagacggccgcuuuugggaguugguggauagggagcgaaaccugcaccucgaaggcaagugcgagacuuguguauacaauaugauggggaaacgggaaaagaaacuuggagaguucgguaaggccaagggcagcagagcaaucugguauauguggcugggggccagguuuuuagaauucgaggcucugggauuuuugaacgaggaccauugguucagucgcggcaauucccucagcgguguggaaggggagggacugcaccgucuaggcuacauucuucgggauguuggcaaaaaggaagggggagccauguacgcggacgauacagcagguugggacaccagaauaacacuggaggaccucaaaaacgaagagauggucacuaaucauaugaagggcgagcacaaaaagcuggccgaagcuaucuuuaaguugaccuaucagaacaaaguggugaggguccaacgcccaacgccucgagggaccguuauggauauuaucucucggagagaccagaggggaucaggccagguggguacauacgggcugaauacuuucaccaacauggaggcccaacucauccgccagauggaaggagagggcauuuucaagaguauacagcaucuuacagcaacugaggaaaucgcuguacagaauuggcuggccagagugggccgggagagguuaucccguauggcuauuagcggggaugacugcgucgugaaacccaucgaugaccgauuugccucugcacugaccgcguugaacgauaugggaaagguucgcaaagacauucaacagugggaaccaucgagagguuggaaugauuggacgcaggugcccuucugcucacaccacuuucaugagcucgucaugaaggacggccgggugcugguaguuccuuguaggaaccaggaugaacuaaucgggcgcgccagaauaagccaaggagcuggcuggucccuuaaggagacagccugccuggguaaaaguuaugcacagauguggacccucauguacuuccaccggagggaccugcgauuggcugccaacgcaaucuguucugccgugccaagccauugggucccgacuucccguacaaccuggucaauucacgcgaagcacgaguggaugacuaccgaagauauguuagcuguguggaauagaguguggauccaggagaaccccuggauggaagacaaaacaccugucgagaguugggaagagguuccauaucuggggaagcgcgaggaccaguggugcggaucucucauuggccuuacgagccgggccaccugggcaaaaaauauccaaacugccauaaaccaggugaggucccugauuggcaaugaagaguacacagauuauaugcccucaaugaagagauuucgccgggaagaggaagaggcugggguacuaugguga

SEQ ID NO: 14552 - RNA, 9876 nt, Artificial Sequence
  derived and/or modified CDS sequence (opt3) from DENV-2__EU482685__SS-prME
accgccggcgugauaguaaugcugauucccacugcuauggcuuuccaccucacuacgagaaacggggaaccucauaugauaguuggaaggcaggaaaaggguaaaagccuucuguuuaagaccgaggacggcgugaauaugugcacauugauggccaucgauuuaggggaacugugugaggacacuauuaccuacaaaugcccacuacuccggcaaaacgaaccggaggauaucgacuguuggugcaauuccacaucuaccuggguaacuuauggaacauguaccacgacuggcgagcaccgccgagaaaagcguucaguggcgcuggucccccauguggguauggggcuugagaccagaacagaaacuuggaugaguagcgagggagcuuggaaacacguucagaggauugagaccuggauccugcggcauccuggcuucacaauaauggccgcaaucuuggccuacaccauuggcacgacucacuuucagcgcgcucucaucuucauucugcugacagcaguggccccauccaugaccaugagaugcaucgggauaucuaacagggauuuugucgaaggagugucggguggcucauggguagacauuguucucgagcacgggagcugugugacuacaauggcuaagaauaagcccaccuuagauuucgaacugaucaaaacggaggccaagcagccugcgacccuucggaaauauugcauugaagcaaaguugacaaacacuaccacagagagucgcuguccaacucaaggagagcccucccugaaugaggaacaggacaaacgauuuaucugcaagcauucuauggucgauagaggcugggguaacggguguggacuauucggcaagggcgggaucgugaccugcgccauguuuacaugcaaaaagaauauggaaggaaaagugguccagccugagaaccucgaauacaccauuguuauaacuccacacagcggugaggagcaugcugugggcaaugacacggggaagcacggaaaagaaaucaagauuacaccgcaguccucaaucaccgaggccgaacugacuggcuaugguaccguaacaauggaguguagucccaggaccgggcuugauuucaacgaaauggugcuguugcaaauggaggacaaagcauggcucguccaccggcagugguuucuggauuuaccucugccauggcuccccggcgcugacacucagggaagcaauuggauacagaaggagacacuugugacguucaagaacccucaugccaaaaagcaagacguugugguccugggcucucaggaaggggcgaugcacaccgccuugacuggagcaacagagauucagauguccucagguaaucuacuguuuaccggccaucucaaaugccgucugcgcauggauaaacuucaacugaaagggaugagcuacaguauguguacaggaaaguucaagaucgugaaagaaaucgcugagacucagcacggcaccauuguaaucagaguucaguaugagggugacgggucuccaugcaagauucccuucgaaauaacggauuuggagaaaaggcaugugcucggccggcugaucaccgucaacccgauugugacagaaaaggacuccccugucaacaucgaggccgaacccccauuuggagauagcuacaucauuauaggcguggagccugggcaguuaaaacugaauugguucaagaagggaucgucuaucggucaaauguuugagacuaccaugcgaggcgcuaaacgcauggccauucuaggggacacagcaugggauuucggaucccucggcgguguuuuuacuucaaucgggaaggcccugcaccagguguucggcgcuauuuacggagcggcauuuaguggcguaagcuggaccaugaaaauccuuauaggggucaucauuacguggaucggaaugaacuccagaucuacuagcuugucagugagucugguucucgugggcgucgugacccuguaucuuggugccguagugcaggcugacuccggguguguugucagcuggaagaauaaagaacugaagugcggaucuggcauuuucaucacugauaacgugcacacauggaccgagcaguacaaguuucaacccgaaucaccaaguaaauuggccagcgcaauacagaaggcccaugaggaagguauuuguggcaucagguccgugacucggcucgagaaucugauguggaaacagauuacccccgaguuaaaccacauccugucugaaaaugaggucaagcuaacaauaaugacgggggacaucaaaggaauuaugcaggcuggcaagcgcucgcucagaccucaaccaaccgaacugaaauauagcuggaagacuugggggaaggccaaaaugcuuuccacagagucacauaaccagaccuucuugaucgauggaccggaaacagcagagugccccaauacuaacagggcguggaauagucuggagguugaagacuacggcuuugguguguucaccacgaacauuuggcucaagcugcgugagaaacaggacguguuuugugauucuaaguuaaugagcgcugccaucaaagacaaucgggcaguacacgccgauaugggguauuggauagaauccgcucugaacgacacauggaagauggagaaggccucauucauugaggucaaaagcugccacuggccuaagucucauacccuuugguccaauggaguguuggaaagugagaugaucauccccaagaacuucgcaggccccguuagccagcacaacuaccgaccugguuaucauacucaaaccgcuggcccauggcaccucgggaagcuggaaauggauuuugacuucugugagggaacaacuguggucgugaccgaagauugcggcaauagagggcccucucuaaggacaacgaccgccuccggaaaacugauuacugaguggugcugucgcucaugcacacucccgccucugcgguacagaggcgaggacgguuguugguacgggauggaaaucaggccacuuaaggagaaggaagagaacuugguuaauagucuggugaccgcgggaaacggccagauugauaauuuuagcuuagguguacucggcauggcccuguuccuugaagagaugcugcgcacucgaauagggacaaaacaugcuaucuugcucgucgcagugucguuugugacccugauuacgggaaacauguccuuccgggaccuaggccgugucaugguuauggugggggccacuaugaccgaugacaucggaaugggcguaacauaucuggcucuccuggccgcauuuaaggugagacccaccuucgcggccggucuuuugcugaggaaauuaacuucuaaggagcucaugauggcuacaauugggaucgcccugcuuagccagucaaccauaccugaaacaauccuggagcuaacugaugcacucgcucugggaaugauggucuugaaaauugugcgcaauauggaaaaguaccaacuggccguuaccaucauggcaauuaguugcgugcccaacgccgucaucuuacagaaugcuuggaagguguccuguacgauacucgcggccguuucugugagcccacugcuucugacauccucacagcagaaagcagacuggauuccuuuggcucucaccaucaagggccugaaccccacugccaucuuucuaaccacacugagccggacaaguaaaaagagaucuuggccacuuaaugaggccauuauggcugucggcaugguauccauacucgcaagcucgcuguugaaaaacgacaucccgaugaccgggccucugguggccggagguuuacucacgguuugcuaugugcugacaggcaggucagcggaucuugaacuggagcgagcugccgacgucaagugggaggaucaagcagaaauuucugggaguucccccaucuugagcauuaccaucucugaggacggaagcauguccaucaaaaaugaagaggaggaacagacucucacaauccugauucgcaccggccuacuggugaucucagguguauucccagugaguauucccaucacugccgcugcaugguaccuuugggaggucaagaagcagcgggccgggguucucugggaugugccuagcccacccccuguggaaaaagcggagcuggaagacggagcuuauagaauaaagcagaggggcauuuugggcuacucucaaaucggggccggagucuauaaagaggguacauuucacaccauguggcacgugacgcguggcgcaguuuuaaugcaucgcgggaagcggaucgagccguccugggccgaugucaaaaaggaccugauuucauacggaggcgguuggaagcucgaaggggaguggaaagaaggagaggaagugcagguccuggcucuugagccaggcaagaaccccagagccgugcagacuaaaccuggcaucuucaagaccaauacagggaccauaggagcaguuagucuggauuuuagcccagguacauccggcucucccauuguggacaggaaagggaaggucgugggauuguacggcaacgguguagucacucgaucgggggcuuaugugagcgccaucgcgcagaccgagaagucaauugaagauaacccugagaucgaagacgauauauuccggaaaaagcgccuaacgauuauggaccugcacccgggagccggcaaaacaaagagauaccuccccgcaaucguuagggaggcuaucaaacggggccugcgaacucuuauuuuagccccaaccagaguggucgcugcagaaauggaggaggcccugcgcgggcucccuaucagguaucaaacacccgccauuaagaccgaacauacuggacgugagauaguggacuugaugugucacgcuaccuucacaaugcggcugcucuccccaguuagagugccuaauuacaaccugaucauuauggaugaagcgcauuuuacggaccccgcaaguaucgccgcuagggguuauaucucuacucgcgucgagaugggcgaggccgcagggauuuucaugaccgccacaccaccgggaagccgagauccuuuuccccaguccaaugcuccaauaauggacgaagagagagaaauccccgagcggucauggaacucuggccacgaaugggugaccgauuucaaggguaaaacuguaugguuugugccuagcauuaaggcggggaaugacaucgccgcaugccuuaggaaaaacggaaagaaaguuauucagcugagucgcaagacauucgauuccgaguacgucaagacccgugcuaaugacugggauuuuguggugacgacugacaucagcgagaugggcgccaacuucaaagcagaaagagucauagauccacggagguguaugaagcccguaaucuugacagacggcgaggaacgcgugauucuagccgggccuaugccgguuacccacucuucagcugcccaacgaagaggacggaucgguaggaaucccaaaaacgagaaugaccaguauauuuacaugggcgaaccccuggagaacgaugaggacugcgcgcauuggaaggaagcaaaaaugcucuuagauaauaucaacaccccugaggggauaauucccuccauguuugaaccagagcgcgaaaagguggacgccaucgauggagaguacagacugaggggcgaggcucggaaaacuuucgucgaccuuaugcgucgcggugaucugccuguguggcucgccuauaagguugcugcagaagggauuaauuacgccgaccgaaagugguguuuugauggcaucaaaaacaaccagauauuggaggaaaauauggagguggagaucuggacaaaggaaggagagaggaaaaagcugaaacccagauggcucgacgcucggauuuauagugauccacuggcccuuaaggaguucaaggaguucgcagcgggccgcaaaagccuaacccugaacuugaucacagaaauggggagauuaccuacuuuuaugacgcagaaggccaggaaugcucuggacaaccucgccguccugcacaccgcagaggcuggaggucgggccuacaaucaugcacuuucggagcugccggaaacacucgagacuuugcugcuacugacccuccuugccacagugaccggcgggauuuuccuguuuuuaaugucuggaaaaggcaucgguaagaugacuuuggggaugugcugcauaauuacggcuuccauccugcucugguaugcgcaaauccagccccacuggauugccgcaagcaucauacuggaguucuuucuuauuguacugcucaucccagagccugaaaaacagcgaaccccacaggauaaccaauugacauacgugguuauugcuauccugacugucguggccgccaccauggcaaaugagaugggcuucuuagagaagacaaagaaagaccuaggacugggcucaauaaccacucaggaaagugagucuaacauccucgacauugaucuuagaccagcuuccgccuggacacuguaugcgguggcuacgaccuuugucacuccuauguugcgccacagcaucgaaaauucaaguguuaacgugagccugacagccauugcaaaucaggccaccguacucauggggcugggaaaggguuggccccuuuccaaaauggacaucggcgugccgcuccuggcuauuggguguuacucucaggucaacccaaucaccuugacagcagcccuguuacuacugguggcgcauuacgcuauaauuggaccuggccuccaagccaaggcaacuagggaggcccagaaacgggcugccgcagguaucaugaagaaucccacgguugaugggaucaccgugauugaccuugaaccaauacccuaugauccuaaguucgagaaacagcugggccaggucauguugcugauccucugcguaacacaagugcugaugaugcguacuaccugggcucuuugugaggccuuaacacuggcgaccggaccgauuagcacucucugggaaggcaaccccgggagauuuuggaauacgacaaucgccguuuccauggcaaacauuuucaggggaucauacuuggcuggcgccggucugcuauuuucuaucaugaagaauaccacaaguacccgccgggggacaggaaacauaggcgagacucugggugaaaaauggaagucgcgacucaacgcacuuggcaaaagcgaguuccagaucuauaagaaauccgggauucaggagguggacagaacccuggcuaaggaaggaaucaagaggggcgagacagaucaccaugccgucucucgcgggucagccaaauugcggugguuuguggaaagaaauauggucacgccagagggaaaggugguugaccugggcugcggucgugggggauggagcuacuauuguggcggucucaaaaacgugaggcaaguaaagggccugaccaaagggggaccuggccacgaagaaccaauuccuauguccacuuacggguggaauuuagugcggcuucagaguggagucgauguuuucuucacaccacccgagaagugcgacacccugcucugugauaucggcgaaucuagcccuaacccaacuauagaggcgggucgcacacuacgagugcugaauuuggucgaaaacuggcugaauaacaauacccaguuuugcauuaaggugcucaaccccuauaugccgucaguaaucgagaaaauggaagcacuucagagacaauacgggggagcacuggugaggaauccuuugucccggaacaguacgcaugagauguacuggguuagcaaugccaccggcaacaucgugucuuccgucaauaugauuucacgcaugcugauaaacagauucacaaugaagcacaaaaaggcuacuuaugagccagacguggaucucggcagcgggaccaggaacaucggaauugaaucggagauccccaauuuagacauuaucgguaaacgaauagaaaagaucaagcaggagcacgaaauuucuuggcauuacgaccaggaucacccuuauaaaacaugggccuaccauggcaguuaugagacuaagcagaccggguccgcaagcucaauggucaacggagugguucggcugcuuacaaaaccaugggacguagugcccauggucacccaaauggccaugacugauacgacaccguuuggccagcagcguguguucaaggagaaaguugacaccagaacucaggaaccuaaggaggguaccaagaaacugaugaagaucacagcugaauggcuauggaaagagcucgggaagaaaaagacgccccgcauguguaccagggaggaauuuacuaaaaaggugcgguccaaugcggcccugggagcaauuuucacagaugagaacaaguggaaaucugcuagagaagccgucgaggacggccgcuuuugggaauugguggauagggagcgaaaucugcaccucgagggcaagugcgaaaccuguguauacaacaugauggggaaacgggagaagaaacuuggagaguucgguaaggcaaagggcagcagagccaucugguauauguggcugggggcuagguuuuuagaguucgaagcccugggauuuuugaaugaggaccacugguucagucgcggcaacucccucagcgguguggagggggaaggacugcaucgucuaggcuacauucuucgggauguuggcaaaaaggaagggggagcgauguacgcagacgauacugccgguugggacacaagaauaacccuggaagaccucaaaaaugaggaaauggucacaaaccacaugaagggcgagcauaaaaagcuggcugaggccaucuuuaaguugacuuaucaaaauaaaguggugaggguccagcgcccaaccccucgagggacgguuauggauauuaucucucggagagaccagaggggaucaggccaaguggguaccuacgggcugaacacauucacuaauauggaagcacagcucauccgccagauggagggagaaggcauuuucaagaguauacagcaccuuaccgcuacagaggagaucgccguacaaaacuggcuggcuagagugggccgggaaagguuaucccguauggccauuagcggggaugacugcgucgugaaacccaucgaugaccgauuugcaucugcgcugacugccuugaaugauaugggaaagguucgcaaagacauucagcagugggagccaucgagagguuggaacgauuggacccaggugcccuucugcucacaucacuuucacgaacucgucaugaaggacggccgggugcugguaguuccuuguaggaaccaagaugagcuaaucgggcgcgcuagaauaagccagggagccggcuggucccuuaaggaaacggcaugccuggguaaaaguuaugcucagauguggacacucauguacuuccaucggagggaccugcgauuggccgcaaaugccaucuguucugcggugccaagccacugggucccgaccucccguacuacauggucaauucaugcuaagcacgaguggaugaccacugaggauauguuagccguguggaacagaguguggauccaggaaaaucccuggauggaggacaaaaccccugucgaaaguugggaggaaguuccauaucuggggaagcgcgaggaccaauggugcggaucucucauuggccuuacaagccgggcaacgugggccaaaaacauccagaccgcuauaaaucaggugaggucccugauuggcaacgaggaauacacugauuauaugcccucaaugaagagauuucgccgggaggaagaggaagccgggguacuaugguga

SEQ ID NO: 14553 - RNA, 9876 nt, Artificial Sequence
  derived and/or modified CDS sequence (opt3) from DENV-2__EU482687__SS-prME
accgccggcgugaucgucaugcugauuccaacugcuauggcuuuccaccucacuacgagaaacggggaaccucauaugauaguuggaaggcaggaaaaggguaaaagccuucuguuuaagaccgaagacggcgugaauaugugcacauugauggccaucgauuuaggggaacugugugaagacacuauuaccuacaaaugcccacuacuccggcaaaacgaaccggaagauaucgacuguuggugcaauuccacaucuaccugggucacuuauggaacauguaccacgacuggcgagcaccgccgagaaaagcguucaguggcgcuggucccccauguggguauggggcuugagaccagaacagaaacuuggaugaguagcgagggagcuuggaaacacguucagaggauugagaccuggauccugcggcauccuggcuucacaauaauggccgcaguguuggccuacaccaucggcacgacucacuuucagcgcgcucucauuuucguccugcugacagcaguggccccauccaugaccaugagaugcaucgggauuucuaacagggauuuuguagaaggaguuucggguggcucauggguggacaucguccucgagcacgggagcugugugacuacaauggcuaagaauaagcccaccuuagauuucgaacugauaaaaacggaggccaagcagccugcgacccuucggaaauauugcauugaagcaaaguugacaaacacuaccacagagagucgcuguccaacucaaggagagcccucccugaaugaagaacaggacaaacgauuuaucugcaagcauucuaugguggauagaggcugggguaacggguguggacuauucggcaagggcgggauuguaaccugcgccauguuuacaugcaaaaagaauauggaaggaaaaguugugcagccugagaaccucgaauacaccaucguaaucacuccacacagcggugaggagcaugcugugggcaaugacacggggaagcacggaaaagaaauuaagauaacaccgcaguccucaaucaccgaggccgaacugacuggcuaugguaccgucacaauggaguguagucccaggaccgggcuugauuucaacgaaauggugcuguugcaaauggaggacaaagcauggcucguucaccggcagugguuucuggauuuaccucugccauggcuccccggcgcugacacucagggaagcaauuggauucagaaggagacacuugugacguucaagaacccucaugccaaaaagcaagacgucgugguacugggcucucaggaaggggcgaugcacaccgccuugacuggagcaacagagauccagauguccucagguaaucuacuguuuaccggccaucucaaaugccgucugcgcauggauaaacuucaacugaaagggaugagcuacaguauguguacaggaaaguucaagauaguuaaagaaauugcugagacucagcacggcaccaucgugaucagaguccaguaugagggugacgggucuccaugcaagauucccuucgaaaucacggauuuggagaaaaggcaugugcucggccggcugauuaccgucaacccgauagugacagaaaaggacuccccuguuaacaucgaggccgaacccccauuuggagauagcuacauuaucaucggcguggagccugggcaguuaaaacugaauugguucaagaagggaucgucuauuggucaaauguuugagacuaccaugcgaggcgcuaaacgcauggccauacuaggggacacagcaugggauuucggaucccucggcgguguauuuacuucaaucgggaaggcccugcaccaggucuucggcgcuauuuacggagcggcauuuaguggcgugagcuggaccaugaaaauccuuauugggguuaucauaacguggaucggaaugaacuccagaucuacuagcuugucagugagucugguccucgugggcguagugacccuguaucuuggugccguuguccaggcugacuccggguguguggugagcuggaagaauaaagaacugaagugcggaucuggcauuuucaucacugauaacguccacacauggaccgagcaguacaaguuucaacccgaaucaccaaguaaauuggccagcgcaauucagaaggcccaugaggaagguaucuguggcauaagguccguuacucggcucgagaaucugauguggaaacagauuacccccgaguuaaaccacauccugucugaaaaugaggugaagcuaacaauuaugacgggggacaucaaaggaauaaugcaggcuggcaagcgcucgcucagaccucaaccaaccgaacugaaauauagcuggaagacuugggggaaggccaaaaugcuuuccacagagucacauaaccagaccuucuugaucgauggaccggaaacagcagagugccccaauacuaacagggcguggaauagucuggagguggaagacuacggcuuugguguauucaccacgaacauuuggcucaagcugcgugagaaacaggacgucuuuugugauucuaaguuaaugagcgcugccaucaaagacaaucgggcagugcacgccgauaugggguauuggauugaauccgcucugaacgacacauggaagauggagaaggccucauucaucgagguuaaaagcugccacuggccuaagucucauacccuuugguccaauggaguguuggaaagugagaugauaauucccaagaauuucgcaggccccgucagccagcacaacuaccgaccugguuaucauacucaaaccgcuggcccauggcaccucgggaagcuggaaauggauuuugacuucugugagggaacaacugugguugugaccgaagauugcggcaauagagggcccucucuaaggacaacgaccgccuccggaaaacugaucacugaguggugcugucgcucaugcacacucccgccucugcgguacagaggcgaggacgguuguugguacgggauggaaaucaggccacuuaaggagaaggaagagaacuugguaaauagucuggucaccgcgggacauggccagauugauaacuuuagcuuaggugugcucggcauggcccuguuccuugaagagaugcugcgcacucgaaucgggacaaaacacgcuauuuugcucguggcagucucguuuguuacccugauaacgggaaauauguccuuccgggaccuaggccgugugaugguaauggugggggccacuaugaccgaugacaucggaaugggcgucacauaucuggcucuccuggccgcauuuaaggugagacccaccuucgcggccggucuuuugcugaggaaauuaacuucuaaggagcucaugauggcuacaauugggaucgcccugcuuagccagucaaccauuccugaaacaauccuggagcuaacugaugcacucgcucugggaaugaugguuuugaaaauagugcgcaacauggaaaaguaccaacuggccgucaccaucauggcaauuaguugcgugcccaaugccguuaucuuacagaacgcuuggaagguguccuguacgauucucgcggccgucucuguaagcccacugcuucugacauccucacagcagaaagcagacuggaucccuuuggcucucaccauaaagggccugaaucccacugccauuuuucuaaccacacugagccggacaaguaaaaagagaucuuggccacuuaacgaggccaucauggcugugggcaugguuuccauccucgcaagcucgcuguugaaaaaugacauuccgaugaccgggccucugguggccggagguuuacucacggucugcuaugugcugacaggcaggucagcggaucuugaacuggagcgagcugccgacguaaagugggaggaucaagcagaaauaucugggaguucccccaucuugagcauuaccaucucugaggacggaagcauguccauuaaaaacgaagaggaggaacagacucucacaauccugauacgcaccggccuacuggugaucucaggugucuucccaguuaguauucccaucacugccgcugcaugguaccuuugggaggugaagaagcagcgggccggggugcucugggaugucccuagcccacccccuguggaaaaagcggagcuggaagacggagcuuauagaauuaagcagaggggcaucuugggcuacucucaaauaggggccggaguuuauaaagaggguacauuucacaccauguggcauguaacgcguggcgcaguguuaaugcaccgcgggaagcggauugagccguccugggccgaugucaaaaaggaccugaucucauacggaggcgguuggaagcucgaaggggaguggaaagaaggagaggaagugcagguucuggcucuugagccaggcaagaaucccagagccgugcagacuaaaccuggcaucuucaagaccaacacagggaccauuggagcagucagucuggauuuuagcccagguacauccggcucucccaucguggacaggaaagggaagguagucggauuguacggcaauggugugguuacucgaucgggggcuuaugugagcgccauagcgcagaccgagaagucaauugaagauaacccugagaucgaagacgauauuuuccggaaaaagcgccuaacgaucauggaccugcauccgggagccggcaaaacaaagagauaccuccccgcaauagucagggaggcuauuaaacggggccugcgaacucuuaucuuagccccaaccagagugguugcugcagaaauggaggaggcccugcgcgggcucccuaucagguaucaaacacccgccauuaagaccgaacacacuggacgugagaucguggacuugaugugucaugcuaccuucacaaugcggcugcucuccccagucagagugccuaacuacaaucugauuauaauggaugaagcgcacuuuacggaccccgcaaguaucgccgcuagggguuauauuucuacucgcguagagaugggcgaggccgcagggaucuucaugaccgccacaccaccgggaagccgagauccuuuuccccaguccaacgcuccaaucauggacgaagagagagaaauucccgagcggucauggaacucuggccacgaaugggugaccgauuucaaggguaaaacuguuugguuugucccuagcauaaaggcggggaacgacaucgccgcaugccuuaggaaaaauggaaagaaagugauucagcugagucgcaagacauucgauuccgaguacgugaagacccgugcuaacgacugggauuuugucguaacgacugacaucagcgagaugggcgccaauuucaaagcagaaagagugauugauccacggagguguaugaagcccguuaucuugacagacggcgaggaacgcgugauacuagccgggccuaugccggucacccauucuucagcugcccaacgaagaggacggaucgguaggaaccccaagaaugagaacgaccaguauauuuacaugggcgaaccccuggagaaugaugaggacugcgcgcacuggaaggaagcaaaaaugcucuuagauaacaucaauaccccugaggggauuauccccuccauguuugaaccagagcgcgaaaagguggacgccauagauggagaguacagacugaggggcgaggcucggaaaacuuucguugaccuuaugcgucgcggugaucugccuguguggcucgccuauaaggucgcugcagaagggauuaacuacgccgaccgaaagugguguuuugauggcaucaaaaauaaccagauuuuggaggaaaacauggagguggagaucuggacaaaggaaggagagaggaaaaagcugaaacccagauggcucgacgcucggauauauagugauccacuggcccuuaaggaguucaaggaguucgcagcgggccgcaaaagccuaacccugaauuugaucacagaaauggggagauuaccuacuuuuaugacgcagaaggccaggaacgcucuggacaaucucgccguacugcauaccgcagaggcuggaggucgggccuacaaccacgcacuuucggagcugccggaaacacucgagacuuugcugcuacugacccuccuugccacagugaccggcgggauuuuccuguuuuuaaugucuggaaaaggcaucgguaagaugacuuuggggaugugcugcauuaucacggcuuccauacugcucugguaugcgcaaauucagccccacuggaucgccgcaagcaucauucuggaguucuuucuuaucguucugcucauaccagagccugaaaaacagcgaaccccacaggauaaucaauugacauacgucgugauugcuauccugacuguggucgccgccaccauggcaaacgagaugggcuucuuagagaagacaaagaaagaccuaggacugggcucaauuaccacucaggaaagugagucuaauauccucgacauagaucuuagaccagcuuccgccuggacacuguaugcgguugcuacgaccuuugugacuccuauguugcgccauagcaucgaaaacucaaguguaaaugugagccugacagccauugcaaaccaggccaccguccucauggggcugggaaaggguuggccccuuuccaaaauggacaucggcgugccgcuccuggcuauuggguguuacucucagguuaauccaaucaccuugacagcagcccuguuacuacugguggcgcacuacgcuauuaucggaccuggccuccaagccaaggcaacuagggaggcccagaaacgggcugccgcagguauaaugaagaaccccacggucgaugggauuaccguaaucgaccuugaaccaauccccuaugauccuaaguucgagaaacagcugggccaggugauguugcugauucucugcguuacacaagugcugaugaugcguacuaccugggcucuuugugaggccuuaacacuggcgaccggaccgauaagcacucucugggaaggcaaucccgggagauuuuggaacacgacaaucgccgucuccauggcaaauauuuucaggggaucauacuuggcuggcgccggucugcuauuuucuaucaugaagaacaccacaaguacccgccgggggacaggaaauauuggcgagacucugggugaaaaauggaagucgcgacucaacgcacuuggcaaaagcgaguuccagaucuauaagaaauccgggauacaggagguggacagaacccuggcuaaggaaggaaucaagaggggcgagacagaucaucacgccgucucucgcgggucagccaaauugcggugguuuguggaaagaaacaugguuacgccagagggaaaggugguagaccugggcugcggucgugggggauggagcuacuauuguggcggucucaaaaaugugagggaagucaagggccugaccaaagggggaccuggccaugaggagcccauuccuauguccacuuacggguggaacuuaguucggcuucaaaguggaguggaugucuucuucacaccacccgaaaagugcgacacccugcucugugauaucggcgagucuagcccuaauccaacuauugaagcgggucgcacacuacgagugcugaacuugguagagaauuggcugaacaauaacacccaguuuugcaucaaggugcucaaucccuauaugccgucaguuauagagaaaauggaggcacuucagagacaguacgggggagcacuggugaggaacccuuugucccggaauaguacgcacgagauguacugggucagcaacgccaccggcaauauugugucuuccgucaacaugaucucacgcaugcugaucaauagauucacaaugaagcacaaaaaggcuacuuaugaaccagacguggaucucggcagcgggaccaggaacauuggaauagagucggaaauccccaacuuagacauuaucgguaaacgaauugagaagaugaagcaagaacaugagaucucuuggcacuacgaccaggaucauccuuauaaaacaugggccuaccacggcaguuaugagacuaagcagaccggguccgcaagcucaaugguuaauggaguagugcggcugcuuacaaaaccaugggacgucgugcccaugguuacccagauggccaugacugauacgacaccguuuggccaacagcguguguucaaggaaaaagucgacaccagaacucaggagccuaaggaagguaccaagaaacugaugaagauaacagcugaguggcuauggaaagagcucgggaagaaaaagacgccccgcauguguaccagggaagaguuuacucggaaagugagauccaacgcggcccugggagcaaucuucacagaugaaaauaaguggaagucugcucgcgaggccguagaagacggcagguuuugggaguugguggaucgagagcggaaccugcaccucgaaggcaaaugcgagaccuguguuuacaauaugauggggaagagagagaagaaacuuggagaguucgguaaagcaaaaggcagcagggccauuugguauauguggcugggggcucgcuuuuuagaguucgaggcccugggauuuuugaacgaggaccauugguucagucguggcaauucccucagcggugucgaaggggagggacugcaccggcuaggcuacauccuuagagaugugggcaagaaagaagggggagcgauguacgcagacgauacugccgguugggacacaaggauuacccuggaggaccucaagaacgaagagauggugacaaaucauaugaaaggcgagcacaagaaacuggcugaagccaucuuuaaguugacuuaucagaacaaggucguucgcgugcaacgaccaaccccucgggggacgguaauggauauuauaucuagaagggaccagcgcggaucaggccagguggguaccuacgggcugaauacauucacuaacauggaggcacaacucaucagacagauggaaggagagggcauuuucaaaaguauccagcaucuuaccgcuacagaggaaaucgccguccagaauuggcuggcucgggugggcagggagcguuuaucccgaauggccauuagcggggaugacugcguugugaagcccauagaugaccgcuuugcaucugcgcugacugccuugaacgauaugggaaaagucagaaaggacauccaacagugggaaccaucgcgggguuggaaugauuggacccaggugcccuucugcucacaccacuuucaugagcucguaaugaaagacggcaggguucugguggucccuugucgcaaccaggaugaacuaauugggagagcucggaucagccaaggagccggcuggucccuuaaggagacggcaugccuggguaagaguuaugcucagauguggacacucauguacuuccacaggcgagaccugcguuuggccgcaaacgccauuuguucugcggugccaagccauugggugccgaccuccagaacuacauggucaauccacgcuaaacacgaguggaugaccacugaagauauguuagccgucuggaaucgcguuuggauacaggagaaccccuggauggaagacaagaccccuguggagaguugggaagagguaccauaucuggggaaacgggaggaccaguggugcggaucucucaucggccuuacaagcagggcaacgugggccaagaauauucaagcugccaucaaccaggugagaucccugauuggcaaugaagaguacaccgauuauaugcccucaaugaaacgcuuucggagggaagaggaagaggcagggguccuaugguga

SEQ ID NO: 14554 - RNA, 9876 nt, Artificial Sequence
  derived and/or modified CDS sequence (opt3) from DENV-2__EU482688__SS-prME
accgccggcgugaucgucaugcugauucccacagcuauggcauuccaccucacuacgagaaacggggagccucauaugauaguuggaaggcaggaaaaggguaaaagccuucuguuuaagaccgaggacggcgugaauaugugcacauugauggccaucgauuuaggggaacugugugaggacacuauuaccuacaaaugcccacuacuccggcaaaacgaaccggaggauaucgacuguuggugcaauuccacaucuaccuggguaacuuauggaacauguaccacgacuggcgagcaccgccgagaaaagcguucaguggcgcuggucccccauguggguauggggcuugagaccagaacagaaacuuggaugaguagcgagggagcuuggaaacacguucagaggauugagaccuggauccugcggcauccuggcuucacaauaauggccgcaaucuuggccuacaccauuggcacgacucacuuucagcgcgcucucaucuucauucugcugacagcaguggccccauccaugaccaugagaugcaucgggauaucuaacagggauuuugucgaaggagugucggguggcucauggguagacauuguucucgagcacgggagcugugugacuacaauggcuaagaauaagcccaccuuagauuucgaacugaucaaaacggaggccaagcagccugcgacccuucggaaauauugcauugaagcaaaguugacaaacacuaccacagagagucgcuguccaacucaaggagagcccucccugaaugaagagcaggacaaacgauuuaucugcaagcauucuauggucgauagaggcugggguaacggguguggacuauucggcaagggcgggaucgugaccugcgccauguuuacaugcaaaaagaauauggaaggaaaagugguccagccugagaaccucgaauacaccauuguuauaacuccacacagcggugaggagcaugcugugggcaaugacacggggaagcacggaaaagaaaucaagauuacaccgcaguccucaaucaccgaggccgaacugacuggcuaugguaccguaacaauggaguguagucccaggaccgggcuugauuucaacgaaauggugcuguugcaaauggaggacaaagcauggcucguccaccggcagugguuucuggauuuaccucugccauggcuccccggcgcugacacucagggaagcaauuggauacagaaggagacacuugugacguucaagaacccucaugccaaaaagcaagacguugugguccugggcucucaggaaggggcgaugcacaccgccuugacuggagcaacagagauucagauguccucagguaaucuacuguuuaccggccaucucaaaugccgucugcgcauggauaagcuucaacugaaagggaugagcuacaguauguguacaggaaaguucaagaucgugaaagaaaucgcugagacucagcacggcaccauuguaaucagaguucaguaugagggugacgggucuccaugcaagauucccuucgaaauaacggauuuggagaaaaggcaugugcucggccggcugaucaccgucaacccgauugugaucgaaaaggacuccccugucaacaucgaggccgaacccccauuuggagauagcuacauuauaaucggcguggagccugggcaguuaaaacugaauugguucaagaagggaucgucuauuggucaaauguuugagacaacuaugcgaggcgcuaaacgcauggccauccuaggggacaccgcaugggauuucggaucccucggcgguguuuuuacaucaauugggaaggcccugcaccagguguucggcgcuaucuacggagcggcauuuaguggcguaagcuggacuaugaaaauacuuaucggggucauuaucaccuggauuggaaugaacuccagaucuacgagcuugucagugagucugguucucgugggcgucgugacacuguaucuuggugccaugguacaggcugacuccgggugugugguuagcuggaagaauaaagaacugaagugcggaucuggcaucuucauaaccgauaacguccacacuuggacagagcaguacaaguuucaacccgaaucaccaaguaaauuggccagcgcaauucagaaggcccaugaggaagguaucuguggcauuagguccgugacccggcucgagaaucugauguggaaacagaucacucccgaguuaaaccacauacugucugaaaaugaggugaagcuaaccaucaugacaggggacauucgcggaaucaugcaggcuggcaaaagaucgcucaggccucaaccaacggaacugaaguauagcuggaaaaccugggggaaggccaagaugcuuuccacugagucacauaaccagacauucuugauugauggaccggaaaccgcagagugccccaauacaaaccgugcguggaauagucuggaggucgaagacuacggcuuugguguuuucacuaccaacaucuggcucaaacugcgggagaagcaggacguguuuugugauucuaaauuaaugagcgcugccauaaaggacaaucgagcagugcacgccgauaugggguauuggauugaauccgcucugaacgacacguggaaaauggagaaggccucauucaucgagguaaagagcugccacuggccuaaaucucauacacuuugguccaauggagucuuggaaagugagaugaucauuccaaagaacuucgcaggccccgugagccagcacaacuacagaccugguuaucauacccaaacugcuggcccauggcaccucgggaaacuggaaauggauuuugaccuaugugagggaaccacaguuguggucacugaagauugcggcaauagggggcccucucugcgcaccacaacggccuccggaaagcucaucaccgaguggugcugucggucaugcacucugccgccucuuagauacaggggcgaggacgguuguugguacgggauggaaauucgcccauugaaagagaaggaagagaaccuggugaauaguuuaguuacagcgggacauggccagauagauaacuucagccucggugugcugggcauggcccuuuuucuggaagagauguugcgaacccggaucgggacuaagcacgcuauucuccugguagcagucucgcuagugacacugaucaccggaaauauguccuuccgugaccucggcagagugauggucaugguuggggccacgaugacugaugacauuggaaugggcgugaccuaucuggcucuuuuggccgcauuuaaaguaaggcccacauucgcggccggucuguuacuccgcaagcugaccucuaaagagcuuaugauggcuacuaucgggauagcccugcuaagccagucaacaaucccugaaaccauucucgagcugacagaugcauuggcucugggaaugaugguguuaaagaucguccggaacauggaaaaauaccaacucgccgugacuauuauggcaaucaguugcguucccaaugccgugauacugcagaacgcuuggaaggucuccuguaccauucuugcggccgugucuguuagcccacuguugcucacguccucacagcagaaggcagacuggaucccucuggcucuaacaaucaaaggccugaaucccaccgccauuuuucuuacuacccucagcagaacaaguaagaaaaggucuuggccacugaacgaggccauaauggcugugggcauggucuccaucuuggcaagcucgcuguuaaagaaugacauuccgaugacugggccucucguagccggaggucugcuuaccgugugcuauguucugacgggccgaucagcggauuuggaacucgagcgcgcugccgacgugaaaugggaggaucaagcagaaaucucugggaguucccccauucugagcaucacaauaucugaggacggaagcauguccaucaagaacgaagaggaggaacagacccuaacuauucugauccggacaggccuucucgucauuucagguguguucccaguaaguauccccauaaccgccgcugcaugguaccugugggaggugaaaaagcagagagccggggucuugugggauguuccuagcccacccccuguggaaaaggcggaguuagaagacggagcuuauaggauuaaacagcguggcauccugggcuacucucaaaucggggccggaguguauaaggaggguacuuuucacacaauguggcaugucacccgcggcgcagugcucaugcaccgggggaaaagaauugagccguccugggccgauguuaagaaagaccugaucucauacggaggcgguuggaagcuugaaggggaguggaaggaaggagaggaaguacaggugcuggcuuuggagccaggcaaaaaucccagggccguccagacgaagccuggcauauucaaaacuaacaccgggacaauuggagcagugagucuagauuuuagcccagguaccuccggcucucccaucguugaccgaaaggggaaaguggucggacuguacggcaauggugugguaacacggucgggggcuuaugucagcgccauugcgcagacugagaagucaaucgaagauaacccugagauagaagacgauauuuuccgcaagaaaagacucaccaucauggaccugcauccgggagccggcaagacgaaaagguaccuucccgcaaucgugcgggaggcuauuaagcgaggcuuaagaacacugauccucgccccaacucgcguuguggcugcagaaauggaggaggccuugagggggcugccuauucguuaucaaaccacagccauaaaaaccgaacacacuggacgggagaucgucgaccucaugugucaugcuaccuuuacaaugagacugcuuucccccgugaggguuccaaacuacaaucugauuaucauggaugaagcgcacuucacggacccugcaaguaucgccgcucgcgguuauauuucuacucgaguggagaugggcgaggccgcagggauauucaugaccgccacacccccaggaagcagagauccguuuccucaguccaacgcucccaucauggacgaagagcgggaaauuccagagaggucauggaauucuggccacgaaugggucaccgauuucaaggguaagacugugugguuuguacccagcaucaaagcggggaacgacauugccgcaugcuugcgcaagaauggaaaaaaggugauccagcuaagucguaaaacauucgauuccgaguacguuaagaccagagcuaacgacugggauuuugucgugacgacugacauaagcgagaugggcgccaauuucaaggcagaacgggugaucgauccuaggcgcuguaugaaaccagucauucugacagacggcgaggaacgaguaauccucgccgggcccaugccugugacccauucuucagcugcccaaagacggggaaggauuggucgcaacccgaagaaugagaacgaccaguauaucuacaugggcgaaccauuagagaaugaugaggacugcgcgcacuggaaagaagcaaagaugcugcuugauaacauaaauacccccgaggggauuaucccuuccauguuugaacccgagagagaaaaaguugacgccauugauggagaguacaggcugcggggcgaggcucguaagacuuucguggaccucaugcgccgaggugauuugccagucuggcuggccuauaaaguggcugcagaagggaucaacuacgccgacagaaagugguguuuugauggcauaaagaauaaccagauccucgaggaaaacauggagguugagauuuggacaaaagaaggagagaggaagaaacugaagccucgguggcuugacgcucgcaucuauagugauccccuagcccugaaagaauucaaggaguuugcagcgggcagaaagagcuugaccuuaaaucugauuacagaaauggggaggcucccaacuuucaugacgcagaaagcccggaacgcucuggacaaucuugccgugcugcauaccgcagaggcuggaggucgagccuacaaccacgcacucucggaguugccugaaacacuggagacucuacugcuccuuacccuguuagccacagucaccggcgggaucuucuuguuucugaugucuggaaagggcauagguaaaaugacucucgggaugugcugcauuaucacggcuuccauccugcuuugguaugcgcaaauucagccgcacuggaucgccgcaagcauaauucuggaauucuuucucaucguguugcugauucccgagccagaaaagcagagaaccccucaggauaaucaauuaacauacguagugaucgcuauacuaacuguugucgccgccaccauggcaaacgagaugggcuuccuggagaaaacaaagaaggaccucggacuuggcucaaucaccacucaggaaagugagucuaauauucuggacaucgauuugcgccccgcuuccgccuggacacuguaugcgguggcuacgaccuuugugacuccaaugcucaggcauagcauugaaaacucaagugucaauguuagccugacagccaucgcaaaccaggccaccgugcuuauggggcucggaaaagguuggccucuguccaagauggacauuggcguacccuugcuggcuaucggguguuacucucaggugaauccgauaaccuuaacagcagcccuacugcuccuugucgcgcacuacgcuauuaucggaccaggccugcaagccaaagcaacucgggaggcccagaagcgugcugccgcagguaucaugaaaaacccuacgguggaugggauuaccguuauagacuuggaacccaucccauaugaucccaaguucgagaagcagcugggccaggugaugcuccugauucuuugcgucacacaaguauuaaugaugagaacuaccugggcucugugugaggcccucacauuggcgaccggaccuaucagcacucugugggaaggcaauccggggagguuuuggaacacgacaauugccguguccauggcaaauaucuuccgcggaucauaccuagcuggcgccggucugcucuuuucuauaaugaaaaacaccacuaauacccggcgagggacaggaaacaucggcgagacucuuggugaaaaguggaaaaguagacugaacgcauugggcaagucggaguuccagauuuauaaaaagagcgggauccaggagguugacaggacccuggcuaaagaaggaauuaagcgcggcgagacagaucaucacgccgugucccgggggucugccaagcucagaugguuugucgaacguaauauggugacgcccgagggaaaagucguggaccugggcugcgguagggggggauggucauacuauuguggcgguuuaaagaacguucgggaagugaaaggccuuaccaaggggggaccaggccaugaggagccuauccccaugagcacuuacggguggaaucugguacgccuccaauccggaauagauguguucuuuacaccuccagaaaaaugcgacacccuacugugugauauuggcgagaguucucccaacccuacuaucgaagcgggucgaacauugagaguccugaaucucguugagaacuggcuuaauaacaauacccaguucugcaucaaggugcugaacccauauaugcccagcgucauugaaaagauggaggcuuugcagaggaaauacgggggagcacuggugcggaauccgcucucacgcaacuccacgcacgagauguacuggguaaguaaugccaccggcaacauagugagcucuguuaauaugaucuccagaauguuaauuaacagguucacaaugaagcacaaaaaggcuacuuaugaaccugacguggaucugggcucagggacccgaaacaucggaauugagagcgaaaucccaaaucuugacauaaucgguaaacggauugagaagaucaagcaggaacaugagacaucguggcacuacgaccaagaucaucccuauaaaacuugggccuaccacggcucuuaugagaccaagcagacagggagugcauccagcauggucaacggagugguccgucugcuaaccaaaccuugggacgugguuccaaugguaacucagauggccaugacggauacaacccccuuuggccagcaaagaguguucaaggaaaaagucgacacucgcacccaggagccgaaggaagguacaaagaaacucaugaagauuacggcugaguggcuguggaaagaguuggggaagaaaaagaccccuaggauguguacucgggaagaguuuacaagaaaagugcgcucaaaugcggcccugggagcaaucuucaccgaugaaaacaaguggaaguccgcuagggaggccguugaagacggccgauuuugggagcucguggaucgggagagaaaucuucaccuggaaggcaaaugcgagacuugugucuacaacaugauggggaagagggaaaaaaaguuaggagaguucgguaaagcaaagggcucucgcgccauuugguauauguggcugggggcucguuuuuuggaauucgaggcccucggauuucugaaugaggaccauugguucagccggggcaacagucuauccgguguggaaggggagggacuucacagacugggcuacauacucagggauguaggcaagaaagaagggggagcgauguacgcagacgauacagccgguugggacacccgcaucacacuggaggacuugaagaaugaagagauggugacuaaccauaugaaaggcgagcacaagaaacuggcugaagccauuuuuaagcucaccuaucagaauaagguuguccgagugcagcggcccacgccaagagggaccgugauggauaucaucagcaggcgcgaccaaagaggaucuggccaggucgguacauacgggcuuaacacuuucaccaauauggaggcacagcugauucggcaaauggaaggagagggcauauuuaaaucaauccagcauuuaacagcuacugaggaaauugccguucagaacuggcuggcuagggugggccgugagcgauugagucgcauggccaucuccggggaugacugcguagugaagccuauugaugacagauucgcaagcgcgcucaccgcccugaaugauaugggaaaaguccggaaggacauccagcaaugggaacccucuagggguuggaacgauuggacgcaggugccauucugcucgcaccacuuucaugagcuaguuaugaaagacggccgcgugcuugucgugcccuguagaaaccaggaugaacugauagggcgggcuaggaucucacagggagccggcuggagccucaaggagacagcaugccuggguaaguccuaugcucaaauguggaccuugauguacuuccaccgacgugacuuaagacuggccgcaaaugccauuuguagugcgguaccuucucauuggguuccaacuagccgcacaaccugguccauccacgcuaaacacgaguggaugacuaccgaagauaugcucgccguguggaaccgggucuggauucaggagaauccguggauggaagacaagacacccguggagucaugggaagaggugccuuaucuugggaaaagggaggaccaguggugcggaaguaugaucggccugacgucuagagcaaccugggccaagaacauacagacugcuauuaaucaaguccgcagccuaaucggcaacgaagaguacacagauuauaugccauccaugaaacgguuuaggcgagaagaggaagaggccgggguucugugguga

SEQ ID NO: 14555 - RNA, 9876 nt, Artificial Sequence
  derived and/or modified CDS sequence (opt3) from DENV-2__EU482691__SS-prME
accgccggcgugaucgucaugcugauucccacagcuauggcauuccaccucacuacgagaaacggggagccucauaugauaguuggaaggcaggaaaaggguaaaagccuucuguuuaagaccgaggacggcgugaauaugugcacauugauggccaucgauuuaggggaacugugugaggacacuauuaccuacaaaugcccacuacuccggcaaaacgaaccggaggauaucgacuguuggugcaauuccacaucuaccuggguaacuuauggaacauguaccacgacuggcgagcaccgccgagaaaagcguucaguggcgcuggucccccauguggguauggggcuugagaccagaacagaaacuuggaugaguagcgagggagcuuggaaacacguucagaggauugagaccuggauccugcggcauccuggcuucacaauaauggccgcaaucuuggccuacaccauuggcacgacucacuuucagcgcgcucucaucuucauucugcugacagcaguggccccauccaugaccaugagaugcaucgggauaucuaacagggauuuugucgaaggagugucggguggcucauggguagacauuguucucgagcacgggagcugugugacuacaauggcuaagaauaagcccaccuuagauuucgaacugaucaaaacggaggccaagcagccugcgacccuucggaaauauugcauugaagcaaaguugacaaacacuaccacagagagucgcuguccaacucaaggagagcccucccugaaugaagagcaggacaaacgauuuaucugcaagcauucuauggucgauagaggcugggguaacggguguggacuauucggcaagggcgggaucgugaccugcgccauguuuacaugcaaaaagaauauggaaggaaaagugguccagccugagaaccucgaauacaccauuguuauaacuccacacagcggugaggagcaugcugugggcaaugacacggggaagcacggaaaagaaaucaagauuacaccgcaguccucaaucaccgaggccgaacugacuggcuaugguaccguaacaauggaguguagucccaggaccgggcuugauuucaacgaaauggugcuguugcaaauggaggacaaagcauggcucguccaccggcagugguuucuggauuuaccucugccauggcuccccggcgcugacacucagggaagcaauuggauacagaaggagacacuugugacguucaagaacccucaugccaaaaagcaagacguugugguccugggcucucaggaaggggcgaugcacaccgccuugacuggagcaacagagauucagauguccucagguaaucuacuguuuaccggccaucucaaaugccgucugcgcauggauaagcuucaacugaaagggaugagcuacaguauguguacaggaaaguucaagaucgugaaagaaaucgcugagacucagcacggcaccauuguaaucagaguucaguaugagggugacgggucuccaugcaagauucccuucgaaauaacggauuuggagaaaaggcaugugcucggccggcugaucaccgucaacccgauugugacagaaaaggacuccccugucaacaucgaggccgaacccccauuuggagauagcuacaucauuauaggcguggagccugggcaguuaaaacugaauugguucaagaagggaucgucuaucggucaaauguuugagacuaccaugcgaggcgcuaaacgcauggccauucuaggggacacagcaugggauuucggaucccucggcgguguuuuuacuucaaucgggaaggcccugcaccagguguucggcgcuauuuacggagcggcauuuaguggcguaagcuggaccaugaaaauccuuauaggggucaucauuacguggaucggaaugaacuccagaucuacaagcuugucagugagucugguucucgugggcgucgugacccuguaucuuggugccguagugcaggcugacuccggguguguugucagcuggaagaauaaagaacugaagugcggaucuggcauuuucaucacugauaacgugcacacauggaccgagcaguacaaguuucaacccgaaucaccaaguaaauuggccagcgcaauacagaaggcccaugaggaagguauuuguggcaucagguccgugacucggcucgagaaucugauguggaaacagauuacccccgaguuaaaccacauccugucugaaaaugaggucaagcuaacaauaaugacgggggacaucaaaggaauuaugcaggcuggcaagcgcucgcucagaccucaaccaaccgaacugaaauauagcuggaagacuugggggaaggccaaaaugcuuuccacagagucacauaaccagaccuucuugaucgauggaccggaaacagcagagugccccaauauuaacagggcguggaauagucuggagguugaagacuacggcuuugguguguucacuaccaacaucuggcucaagcugcgugagaaacaggacguguuuugugauucuaaguuaaugagcgcugccauaaaagacaaucgggcaguacacgccgauaugggguauuggauugaauccgcucugaacgacacguggaagauggagaaggccucauucaucgaggucaaaagcugccacuggccuaagucucauacacuuugguccaauggaguguuggaaagugagaugaucauuccaaaaaacuucgcaggccccguuagccagcacaacuaccgaccugguuaucauacccaaacugcuggcccauggcaccucgggaagcuggaaauggauuuugacuucugugagggaaccacaguggucgugacugaagauugcggcaauagagggcccucucuaaggaccacaacggccuccggaaaacugaucaccgaguggugcugucgcucaugcacucucccgccucugcgguacagaggcgaggacgguuguugguacgggauggaaauuaggccacuuaaggagaaggaagagaacuugguuaauagucuggugacagcgggacauggccagauagauaacuuuagcuuagguguacucggcauggcccuguuccuugaagagaugcugcgcacccgaaucgggacuaaacacgcuauuuugcucgucgcagugucguuugugacacugaucaccggaaauauguccuuccgggaccuaggccgugucaugguuauggugggggccacgaugacugaugacauuggaaugggcguaaccuaucuggcucuccuggccgcauuuaaggugagacccacauucgcggccggucuuuugcugaggaaauuaaccucuaaggagcucaugauggcuacuaucgggauagcccugcuuagccagucaacaaucccugaaaccauucuggagcuaacagaugcacucgcucugggaaugauggucuugaaaaucgugcgcaacauggaaaaguaccaacuggccguuacuauuauggcaaucaguugcgugcccaaugccgucauauuacagaacgcuuggaagguguccuguaccauucucgcggccguuucugugagcccacugcuucugacguccucacagcagaaagcagacuggaucccuuuggcucucacaaucaagggccugaaucccaccgccauuuuucuaacuacccugagccggacaaguaaaaagagaucuuggccacuuaacgaggccauaauggcugucggcaugguauccauccucgcaagcucgcuguugaaaaaugacauuccgaugacugggccucugguggccggagguuuacucaccguuugcuaugugcugacgggcaggucagcggaucuugaacuggagcgagcugccgacguccgcugggaggaucaagcagaaaucucugggaguucccccauuuugagcaucacaauaucugaggacggaagcauguccaucaagaacgaagaggaggaacagacccucacuauucugauccggacaggccuacuggugauuucagguguauucccagugaguauccccauaaccgccgcugcaugguaccuuugggaggucaaaaagcagagagccgggguucucugggaugugccuagcccacccccuguggaaaaggcggagcuggaagacggagcuuauaggauuaaacagcguggcaucuugggcuacucucaaaucggggccggagucuauaaggaggguacuuuucacacaauguggcaugugacccgcggcgcaguuuuaaugcaccgggggaaaagaauugagccguccugggccgauguaaagaaagaccugaucucauacggaggcgguuggaagcucgaaggggaguggaaggaaggagaggaagugcagguccuggcucuugagccaggcaaaaaucccagggccgugcagacgaagccuggcauauucaaaacuaacaccgggacaauuggagcaguuagucuggauuuuagcccagguaccuccggcucucccaucguggaccgaaaggggaaagucgugggauuguacggcaaugguguagucacacggucgggggcuuaugugagcgccauugcgcagacugagaagucaaucgaagauaacccugagauagaagacgauauuuuccgcaagaaaagacuaaccaucauggaccugcauccgggagccggcaagacgaaaagguaccuccccgcaaucguucgggaggcuauuaagcgaggccugagaacacuuaucuuagccccaacucgcguggucgcugcagaaauggaggaggcccugagggggcucccuauucguuaucaaacccccgccauaaaaacagaacacaccggacgggagaucguggacuugaugugucaugcuacuuucaccaugagacugcucuccccaguuagggugccuaacuacaaucugauuaucauggaugaagcgcacuuuacagaccccgcaaguaucgccgcucgcgguuauauuucuacgcgagucgagaugggcgaggccgcagggauauucaugacugccaccccaccgggaagcagagauccuuuuccccaguccaacgcuccaaucauggacgaagagcgggaaauucccgagaggucauggaauucuggccacgaaugggugacagauuucaaggguaagaccguaugguuugugccuagcaucaaagcggggaacgacauugccgcaugccuucgcaagaauggaaaaaagguuauccagcugagucguaaaacuuucgauuccgaguacgucaagacaagagcuaacgacugggauuuuguggugaccacggacauaagcgagaugggcgccaauuucaaggcagaacgggucaucgauccaaggcgcuguaugaaacccguaauuuugacugacggcgaggaacgagugauccuagccgggccuaugccgguuacacauucuucagcugcccaaagacggggaaggauuggucgcaacccaaagaaugagaacgaccaguauaucuacaugggcgaaccccuggagaaugaugaggacugcgcgcacuggaaagaagcaaagaugcucuuagauaacauaaauaccccugaggggauuauccccuccauguuugaaccagagagagaaaaaguggacgccauugauggagaguacaggcugcggggcgaggcucguaagaccuucgucgaccuuaugcgccgaggugaucugccuguguggcucgccuauaaaguugcugcagaagggaucaacuacacugacagaaagugguguuuugauggcauaaagaauaaccagaucuuggaggaaaacauggagguggagauuuggacaaaagaaggagagaggaagaaacugaagccccgguggcucgacgcccgcaucuauagugauccacuggcucuuaaagaauucaaggaguucgccgcaggcagaaagagccuaacccugaauuugauuacagaaauggggagguuaccuacuuuuaugacgcagaaagcgcggaacgcccuggacaaucucgcuguccugcauaccgccgaggcaggaggucgagcuuacaaccacgcccuuucggagcugccggaaacacucgagacuuugcugcuacugacccuccuugcaacagugaccggcgggaucuuccuguuuuuaaugucuggaaagggcauagguaaaaugacuuuggggaugugcugcauuaucacggccuccauccugcucugguaugcucaaauucagccccacuggaucgcggccagcauaauucuggaauucuuucuuaucguacugcucauuccagagccugaaaagcagagaaccccccaggauaaucaauugacauacgugguuaucgcaauacugacugucguggcugccaccauggccaacgagaugggcuucuuagagaaaacaaagaaggaccuaggacugggcucaaucaccacucaggaaagugagucuaauauucucgacaucgaucuucgcccagcauccgcuuggacacuguaugccguggcgacgaccuuugucacuccuauguugaggcauagcauugaaaacucaaguguuaaugugagccugacagcuaucgccaaccaggcaaccguacucauggggcugggaaaagguuggccccuuuccaagauggacauuggcgugccgcuccuggccaucggguguuacucucaggucaauccaauaaccuugacagcugcacuguuacuacugguggcccacuacgcgauuaucggaccuggccuccaagcuaaagccacucgggaggcacagaagcgugccgcugccgguaucaugaaaaaccccacgguugaugggauuaccgugauagaccuugaaccaauccccuaugauccuaaguucgagaagcagcugggccaggucauguugcugauucucugcguaacacaagugcugaugaugagaacuaccugggcacuuugugaggcuuuaacacuggccaccggaccgaucagcacucucugggaaggcaaucccgggagguuuuggaacacgacaauugcgguuuccauggccaauaucuuccgcggaucauacuuggcaggcgcuggucugcuauuuucuauaaugaaaaacaccacuaguacccggcgagggacaggaaauaucggcgagacucugggugaaaaguggaaaucgagacucaacgcccuuggcaagagcgaguuccagauuuauaaaaaguccgggauccaggagguggacaggacccuggcaaaagaaggaauuaagcgcggcgagacagaucaucacgcugucucucgggggucagccaaguugagaugguuuguggaacguaacauggucacgccagagggaaaagugguugaccugggcugcgguagggggggauggagcuacuauuguggcggucucaagaaugugcgggaaguaaaaggccugaccaaggggggaccuggccaugaggagcccaucccuauguccacuuacggguggaacuuagugcgccuucaaaguggagucgauguuuucuucacaccacccgaaaaaugcgacacccugcucugugauauaggcgagucuagcccuaauccaacuauugaagccggucgaacacuaagagugcugaacuuggucgagaauuggcugaacaauaacacccaguuuugcgugaagguacucaaucccuauaugccgucagugaucgaaaagauggaggcgcuucagaggcaguacgggggagcucugguucggaacccuuugucccgcaauaguacgcacgagauguacugggugagcaacgcaaccggcaauaucgucucuuccgugaacaugauuucaagaaugcugauaaauagguucacaaugaaacacaagaaagccacuuaugaaccagacgucgaucucggcagcgggacccgaaacaucggaauugagucggaaauccccaacuuagacauuaucgguaagcggauagagaaaaucaagcaagaacaugagauuucuuggcacuacgaccaggaucauccuuauaagacaugggcuuaccacggcaguuaugagacuaaacagaccggguccgccagcucaauggugaauggaguuguacgucugcuuacaaagccaugggacgugguccccauggugacccagauggcaaugacugauacgacaccguuuggccaacagagaguuuucaaagaaaagguggacacccgcacucaggagccuaaagaagguaccaagaagcugaugaaaaucacagccgaguggcuauggaaggagcucgggaaaaagaaaacgcccaggauguguacccgggaagaguuuacuagaaagguccgcuccaacgcugcgcugggagccauuuucacagaugaaaauaaauggaagucugcaagggaggcuguggaagacggccgauuuugggaguugguagaucgggagagaaaccugcaccucgaaggcaagugcgagaccuguguguacaauaugauggggaaaagggaaaagaaacuuggagaguucgguaaggccaaaggcagccgcgcaaucugguauauguggcugggggcccguuuuuuagaauucgaggcucugggauuuuugaacgaggaccauugguucagucggggcaauucccucagcgguguugaaggggagggacugcacagacuaggcuacauucuuagggaugucggcaagaaggaagggggagccauguacgcggacgauacugcagguugggacacacgcauaacccuggaggaccucaaaaacgaagagauggugacaaaucauaugaagggcgagcacaaaaagcuggccgaagcuaucuuuaaauugacuuaucagaacaaggugguccgaguucaacggccaaccccuagagggacggugauggauauuaucucuaggcgcgaccagagaggaucaggccagguagguaccuacgggcugaauacauucacuaacauggaggcccaacucauccggcagauggaaggagagggcauuuucaagaguauacagcaucuuaccgcaacagaggaaaucgcugugcagaauuggcuggccagggucggccgugagcgauuaucccgcauggcuauuagcggggaugacugcgugguuaaacccaucgaugacagauuugccucugcacugacugcguugaacgauaugggaaaggugcggaaagacauucaacagugggaaccaucgagggguuggaaugauuggacccagguccccuucugcucacaccacuuucaugagcucgugaugaaggacggccgcguacugguugugccuuguagaaaccaggaugaacuaaucgggcgggccaggauaagccaaggagcuggcuggucccuuaaagagacggccugccuggguaagaguuaugcacagauguggacacucauguacuuccaccgacgugaccugagauuggcugccaacgcaaucuguucugccgucccaagccauugggugccgaccucccgcacuacauggucaauucacgcgaagcacgaguggaugaccacugaagauauguuagcuguguggaaucgggucuggauccaggagaaccccuggauggaagacaaaaccccuguugagaguugggaagaggugccauaucuggggaagagggaggaccaguggugcggaucucucauuggccuuacaagcagagccacgugggcaaaaaauauccaaaccgccauaaaccagguacgcucccugauuggcaaugaagaguacacugauuauaugcccucaaugaagcgguuuaggcgagaagaggaagaggcuggggugcuaugguga

SEQ ID NO: 14556 - RNA, 9876 nt, Artificial Sequence
  derived and/or modified CDS sequence (opt3) from DENV-2__EU482693__SS-prME
acagccggcgugaucguaaugcugauuccaacagcuauggcauuccaccucacuacgagaaacggggagccucauaugauaguuggaaggcaggaaaaggguaaaagccuucuguuuaagaccgaggacggcgugaauaugugcacauugauggccaucgauuuaggggaacugugugaggacacuauuaccuacaaaugcccacuacuccggcaaaacgaaccggaggauaucgacuguuggugcaauuccacaucuaccuggguaacuuauggaacauguaccacgacuggcgagcaccgccgagaaaagcguucaguggcgcugguaccacauguggguauggggcuugagaccagaacagaaacuuggaugaguagcgagggagcuuggaaacacguucagaggauugagaccuggauccugcggcauccuggcuucacaauaauggccgcaaucuuggccuacaccauuggcacgacucacuuucagcgcgcucucaucuucauucugcugacagcaguggccccauccaugaccaugagaugcaucgggauaucuaacagggauuuugucgaaggagugucggguggcucauggguugacauuguucucgagcacgggagcugugugacuacaauggcuaagaauaagcccaccuuagauuucgaacugaucaaaacggaggccaagcagccugcgacccuucggaaauauugcauugaagcaaaguugacaaacacuaccacagagagucgcuguccaacucaaggagagcccucccugaaugaagaacaggacaaacgauuuaucugcaagcauucuauggucgauagaggcugggguaacggguguggacuauucggcaagggcgggaucgugaccugcgccauguuuacaugcaaaaagaauauggaaggaaaagugguccagccugagaaccucgaauacaccauuguuauaacuccacacagcggugaggagcaugcugugggcaaugacacggggaagcacggaaaagaaaucaagauuacaccgcaguccucaaucaccgaggccgaacugacuggcuaugguaccguaacaauggaguguagucccaggaccgggcuugauuucaacgaaauggugcuguugcaaauggaggacaaagcauggcucguccaccggcagugguuucuggauuuaccucugccauggcuccccggcgcugacacucagggaagcaauuggauacagaaggagacacuugugacguucaagaacccucaugccaaaaagcaagacguugugguccugggcucucaggaaggggcgaugcacaccgccuugacuggagcaacagagauucagauguccucagguaaucuacuguuuaccggccaucucaaaugccgucugcgcauggauaaacuucaacugaaagggaugagcuacaguauguguacaggaaaguucaagaucgugaaagaaaucgcugagacucagcacggcaccauuguaaucagaguucaguaugagggugacgggucuccaugcaagauucccuucgaaauaacggauuuggagaaaaggcaugugcucggccggcugaucaccgucaacccgauugugacagaaaaggacuccccugucaacaucgaggccgaacccccauuuggagauagcuacaucauuauaggcguggagccugggcaguuaaaacugaauugguucaagaagggaucgucuaucggucaaauguuugagacuaccaugcgaggcgcuaaacgcauggccauucuaggggacacagcaugggauuucggaucccucggcgguguuuuuacuucaaucgggaaggcccugcaccagguguucggcgcuauuuacggagcggcauuuaguggcguaagcuggaccaugaaaauccuuauaggggucaucauuacguggaucggaaugaacuccagaucuaccagcuugucagugagucugguucucgugggcgucgugacccuguaucuuggugccguagugcaggcugacuccggguguguugucagcuggaagaauaaagaacugaagugcggaucuggcauuuucaucacugauaacgugcacacauggaccgagcaguacaaguuucaacccgaaucaccaaguaaauuggccagcgcaauacagaaggcccaugaggaagguauuuguggcaucagguccgugacucggcucgagaaucugauguggaaacagauuacccccgaguuaaaccacauccugucugaaaaugaggucaagcuaacaauaaugacgggggacaucaaaggaauuaugcaggcuggcaagcgcucgcucagaccucaaccaaccgaacugaaauauagcuggaagacuugggggaaggccaaaaugcuuuccacagagucacauaaccagaccuucuugaucgauggaccggaaacagcagagugccccaauacuaacagggcguggaauagucuggagguugaagacuacggcuuugguguguucaccacgaacauuuggcucaagcugcgugagaaacaggacguguuuugugauucuaaguuaaugagcgcugccaucaaagacaaucgggcaguacacgccgauaugggguauuggauagaauccgcucugaacgacacauggaagauggagaaggccucauucauugaggucaaaagcugccacuggccuaagucucauacccuuugguccaauggaguguuggaaagugagaugaucauccccaagaauuucgcaggccccguuagccagcacaacuaccgaccugguuaucauacucaaaccgcuggcccauggcaccucgggaagcuggaaauggauuuugaccuaugugagggaacaacuguggucgugaccgaagauugcggcaauagagggcccucucugaggacaacgaccgccuccggaaaacucauuacugaguggugcugucgcucaugcacacugccgccucuucgguacagaggcgaggacgguuguugguacgggauggaaaucaggccauugaaggagaaggaagagaaccugguuaauaguuuagugaccgcgggacauggccagauugauaacuucagccucgguguacugggcauggcccuuuuucuggaagagauguugcgcacucgaauagggacaaaacacgcuacccuccuggucgcagugucguucgugacgcuaaucacuggaaauauguccuuucgggaccugggccgugucaugguuauggugggggccaccaugacagaugacauuggaaugggcguaaccuaucucgcucugcuugccgcauucaaggugagacccacuuuugcggccgguuugcuguuaaggaaacucacaucuaaggagcugaugauggcuaccaucgggauugcccuucugagccagucaacaaucccugaaacuauacuagagcucaccgaugcacuggcuuugggaaugaugguccugaaaaucgugcgcaacauggaaaaguaccaauuagccguuacgauuauggcaaucaguugcgugcccaaugccgucauucuccagaacgcuuggaagguguccuguacaauccuggcggccguuucugugagcccacuucuguugaccuccucacagcagaaagcagacuggauaccucucgcucugacuauuaagggccuaaaucccaccgccaucuuccugacaacucuuagccggaccaguaaaaagagaucuuggccacucaacgaggccaucauggcugucggcaugguauccauucuggcaagcucguugcugaaaaaugacauaccgaugacggggccuuuaguggccggaggucuccugacaguuugcuaugugcuuaccggcaggucagcggaucuggaauuggagcgagcugccgacgucaagugggaggaucaagcagaaaucucugggaguucccccauucucagcaucacuauuucugaggacggaagcauguccaucaaaaacgaagaggaggaacagacacugaccauacuaauccgcacuggccugcuugugauuucagguguauuuccagugaguauccccauuacagccgcugcaugguaccucugggaggucaagaagcagcgggccgggguucugugggaugugccuagcccacccccuguggaaaaagcggaguuggaagacggagcuuauagaaucaagcagaggggcauauuaggcuacucucaaauuggggccggagucuauaaagaggguaccuuccacacgauguggcaugugacucguggcgcaguucugaugcaccgcgggaagcggaucgagccguccugggccgaugucaaaaaggaccucaucucauacggaggcgguuggaagcuggaaggggaguggaaagaaggagaggaagugcagguccuugcucuggagccaggcaagaaucccagagccgugcagaccaaaccuggcauuuuuaagacaaacaccgggacaaucggagcaguuaguuuggauuucagcccagguacuuccggcucucccauaguggacaggaaagggaaggucgugggacuauacggcaaugguguagucacccgaucgggggcuuaugugagcgccauugcgcagacggagaagucaaucgaagauaacccugagauugaagacgauaucuuucggaaaaagcgccugacaauaauggaccuccauccgggagccggcaaaacuaagagauaccugcccgcaauuguuagggaggcuaucaaacggggccuucgaaccuuaauccuggccccaacaagaguggucgcugcagaaauggaggaggcccuccgcggguugccuauuagguaucaaacccccgccaucaagacugaacacaccggacgugagauuguggaccugaugugucaugcuacauucacgaugcggcuccuguccccaguuagagugccuaacuacaaucuuauaaucauggaugaagcgcacuucacugaccccgcaaguauugccgcuagggguuauaucucuacccgcgucgagaugggcgaggccgcagggaucuuuaugacagccaccccaccgggaagccgagauccuuucccccaguccaacgcuccaauuauggacgaagagagagaaauacccgagcggucauggaacucuggccacgaaugggugacugauuuuaaggguaaaacaguaugguucgugccuagcaucaaggcggggaacgacauugccgcaugccugaggaaaaauggaaagaaaguuauccaguugagucgcaagaccuuugauuccgaguacgucaagacgcgugcuaacgacugggauuucguggugacuacagacauuagcgagaugggcgccaauuuuaaagcagaaagagucaucgauccacggagguguaugaagcccguaauacuaaccgacggcgaggaacgcgugauccuggccgggccuaugccgguuacccauucuucagcugcccaacgaagaggacggauugguaggaaccccaaaaaugagaacgaccaguauaucuacaugggcgaaccccucgagaaugaugaggacugcgcgcacuggaaggaagcaaaaauguuacuggauaacauuaauacuccugaggggaucauacccuccauguucgaaccagagcgcgaaaagguggacgccauugauggagaguacagacuuaggggcgaggcucggaaaacauuugucgaccugaugcgucgcggugaucucccugugugguuggccuauaagguugcugcagaagggaucaacuacgccgaccgaaagugguguuucgauggcauuaaaaauaaccagauccuggaggaaaacauggagguggagauauggaccaaggaaggagagaggaaaaagcucaaacccagauggcuggacgcucggaucuauagugauccacuugcccuaaaggaauuuaaggaguucgcagcgggccgcaaaagccugacauugaauuuaauuacugaaauggggagacugccuacguucaugacccagaaggccaggaacgcucucgacaaucuggccguccuucauacagcagaggcuggaggucgggccuacaaccacgcacugucggagcucccggaaacuuuggagacccugcuacugcucacacuucuggccaccgugacuggcgggaucuuuuuauucuugaugucuggaaaaggcauugguaagaugacgcuggggaugugcugcaucauaaccgcuuccauucuccugugguaugcgcaaauccagccccacuggaucgccgcaagcauuauccuugaauuuuuccugauaguacucuugauuccagagccugaaaaacagcgaacaccccaggauaaucaacugacuuacgugguuaucgcuauuuuaaccgucguggccgccacaauggcaaacgagaugggcuuucuagagaagaccaagaaagaccugggacucggcucaaucacuacacaggaaagugagucuaauauacuugacaucgaucugagaccagcuuccgccuggacguuguaugcgguggcuaccacuuucgucacaccuaugcugcgccauagcauugaaaacucaaguguuaaugugagccucaccgccaucgcaaaccaggccaccguacugauggggcuuggaaaggguuggccccucuccaaaauggacauuggcgugccgcuguuggcuaucggguguuacucucaggucaauccaauuacacugacugcagccuuacuacugcucguggcgcacuacgcuaucauaggaccuggccuucaagccaaggcaacgagggaggcccagaaacgggcugccgcagguauuaugaagaaccccaccguugaugggaucacagugaucgaccuggaaccaauucccuaugauccuaaguuugagaaacaguugggccaggucaugcugcucauacugugcguaacucaagugcuuaugaugcguaccacaugggcuuuaugugaggcccugacccucgcgacuggaccgaucagcacguugugggaaggcaaucccgggagauucuggaacacaaccauugccguuuccauggcaaauaucuuuaggggaucauaccuggcuggcgccggucuacuguucucuauuaugaagaacacuaccaguacacgccgggggacuggaaauaucggcgagacccucggugaaaaauggaagucgcgacuuaacgcacugggcaaaagcgaguuucagauauauaagaaauccgggauccaggagguggacagaacauuggcuaaggaaggaauuaagaggggcgagacggaucaucacgccgucucucgcgggucagccaaacugcggugguucguggaaagaaacauggucaccccagagggaaaggugguugaccucggcugcggucgugggggauggagcuacuauuguggcggucugaaaaaugugagggaaguaaagggcuuaacuaaagggggaccuggccaugaggagcccaucccuauguccacauacggguggaaccuugugcggcugcaaaguggagucgauguauuuuucaccccacccgaaaagugcgacacucuccuaugugauauuggcgagucuagcccuaauccaacaaucgaagcgggucgcacccugcgaguguugaaccuggucgagaauuggcucaacaauaacacgcaguucugcauaaaggugcuuaaucccuauaugccgucaguaauugagaaaauggaggcucugcagagaaaguacgggggagcauuggugaggaacccucugucccggaauaguacccacgagauguacuggguuagcaacgccacaggcaauaucgugucuuccgucaacaugaucucacgcaugcucauuaauagauuuacuaugaaacacaagaaagcuaccuaugaaccagacguggauuuaggcagcgggacaaggaacauaggaaucgagucggaaauucccaaccuggacaucauugguaagcgaaucgagaagauaaaacaggaacaugagacuucuuggcacuacgaccaagaucauccuuauaagaccugggccuaccacggcaguuaugagacaaaacagaccggguccgcaagcucaauggucaauggagugguucggcuucugacuaagccaugggacguagugcccauggucacgcagauggccaugacagauaccacuccguucggccagcaacguguguuuaaagaaaagguugacaccagaacacaggagccuaaggaagguacgaaaaagcuaaugaaaaucaccgcugaguggcucuggaaggagcuggggaaaaagaaaacuccccgcauguguacaagggaagaguucacccggaaggugagauccaacgcggccuugggagcaauuuuuacugaugaaaauaaguggaaaucugcucgcgaggccgucgaagacggcagguucugggagcugguggaucgagagcggaaccuccaccuugaaggcaagugcgagacauguguauacaauaugauggggaaaagagaaaagaaacugggagaguuugguaaggcaaagggcagcagggccaucugguauaugugguuaggggcucgcuuccuggaauuugaggccuugggauuccucaacgaggaccauugguuuagucguggcaauucccugagcgguguggaaggggagggacuacaccggcuuggcuacauucugagagauguuucuaaaaaggaaggcggggcgauguacgcagacgauaccgccggaugggacacaaggaucacucucgaggaccugaaaaacgaagagauggucaccaaucauaugaagggugagcacaaaaaguuggcugaagccauuuucaagcugacguaucagaacaaaguggugcgcguccagcgaccaaccccucggggcacaguuauggauauaaucucaagaagggaccaacgcgggaguggacaggugggcacuuacggucucaauaccuuuacaaacauggaggcacagcuuauuagacaaauggaaggggagggaaucuucaaguccauccagcaucugacugcugccgaggaaaauguagugcagaacugguuagcucgggucggcagggagcgucugagccgaauggccauuucuggcgaugacugcgugguuaaacccauagaugaccgcuucgcaucggcguugaccgcccucaaugauauggggaaggugagaaaagacauccagcaaugggaaccaucacggggauggaacgauuggacgcagguccccuuuugcagccaccacuuccaugagcuggugaugaaggacgguaggguccuaguugugccuugucgcaaccaggaugaacuuauuggcagagcucggaucucccagggggccggauggagucugaaggagacagcaugccucggcaaaucuuaugcucaaauguggacccugauguacuuucacaggcgagacuugcguuuagccgcaaaugccauuuguagcgcggucccaucccauugggugccgacuucaagaacaaccuggaguauccacgcuaagcacgaguggaugacuaccgaagauaugcuggccguguggaaccgcgucuggauacaggagaaucccuggauggaagacaaaacaccuguugagucuugggaagaggugccauaucucgguaagcgggaggaccaguggugcgggagccuuaucggacugacguccagggcaaccugggccaaaaacauucagacugcuaucaaucaaguaagaucacuaauuggcaacgaagaguacacagauuauaugcccagcaugaagcgcuuccggagggaagaggaagaggccggcgugcugugguga

SEQ ID NO: 14557 - RNA, 9876 nt, Artificial Sequence
  derived and/or modified CDS sequence (opt3) from DENV-2__EU596483__SS-prME
accgccggcgugaucguaaugcugauuccaacggcuauggcauuccaccucacuacgagaaacggggaaccucauaugauaguuggaaggcaggaaaaggguaaaagccuucuguuuaagaccgaagacggcgugaauaugugcacauugauggccaucgauuuaggggaacugugugaagacacuauuaccuacaaaugcccacuacuccggcaaaacgaaccggaagauaucgacuguuggugcaauuccacaucuaccuggguaacuuauggaacauguaccacgacuggcgagcaccgccgagaaaagcguucaguggcgcuggucccccauguggguauggggcuugagaccagaacagaaacuuggaugaguagcgagggagcuuggaaacacguucagaggauugagaccuggauccugcggcauccuggcuucacaauaauggccgcaaucuuggccuacaccauuggcacgacucacuuucagcgcgcucucaucuucauucugcugacagcaguggccccauccaugaccaugagaugcaucgggauaucuaacagggauuuugucgaaggagugucggguggcucauggguagacauuguucucgagcacgggagcugugugacuacaauggcuaagaauaagcccaccuuagauuucgaacugaucaaaacggaggccaagcagccugcgacccuucggaaauauugcauugaagcaaaguugacaaacacuaccacagagagucgcuguccaacucaaggagagcccucccugaaugaagaacaggacaaacgauuuaucugcaagcauucuauggucgauagaggcugggguaacggguguggacuauucggcaagggcgggaucgugaccugcgccauguuuacaugcaaaaagaauauggaaggaaaagugguccagccugagaaccucgaauacaccauuguuauaacuccacacagcggugaggagcaugcugugggcaaugacacggggaagcacggaaaagaaaucaagauuacaccgcaguccucaaucaccgaggccgaacugacuggcuaugguaccguaacaauggaguguagucccaggaccgggcuugauuucaacgaaauggugcuguugcaaauggaggacaaagcauggcucguccaccggcagugguuucuggauuuaccucugccauggcuccccggcgcugacacucagggaagcaauuggauacagaaggagacacuugugacguucaagaacccucaugccaaaaagcaagacguugugguccugggcucucaggaaggggcgaugcacaccgccuugacuggagcaacagagauucagauguccucagguaaucuacuguuuaccggccaucucaaaugccgucugcgcauggauaaacuucaacugaaagggaugagcuacaguauguguacaggaaaguucaagaucgugaaagaaaucgcugagacucagcacggcaccauuguaaucagaguucaguaugagggugacgggucuccaugcaagauucccuucgaaauaacggauuuggagaaaaggcaugugcucggccggcugaucaccgucaacccgauugugacagaaaaggacuccccugucaacaucgaggccgaacccccauuuggagauagcuacaucauuauaggcguggagccugggcaguuaaaacugaauugguucaagaagggaucgucuaucggucaaauguuugagacuaccaugcgaggcgcuaaacgcauggccauucuaggggacacagcaugggauuucggaucccucggcgguguuuuuacuucaaucgggaaggcccugcaccagguguucggcgcuauuuacggagcggcauuuaguggcguaagcuggaccaugaaaauccuuauaggggucaucauuacguggaucggaaugaacuccagaucuacuagcuugucagugagucugguucucgugggcgucgugacccuguaucuuggugccguagugcaggcugacuccggguguguugucagcuggaagaauaaagaacugaagugcggaucuggcauuuucaucacugauaacgugcacacauggaccgagcaguacaaguuucaacccgaaucaccaaguaaauuggccagcgcaauacagaaggcccaugaggaagguauuuguggcaucagguccgugacucggcucgagaaucugauguggaaacagauuacccccgaguuaaaccacauccugucugaaaaugaggucaagcuaacaauaaugacgggggacaucaaaggaauuaugcaggcuggcaagcgcucgcucagaccucaaccaaccgaacugaaauauagcuggaagacuugggggaaggccaaaaugcuuuccacagagucacauaaccagaccuucuugaucgauggaccggaaacagcagagugccccaauacuaacagggcguggaauagucuggagguugaagacuacggcuuugguguguucaccacgaacauuuggcucaagcugcgugagaaacaggacguguuuugugauucuaaguuaaugagcgcugccaucaaagacaaucgggcaguacacgccgauaugggguauuggauggaauccgcucugaacgacacauggaagauggagaaggccucauucauagaggucaaaagcugccacuggccuaagucucauacccuuugguccaauggaguguuggaaagugagaugauuauccccaagaauuucgcaggccccguuagccagcacaacuaccgaccugguuaucauacucaaaccgcuggcccauggcaccucgggaagcuggaaauggauuuugacuucugugagggaacaacuguggucgugaccgaagauugcggcaauagagggcccucucuaaggacaacgaccgccuccggaaaacugaucacugaguggugcugucgcucaugcacacucccgccucugcgguacagaggcgaggacgguuguugguacgggauggaaauuaggccacuuaaggagaaggaagagaacuugguuaauagucuggugaccgcgggacauggccagaucgauaacuuuagcuuagguguacucggcauggcccuguuccuugaagagaugcugcgcacucgaauugggacaaaacacgcuauauugcucgucgcagugucguuugugacccugaucacgggaaauauguccuuccgggaccuaggccgugucaugguuauggugggggccacuaugaccgaugacauuggaaugggcguaacauaucuggcucuccuggccgcauuuaaggugagacccaccuucgcggccggucuuuugcugaggaaauuaacuucuaaggagcucaugauggcuacaaucgggauugcccugcuuagccagucaaccaucccugaaacaauacuggagcuaacugaugcacucgcucugggaaugauggucuugaaaaucgugcgcaacauggaaaaguaccaacuggccguuaccauuauggcaaucaguugcgugcccaaugccgucauuuuacagaacgcuuggaagguguccuguacgauccucgcggccguuucugugagcccacugcuucugacauccucacagcagaaagcagacuggauaccuuuggcucucaccauuaagggccugaaucccacugccaucuuucuaaccacacugagccggacaaguaaaaagagaucuuggccacuuaacgaggccaucauggcugucggcaugguauccauucucgcaagcucgcuguugaaaaaugacauaccgaugaccgggccucugguggccggagguuuacucacgguuugcuaugugcugacaggcaggucagcggaucuugaacuggagcgagcugccgacgucaagugggaggaucaagcagaaaucucugggaguucccccauuuugagcaucaccauuucugaggacggaagcauguccaucaaaaacgaagaggaggaacagacucucacaauacugauccgcaccggccuacuggugauuucagguguauucccagugaguauccccauuacugccgcugcaugguaccuuugggaggucaagaagcagcgggccgggguucucugggaugugccuagcccacccccuguggaaaaagcggagcuggaagacggagcuuauagaaucaagcagaggggcauauugggcuacucucaaauuggggccggagucuauaaagaggguacauuucacaccauguggcaugugacgcguggcgcaguuuuaaugcaccgcgggaagcggaucgagccguccugggccgaugucaagaaggaccugaucucauacggaggcgguuggaagcucgaaggggaguggaaagaaggagaggaagugcagguccuggcucuugagccaggcaagaaucccagagccgugcagacuaaaccuggcauuuucaagaccaacacagggaccaucggagcaguuagucuggauuuuagcccagguacauccggcucucccauaguggacaggaaagggaaggucgugggauuguacggcaaugguguagucacucgaucgggggcuuaugugagcgccauugcgcagaccgagaagucaaucgaagauaacccugagauugaagacgauaucuuccggaaaaagcgccuaacgauaauggaccugcauccgggagccggcaaaacaaagagauaccuccccgcaauuguuagggaggcuaucaaacggggccugcgaacucuuaucuuagccccaaccagaguggucgcugcagaaauggaggaggcccugcgcgggcucccuauuagguaucaaacacccgccaucaagaccgaacacacuggacgugagauuguggacuugaugugucaugcuaccuucacaaugcggcugcucuccccaguuagagugccuaacuacaaucugauaaucauggaugaagcgcacuuuacggaccccgcaaguauugccgcuagggguuauaucucuacucgcgucgagaugggcgaggccgcagggaucuucaugaccgccacaccaccgggaagccgagauccuuuuccccaguccaacgcuccaauuauggacgaagagagagaaauacccgagcggucauggaacucuggccacgaaugggugaccgauuucaaggguaaaacuguaugguuugugccuagcaucaaggcggggaacgacauugccgcaugccuuaggaaaaauggaaagaaaguuauccagcugagucgcaagacauucgauuccgaguacgucaagacccgugcuaacgacugggauuuuguggugacgacugacauuagcgagaugggcgccaauuucaaagcagaaagagucaucgauccacggagguguaugaagcccguaauauugacagacggcgaggaacgcgugauccuagccgggccuaugccgguuacccauucuucagcugcccaacgaagaggacggauugguaggaaccccaaaaaugagaacgaccaguauaucuacaugggcgaaccccuggagaaugaugaggacugcgcgcacuggaaggaagcaaaaaugcucuuagauaacauuaauaccccugaggggaucauacccuccauguuugaaccagagcgcgaaaagguggacgccauugauggagaguacagacugaggggcgaggcucggaaaacuuucgucgaccuuaugcgucgcggugaucugccuguguggcucgccuauaagguugcugcagaagggaucaacuacacagaccgaaagugguguuuugauggcauuaaaaauaaccagaucuuggaggaaaacauggagguggagauauggaccaaggaaggagagaggaaaaagcugaaacccagauggcucgacgcccggaucuauagugauccacuggcucuuaaggaguucaaggaguucgccgcaggccgcaaaagccuaacacugaauuugauuacugaaauggggagauuaccuacguuuaugacccagaaggcgaggaacgcccuggacaaucucgcuguccugcauacagccgaggcaggaggucgggcuuacaaccacgcccuuucggagcugccggaaacucucgagaccuugcugcuacugacacuccuugcaaccgugacuggcgggaucuuccuguuuuuaaugucuggaaaaggcauugguaagaugacguuggggaugugcugcaucauaaccgccuccauucugcucugguaugcucaaauccagccccacuggaucgcggccagcauuauccuggaguucuuucuuauaguacugcucauuccagagccugaaaaacagcgaacaccccaggauaaucaauugacuuacgugguuaucgcaauucugaccgucguggcugccacaauggccaacgagaugggcuucuuagagaagaccaagaaagaccuaggacugggcucaaucacuacacaggaaagugagucuaauauacucgacaucgaucuuagaccagcauccgcuuggacgcuguaugccguggcgaccacuuuugucacaccuauguugcgccauagcauugaaaacucaaguguuaaugugagccugaccgcuaucgccaaccaggcaaccguacucauggggcugggaaaggguuggccccuuuccaaaauggacauuggcgugccgcuccuggccaucggguguuacucucaggucaauccaauuacauugacugcugcacuguuacuacugguggcccacuacgcgaucauaggaccuggccuccaagcuaaggccacgagggaggcacagaaacgggccgcugccgguauuaugaagaaccccaccguugaugggaucacagugaucgaccuugaaccaauucccuaugauccuaaguucgagaaacagcugggccaggucauguugcugauacucugcguaacucaagugcugaugaugcguaccacaugggcacuuugugaggcuuuaacccuggccacuggaccgaucagcacgcucugggaaggcaaucccgggagauuuuggaacacaaccauugcgguuuccauggccaauaucuucaggggaucauacuuggcaggcgcuggucugcuauuuucuauuaugaagaacacuaccaguacacgccgggggacuggaaauaucggcgagacccugggugaaaaauggaagucgcgacucaacgcccuuggcaaaagcgaguuccagauauauaagaaauccgggauccaggagguggacagaacacuggcaaaggaaggaauuaagaggggcgagacggaucaucacgcugucucucgcgggucagccaaauugcggugguuuguggaaagaaacauggucaccccagagggaaaggugguugaccugggcugcggucgugggggauggagcuacuauuguggcggucucaaaaaugugagggaaguaaagggccugacuaaagggggaccuggccaugaggagcccaucccuauguccacauacggguggaacuuagugcggcuucaaaguggagucgauguuuucuucaccccacccgaaaagugcgacacucugcucugugauauuggcgagucuagcccuaauccaacaaucgaagccggucgcacccuacgagugcugaacuuggucgagaauuggcugaacaauaacacgcaguuuugcauaaaggugcucaaucccuauaugccgucaguaauugagaaaauggaggcgcuucagagacaguacgggggagcucuggugaggaacccuuugucccggaauaguacccacgagauguacuggguuagcaacgcaacaggcaauaucgugucuuccgucaacaugaucucacgcaugcugauuaauagauucacuaugaagcacaaaaaggccaccuaugaaccagacguggaucucggcagcgggacaaggaacauaggaaucgagucggaaauucccaacuuagacaucauugguaaacgaaucgagaagauaaagcaagaacaugagaucucuuggcacuacgaccaggaucauccuuauaaaacuugggcuuaccacggcaguuaugagaccaagcagacaggguccgccagcucaauggucaauggagugguucggcugcuuaccaaaccaugggacguagugcccauggucacucagauggcaaugacggauacaaccccguuuggccaacagcguguguucaaggaaaaaguugacacuagaacccaggagccuaaggaagguacaaagaaacugaugaagauuacggccgaguggcuauggaaagagcucgggaagaaaaagaccccacgcauguguacuagggaagaguuuacacggaaagugagauccaacgcugcgcugggagccaucuucaccgaugaaaauaaguggaagucugcacgcgaggcugucgaagacggcagguuuugggaguugguggaucgagagcggaaccugcaccucgaaggcaaaugcgagacuuguguauacaauaugauggggaagagagagaagaaacuuggagaguucgguaaagccaaaggcagcagggcaauuugguauauguggcugggggcccgcuuuuuagaguucgaggcucugggauuuuugaacgaggaccauugguucagucguggcaauucccucagcgguguggaaggggagggacugcaccggcuaggcuacauccuuagagauguuggcaagaaagaagggggagccauguacgcggacgauacagcagguugggacaccaggauuacacuggaggaccucaagaacgaagagauggucacuaaucauaugaaaggcgagcacaagaaacuggccgaagcuauauuuaaguugaccuaucagaacaagguggugcgcguccaacgaccaacgccucgggggaccguuauggauaucauuucuagaagggaccagcgcggaucaggccagguggguacauacgggcugaauacuuucaccaacauggaggcccaacucaucagacagauggaaggagagggcaucuucaaaaguauucagcaucuuacagcaacugaggaaauagcuguacagaauuggcuggcccgggugggcagggagcguuuaucccgaauggcuaucagcggggaugacugcgucgugaagcccauugaugaccgcuuugccucugcacugaccgcguugaacgauaugggaaaaguuagaaaggacauccaacagugggaaccaucgcgggguuggaaugauuggacacaggugcccuucugcucacaccacuuucaugagcucgucaugaaagacggcagggugcugguaguuccuugucgcaaccaggaugaacuaauugggagagcccggaucagccaaggagcuggcuggucccuuaaggagacagccugccuggguaagaguuaugcacagauguggacccucauguacuuccacaggcgagaccugcguuuggcugccaacgcaauauguucugccgugccaagccauugggucccgacuuccagaacaaccuggucaauccacgcgaaacacgaguggaugacuaccgaagauauguuagcuguguggaaucgcguguggauucaggagaaccccuggauggaagacaagacaccugucgagaguugggaagagguuccauaucuggggaaacgggaggaccaguggugcggaucucucaucggccuuacgagcagggccaccugggcaaagaauauucaaacugccaucaaccaggugagaucccugauaggcaaugaagaguacacagauuauaugcccucaaugaaacgcuuucggagggaagaggaagagaccgggguacuaugguga

SEQ ID NO: 14558 - RNA, 9876 nt, Artificial Sequence
  derived and/or modified CDS sequence (opt3) from DENV-2__EU482597__SS-prME
accgccggagugaucgucaugcugauucccacugcuauggcauuccaccucacuacgagaaauggggagccucauaugauaguuggaaggcaggaaaaggguaaaagccuucuguuuaagaccgaggacggcgugaauaugugcacauugauggccaucgauuuaggggaacugugugaggacacuauuaccuacaaaugcccacuacuccggcaaaacgaaccggaggauaucgacuguuggugcaauuccaccucuaccuggguaacuuauggaacauguaccacgacuggcgagcaccgccgagaaaagcguucaguggcgcuggucccccauguggguauggggcuugagaccaggacagaaacuuggaugaguagcgagggagcuuggaaacacguucagaggauugagaccuggauccugcggcauccuggcuucacaauuauggccgcaaucuuggccuacaccauuggcacgacucacuuucagcgcgcucucaucuucauucugcugacagcaguggccccauccaugaccaugagaugcaucgggauaucuaacagggauuuugucgaaggagugucggguggcucauggguagacauuguucucgagcacgggagcugugugacuacaauggcuaagaauaagcccaccuuagauuucgaacugaucaaaacggaggccaagcagccugcgacccuucggaaauauugcauugaagcaaaguugacaaacacuaccacagagagucgcuguccaacucaaggagagcccucccugucugaggaacaggacaaacgauuuaucugcaagcauagcauggucgauagaggcugggguaauggguguggacuauucggcaagggcgggaucgugaccugcgccauguuuacaugcaaaaagaacauggaaggaaaagugguccagccugagaaucucgaauacaccauuguuauaacuccacacuccggugaggagcaugcugugggcaacgacacggggaagcacggaaaagaaaucaagauuacaccgcagucaaguaucaccgaggccgaacugacuggcuaugguaccguaacaauggaguguagccccaggaccgggcuugauuucaaugaaauggugcuguugcaaauggaggacaaagcauggcucguccaccggcagugguuucuggauuuaccucugccauggcuccccggcgcugacacucagggaucuaacuggauacagaaggagacacuugugacguucaagaauccucaugccaaaaagcaagacguugugguccugggcucccaggaaggggcgaugcacaccgccuugacuggagcaacagagauucagaugucaagcgguaaccuacuguuuaccggccaucucaaaugccgucugcgcauggauaaacuucaacugaaagggaugaguuacucuauguguacaggaaaguucaagaucgugaaagaaaucgcugagacucagcacggcaccauuguaaucagaguucaguaugagggugacggguccccaugcaagauucccuucgaaauaacggauuuggagaaaaggcaugugcucggccggcugaucaccgucaauccgauugugacagaaaaggacagcccugucaacaucgaggccgaacccccauuuggagauucguacaucauuauaggcguggagccugggcaguuaaaacugaacugguucaagaagggaucuuccaucggucaaauguuugagacuaccaugcgaggcgcuaaacgcauggccauucuaggggacacagcaugggauuucggaucacucggcgguguuuuuacaaguaucgggaaggcccugcaccagguguucggcgcuauuuacggagcggcauuuagcggcguauccuggaccaugaaaauccuuauaggggucaucauuacguggaucggaaugaacucuagaagcacaucauugagugugucccugguucucgugggcgucgugacccuguaucuuggugccaugguacaggcugacagcgggugugugguuucuuggaagaacaaagaacugaagugcggaucaggcauuuucaucacugauaauguccacacauggaccgagcaguacaaguuucaacccgaaaguccaagcaaauuggccuccgcaauacagaaggcccaugaggaagguauuuguggcaucaggucugugacucggcucgagaaccugauguggaaacagauuacccccgaguuaaaucacauccugucggaaaacgaggugaagcuaacaauaaugacgggggacauccgcggaauuaugcaggcuggcaaaagaagccucaggccucaaccaaccgaacugaaguauuccuggaaaacuugggggaaggccaagaugcuuucaacagagagucauaaucagaccuucuugaucgauggaccggaaacagcagagugccccaacacuaaucgugcguggaacucucuggaggucgaagacuacggcuuugguguuuucaccacgaauauuuggcucaaacugcgggagaagcaggacguguuuugugauagcaaauuaauguccgcugccaucaaggacaaccgagcagugcacgccgauaugggguauuggauagaaucagcucugaaugacacauggaaaauggagaaggccagcuucauugagguaaagucuugccacuggccuaaaucccauacccuuuggaguaacggagucuuggaaagcgagaugaucaucccaaagaauuucgcaggccccgugucucagcacaacuacagaccugguuaucauacucaaaccgcuggcccauggcaccucgggaaacuggaaauggauuuugaccuaugugagggaacaacuguuguggucaccgaagauugcggcaacagggggcccucccugcgcacaacgaccgccucaggaaagcucauuacugaguggugcugucggaguugcacacugccgccucuuagauacaggggcgaggacgguuguugguacgggauggaaauccgcccauugaaagagaaggaagagaaucuggugaacagcuuaguuaccgcgggacauggccagauugauaauuucucgcucggugugcugggcauggcccuuuuucuggaagagauguugcgaacucggauagggacaaagcacgcuauccuccugguagcagucuccuucgugacccuaauuacgggaaacaugucuuuucgugaccugggcagagugauggucaugguuggggccacuaugaccgaugacaucggaaugggcgugacauaucucgcucugcuugccgcauucaaaguaaggcccaccuuugcggccgguuugcuguuacgcaagcucacuagcaaagagcugaugauggcuacaauugggaucgcccuucugucacagaguaccauaccugaaacaauccuagagcucacugaugcacuggcuuugggaaugauggugcugaagauuguccggaauauggaaaaauaccaauuagccgugaccaucauggcaauuuccugcguucccaacgccgugauccuccagaaugcuuggaaggucucuuguacgauacuggcggccgugagcguuuccccacuucuguugacaucaagccagcagaaggcagacuggauuccucucgcucugaccaucaaaggccuaaaccccacugccaucuuccugaccacacuuaguagaacuucuaagaaaagguccuggccacucaaugaggccauuauggcugugggcauggucagcauacuggcaucgucauugcugaagaacgacaucccgaugaccgggccuuuaguagccggaggucuccugacggugugcuauguucuuacaggccgaucugcggaucuggaauuggagcgcgcugccgacgugaaaugggaggaucaagcagaaauuaguggguccagccccauccucucuauuaccaucagcgaggacggauccaugucaauaaagaaugaagaggaggaacagacucugacaauccuaauucggaccggccugcuugucaucagugguguguuuccaguaagcauucccaucacugccgcugcaugguaccucugggaggugaaaaagcagagagccgggguccugugggauguuccuucuccacccccuguggaaaaggcggaguuggaagacggagcuuauaggauaaaacagcguggcauuuuaggcuacucccaaaucggggccggaguguauaaggaggguacauuccacaccauguggcaugucacgcgcggcgcagugcugaugcaccgggggaaaagaaucgagccgucaugggccgauguuaagaaagaccucauuaguuacggaggcgguuggaagcuggaaggggaguggaaggaaggagaggaaguacaggugcuugcucuggagccaggcaaaaaccccagggccguccagacuaagccuggcaucuuuaaaaccaauacagggaccauaggagcagugagcuuggauuucuccccagguacaucuggcucgcccauuguugaccgaaaggggaaaguggucggacuauacggcaacggugugguaacucggagcggggcuuaugucucagccaucgcgcagaccgagaaguccauugaagauaauccugagaucgaagacgauauauuucgcaagaaaagacugacgauuauggaccuccauccgggagccggcaagacaaaaagguaccugcccgcaaucgugcgggaggcuaucaagcgaggccuuagaacuuuaauucuggccccaacccgcguuguggcugcagaaauggaggaggcccucaggggguugccuauccguuaucaaacaaccgccauuaaaacugaacacaccggacgggagauagucgaccugaugugucaugcuacauucacgaugagacuccugagucccgugaggguuccaaacuacaaccuuaucauuauggaugaagcgcacuucacugacccugcaucuaucgccgcucgcgguuauaucagcacccgaguggagaugggcgaggccgcagggauuuuuaugacagccacacccccaggauccagagauccguucccucagucaaaugcucccauaauggacgaagaacgggaaaucccagagaggucuuggaacagcggccacgaaugggucacugauuuuaaggguaagacagugugguucguacccaguauuaaagcggggaaugacaucgccgcaugccugcgcaagaacggcaagaaggugauucaguugucccguaaaaccuuugauagcgaguacguuaagacgagagcuaaugacugggauuucgucgugacuacagacaucucugagaugggcgccaacuuuaaggcagaacgggugauagauccuaggcgcuguaugaaaccagucauccuaaccgacggcgaggaacgaguaauucuggccgggcccaugccugugacccauucauccgcugcccaaagacggggaaggaucggucgcaauccgaagaacgagaaugaccaguauauuuacaugggcgaaccacucgagaacgaugaggacugcgcgcacuggaaagaagcaaagauguuacuggauaauaucaacacucccgaggggauaauuccuaguauguucgaacccgagagagaaaaaguugacgccaucgauggagaguacaggcuucggggcgaggcucguaagacauuuguggaccugaugcgccgaggugaucucccagucugguuggccuauaaaguggcugcagaagggauuaauuacgccgacagaaagugguguuucgauggcaucaagaacaaucagauacuggaggaaaacauggagguugagaucuggaccaaagaaggagagaggaagaaacucaagccucgguggcuggacgcucgcauuuauagcgauccccuugcccuaaaagaauuuaaggaguucgcagcgggcagaaagucgcugacauugaacuuaaucacugaaauggggaggcugccaacguucaugacccagaaagcccggaaugcucucgacaaccuggccgugcuucauacagcagaggcuggaggucgagccuacaaucacgcacugucugagcucccugaaacuuuggagacccugcuacugcucacacuucuggccaccgucacuggcgggauauuuuuauucuugauguccggaaagggcaucgguaaaaugacgcuggggaugugcugcauaauuaccgcuagcauccuccugugguaugcgcaaauccagccgcacuggauugccgcaucaaucauacuugaauuuuuccugauugugcucuugauccccgagccagaaaagcagagaacaccucaggauaaccaacugacuuacguagugauugcuaucuuaaccguugucgccgccacaauggcaaaugagaugggcuuucuagagaaaaccaagaaggaccugggacucggcaguauaacuacacaggaaucugaguccaacauccuugacauugaucugcgccccgcuagcgccuggacguuguaugcgguggcuaccacuuucgugacaccaaugcugaggcauucaaucgaaaauaguagcgucaacguuucccucaccgccauugcaaaucaggccaccgugcugauggggcuuggaaaagguuggccucucucuaagauggacaucggcguaccccuguuggcuauuggguguuacagccaggugaacccgaucacacugacugcagccuuacuacugcucgucgcgcacuacgcuauaauuggaccaggccuucaagccaaagcaacgcgggaggcccagaagcgugcugccgcagguaucaugaaaaauccuaccguggaugggaucacaguuauugaccuggaacccauaccauaugaucccaaguuugagaagcaguugggccaggugaugcugcucauccugugcgucacucaaguacuuaugaugagaaccacaugggcuuuaugugaggcccugacccucgcgacuggaccuauuuccacguugugggaaggcaacccggggagguucuggaauacaaccaucgccgugucaauggcaaacauuuuucgcggaucuuaccuggcuggcgccggucuacuguucaguaucaugaaaaauacuaccaacacacggcgagggacuggaaauauaggcgagacccucggugaaaaguggaaaucgagacuuaacgcacugggcaagagcgaguuucagaucuauaaaaaguccgggauucaggagguugacaggacauuggcuaaagaaggaaucaagcgcggcgagacggaucaucacgccgugucucgggggucagccaagcugagaugguucgucgaacguaacauggugacccccgagggaaaagucguggaccucggcugcgguagagggggauggagcuacuauuguggcggucugaagaauguucgggaagugaaaggcuuaacuaaagggggaccaggccaugaggagccuauucccauguccacauacggguggaaccuuguacgccugcaaaguggaguggaugucuuuuucaccccuccagaaaaaugcgacacucuccuaugugauaucggcgagucuagccccaauccuacaauagaagcgggucgaacccugagaguuuugaaccugguggagaauuggcucaacaauaacacgcaguucugcauuaagguccuuaauccauauaugcccucagugaucgaaaagauggaggcucugcagaggaaauacgggggagcauugguacggaacccgcugucccgcaauaguacccacgagauguacugggugagcaacgccacaggcaauaucguuucuuccgugaacaugauuucaagaaugcucauaaauagguuuacuaugaagcacaaaaaggcuaccuaugaaccugacgucgauuuaggcagcgggacacgaaacaucggaauugagucggaaaucccaaaccuggacauuaucgguaaacggauagagaagaucaagcaggaacaugagacuucuuggcacuacgaccaagaucaucccuauaaaaccugggccuaccacggcaguuaugagacaaagcagaccggguccgcaagcucaauggugaauggagucgugcgucuucugacuaaaccuugggacguuguaccaauggugacgcagauggccaugacagauaccacucccuucggccagcaaagagucuuuaaggaaaaaguggacacccgcacacaggagccgaaggaagguacgaagaaacuaaugaagauuaccgcugaguggcucuggaaagagcuggggaagaaaaagacuccuaggauguguacacgggaagaguucaccagaaaaguucgcuccaacgcggccuugggagcaaucuuuacugaugaaaauaaguggaagucugcuagggaggccguggaagacggccgauucugggagcuggucgaucgggagagaaaccuccaccuugaaggcaaaugcgagacauguguguacaauaugauggggaagagggagaagaagcugggagaguuugguaaagcaaagggcagccgcgccauuugguauaugugguuaggggcucguuuccuggaauuugaggccuugggauuccucaacgaggaccauugguuuagucggggcaauucccugagcgguguagaaggggagggacuacacagacuuggcuacauccugagggaugugggcaagaaagaagggggagcgauguacgcagacgauaccgccgguugggacacacgcauuacucucgaggaccugaagaacgaagagaugguuaccaaucauaugaaaggcgagcacaagaaauuggcugaagccauauucaagcugacguaucagaacaaggucgugcgagugcagcggcccaccccaagagggacagucauggauaucauuucuaggcgcgaccaaagaggaucaggccagguugguacuuacgggcucaauaccuuuacaaacauggaggcacagcuuauccggcaaauggaaggagagggcaucuucaaaaguauucagcaucugacugcuaccgaggaaauagccgugcagaauugguuagcuaggguaggccgugagcgacugucccgcauggccaucagcggggaugacugcguggucaagccuauugaugacagauucgcaucugcguugacggcccucaacgauaugggaaaaauccggaaggacauucagcaaugggaacccucgagggguuggaaugauuggacacaggugccauuuugcucacaccacuuccaugagcugguuaugaaagacggccgcgugcuagucgugcccuguagaaaccaggaugaacuuaucgggcgggcuaggauaagccagggagccggcuggucccugaaggagaccgcaugccucgguaagaguuaugcucaaauguggacucugauguacuuucaccgacgugacuugagauuagccgcaaacgccaucuguucugcgguaccuagccauuggguuccaacaucccgcaccacuuggucaauucacgcuaaacacgaguggaugaccacagaagauaugcuggccguguggaaucgggucuggauccaggagaacccguggauggaagacaagacgcccguggagaguugggaagaggugccuuaucucgggaaaagggaggaccaguggugcggaucucuuauuggccugaccagcagagcaacuugggccaagaauauccagacagcuauaaaccaaguccgcucccuaauuggcaaugaagaguacaccgauuauaugccaucaaugaaacgguucaggcgagaagaggaagaggccgggguucugugguga

SEQ ID NO: 14559 - RNA, 9876 nt, Artificial Sequence
  derived and/or modified CDS sequence (opt3) from DENV-2__EU482598__SS-prME
accgccggagugaucguaaugcugauucccacagcuauggcauuccaccucacuacgagaaauggggagccucauaugauaguuggaaggcaggaaaaggguaaaagccuucuguuuaagaccgaggacggcgugaauaugugcaccuugauggccaucgauuuaggggaacugugugaggacacuauuaccuacaaaugcccacuacuccggcaaaacgaaccggaggauaucgacuguuggugcaauuccacaucuaccuggguuacuuauggaacauguaccacgacuggcgagcaccgccgagaaaagcguucaguggcgcuggucccccauguggguauggggcuugagaccaggacagaaacuuggaugaguagcgagggagcuuggaaacacguucagaggauugagaccuggauccugcggcauccuggcuucacaauaauggccgcaaucuuggccuacaccauuggcacgacucacuuucagcgcgcucucaucuucauucugcugacagcaguggccccauccaugaccaugagaugcaucgggauaucuaacagggauuuugucgaaggagugucggguggcucauggguggacauuguucucgagcacgggagcugugugacuacaauggcuaagaauaagcccaccuuagauuucgaacugaucaaaacggaggccaagcagccugcgacccuucggaaauauugcauugaagcaaaguugacaaacacuaccacagagagucgcuguccaacucaaggagagcccucccugaaugaggaacaggacaaacgauuuaucugcaagcauucuauggucgauagaggcugggguaacggguguggacuauucggcaagggcgggaucgugaccugcgccauguuuacaugcaaaaagaauauggaaggaaaaauugugcagccugagaaccucgaauacaccauagucaucacuccacacagcggugaggagcaugcuguuggcaaugacacggggaagcacggaaaagaaauuaagaucacaccgcaguccucaauaaccgaggccgaacugacuggcuaugguaccgugacaauggaguguagucccaggaccgggcuugauuucaacgaaaugguacuguugcaaauggaggacaaagcauggcucgugcaccggcagugguuucuggauuuaccucugccauggcuccccggcgcugacacucagggaagcaauuggauucagaaggagacacuugucacguucaagaacccucaugccaaaaagcaagacgugguugugcugggcucucaggaaggggcgaugcacaccgccuugacuggagcaacagagauccagauguccucagguaaucuacuguuuaccggccaucucaaaugccgucugcgcauggauaaacuucaacugaaagggaugagcuacaguauguguacaggaaaguucaagaucgucaaagaaauugcugagacucagcacggcaccaucgugauuagaguacaguaugagggugacgggucuccaugcaagauacccuucgaaaucacggauuuggagaaaaggcauguucucggccggcugauuaccgugaacccgaucgucacagaaaaggacuccccugugaacaucgaggccgaacccccauuuggagauagcuacauuauaaucggcgucgagccugggcaguuaaaacugaauugguucaagaagggaucgucuauuggucaaauguuugagacuaccaugcgaggcgcuaaacgcauggccauccuaggggacacagcaugggauuucggaucccucggcgguguguuuacuucaauugggaaggcccugcaccagguuuucggcgcuaucuacggagcggcauuuaguggcgugagcuggaccaugaaaauacuuaucgggguaauuaucacguggauuggaaugaacuccagaucuacuagcuugucagucagucuggugcucguuggcguggucacccuguaucuuggugccauggugcaggcugacuccggguguguagugagcuggaagaauaaagaacugaagugcggaucuggcaucuucauaacugauaacguucacacauggaccgagcaguacaaguuucaacccgaaucaccaaguaaauuggccagcgcaauucagaaggcccaugaggaagguaucuguggcauuagguccgucacucggcucgagaaucugauguggaaacagaucacccccgaguuaaaccacauacugucugaaaaugaggugaagcuaacaaucaugacgggggacauucgcggaaucaugcaggcuggcaaaagaucgcucaggccucaaccaaccgaacugaaguauagcuggaaaacuugggggaaggccaagaugcuuuccacagagucacauaaccagaccuucuugauugauggaccggaaacagcagagugccccaauacuaaccgugcguggaauagucuggagguggaagacuacggcuuuggugucuucaccacgaacaucuggcucaaacugcgggagaagcaggacguauuuugugauucuaaauuaaugagcgcugccauaaaggacaaucgagcagugcacgccgauaugggguauuggauugaauccgcucugaacgacacauggaaaauggagaaggccucauucaucgagguaaagagcugccacuggccuaaaucucauacccuuugguccaauggaguauuggaaagugagaugaucauuccaaagaacuucgcaggccccgucagccagcacaacuacagaccugguuaucauacucaaaccgcuggcccauggcaccucgggaaacuggaaauggauuuugaccuaugugagggaacaacugugguugugaccgaagauugcggcaauagggggcccucucugcgcacaacgaccgccuccggaaagcucaucacugaguggugcugucggucaugcacacugccgccucuuagauacaggggcgaggacgguuguugguacgggauggaaauucgcccauugaaagagaaggaagagaaccuggucaauaguuuagugaccgcgggacauggccagauagauaacuucagccucgguguucugggcauggcccuuuuucuggaagagauguugcgaacucggaucgggacaaagcacgcuauucuccugguggcaguaucguucgucacccuaaucacgggaaauauguccuuucgugaccugggcagagugauggugauggucggggccacuaugaccgaugacauuggaaugggcguuacauaucucgcucugcuugccgcauucaaagugaggcccaccuuugcggccgguuugcuguuacgcaagcucacuucuaaagagcugaugauggcuacaaucgggauagcccuucugagccagucaaccaucccugaaacaauucuagagcucacugaugcacuggcuuugggaaugaugguacugaagaucgugcggaacauggaaaaauaccaauuagccgucaccauuauggcaaucaguugcgugcccaaugccguuauacuccagaacgcuuggaagguguccuguacgauucuggcggccgucucugugagcccacuucuguugacauccucacagcagaaggcagacuggaucccucucgcucugaccaucaaaggccuaaaucccacugccauuuuccugaccacacuuagcagaacaaguaagaaaaggucuuggccacucaacgaggccauaauggcuguuggcaugguguccauccuggcaagcucguugcugaagaaugacauuccgaugaccgggccuuuagucgccggaggucuccugacgguaugcuaugugcuuacaggccgaucagcggaucuggaauuggagcgcgcugccgacguuaaaugggaggaucaagcagaaaucucugggaguucccccauucucagcaucaccauaucugaggacggaagcauguccaucaagaacgaagaggaggaacagacucugacaauucuaauccggaccggccugcuugugauuucaggugucuuuccagugaguauccccauaacugccgcugcaugguaccucugggaggucaagaagcagagagccggggugcugugggaugucccuagcccacccccuguugaaaaggcggaguuggaagacggagcuuauaggauuaaacagcguggcaucuuaggcuacucucaaaucggggccggaguguauaaggaggguacauuccacaccauguggcaugugacgcgcggcgcaguccugaugcaccgggggaaaagaauugagccguccugggccgaugugaagaaagaccucaucucauacggaggcgguuggaagcuggaaggggaguggaaggaaggagaggaaguucagguacuugcucuggagccaggcaaaaaucccagggccgugcagacuaagccuggcauauuuaaaaccaacacagggaccauuggagcagucaguuuggauuucagcccagguacauccggcucucccaucguggaccgaaaggggaaaguugugggacuauacggcaauggugucgugacucggucgggggcuuauguaagcgccauugcgcagaccgagaagucaaucgaagauaacccugagauagaagacgauauuuuucgcaagaaaagacugacgaucauggaccuccauccgggagccggcaagacaaaaagguaccugcccgcaaucguccgggaggcuauuaagcgaggccuuagaacuuuaauccuggccccaacccgcgugguugcugcagaaauggaggaggcccucaggggguugccuauucguuaucaaacaaccgccauaaaaacugaacacaccggacgggagaucguggaccugaugugucaugcuacauucacgaugagacuccugucccccgucagggugccaaacuacaaucuuauuaucauggaugaagcgcacuucacugacccugcaaguaucgccgcucgcgguuauauuucuacccgaguugagaugggcgaggccgcagggauauuuaugacagccacacccccaggaagcagagauccguucccucaguccaacgcucccaucauggacgaagaacgggaaauuccagagaggucauggaacucuggccacgaaugggugacugauuuuaaggguaagacagucugguucgugcccagcaucaaagcggggaacgacauugccgcaugccugcgcaagaauggcaagaagguaauccaguugagucguaaaaccuuugauuccgaguacgugaagacgagagcuaacgacugggauuucguugucacuacagacauaagcgagaugggcgccaauuuuaaggcagaacgggugaucgauccuaggcgcuguaugaaaccagugauucuaaccgacggcgaggaacgagucauccuggccgggcccaugccuguaacccauucuucagcugcccaaagacggggaaggauuggucgcaacccgaagaaugagaacgaccaguauaucuacaugggcgaaccacucgagaaugaugaggacugcgcgcacuggaaagaagcaaagauguuacuggauaacauaaauacucccgaggggauuaucccuuccauguucgaacccgagagagaaaaaguggacgccauugauggagaguacaggcuucggggcgaggcucguaagacauuuguugaccugaugcgccgaggugaucucccagugugguuggccuauaaagucgcugcagaagggaucaacuacgccgacagaaagugguguuucgauggcauaaagaauaaccagauccuggaggaaaacauggagguggagauuuggaccaaagaaggagagaggaagaaacucaagccucgguggcuggacgcucgcaucuauagugauccccuugcccuaaaagaauuuaaggaguucgcagcgggcagaaagagccugacauugaauuuaauuacugaaauggggaggcugccaacguucaugacccagaaagcccggaacgcucucgacaaucuggccguucuucauacagcagaggcuggaggucgagccuacaaccacgcacugucggagcucccugaaacuuuggagacccugcuacugcucacacuucuggccaccgugacuggcgggaucuuuuuauucuugaugucuggaaagggcauagguaaaaugacgcuggggaugugcugcauuaucaccgcuuccauccuccugugguaugcgcaaauucagccgcacuggaucgccgcaagcauaauucuugaauuuuuccugaucguccucuugauucccgagccagaaaagcagagaacaccucaggauaaucaacugacuuacgugguaaucgcuauauuaaccgugguugccgccacaauggcaaacgagaugggcuuucuagagaaaaccaagaaggaccugggacucggcucaaucacuacacaggaaagugagucuaauauucuugacaucgaucugcgccccgcuuccgccuggacguuguaugcggucgcuaccacuuucgugacaccaaugcugaggcauagcauugaaaacucaagugugaaugucagccucaccgccaucgcaaaccaggccaccguucugauggggcuuggaaaagguuggccucucuccaagauggacauuggcgugccccuguuggcuaucggguguuacucucagguaaauccgauaacacugacugcagccuuacuacugcucguggcgcacuacgcuauuaucggaccaggccuucaagccaaagcaacgcgggaggcccagaagcgugcugccgcagguaucaugaaaaacccuaccgucgaugggauuacagugauagaccuggaacccaucccauaugaucccaaguuugagaagcaguugggccagguuaugcugcucauucugugcgugacucaaguccuuaugaugagaaccacaugggcuuuaugugaggcccugacccucgcgacuggaccuaucagcacguugugggaaggcaauccggggagguucuggaacacaaccauugccguauccauggcaaauaucuuucgcggaucauaccuggcuggcgccggucuacuguucucuauaaugaaaaacacuaccaauacacggcgagggacuggaaacaucggcgagacccucggugaaaaguggaaaaguagacuuaacgcacugggcaagucggaguuucagauuuauaaaaagagcgggauccaggagguggacaggacauuggcuaaagaaggaauuaagcgcggcgagacggaucaucacgccguuucccgggggucugccaagcugagaugguucguggaacguaauauggucacccccgagggaaaaguggucgaccucggcugcgguagagggggauggucauacuauuguggcggucugaagaacgugcgggaaguuaaaggcuuaacuaaagggggaccaggccaugaggagccuauccccaugagcacauacggguggaaucuugugcgccugcaauccggaguagauguguuuuucaccccuccagaaaaaugcgacacucuccuaugugauauaggcgagaguucucccaacccuacaauugaagcgggucgaacccugagagucuugaaucugguugagaacuggcucaauaacaauacgcaguucugcaucaaggugcuuaacccauauaugcccagcgucaucgaaaagauggaggcucugcagaggaaauacgggggagcauuggugcggaauccgcugucacgcaacuccacccacgagauguacuggguaaguaaugccacaggcaacauugugagcucuguuaauaugauauccagaaugcucaucaacagguuuacuaugaagcacaaaaaggcuaccuaugaaccugacguggauuuaggcucagggacacgaaacauuggaaucgagagcgaaauuccaaaucuggacaucauagguaaacggaucgagaagauuaagcaggaacaugagacuucguggcacuacgaccaagaucaucccuauaaaaccugggccuaccacggcucuuaugagacaaagcagaccgggagugcauccagcauggucaacggagugguccgucuucugacuaaaccuugggacgugguuccaaugguaacgcagauggccaugacagauaccacucccuucggccagcaaagaguguuuaaggaaaaagucgacacccgcacacaggagccgaaggaagguacgaagaaacuaaugaagaucaccgcugaguggcucuggaaagagcuggggaagaaaaagacuccuaggauguguacacgggaagaguucaccagaaaagugcgcucaaaugcggccuugggagcaauuuuuacugaugaaaacaaguggaaguccgcuagggaggccguugaagacggccgauucugggagcugguggaucgggagagaaaucuccaccuugaaggcaaaugcgagacaugugucuacaacaugauggggaagagggagaaaaagcugggagaguuugguaaagcaaagggcucucgcgccaucugguauaugugguuaggggcucguuuccuggaauuugaggccuugggauuccucaaugaggaccauugguuuagccggggcaacagucuguccgguguggaaggggagggacuacacagacuuggcuacauucugagggauguaggcaagaaagaagggggagcgauguacgcagacgauaccgccgguugggacacacgcauaacucucgaggaccugaagaaugaagagauggugaccaaccauaugaaaggcgagcacaagaaauuggcugaagccaucuucaagcugacguaucagaauaagguuguccgagugcagcggcccaccccaagagggacagugauggauauuaucagcaggcgcgaccaaagaggaucuggccaggucgguacuuacgggcucaacaccuuuacaaauauggaggcacagcuuauccggcaaauggaaggagagggcauuuucaaaucaauacagcaucugacugcuaccgaggaaaucgccguucagaacugguuagcuagggugggccgugagcgacugagucgcauggccauuuccggggaugacugcguagugaagccuaucgaugacagauucgcaagcgcguugacggcccucaaugauaugggaaaaguccggaaggacauucagcaaugggaacccucuagggguuggaacgauuggacacaggugccauuuugcucgcaccacuuccaugagcugguuaugaaagacggccgcgugcuagucgugcccuguagaaaccaggaugaacuuaucgggcgggcuaggauaucacagggagccggcuggagccugaaggagaccgcaugccucgguaaguccuaugcucaaauguggacucugauguacuuucaccgacgugacuugagauuagccgcaaaugccaucuguagugcgguaccuucucauuggguuccaacaagccgcaccacuugguccauucacgcuaaacacgaguggaugaccacagaagauaugcuggccguguggaaccgggucuggauccaggagaauccguggauggaagacaagacgcccguggagucaugggaagaggugccuuaucucgggaaaagggaggaccaguggugcggaagucuuauuggccugaccucuagagcaacuugggccaagaacauccagacagcuauaaaucaaguccgcagccuaauuggcaacgaagaguacaccgauuauaugccauccaugaaacgguucaggcgagaagaggaagaggccgggguucugugguga

SEQ ID NO: 14560 - RNA, 9876 nt, Artificial Sequence
  derived and/or modified CDS sequence (opt3) from DENV-2__EU482603__SS-prME
accgcaggcgugauagucaugcugauucccacugcuauggcauuccaccucacuacgagaaacggggagccucauaugauaguuggaaggcaggaaaaggguaaaagccuucuguuuaagaccgaggacggcgugaauaugugcacauugauggccaucgauuuaggggaacugugugaggacacuauuaccuacaaaugcccacuacuccggcaaaacgaaccggaggauaucgacuguuggugcaauuccacaucuaccuggguaacuuauggaacauguaccacgacuggcgagcaccgccgagaaaagcguucaguggcgcuggucccccauguggguauggggcuugagaccagaacagaaacuuggaugaguagcgagggagcuuggaaacacguucagaggauugagaccuggauccugcggcauccuggcuucacaauuauggccgcaaucuuggccuacaccauuggcacgacucacuuucagcgcgcucucaucuucauucugcugacagcaguggccccauccaugaccaugagaugcaucgggauaucuaacagggauuuugucgaaggagugucggguggcucauggguagacauuguucucgagcacgggagcugugugacuacaauggcuaagaauaagcccaccuuagauuucgaacugaucaaaacggaggccaagcagccugcgacccuucggaaauauugcauugaagcaaaguugacaaacacuaccacagagagucgcuguccaacucaaggagagcccucccugaaugaggaacaggacaaacgauuuaucugcaagcauucuauggucgauagaggcugggguaacggguguggacuauucggcaagggcgggaucgugaccugcgccauguuuacaugcaaaaagaauauggaaggaaaagugguccagccugagaaccucgaauacaccauuguuauaacuccacacagcggugaggagcaugcugugggcaaugacacggggaagcacggaaaagaaaucaagauuacaccgcaguccucaaucaccgaggccgaacugacuggcuaugguaccguaacaauggaguguagucccaggaccgggcuugauuucaacgaaauggugcuguugcaaauggaggacaaagcauggcucguccaccggcagugguuucuggauuuaccucugccauggcuccccggcgcugacacucagggaagcaauuggauacagaaggagacacuugugacguucaagaacccucaugccaaaaagcaagacguugugguccugggcucucaggaaggggcgaugcacaccgccuugacuggagcaacagagauucagauguccucagguaaucuacuguuuaccggccaucucaaaugccgucugcgcauggauaaacuucaacugaaagggaugagcuacaguauguguacaggaaaguucaagaucgugaaagaaaucgcugagacucagcacggcaccauuguaaucagaguucaguaugagggugacgggucuccaugcaagauucccuucgaaauaacggauuuggagaaaaggcaugugcucggccggcugaucaccgucaacccgauugugacagaaaaggacuccccugucaacaucgaggccgaacccccauuuggagauagcuacaucauuauaggcguggagccugggcaguuaaaacugaauugguucaagaagggaucgucuaucggucaaauguuugagacuaccaugcgaggcgcuaaacgcauggccauucuaggggacacagcaugggauuucggaucccucggcgguguuuuuacuucaaucgggaaggcccugcaccagguguucggcgcuauuuacggagcggcauuuaguggcguaagcuggaccaugaaaauccuuauaggggucaucauuacguggaucggaaugaacuccagaucuacuagcuugucagugagucugguucucgugggcgucgugacccuguaucuuggugccaugguacaggcugacuccgggugugugguuagcuggaagaauaaagaacugaagugcggaucuggcauuuucaucacugauaacguccacacauggaccgagcaguacaaguuucaacccgaaucaccaaguaaauuggccagcgcaauacagaaggcccaugcugaggguauuuguggcaucagguccgugacucggcucgaaaaucugauguggaaacagauuacccccgaguuaaaccacauccugucugagaaugaagugaagcuaacaauaaugacgggggacaucaaaggaauuaugcaggccggcaagcgcucgcucagaccucaaccaaccgagcugaaauauagcuggaagacuugggggaaggcaaaaaugcuuuccacagaaucacauaaccagaccuucuugaucgauggaccggagacagcggaaugccccaauacuaacagggcuuggaauagucuggaggucgaggacuacggcuuugguguuuucaccacgaacauuuggcucaagcugcgugaaaaacaggacguguuuugugauucuaaguuaaugagcgccgcaaucaaagacaaucgggccgugcacgcugauaugggguauuggauagaguccgcccugaacgacacauggaagauggaaaaggcaucauucauugagguaaaaagcugccacuggccuaagucucauacccuuugguccaauggagucuuggagagugaaaugaucauccccaagaacuucgcuggccccgugagccagcacaacuaccgaccugguuaucauacucaaaccgccggcccauggcaccucgggaagcuggagauggauuuugaccuaugugaaggaacaacuguuguggucaccgaggauugcggcaauagagggcccucucugaggacaacgaccgcguccggaaaacucauuacugaauggugcugucgcucaugcacacugccgccucuucgguacagaggcgaggacgguuguugguacgggauggagaucaggccauugaaggaaaaggaggaaaaccuggugaauaguuuaguuaccgccggacauggccagauugauaacuucagccucggugugcugggcauggcucuuuuucuggaggaaauguugcgcacucgaauagggacaaaacacgcaauccuccugguagccgucucguucgugacccuaauuacgggaaauauguccuuucgggaccugggccgugugauggucaugguuggggcuacuaugaccgaugacaucggaaugggcgugacauaucucgcccugcuugcagcguucaagguaagacccaccuuugccgcugguuugcuguuaaggaaacucacuucuaaggagcugaugauggccacaauugggaucgcacuucugagccagucaaccauaccugagacaauccuagaacucacugaugcucuggccuugggaaugauggugcugaaaauuguccgcgacauggagaaguaccaauuagcagugaccaucauggccauuaguugcguucccaacgcugugauccuccagaaugcguggaaggucuccuguacgauacuggccgcagugucuguuagcccacuucuguugacauccucacagcagaaagcugacuggauuccucucgcccugaccaucaagggccuaaaccccacugccaucuuccugaccacacuuagccggacaaguaaaaagagaucuuggccacucaaugaagcuauuauggcagugggcauggucuccauacuggccagcucguugcugaaaaacgauaucccgaugaccgggccuuuaguagcgggaggucuccugacggugugcuauguucuuacaggcaggucagcugaccuggaguuggaacgagccgcagaugugaagugggaggaccaagccgagauuucugggaguucccccauccucagcauuaccaucucugaagauggaagcauguccaucaaaaaugaggaagaggagcagacucugacaauccuaauucgcaccggccugcuugucaucucagguguguuuccaguaaguauucccaucacugcugcagccugguaccucugggaagugaagaagcagcgggcggggguccugugggacguuccuagcccacccccuguggagaaagcugaauuggaggauggagccuauagaauaaagcagaggggcauuuuaggcuacucucaaaucggggcaggaguguauaaagaagguacauuccacaccauguggcaugucacgcguggcgccgugcugaugcaccgcgggaagcggaucgagccguccugggcugacguuaaaaaggaucucauuucauacggaggcgguuggaagcuggagggggaauggaaagagggagaagagguacaggugcuugcccuggaaccaggcaagaaccccagagcaguccagacuaaaccuggcaucuuuaagaccaauacagggaccauaggagcugugaguuuggacuucagcccagguacauccggcucucccauuguugauaggaaagggaagguggucggacuauacggcaacggugugguaacucgaucgggggccuaugucagcgcgaucgcccagaccgagaagucaauugaggacaauccugaaaucgaggaugacauauuucggaaaaagcgccugacgauuauggaccuccauccgggagcaggcaaaacaaagagauaccugcccgcuaucgugagggaagccaucaaacggggccuucgaacuuuaauucuggcuccaaccagaguuguggcagccgagauggaagaggcccuccgcggguugccuaucagguaucaaacacccgcuauuaagaccgagcacacuggacgugaaauagucgaucugaugugucaugcgaccuucacaaugcggcuccuguccccagugagaguuccuaacuacaaccuuaucauuauggacgaggcacacuucacggaucccgccaguaucgcugccagggguuauaucucuacucgcguggaaaugggcgaggcagccgggauuuuuaugaccgcuacaccaccgggaagccgagacccuuucccccaguccaaugcgccaauaauggaugaggaaagagagauccccgaacggucauggaacucuggccacgagugggucaccgacuuuaaggguaaaacugugugguucguaccuagcauuaaggccgggaaugauaucgcagcuugccugaggaaaaacggaaagaaagugauucaguugagucgcaagacauuugacuccgaauacguuaagacccgugccaaugauugggacuucgucgugacgacugauaucagcgagaugggcgcaaacuuuaaagccgagagagugauagacccacggagguguaugaagcccgucauccuaacagacggcgaagaacgcguaauucuggcugggccuaugccggugacccauucuucagccgcgcaacgaagaggacggaucgguaggaaucccaaaaacgaaaaugaucaguauauuuacaugggcgagccccucgaaaacgacgaggauugcgcacacuggaaggaggccaaaauguuacuggacaauaucaacaccccugaagggauaauucccuccauguucgagccagaacgcgagaagguugaugcuaucgacggagaauacagacuuaggggcgaggcccggaaaacuuuuguggaucugaugcgucgcggugaccucccugucugguuggcuuauaagguggcagccgaggggauuaauuacgcugaucgaaagugguguuucgacggcaucaaaaacaaucagauacuggaagagaacauggaaguugagaucuggacaaaggagggagaaaggaaaaagcucaaacccagauggcuggaugcccggauuuauagugacccacuugcacuaaaggaguuuaaggaguucgcggccggccgcaaaagccugaccuugaacuuaaucacagagauggggagacugccuacuuucaugacgcagaaggcuaggaaugcccucgauaaccuggcagugcuucauaccgcugaagccggaggucgggcauacaaucacgcccugucggagcucccggagacauuggaaacucugcuacugcucacccuucuggcuacagucaccggcgggauauuuuuauucuugaugucuggaaaaggcaucgguaagaugacucuggggaugugcugcauaauuacggcguccauccuccugugguaugcccaaauccagccccacuggauugcagcuagcaucauacuugaguuuuuccugauugugcucuugaucccagaaccugagaaacagcgaaccccacaggacaaccaacugacauacguagugauugccaucuuaacuguugucgccgcaaccauggcuaaugaaaugggcuuucuagagaagacaaagaaagaccugggacucggcucaauaaccacucaggagagugaaucuaacauccuugauauugaccugagaccagccuccgcguggacauuguaugcuguggccacgaccuucgugacuccuaugcugcgccauagcaucgaaaauucaagugucaacguuagccucacagcaauugccaaucaggcuaccgugcugauggggcuuggaaaggguuggccccucuccaaaauggauaucggcguaccgcuguuggcaauuggguguuacucucaggugaacccaaucacccugacagccgcguuacuacugcucgucgcucacuacgccauaauuggaccuggccuucaagcaaaggccacuagggaagcucagaaacgggccgcagcugguaucaugaagaaucccacgguggacgggaucaccguuauugaucuggagccaauacccuaugacccuaaguuugaaaaacaguugggccaggugaugcugcucauccugugcgucacacaaguacuuaugaugcguacuaccugggccuuaugugaggcgcugacacucgccaccggaccgauuagcacuuugugggagggcaaccccgggagauucuggaauacgacaaucgcaguguccauggcuaacauuuuuaggggaucauaccuggccggcgcaggucuacuguucucuaucaugaagaauaccacaaguacccgccgggggacaggaaacauaggcgaaacucucggugagaaauggaagucgcgacuuaaugcucugggcaaaagcgaauuucagaucuauaagaaauccgggauucaggagguugauagaaccuuggccaaggagggaaucaagaggggcgaaacagaccaucacgccgugucucgcgggucagcgaaacugcggugguucgucgagagaaacauggugacgccagaaggaaaggucguggaucucggcugcggucgugggggauggagcuacuauuguggcggucugaaaaacguuagggaggugaagggcuuaaccaaagggggaccuggccaugaggaaccaauuccuauguccacuuacggguggaaucuuguacggcugcaaaguggaguggacgucuuuuucacaccacccgagaagugcgauacccuccuaugugacaucggcgaaucuagcccuaacccaacuauagaggcuggucgcacacugcgaguuuugaaucugguggaaaacuggcucaauaacaauacccaguucugcauuaagguccuuaaccccuauaugccgucagugaucgagaaaauggaagcacugcagagaaaguacgggggagccuugguaaggaauccucugucccggaacaguacgcacgagauguacugggugagcaaugcuaccggcaacaucguuucuuccgugaauaugauuucacgcaugcucauaaacagauuuacaaugaaacacaagaaaacuaccuaugagccagaugucgacuuaggcagcgggacaaggaauaucggaauugaaucggagauccccaaccuggacauuaucgguaagcgaauagaaaagaucaaacaggagcaugaaacuucuuggcacuacgaucaagaccauccuuauaagaccugggccuaccacggcaguuaugagacaaaacagaccggguccgcaagcucaauggugaacggagucgugcggcuucugacuaagccaugggauguuguacccauggugacgcagauggccaugacagacaccacuccguucggccagcaacgugucuuuaaagagaagguggauaccagaacacaggaaccuaaggaggguacgaaaaagcuaaugaaaauuaccgcugaauggcucuggaaggagcuggggaaaaagaaaacuccccgcauguguacaagggaggaguucacccggaagguuagauccaaugcggccuugggagcaaucuuuacugacgagaacaaguggaaaucugcucgcgaagccguggaggauggcagguucugggaacuggucgaccgagagcggaaucuccaccuugagggcaagugcgaaacauguguguacaacaugauggggaaaagagagaagaaacugggagaauuugguaaggcaaagggcagcagggccauuugguauaugugguuaggggcucgcuuccuggaguuugaagccuugggauuccucaaugaggaucauugguuuagucguggcaacucccugagcgguguagagggggaaggacuacaccggcuuggcuacauccugagagacgugucuaaaaaggagggcggggcgauguacgcagaugacaccgccggaugggacacaaggauuacucucgaagaucugaaaaaugaggaaaugguuaccaaccauaugaagggugagcacaaaaaguuggcugaggccauauucaagcugacguaucagaauaaagucgugcgcgugcagcgaccaaccccucggggcacagucauggacaucauuucaagaagggaucaacgcgggaguggacagguuggcacuuacggucucaacaccuuuacaaauauggaagcacagcuuaucagacaaauggagggggaaggaaucuucaaguccauucagcaucugacugcuaccgaggagauagugguacagaacugguuagcccgggugggcagggaacgucugagccgaauggcuaucucuggcgacgauugcgucgugaaacccauugacgaucgcuucgccucggcauugacggcgcucaaugacauggggaagguuagaaaagauauccagcaaugggagccaucacggggauggaacgacuggacacaggugcccuuuugcagccaccacuuccaugaacuggucaugaaggaugguagggugcuaguaguuccuugucgcaaucaggacgagcuuauuggcagagcccggaucucccagggggcuggauggagucugaaggaaaccgccugccucggcaaaucuuaugcacaaauguggacucugauguacuuucacaggcgagauuugcguuuagcugccaacgcaauauguagcgccgugccaucccauugggucccgacaucaagaaccacuuggaguauccacgcgaagcacgaguggaugaccacagaggacaugcuggcuguguggaaccgcguguggauucaggaaaaucccuggauggaggacaaaacgccugucgaaucuugggaggaaguuccauaucucgguaagcgggaggaucaguggugcgggagccuuaucggacugaccuccagggccacuugggccaaaaacauucagacagccaucaaucaagugagaucacuaauaggcaacgaggaauacaccgacuauaugcccagcaugaagcgcuuccggagggaggaagaggaagcuggcguacugugguga

SEQ ID NO: 14561 - RNA, 9876 nt, Artificial Sequence
  derived and/or modified CDS sequence (opt3) from DENV-2__EU482599__SS-prME
accgccggagugaucgucaugcugauucccacagcuauggcauuccaccucacuacgagaaauggggagccucauaugauaguuggaaggcaggaaaaggguaaaagccuucuguuuaagaccgaggacggcgugaauaugugcaccuugauggccaucgauuuaggggaacugugugaggacacuauuaccuacaaaugcccacuacuccggcaaaacgaaccggaggauaucgacuguuggugcaauuccacaucuaccuggguaacuuauggaacauguaccacgacuggcgagcaccgccgagaaaagcguucaguggcgcuggucccccauguggguauggggcuugagaccaggacagaaacuuggaugaguagcgagggagcuuggaaacacguucagaggauugagaccuggauccugcggcauccuggcuucacaauuauggccgcaaucuuggccuacaccauuggcacgacucacuuucagcgcgcucucaucuucauucugcugacagcaguggccccauccaugaccaugagaugcaucgggauaucuaacagggauuuugucgaaggagugucggguggcucauggguugacauuguucucgagcacgggagcugugugacuacaauggcuaagaauaagcccaccuuagauuucgaacugaucaaaacggaggccaagcagccugcgacccuucggaaauauugcauugaagcaaaguugacaaacacuaccacagagagucgcuguccaacucaaggagagcccucccugaaugaggaacaggacaaacgauuuaucugcaagcauucuauggucgauagaggcugggguaacggguguggacuauucggcaagggcgggaucgugaccugcgccauguuuacaugcaaaaagaauauggaaggaaaagugguccagccugagaaccucgaauacaccauuguuauaacuccacacagcggugaggagcaugcugugggcaaugacacggggaagcacggaaaagaaaucaagauuacaccgcaguccucaaucaccgaggccgaacugacuggcuaugguaccguaacaauggaguguagucccaggaccgggcuugauuucaacgaaauggugcuguugcaaauggaggacaaagcauggcucguccaccggcagugguuucuggauuuaccucugccauggcuccccggcgcugacacucagggaagcaauuggauacagaaggagacacuugugacguucaagaacccucaugccaaaaagcaagacguugugguccugggcucucaggaaggggcgaugcacaccgccuugacuggagcaacagagauucagauguccucagguaaucuacuguuuaccggccaucucaaaugccgucugcgcauggauaaacuucaacugaaagggaugagcuacaguauguguacaggaaaguucaagaucgugaaagaaaucgcugagacucagcacggcaccauuguaaucagaguucaguaugagggugacgggucuccaugcaagauucccuucgaaauaacggauuuggagaaaaggcaugugcucggccggcugaucaccgucaacccgauugugacagaaaaggacuccccugucaacaucgaggccgaacccccauuuggagauagcuacaucauuauaggcguggagccugggcaguuaaaacugaauugguucaagaagggaucgucuaucggucaaauguuugagacuaccaugcgaggcgcuaaacgcauggccauucuaggggacacagcaugggauuucggaucccucggcgguguuuuuacuucaaucgggaaggcccugcaccagguguucggcgcuauuuacggagcggcauuuaguggcguaagcuggaccaugaaaauccuuauaggggucaucauuacguggaucggaaugaacuccagaucuacuagcuugucagugagucugguucucgugggcgucgugacccuguaucuuggugccaugguacaggcugacuccgggugugugguuagcuggaagaauaaagaacugaagugcggaucuggcauuuucaucacugauaacguccacacauggaccgagcaguacaaguuucaacccgaaucaccaaguaaauuggccagcgcaauacagaaggcccaugaggaagguauuuguggcaucagguccgugacucggcucgagaaucugauguggaaacagauuacccccgaguuaaaccacauccugucugaaaaugaggugaagcuaacaauaaugacgggggacauccgcggaauuaugcaggcuggcaaaagaucgcucaggccucaaccaaccgaacugaaguauagcuggaaaacuugggggaaggccaagaugcuuuccacagagucacauaaccagaccuucuugaucgauggaccggaaacagcagagugccccaauacuaaccgugcguggaauagucuggaggucgaagacuacggcuuugguguuuucaccacgaacauuuggcucaaacugcgggagaagcaggacguguuuugugauucuaaauuaaugagcgcugccaucaaggacaaucgagcagugcacgccgauaugggguauuggauagaauccgcucugaacgacacauggaaaauggagaaggccucauucauugagguaaagagcugccacuggccuaaaucucauacccuuugguccaauggagucuuggaaagugagaugaucaucccaaagaacuucgcaggccccgugagccagcacaacuacagaccugguuaucauacucaaaccgcuggcccauggcaccucgggaaacuggaaauggauuuugaccuaugugagggaacaacuguuguggucaccgaagauugcggcaauagggggcccucucugcgcacaacgaccgccuccggaaagcucauuacugaguggugcugucggucaugcacacugccgccucuuagauacaggggcgaggacgguuguugguacgggauggaaauccgcccauugaaagagaaggaagagaaccuggugaauaguuuaguuaccgcgggacauggccagauugauaacuucagccucggugugcugggcauggcccuuuuucuggaagagauguugcgaacucggauagggacaaagcacgcuauccuccugguagcagucucguucgugacccuaauuacgggaaauauguccuuucgugaccugggcagagugauggucaugguuggggccacuaugaccgaugacaucggaaugggcgugacauaucucgcucugcuugccgcauucaaaguaaggcccaccuuugcggccgguuugcuguuacgcaagcucacuucuaaagagcugaugauggcuacaauugggaucgcccuucugagccagucaaccauaccugaaacaauccuagagcucacugaugcacuggcuuugggaaugauggugcugaagauuguccggaacauggaaaaauaccaauuagccgugaccaucaugguuauuaguugcgugcccaaugcagucauccuccagaacgccuggaagguguccuguacgauacuggcugcgguuucugugagcccacuucuguugacauccucacagcagaaggccgacuggauuccucucgcacugaccaucaaaggccuaaaucccacugcuaucuuccugaccacacuuagcagaacaaguaagaaaaggucuuggccacucaacgaggccauuauggccgucggcaugguauccauacuggcuagcucguugcugaagaaugacaucccgaugaccgggccuuuaguggcaggaggucuccugacgguuugcuaugugcuuacaggccgaucagccgaucuggaauuggagcgcgcggcugacgucaaaugggaggaucaagccgaaauuucugggaguucccccauccucagcauuaccaucucugaggacggaagcauguccauaaagaacgaagaggaggaacagacucugacaauccuaauucggaccggccugcuugugaucucagguguauuuccagugaguauucccaucacugcagccgcuugguaccucugggaggucaaaaagcagagagcagggguucugugggaugugccuagcccacccccuguggaaaaggccgaguuggaagacggagcguauaggauaaaacagcguggcauuuuaggcuacucucaaaucggggcuggagucuauaaggaggguacauuccacaccauguggcaugugacgcgcggcgccguucugaugcaccgggggaaaagaaucgagccguccugggcagauguaaagaaagaccucauuucauacggaggcgguuggaagcuggaaggggaguggaaggaaggagaggaagugcagguccuugcccuggagccaggcaaaaaucccagggcugugcagacuaagccuggcaucuuuaaaaccaacacagggaccauaggagccguuaguuuggauuucagcccagguacauccggcucucccauuguggaccgaaaggggaaagucgugggacuauacggcaaugguguagucacucggucgggggcauaugugagcgcuaucgcccagaccgagaagucaauugaagauaacccugagaucgaagacgauauauuucgcaagaaaagacugacgauuauggaccuccauccgggagcgggcaagacaaaaagguaccugcccgccaucguucgggaggcaaucaagcgaggccuuagaacuuuaauucuggcuccaacccgcguggucgccgcugaaauggaggaggcacucaggggguugccuauccguuaucaaacaaccgccauuaaaacugaacacaccggacgggagauaguggaccugaugugucaugccacauucacgaugagacuccugucccccguuagggugccaaacuacaaucuuaucauuauggaugaagcucacuucacugacccugcgaguaucgcagcccgcgguuauaucucuacccgagucgagaugggcgaggcugccgggauuuuuaugacagcaacacccccaggaagcagagauccguucccucaguccaacgcccccauaauggacgaagaacgggaaaucccagagaggucauggaacucuggccacgaaugggugacugauuuuaaggguaagacaguaugguucgugcccagcauuaaagcugggaacgacaucgcggccugccugcgcaagaauggcaagaagguuauucaguugagucguaaaaccuuugauuccgaguacgucaagacgagagcaaacgacugggauuucguggugacuacagacaucagcgagaugggcgcuaauuuuaaggccgaacgggucauagauccuaggcgcuguaugaaaccaguaauccuaaccgacggcgaggaacgagugauucuggcagggcccaugccuguuacccauucuucagccgcucaaagacggggaaggaucggucgcaacccgaagaaugagaacgaccaguauauuuacaugggcgaaccacucgagaaugaugaggacugcgcccacuggaaagaagcgaagauguuacuggauaacaucaauacucccgaggggauaauuccuuccauguucgaacccgagagagaaaaaguggacgcaaucgauggagaguacaggcuucggggcgaggcccguaagacauuugucgaccugaugcgccgaggugaucucccagugugguuggcuuauaaaguugccgcugaagggauuaacuacgcagacagaaagugguguuucgauggcaucaagaauaaccagauacuggaggaaaacauggagguggagaucuggaccaaagaaggagagaggaagaaacucaagccucgguggcuggacgcccgcauuuauagugauccccuugcucuaaaagaauuuaaggaguucgccgcaggcagaaagagccugacauugaauuuaaucacugaaauggggaggcugccaacguucaugacccagaaagcgcggaacgcccucgacaaucuggcuguccuucauacagccgaggcaggaggucgagcuuacaaccacgcccugucggagcucccugaaacuuuggagacccugcuacugcucacacuucuggcaaccgugacuggcgggauauuuuuauucuugaugucuggaaagggcaucgguaaaaugacgcuggggaugugcugcauaauuaccgccuccauccuccugugguaugcucaaauccagccgcacuggauugcggccagcaucauacuugaauuuuuccugauuguacucuugauccccgagccagaaaagcagagaacaccucaggauaaucaacugacuuacgugguuauugcaaucuuaaccgucguggcugccacaauggccaacgagaugggcuuucuagagaaaaccaagaaggaccugggacucggcucaauaacuacacaggaaagugagucuaauauccuugacauugaucugcgccccgcauccgcuuggacguuguaugccguggcgaccacuuucgucacaccaaugcugaggcauagcaucgaaaacucaaguguuaaugugagccucaccgcuauugccaaccaggcaaccguacugauggggcuuggaaaagguuggccucucuccaagauggacaucggcgugccccuguuggccauuggguguuacucucaggucaauccgaucacacugacugcugcauuacuacugcucguggcccacuacgcgauaauuggaccaggccuucaagcuaaagccacgcgggaggcacagaagcgugccgcugccgguaucaugaaaaacccuaccguugaugggaucacagugauugaccuggaacccauaccauaugaucccaaguuugagaagcaguugggccaggucaugcugcucauccugugcguaacucaagugcuuaugaugagaaccacaugggcauuaugugaggcucugacccucgccacuggaccuauuagcacguugugggaaggcaauccggggagguucuggaacacaaccaucgcgguuuccauggccaauauuuuucgcggaucauaccuggcaggcgcuggucuacuguucucuaucaugaaaaacacuaccaauacacggcgagggacuggaaacauaggcgagacccucggugaaaaguggaaaaguagacuuaacgcccugggcaagucggaguuucagaucuauaaaaagagcgggauucaggagguggacaggacauuggcaaaagaaggaaucaagcgcggcgagacggaucaucacgcugucucccgggggucugccaagcugagaugguucguggaacguaauauggucacccccgagggaaaagugguugaccucggcugcgguagagggggauggucauacuauuguggcggucugaagaacgugcgggaaguaaaaggcuuaacuaaagggggaccaggccaugaggagccuauucccaugagcacauacggguggaaucuugugcgccugcaauccggagucgauguauuuuucaccccuccagaaaaaugcgacacucuccuaugugauaucggcgagaguucucccaacccuacaauagaagccggucgaacccugagaguguugaaucuggucgagaacuggcucaauaacaauacgcaguucugcauuaaggugcuuaacccauauaugcccagcguaaucgaaaagauggaggcgcugcagaggaaauacgggggagcuuuggugcggaauccgcugucacgcaacuccacccacgagauguacuggguuaguaaugcaacaggcaacaucgugagcucugucaauaugauuuccagaaugcucauaaacagguuuacuaugaagcacaaaaaggccaccuaugaaccugacguggauuuaggcucagggacacgaaacaucggaauugagagcgaaaucccaaaucuggacauuaucgguaaacggauagagaagaucaagcaggaacaugagacuucguggcacuacgaccaagaucaucccuauaaaaccugggcuuaccacggcucuuaugagacaaagcagaccgggagugccuccagcauggucaacggagugguucgucuucugacuaaaccuugggacguagugccaauggucacgcagauggcaaugacagauaccacucccuucggccagcaaagaguguuuaaggaaaaaguugacacccgcacacaggagccgaaggaagguacgaagaaacuaaugaagauuaccgccgaguggcucuggaaagagcuggggaagaaaaagacuccuaggauguguacacgggaagaguucaccagaaaagugcgcucaaaugcugcguugggagccaucuuuacugaugaaaacaaguggaaguccgcaagggaggcugucgaagacggccgauucugggagcugguggaucgggagagaaaucuccaccuugaaggcaaaugcgagacauguguauacaacaugauggggaagagggagaagaagcugggagaguuugguaaagccaagggcucucgcgcaauuugguauaugugguuaggggcccguuuccuggaauuugaggcuuugggauuccucaaugaggaccauugguuuagccggggcaacagucuguccgguguggaaggggagggacuacacagacuuggcuacauccugagggauguuggcaagaaagaagggggagccauguacgcggacgauaccgcagguugggacacacgcauuacucucgaggaccugaagaaugaagagauggucaccaaccauaugaaaggcgagcacaagaaauuggccgaagcuauauucaagcugacguaucagaauaagguggugcgaguccagcggcccaccccaagagggacaguuauggauaucauuagcaggcgcgaccaaagaggaucuggccagguggguacuuacgggcucaacaccuuuacaaauauggaggcccagcuuauccggcaaauggaaggagagggcaucuucaaaucaauucagcaucugacugcaaccgaggaaauagcuguacagaacugguuagccagggugggccgugagcgacugagucgcauggcuaucuccggggaugacugcgucgugaagccuauugaugacagauucgccagcgcauugacggcgcucaaugauaugggaaaaguucggaaggacauccagcaaugggaacccucuagggguuggaacgauuggacacaggugccauuuugcucgcaccacuuccaugagcuggucaugaaagacggccgcgugcuaguaguucccuguagaaaccaggaugaacuuauugggcgggccaggaucucacagggagcuggcuggagccugaaggagaccgccugccucgguaaguccuaugcacaaauguggacucugauguacuuucaccgacgugacuugagauuagcugccaaugcaauauguagugccgugccuucucauugggucccaacaagccgcaccacuugguccauccacgcgaaacacgaguggaugaccacagaagauaugcuggcuguguggaaccggguguggauucaggagaauccguggauggaagacaagacgcccgucgagucaugggaagagguuccuuaucucgggaaaagggaggaccaguggugcggaagucuuaucggccugaccucuagagccacuugggcaaagaacauucagacagccaucaaucaagugcgcagccuaauaggcaacgaagaguacaccgauuauaugccauccaugaaacgguucaggcgagaagaggaagaggcugggguacugugguga

SEQ ID NO: 14562 - RNA, 9876 nt, Artificial Sequence
  derived and/or modified CDS sequence (opt3) from DENV-2__FJ898436__SS-prME
accgccggcgugaucgucaugcugauucccacagcuauggcauuccaccucacuacgagaaacggggagccucauaugauaguuggaaggcaggaaaaggguaaaagccuucuguuuaagaccgaggacggcgugaauaugugcacauugauggccaucgauuuaggggaacugugugaggacacuauuaccuacaaaugcccacuacuccggcaaaacgaaccggaggauaucgacuguuggugcaauuccacaucuaccuggguaacuuauggaacauguaccacgacuggcgagcaccgccgagaaaagcguucaguggcgcuggucccccauguggguauggggcuugagaccagaacagaaacuuggaugaguagcgagggagcuuggaaacacguucagaggauugagaccuggauccugcggcauccuggcuucacaauaauggccgcaaucuuggccuacaccauuggcacgacucacuuucagcgcgcucucaucuucauucugcugacagcaguggccccauccaugaccaugagaugcaucgggauaucuaacagggauuuugucgaaggagugucggguggcucauggguagacauuguucucgagcacgggagcugugugacuacaauggcuaagaauaagcccaccuuagauuucgaacugaucaaaacggaggccaagcagccugcgacccuucggaaauauugcauugaagcaaaguugacaaacacuaccacagagagucgcuguccaacucaaggagagcccucccugaaugaagagcaggacaaacgauuuaucugcaagcauucuauggucgauagaggcugggguaacggguguggacuauucggcaagggcgggaucgugaccugcgccauguuuacaugcaaaaagaauauggaaggaaaagugguccagccugagaaccucgaauacaccauuguuauaacuccacacagcggugaggagcaugcugugggcaaugacacggggaagcacggaaaagaaaucaagauuacaccgcaguccucaaucaccgaggccgaacugacuggcuaugguaccguaacaauggaguguagucccaggaccgggcuugauuucaacgaaauggugcuguugcaaauggaggacaaagcauggcucguccaccggcagugguuucuggauuuaccucugccauggcuccccggcgcugacacucagggaagcaauuggauacagaaggagacacuugugacguucaagaacccucaugccaaaaagcaagacguugugguccugggcucucaggaaggggcgaugcacaccgccuugacuggagcaacagagauucagauguccucagguaaucuacuguuuaccggccaucucaaaugccgucugcgcauggauaagcuucaacugaaagggaugagcuacaguauguguacaggaaaguucaagaucgugaaagaaaucgcugagacucagcacggcaccauuguaaucagaguucaguaugagggugacgggucuccaugcaagauucccuucgaaauaacggauuuggagaaaaggcaugugcucggccggcugaucaccgucaacccgauugugacagaaaaggacuccccugucaacaucgaggccgaacccccauuuggagauagcuacaucauuauaggcguggagccugggcaguuaaaacugaauugguucaagaagggaucgucuaucggucaaauguuugagacuaccaugcgaggcgcuaaacgcauggccauucuaggggacacagcaugggauuucggaucccucggcgguguuuuuacuucaaucgggaaggcccugcaccagguguucggcgcuauuuacggagcggcauuuaguggcguaagcuggaccaugaaaauccuuauaggggucaucauuacguggaucggaaugaacuccagaucuacaagcuugucagugagucugguucucgugggcgucgugacccuguaucuuggugccaugguacaggcugacuccgggugugugguuagcuggaagaauaaagaacugaagugcggaucuggcauuuucaucacugauaacguccacacauggaccgagcaguacaaguuucaacccgaaucaccaaguaaauuggccagcgcaauacagaaggcccaugaggaagguauuuguggcaucagguccgugacucggcucgagaaucugauguggaaacagauuacccccgaguuaaaccacauccugucugaaaaugaggugaagcuaacaauaaugacgggggacauccgcggaauuaugcaggcuggcaaaagaucgcucaggccucaaccaaccgaacugaaguauagcuggaaaacuugggggaaggccaagaugcuuuccacagagucacauaaccagaccuucuugaucgauggaccggaaacagcagagugccccaauacuaaccgugcguggaauagucuggaggucgaagacuacggcuuugguguuuucaccacgaacauuuggcucaaacugcgggagaagcaggacguguuuugugauucuaaauuaaugagcgcugccaucaaggacaaucgagcagugcacgccgauaugggguauuggauagaauccgcucugaacgacacauggaaaauggagaaggccucauucauugagguaaagagcugccacuggccuaaaucucauacccuuugguccaauggagucuuggaaagugagaugaucaucccaaagaacuucgcaggccccgugagccagcacaacuacagaccugguuaucauacucaaaccgcuggcccauggcaccucgggaaacuggaaauggauuuugaccuaugugagggaacaacuguuguggucaccgaagauugcggcaauagggggcccucucugcgcacaacgaccgccuccggaaagcucauuacugaguggugcugucggucaugcacacugccgccucuuagauacaggggcgaggacgguuguugguacgggauggaaauccgcccauugaaagagaaggaagagaaccuggugaauaguuuaguuaccgcgggacauggccagauugauaacuucagccucggugugcugggcauggcccuuuuucuggaagagauguugcgaacucggauagggacaaagcacgcuauccuccugguagcagucucguucgugacccuaauuacgggaaauauguccuuucgugaccugggcagagugauggucaugguuggggccacuaugaccgaugacaucggaaugggcgugacauaucucgcucugcuugccgcauucaaaguaaggcccaccuuugcggccgguuugcuguuacgcaagcucacuucuaaagagcugaugauggcuacaauugggaucgcccuucugagccagucaaccauaccugaaacaauccuagagcucacugaugcacuggcuuugggaaugauggugcugaagauuguccggaacauggaaaaauaccaauuagccgugaccaucauggcaauuaguugcguucccaaugccgugauccuccagaacgcuuggaaggucuccuguacgauacuggcggccgugucuguuagcccacuucuguugacauccucacagcagaaggcagacuggauuccucucgcucugaccaucaaaggccuaaaucccacugccaucuuccugaccacacuuagcagaacuaguaagaaaaggucuuggccacucaacgaggccauuauggcugugggcauggucuccauacuggcaagcucguugcugaagaaugacaucccgaugaccgggccuuuaguagccggaggucuccugacggugugcuauguucuuacaggccgaucagcggaucuggaauuggagcgcgcugccgacgugaaaugggaggaucaagcagaaauuucugggaguucccccauccucagcauuaccaucucugaggacggaagcauguccauaaagaacgaagaggaggaacagacucugacaauccuaauucggaccggccugcuugucaucucagguguguuuccaguaaguauucccaucacugccgcugcaugguaccucugggaggugaaaaagcagagagccgggguccugugggauguuccuagcccacccccuguggaaaaggcggaguuggaagacggagcuuauaggauaaaacagcguggcauuuuaggcuacucucaaaucggggccggaguguauaaggaggguacauuccacaccauguggcaugucacgcgcggcgcagugcugaugcaccgggggaaaagaaucgagccguccugggccgauguuaagaaagaccucauuucauacggaggcgguuggaagcuggaaggggaguggaaggaaggagaggaaguacaggugcuugcucuggagccaggcaaaaaucccagggccguccagacuaagccuggcaucuuuaaaaccaacacagggaccauaggagcagugaguuuggauuucagcccagguacauccggcucucccauuguugaccgaaaggggaaaguggucggacuauacggcaauggugugguaacucggucgggggcuuaugucagcgccaucgcgcagaccgagaagucaauugaagauaacccugagaucgaagacgauauauuucgcaagaaaagacugacgauuauggaccuccauccgggagccggcaagacaaaaagguaccugcccgcaaucgugcgggaggcuaucaagcgaggccuuagaacuuuaauucuggccccaacccgcguuguggcugcagaaauggaggaggcccucaggggguugccuauccguuaucaaacaaccgccauuaaaacugaacacaccggacgggagauagucgaccugaugugucaugcuacauucacgaugagacuccugucccccgugaggguuccaaacuacaaucuuaucauuauggaugaagcgcacuucacugacccugcaaguaucgccgcucgcgguuauaucucuacccgaguggagaugggcgaggccgcagggauuuuuaugacagccacccccccaggaagcagagauccguucccucaguccaacgcucccauaauggacgaagagcgggaaaucccagagaggucauggaauucuggccacgaaugggucacugauuuuaaggguaagacagugugguucguacccagcauuaaagcggggaacgacaucgccgcaugccugcgcaagaauggaaaaaaggugauucaguugagucguaaaaccuuugauuccgaguacguuaagacgagagcuaacgacugggauuucgucgugacuacagacaucagcgagaugggcgccaauuuuaaggcagaacgggugauagauccuaggcgcuguaugaaaccagucauccuaaccgacggcgaggaacgaguaauucuggccgggcccaugccugugacccauucuucagcugcccaaagacggggaaggaucggucgcaacccgaagaaugagaacgaccaguauauuuacaugggcgaaccacucgagaaugaugaggacugcgcgcacuggaaagaagcaaagauguuacuggauaacaucaauacucccgaggggauaauuccuuccauguucgaacccgagagagaaaaaguugacgccaucgauggagaguacaggcuucggggcgaggcucguaagacauuuguggaccugaugcgccgaggugaucucccagucugguuggccuauaaaguggcugcagaagggauuaacuacgccgacagaaagugguguuucgauggcaucaagaauaaccagauacuggaggaaaacauggagguugagaucuggaccaaagaaggagagaggaagaaacucaagccucgguggcuggacgcucgcauuuauagugauccccuugcccuaaaagaauuuaaggaguucgcagcgggcagaaagagccugacauugaauuuaaucacugaaauggggaggcugccaacguucaugacccagaaagcccggaacgcucucgacaaucuggccgugcuucauacagcagaggcuggaggucgagccuacaaccacgcacugucggagcucccugaaacuuuggagacccugcuacugcucacacuucuggccaccgucacuggcgggauuuuuuuauucuugaugucuggaaagggcaucgguaaaaugacgcuggggaugugcugcauaauuaccgcuuccauccuccugugguaugcgcaaauccagccgcacuggauugccgcaagcaucauacuugaauuuuuccugauugugcucuugauccccgagccagaaaagcagagaacaccucaggauaaucaacugacuuacguagugauugcuaucuuaaccguugucgccgccacaauggcaaacgagaugggcuuucuagagaaaaccaagaaggaccugggacucggcucaauaacuacacaggaaagugagucuaauauccuugacauugaucugcgccccgcuuccgccuggacguuguaugcgguggcuaccacuuucgugacaccaaugcugaggcauagcaucgaaaacucaagugucaauguuagccucaccgccauugcaaaccaggccaccgugcugauggggcuuggaaaagguuggccucucuccaagauggacaucggcguaccccuguuggcuauuggguguuacucucaggugaauccgaucacacugacugcagccuuacuacugcucgucgcgcacuacgcuauaauuggaccaggccuucaagccaaagcaacgcgggaggcccagaagcgugcugccgcagguaucaugaaaaacccuaccguggaugggaucacaguuauugaccuggaacccauaccauaugaucccaaguuugagaagcaguugggccaggugaugcugcucauccugugcgucacucaaguacuuaugaugagaaccacaugggcuuuaugugaggcccugacccucgcgacuggaccuauuagcacguugugggaaggcaauccggggagguucuggaacacaaccaucgccguguccauggcaaauauuuuucgcggaucauaccuggcuggcgccggucuacuguucucuaucaugaaaaacacuaccaauacacggcgagggacuggaaacauaggcgagacccucggugaaaaguggaaaaguagacuuaacgcacugggcaagucggaguuucagaucuauaaaaagagcgggauucaggagguugacaggacauuggcuaaagaaggaaucaagcgcggcgagacggaucaucacgccgugucccgggggucugccaagcugagaugguucgucgaacguaauauggugacccccgagggaaaagucguggaccucggcugcgguagggggggauggucauacuauuguggcggucugaagaacguucgggaagugaaaggcuuaacuaaggggggaccaggccaugaggagccuauucccaugagcacauacggguggaaucuuguacgccugcaauccggaguggaugucuuuuucaccccuccagaaaaaugcgacacucuccuaugugauaucggcgagaguucucccaacccuacaauagaagcgggucgaacccugagaguuuugaaucugguggagaacuggcucaauaacaauacgcaguucugcauuaagguccuuaacccauauaugcccagcgugaucgaaaagauggaggcucugcagaggaaauacgggggagcauugguacggaauccgcugucacgcaacuccacccacgagauguacugggugaguaaugccacaggcaacaucguuagcucugugaauaugauuuccagaaugcucauaaacagguuuacuaugaagcacaaaaaggcuaccuaugaaccugacgucgauuuaggcucagggacacgaaacaucggaauugagagcgaaaucccaaaucuggacauuaucgguaaacggauagagaagaucaagcaggaacaugagacuucguggcacuacgaccaagaucaucccuauaaaaccugggccuaccacggcucuuaugagacaaagcagaccgggagugcauccagcauggugaacggagucgugcgucuucugacuaaaccuugggacguuguaccaauggugacgcagauggccaugacagauaccacucccuucggccagcaaagagucuuuaaggaaaaaguggacacccgcacacaggagccgaaggaagguacgaagaaacuaaugaagauuaccgcugcguggcucuggaaagagcuggggaagaaaaagacuccuaggauguguacacgggaggaauucaccagaaaaguucgcucaaaugccgcauugggagcuaucuuuacugaugagaacaaguggaaguccgccagggaagcaguggaggacggccgauucugggaacuggucgaucgggagagaaaucuccaccuugagggcaaaugcgaaacauguguguacaacaugauggggaagagggagaaaaagcugggagaauuugguaaagccaagggcucucgcgcuauuugguauaugugguuaggggcccguuuccuggaguuugaagcguugggauuccucaaugaggaccauugguuuagccggggcaacagucuguccgguguagagggggaaggacuacacagacuuggcuacauccugagggaugugggcaagaaagaggggggagcaauguacgccgacgauaccgcugguugggacacacgcauuacucucgaagaccugaagaaugaggaaaugguuaccaaccauaugaaaggcgagcacaagaaauuggccgaggcaauauucaagcugacguaucagaauaaggucgugcgagugcagcggcccaccccaagagggacagucauggauaucauuagcaggcgcgaccaaagaggaucuggccagguugguacuuacgggcucaacaccuuuacaaauauggaagcucagcuuauccggcaaauggagggagaaggcaucuucaaaucaauucagcaucugacugccaccgaggagauagcugugcagaacugguuagccaggguaggccgugaacgacugagucgcauggcaaucuccggggaugacugcguggucaagccuauugaugacagauucgcgagcgccuugacggcucucaaugauaugggaaaagugcggaaggacauccagcaaugggagcccucuagggguuggaacgauuggacacagguuccauuuugcucgcaccacuuccaugaacuggugaugaaagacggccgcguccuagugguacccuguagaaaccaggaugagcuuauugggcgggccaggaucucacagggagcaggcuggagccugaaggaaaccgcuugccucgguaaguccuaugcccaaauguggacucugauguacuuucaccgacgugacuugagauuagcagccaaugcgauauguagugcuguuccuucucauugggugccaacaagccgcaccacuugguccauccacgccaaacacgaguggaugaccacagaggauaugcuggcagucuggaaccggguguggauucaggaaaauccguggauggaggacaagacgcccguggaaucaugggaggaagucccuuaucucgggaaaagggaggaccaguggugcggaagucuuaucggccugaccucuagagccacuugggcuaagaacauucagacagccaucaaucaaguucgcagccuaauaggcaacgaggaauacaccgauuauaugccauccaugaaacgguucaggcgagaggaagaggaagcaggggugcugugguga

SEQ ID NO: 14563 - RNA, 9876 nt, Artificial Sequence
  derived and/or modified CDS sequence (opt3) from DENV-2__EU482634__SS-prME
accgccggcgugauagucaugcugauucccacagcuauggcauuccaccucacuacgagaaacggggaaccucauaugauaguuggaaggcaggaaaaggguaaaagccuucuguuuaagaccgaggacggcgugaauaugugcacauugauggccaucgauuuaggggaacugugugaggacacuauuaccuacaaaugcccacuacuccggcaaaacgaaccggaggauaucgacuguuggugcaauuccacaucuaccugggugacuuauggaacauguaccacgacuggcgagcaccgccgagaaaagcguucaguggcgcuggucccccauguggguauggggcuugagaccagaacagaaacuuggaugaguagcgagggagcuuggaaacacguucagaggauugagaccuggauccugcggcauccuggcuucacaauuauggccgcaaucuuggccuacaccauuggcacgacucacuuucagcgcgcucucaucuucauucugcugacagcaguggccccauccaugaccaugagaugcaucgggauaucuaacagggauuuugucgaaggagugucggguggcucauggguagacauuguucucgagcacgggagcugugugacuacaauggcuaagaauaagcccaccuuagauuucgaacugaucaaaacggaggccaagcagccugcgacccuucggaaauauugcauugaagcaaaguugacaaacacuaccacagagagucgcuguccaacucaaggagagcccucccugaaugaggaacaggacaaacgauuuaucugcaagcauucuauggucgauagaggcugggguaacggguguggacuauucggcaagggcgggaucgugaccugcgccauguuuacaugcaaaaagaauauggaaggaaaagugguccagccugagaaccucgaauacaccauuguuauaacuccacacagcggugaggagcaugcugugggcaaugacacggggaagcacggaaaagaaaucaagauuacaccgcaguccucaaucaccgaggccgaacugacuggcuaugguaccguaacaauggaguguagucccaggaccgggcuugauuucaacgaaauggugcuguugcaaauggaggacaaagcauggcucguccaccggcagugguuucuggauuuaccucugccauggcuccccggcgcugacacucagggaagcaauuggauacagaaggagacacuugugacguucaagaacccucaugccaaaaagcaagacguugugguccugggcucucaggaaggggcgaugcacaccgccuugacuggagcaacagagauucagauguccucagguaaucuacuguuuaccggccaucucaaaugccgucugcgcauggauaaacuucaacugaaagggaugagcuacaguauguguacaggaaaguucaagaucgugaaagaaaucgcugagacucagcacggcaccauuguaaucagaguucaguaugagggugacgggucuccaugcaagauucccuucgaaauaacggauuuggagaaaaggcaugugcucggccggcugaucaccgucaacccgauugugacagaaaaggacuccccugucaacaucgaggccgaacccccauuuggagauagcuacaucauuauaggcguggagccugggcaguuaaaacugaauugguucaagaagggaucgucuaucggucaaauguuugagacuaccaugcgaggcgcuaaacgcauggccauucuaggggacacagcaugggauuucggaucccucggcgguguuuuuacuucaaucgggaaggcccugcaccagguguucggcgcuauuuacggagcggcauuuaguggcguaagcuggaccaugaaaauccuuauaggggucaucauuacguggaucggaaugaacuccagaucuaccagcuugucagugagucugguucucgugggcgucgugacccuguaucuuggugccaugguacaggcugacuccgggugugugguuagcuggaagaauaaagaacugaagugcggaucuggcauuuucaucacugauaacguccacacauggaccgagcaguacaaguuucaacccgaaucaccaaguaaauuggccagcgcaauacagaaggcccaugaggaagguauuuguggcaucagguccgugacucggcucgagaaucugauguggaaacagauuacccccgaguuaaaccacauccuggcugaaaaugaggugaagcuaacaauaaugacgggggacaucaaaggaauuaugcaggccggcaagcgcucucucagaccucaaccaaccgaacugaaauauucguggaagacuugggggaaggcaaaaaugcuuagcacagagucccauaaccagaccuucuugaucgauggaccggaaacagcggagugccccaauacuaacagggcuuggaacucacuggaggucgaagacuacggcuuugguguuuucaccacgaacauuuggcucaagcugcgugagaaacaggacguguuuugugauaguaaguuaaugucugccgcaaucaaagacaaucgggccgugcacgcugauaugggguauuggauagaaagcgcccugaacgacacauggaagauggagaaggcauccuucauugagguaaaaucaugccacuggccuaagagccauacccuuuggucuaauggagucuuggaauccgagaugaucauccccaagaauuucgcuggccccgugagucagcacaacuaccgaccugguuaucauacucaaaccgccggcccauggcaccucgggaagcuggaaauggauuuugaccuaugugagggaacaacuguuguggucaccgaagauugcggcaauagagggcccagccugaggacaacgaccgcgucuggaaaacucauuacugaguggugcugucgcuccugcacacugccgccucuucgguacagaggcgaggacgguuguugguacgggauggaaaucaggccauugaaggagaaggaagagaaccugguaaauucauuaguuaccgccggacauggccagauugauaacuucagucucggugugcugggcauggcucuuuuucuggaagagauguugcgcacucgaauagggacaaaacacgcaauccuccugguagccgucagcuucgugacccuaauuacgggaaauaugucguuucgggaccugggccgugugauggucaugguuggggcuacuaugaccgaugacaucggaaugggcgugacauaucucgcccugcuugcagcguucaagguaagacccaccuuugccgcugguuugcuguuaaggaaacucacuuccaaggagcugaugauggccacaauugggaucgcacuucugucucagagcaccauaccugaaacaauccuagagcucacugaugcucuggccuugggaaugauggugcugaaaauuguccgcaacauggaaaaguaccaauuagcagugaccaucauggccauuucaugcguucccaaugcugugauccuccagaacgcguggaaggucaguuguacgauacuggccgcaguguccguuucuccacuucuguugacaagcucccagcagaaagcugacuggauuccucucgcccugaccaucaagggccuaaaucccacugccaucuuccugaccacacuuucacggacuaacaaaaagagaagcuggccacucaaugaggcuauuauggcagugggcauggucaguauacuggccucuuccuugcugaaaaacgacaucccgaugaccgggccuuuaguagcgggaggucuccugacggugugcuauguucuuacaggcaggagcgcugaucuggaauuggagcgagccgcagacgugaagugggaggaucaagccgaaauuucggggucaucucccauccucaguauuaccaucuccgaggacggaagcaugucuaucaaaaaugaagaggaggaacagacucugacaauccuaauucgcaccggccugcuugucaucagcgguguguuuccaguauccauucccaucacugcugcagccugguaccucugggaggugaagaagcagcgggcggggguccugugggauguuccuucaccacccccuguggaaaaagcugaguuggaagacggagccuauagaauaaagcagaggggcauuuuaggcuacagucaaaucggggcaggaguguauaaagaggguacauuccacaccauguggcaugucacgcguggcgccgugcugaugcaccgcgggaagcggaucgagccgagcugggcugauguuaaaaaggaccucauuucuuacggaggcgguuggaagcuggaaggggaguggaaagaaggagaggaaguacaggugcuugcccuggagccaggcaagaaccccagagcaguccagacuaaaccuggcaucuuuaagaccaauacagggaccauaggagcuguguccuuggauuucucaccagguacaaguggcagccccauuguugacaggaaagggaagguggucggacuauacggcaacggugugguaacucgauccggggccuaugucucugcgaucgcccagaccgagaagucgauugaagauaacccugagaucgaagacgauauauuucggaaaaagcgccugacgauuauggaccuccauccgggagcaggcaaaacaaagagauaccugcccgcuaucgugagggaggccaucaaacggggccuucgaacuuuaauucuggcuccaaccagaguuguggcagccgaaauggaggaggcccuccgcggguugccuaucagguaucaaacacccgcuauuaagaccgaacacacuggacgugagauagucgaccugaugugucaugcgaccuucacaaugcggcuccugagcccagugagaguuccuaauuacaaccuuaucauuauggaugaagcacacuucacggaccccgccucaaucgcugccagggguuauaucuccacucgcguggagaugggcgaggcagccgggauuuuuaugaccgcuacaccaccgggaagucgagauccuuucccccagucuaaugcgccaauaauggacgaagagagagaaauccccgagcggagcuggaacuccggccacgaaugggucaccgauuuuaaggguaaaacugugugguucguaccuucaauuaaggccgggaaugacaucgcagcuugccugaggaaaaacggaaagaaagugauucaguugucucgcaagacauuugauagcgaguacguuaagacccgugccaaugacugggauuucgucgugacgacugacaucagugagaugggcgcaaacuuuaaagccgaaagagugauagauccacggagguguaugaagcccgucauccuaacagacggcgaggaacgcguaauucuggcugggccuaugccggugacccauuccagcgccgcgcaacgaagaggacggaucgguaggaaucccaaaaacgagaaugaccaguauauuuacaugggcgaaccccucgagaacgaugaggacugcgcacacuggaaggaagccaaaauguuacuggauaauaucaacaccccugaggggauaauucccucuauguucgaaccagagcgcgaaaagguugacgcuaucgauggagaguacagacuuaggggcgaggcccggaaaacuuuuguggaccugaugcgucgcggugaucucccugucugguuggcuuauaagguggcagccgaagggauuaauuacgcugaccgaaagugguguuucgauggcaucaaaaacaaccagauacuggaggaaaauauggagguugagaucuggacaaaggaaggagagaggaaaaagcucaaacccagauggcuggacgcccggauuuauucagauccacuugcacuaaaggaauuuaaggaguucgcggccggccgcaaaucccugaccuugaacuuaaucacagaaauggggagacugccuacuuucaugacgcagaaggcuaggaaugcccucgacaaccuggcagugcuucauaccgcugaggccggaggucgggcauacaaucacgcccugagugagcucccggaaacauuggagacucugcuacugcucacccuucuggcuacagucaccggcgggauauuuuuauucuugaugagcggaaaaggcaucgguaagaugacucuggggaugugcugcauaauuacggcgucgauccuccugugguaugcccaaauccagccccacuggauugcagcuucuaucauacuugaauuuuuccugauugugcucuugaucccagagccugaaaaacagcgaacaccacaggauaaccaacugacauacguagugauugccaucuuaacuguugucgccgcaaccauggcuaaugagaugggcuuucuagagaagacaaagaaagaccugggacucggcuccauaaccacucaggaaagcgagucaaacauccuugacauugaucugagaccagccagugcguggacauuguaugcuguggccacgaccuucgugacuccuaugcugcgccauucuaucgaaaauuccagcgucaacguuucacucacagcaauugccaaucaggcuaccgugcugauggggcuuggaaaggguuggccccucaguaaaauggacaucggcguaccgcuguuggcaauuggguguuacagccaggugaacccaaucacccugacagccgcguuacuacugcucgucgcucacuacgccauaauuggaccuggccuucaagcaaaggccacuagggaggcucagaaacgggccgcagcugguaucaugaagaaucccacgguggaugggaucaccguuauugaccuggaaccaauacccuaugauccuaaguuugagaaacaguugggccaggugaugcugcucauccugugcgucacacaaguacuuaugaugcguacuaccugggccuuaugugaggcgcugacacucgccaccggaccgauuuccacuuugugggaaggcaaccccgggagauucuggaauacgacaaucgcagugucuauggcuaacauuuuuaggggaagcuaccuggccggcgcaggucuacuguucuccaucaugaagaauaccacuucaacccgccgggggacaggaaacauaggcgagacucucggugaaaaauggaagucucgacuuaacgcucugggcaaaagugaguuucagaucuauaagaaaucggggauucaggagguugacagaaccuuggccaaggaaggaaucaagaggggcgagacagaucaucacgccgugagccgcggguccgcgaaacugcggugguucgucgaaagaaauauggugacgccagagggaaaggucguggaccucggcugcggucgugggggauggucuuacuauuguggcggucugaaaaacguuagggaagugaagggcuuaaccaaagggggaccuggccaugaggagcccauuccuaugucaacuuacggguggaaucuuguacggcugcaaagcggaguggaugucuuuuucacaccacccgaaaagugcgacacccuccuaugugauaucggcgaguccaguccuaacccaacuauagaagcuggucgcacacugcgaguuuugaaucugguggagaacuggcucaauaacaauaccaaguucugcauuaaaguccuuaaccccuauaugccgucugugaucgaaaagauggaggcacugcagagaaaauacgggggagccuugguaaggaauccucugagccggaacucaacgcacgagauguacuggguguccaaugcuaccggcaacaucguuaguagcgugaauaugauuucucgcaugcucauaaacagauuuacaaugaagcacaaaaaggccacuuaugaaccagacgucgauuuaggcuccgggaccaggaacaucggaauugagucagaaauccccaaucuggacauuaucgguaagcgaauagagaaaaucaagcaggaacaugagacaagcuggcacuacgaccaggaucauccuuauaaaacuugggcauaccacggcucguaugagaccaagcaaacagggucugccaguuccauggugaacggagucgugcggcuucugaccaaaccaugggacguuguacccauggugacucagauggcuaugacggauacaaccccguucggccagcagcgugucuuuaaggaaaagguggacacuagaacccaagagccuaaagaagguacaaagaaacuaaugaagauuacggcggaguggcucuggaaagagcuggggaagaaaaagaccccacgcauguguacuagggaagaguucacacggaagguuagaagcaaugccgcauugggagcuaucuuuaccgaugaaaacaaauggaagucagcccgcgaggcaguggaagacggcagguucugggagcuggucgaucgagagcggaaucuccaccuugaaggcaaaugcgagacuuguguguacaacaugauggggaagagagagaaaaagcugggagaguuugguaaggccaaaggcuccagggcuauuugguauaugugguuaggggcccgcuuccuggaauuugaggcguugggauuccucaaugaggaccauugguuuucucguggcaacagccugagugguguagaaggggagggacuacaccggcuuggcuacauccugagagauguguccaagaaagaaggcggggcaauguacgccgacgauacagcuggaugggacaccaggauuacacucgaggaccugaagaaugaagagaugguuacuaaccauaugaaaggugagcacaagaaguuggccgaagcaauauucaaacugaccuaucagaauaaggucgugcgcgugcagcgaccaacgccucggggcaccgucauggauaucauuagcagaagggaccagcgcgggucuggacaaguuggcacauacggucucaacacuuuuaccaauauggaggcucagcuuaucagacagauggaaggggagggaaucuucaaaucaauucaacaucugacagccacugaggaaauagugguacagaacugguuagcucgggugggcagggagcgucugagucgaauggccaucuccggcgaugacugcgucgugaagcccauugaugaccgcuucgcaagcgcguugaccgcccucaaugauauggggaaaguuagaaaggacauccagcagugggaaccaucucggggauggaacgauuggacgcaagugcccuuuugcucgcaccacuuccaugagcuggucaugaaggacgguagggugcuaguaguuccuugucgcaaccaggaugaacuuauuggcagagcucggaucucacagggggccggauggagccugaaagagacagcaugccucggcaaguccuaugcucagauguggacccugauguacuuucacaggcgagacuugcguuuagccgcaaaugccauauguagugcggugccaucucauugggucccgacuagcagaacaaccugguccauccacgcuaaacacgaguggaugacuaccgaagauaugcuggccguguggaaccgcguguggauucaagagaaucccuggauggaagacaagacaccugucgagucaugggaagagguuccauaucucgguaaacgggaggaccaguggugcgggagucuuaucggacugacgucuagggcaaccugggccaagaacauucagacugcuaucaaucaggugagaagccuaauaggcaacgaagaguacacagauuauaugcccuccaugaagcgcuuccggagggaagaggaagaggccggcguacugugguga

SEQ ID NO: 14564 - RNA, 9876 nt, Artificial Sequence
  derived and/or modified CDS sequence (opt3) from DENV-2__EU482635__SS-prME
accgccggagugaucgucaugcugauucccacugcuauggcauuccaccucacuacgagaaauggggagccucauaugauaguuggaaggcaggaaaaggguaagagccuucuguuuaagaccgaggacggcgugaauaugugcacuuugauggccaucgauuuaggggaacugugugaggacacuauuaccuacaaaugcccacuacuccggcaaaacgaaccggaggauaucgacuguuggugcaauuccacaucuaccuggguaacuuauggaaccuguaccacgacuggcgagcaccgccgagaaaagcguucaguggcgcuggucccccauguggguauggggcuugagaccaggacagaaacuuggaugaguagcgagggagcuuggaaacacguucagaggauugagaccuggauccugcggcauccuggcuucacaauuauggccgcaaucuuggccuacaccauuggcacgacucacuuucagcgcgcucucaucuucauucugcugacagcaguggccccauccaugaccaugagaugcaucgggauaucuaacagggauuuugucgaaggagugucggguggcucauggguagacauuguucucgagcacgggagcugugugacuacaauggcuaagaauaagcccaccuuagauuucgaacugaucaaaacggaggccaagcagccugcgacccuucggaaauauugcauugaagcaaaguugacaaacacuaccacagagagucgcuguccaacucaaggagagcccucccugucugaggaacaggacaaacgauuuaucugcaagcauagcauggucgauagaggcugggguaauggguguggacuauucggcaagggcgggaucgugaccugcgccauguuuacaugcaaaaagaacauggaaggaaaagugguccagccugagaaucucgaauacaccauuguuauaacuccacacuccggugaggagcaugcugugggcaacgacacggggaagcacggaaaagaaaucaagauuacaccgcagucaaguaucaccgaggccgaacugacuggcuaugguaccguaacaauggaguguagccccaggaccgggcuugauuucaaugaaauggugcuguugcaaauggaggacaaagcauggcucguccaccggcagugguuucuggauuuaccucugccauggcuccccggcgcugacacucagggaucuaacuggauacagaaggagacacuugugacguucaagaauccucaugccaaaaagcaagacguugugguccugggcucccaggaaggggcgaugcacaccgccuugacuggagcaacagagauucagaugucaagcgguaaccuacuguuuaccggccaucucaaaugccgucugcgcauggauaaacuucaacugaaagggaugaguuacucuauguguacaggaaaguucaagaucgugaaagaaaucgcugagacucagcacggcaccauuguaaucagaguucaguaugagggugacggguccccaugcaagauucccuucgaaauaacggauuuggagaaaaggcaugugcucggccggcugaucaccgucaauccgauugugacagaaaaggacagcccugucaacaucgaggccgaacccccauuuggagauucguacaucauuauaggcguggagccugggcaguuaaaacugaacugguucaagaagggaucuuccaucggucaaauguuugagacuaccaugcgaggcgcuaaacgcauggccauucuaggggacacagcaugggauuucggaucacucggcgguguuuuuacaaguaucgggaaggcccugcaccagguguucggcgcuauuuacggagcggcauuuagcggcguauccuggaccaugaaaauccuuauaggggucaucauuacguggaucggaaugaacucuagaagcacaucauugagugugucccugguucucgugggcgucgugacccuguaucuuggugccaugguacaggcugacagcgggugugugguuucuuggaagaacaaagaacugaagugcggaucaggcauuuucaucacugauaauguccacacauggaccgagcaguacaaguuucaacccgaaaguccaagcaaauuggccuccgcaauacagaaggcccaugaggaagguauuuguggcaucaggucugugacucggcucgagaaccugauguggaaacagauuacccccgaguuaaaucacauccugucggaaaacgaggugaagcuaacaauaaugacgggggacauccgcggaauuaugcaggcuggcaaaagaagccucaggccucaaccaaccgaacugaaguauuccuggaaaacuugggggaaggccaagaugcuuucaacagagagucauaaucagaccuucuugaucgauggaccggaaacagcagagugccccaacacuaaucgugcguggaacucucuggaggucgaagacuacggcuuugguguuuucaccacgaauauuuggcucaaacugcgggagaagcaggacguguuuugugauagcaaauuaauguccgcugccaucaaggacaaccgagcagugcacgccgauaugggguauuggauagaaucagcucugaaugacacauggaaaauggagaaggccagcuucauugagguaaagucuugccacuggccuaaaucccauacccuuuggaguaacggagucuuggaaagcgagaugaucaucccaaagaauuucgcaggccccgugucucagcacaacuacagaccugguuaucauacucaaaccgcuggcccauggcaccucgggaaacuggaaauggauuuugaccuaugugagggaacaacuguuguggucaccgaagauugcggcaacagggggcccucccugcgcacaacgaccgccucaggaaagcucauuacugaguggugcugucggaguugcacacugccgccucuuagauacaggggcgaggacgguuguugguacgggauggaaauccgcccauugaaagagaaggaagagaaucuggugaacagcuuaguuaccgcgggacauggccagauugauaauuucucgcucggugugcugggcauggcccuuuuucuggaagagauguugcgaacucggauagggacaaagcacgcuauccuccugguagcagucuccuucgugacccuaauuacgggaaacaugucuuuucgugaccugggcagagugauggucaugguuggggccacuaugaccgaugacaucggaaugggcgugacauaucucgcucugcuugccgcauucaaaguaaggcccaccuuugcggccgguuugcuguuacgcaagcucacuagcaaagagcugaugauggcuacaauugggaucgcccuucugucacagaguaccauaccugaaacaauccuagagcucacugaugcacuggcuuugggaaugauggugcugaagauuguccggaauauggaaaaauaccaauuagccgugaccaucauggcaauuuccugcguucccaacgccgugauccuccagaaugcuuggaaggucucuuguacgauacuggcggccgugagcguuuccccacuucuguugacaucaagccagcagaaggcagacuggauuccucucgcucugaccaucaaaggccuaaaccccacugccaucuuccugaccacacuuaguagaacuucuaagaaaagguccuggccacucaaugaggccauuauggcugugggcauggucagcauacuggcaucgucauugcugaagaacgacaucccgaugaccgggccuuuaguagccggaggucuccugacggugugcuauguucuuacaggccgaucugcggaucuggaauuggagcgcgcugccgacgugaaaugggaggaucaagcagaaauuaguggguccagccccauccucucuauuaccaucagcgaggacggauccaugucaauaaagaaugaagaggaggaacagacucugacaauccuaauucggaccggccugcuugucaucagugguguguuuccaguaagcauucccaucacugccgcugcaugguaccucugggaggugaaaaagcagagagccgggguccugugggauguuccuucuccacccccuguggaaaaggcggaguuggaagacggagcuuauaggauaaaacagcguggcauuuuaggcuacucccaaaucggggccggaguguauaaggaggguacauuccacaccauguggcaugucacgcgcggcgcagugcugaugcaccgggggaaaagaaucgagccgucaugggccgauguuaagaaagaccucauuaguuacggaggcgguuggaagcuggaaggggaguggaaggaaggagaggaaguacaggugcuugcucuggagccaggcaaaaaccccagggccguccagacuaagccuggcaucuuuaaaaccaauacagggaccauaggagcagugagcuuggauuucuccccagguacaucuggcucgcccauuguugaccgaaaggggaaaguggucggacuauacggcaacggugugguaacucggagcggggcuuaugucucagccaucgcgcagaccgagaaguccauugaagauaauccugagaucgaagacgauauauuucgcaagaaaagacugacgauuauggaccuccauccgggagccggcaagacaaaaagguaccugcccgcaaucgugcgggaggcuaucaagcgaggccuuagaacuuuaauucuggccccaacccgcguuguggcugcagaaauggaggaggcccucaggggguugccuauccguuaucaaacaaccgccauuaaaacugaacacaccggacgggagauagucgaccugaugugucaugcuacauucacgaugagacuccugagucccgugaggguuccaaacuacaaccuuaucauuauggaugaagcgcacuucacugacccugcaucuaucgccgcucgcgguuauaucagcacccgaguggagaugggcgaggccgcagggauuuuuaugacagccacacccccaggauccagagauccguucccucagucaaaugcucccauaauggacgaagaacgggaaaucccagagaggucuuggaacagcggccacgaaugggucacugauuuuaaggguaagacagugugguucguacccaguauuaaagcggggaaugacaucgccgcaugccugcgcaagaacggcaagaaggugauucaguugucccguaaaaccuuugauagcgaguacguuaagacgagagcuaaugacugggauuucgucgugacuacagacaucucugagaugggcgccaacuuuaaggcagaacgggugauagauccuaggcgcuguaugaaaccagucauccuaaccgacggcgaggaacgaguaauucuggccgggcccaugccugugacccauucauccgcugcccaaagacggggaaggaucggucgcaauccgaagaacgagaaugaccaguauauuuacaugggcgaaccacucgagaacgaugaggacugcgcgcacuggaaagaagcaaagauguuacuggauaauaucaacacucccgaggggauaauuccuaguauguucgaacccgagagagaaaaaguugacgccaucgauggagaguacaggcuucggggcgaggcucguaagacauuuguggaccugaugcgccgaggugaucucccagucugguuggccuauaaaguggcugcagaagggauuaauuacgccgacagaaagugguguuucgauggcaucaagaacaaucagauacuggaggaaaacauggagguugagaucuggaccaaagaaggagagaggaagaaacucaagccucgguggcuggacgcucgcauuuauagcgauccccuugcccuaaaagaauuuaaggaguucgcagcgggcagaaagucgcugacauugaacuuaaucacugaaauggggaggcugccaacguucaugacccagaaagcccggaaugcucucgacaaccuggccgugcuucauacagcagaggcuggaggucgagccuacaaucacgcacugucugagcucccugaaacuuuggagacccugcuacugcucacacuucuggccaccgucacuggcgggauauuuuuauucuugauguccggaaagggcaucgguaaaaugacgcuggggaugugcugcauaauuaccgcuagcauccuccugugguaugcgcaaauccagccgcacuggauugccgcaucaaucauacuugaauuuuuccugauugugcucuugauccccgagccagaaaagcagagaacaccucaggauaaccaacugacuuacguagugauugcuaucuuaaccguugucgccgccacaauggcaaaugagaugggcuuucuagagaaaaccaagaaggaccugggacucggcaguauaacuacacaggaaucugaguccaacauccuugacauugaucugcgccccgcuagcgccuggacguuguaugcgguggcuaccacuuucgugacaccaaugcugaggcauucaaucgaaaauaguagcgucaacguuucccucaccgccauugcaaaucaggccaccgugcugauggggcuuggaaaagguuggccucucucuaagauggacaucggcguaccccuguuggcuauuggguguuacagccaggugaacccgaucacacugacugcagccuuacuacugcucgucgcgcacuacgcuauaauuggaccaggccuucaagccaaagcaacgcgggaggcccagaagcgugcugccgcagguaucaugaaaaauccuaccguggaugggaucacaguuauugaccuggaacccauaccauaugaucccaaguuugagaagcaguugggccaggugaugcugcucauccugugcgucacucaaguacuuaugaugagaaccacaugggcuuuaugugaggcccugacccucgcgacuggaccuauuuccacguugugggaaggcaacccggggagguucuggaauacaaccaucgccgugucaauggcaaacauuuuucgcggaucuuaccuggcuggcgccggucuacuguucaguaucaugaaaaauacuaccucgacacggcgagggacuggaaacauaggcgagacccucggugaaaaguggaaaagcagacuuaaugcacugggcaaguccgaguuucagaucuauaaaaagucugggauucaggagguugacaggacauuggcuaaagaaggaaucaagcgcggcgagacggaucaucacgccgugucacgggggagcgccaagcugagaugguucgucgaacguaacauggugacccccgagggaaaagucguggaccucggcugcgguagagggggaugguccuacuauuguggcggucugaagaacguucgggaagugaaaggcuuaacuaaagggggaccaggccaugaggagccuauucccaugaguacauacggguggaaucuuguacgccugcaaucuggaguggaugucuuuuucaccccuccagaaaaaugcgacacucuccuaugugauaucggcgagagcucacccaacccuacaauagaagcgggucgaacccugagaguuuugaaucugguggagaacuggcucaauaacaauacgcaguucugcauuaagguccuuaacccauauaugcccuccgugaucgaaaagauggaggcucugcagaggaaauacgggggagcauugguacggaauccgcugagucgcaacagcacccacgagauguacugggugucuaaugccacaggcaacaucguuuccucagugaauaugauuagcagaaugcucauaaacagguuuacuaugaagcacaaaaaggcuaccuaugaaccugacgucgauuuaggcucggggacacgaaauaucggaauugagucugaaaucccaaaccuggacauuaucgguaaacggauagagaagaucaagcaggaacaugagacaaguuggcacuacgaccaagaucaucccuauaaaaccugggccuaccacggcuccuaugagacaaagcagaccgggagcgcaucauccauggugaacggagucgugcgucuucugacuaaaccuugggacguuguaccaauggugacgcagauggccaugacagauaccacucccuucggccagcaaagagucuuuaaggaaaaaguggacacccgcacacaggagccgaaggaagguacgaagaaacuaaugaagauuaccgcugaguggcucuggaaagagcuggggaagaaaaagacuccuaggauguguacacgggaagaguucaccagaaaaguucgcucuaaugcggccuugggagcaaucuuuacugaugaaaacaaguggaaaagcgcuagggaggccguggaagacggccgauucugggagcuggucgaucgggagagaaaucuccaccuugaaggcaaaugcgagacauguguguacaacaugauggggaagagggagaagaagcugggagaguuugguaaagcaaagggcagucgcgccauuugguauaugugguuaggggcucguuuccuggaauuugaggccuugggauuccucaaugaggaccauugguuuucccggggcaacagccugucugguguagaaggggagggacuacacagacuuggcuacauccugagggaugugucaaagaaagaaggcggggcgauguacgcagacgauaccgccggaugggacacacgcauuacucucgaggaccugaagaaugaagagaugguuaccaaccauaugaaaggugagcacaagaaauuggcugaagccauauucaagcugacguaucagaauaaggucgugcgagugcagcggcccaccccaagaggcacagucauggauaucauuaguaggcgcgaccaaagaggguccggacagguuggcacuuacggucucaacaccuuuacaaauauggaggcacagcuuauccggcaaauggaaggggagggaaucuucaaaagcauucagcaucugacugcuaccgaggaaauagccgugcagaacugguuagcuaggguaggccgugagcgacugucucgcauggccaucucgggcgaugacugcguggucaagccuauugaugacagauucgcaucagcguugacggcccucaaugauauggggaaagugcggaaggacauccagcaaugggaacccagcaggggauggaacgauuggacacagguuccauuuugcucccaccacuuccaugagcuggugaugaaagacggucgcguccuagugguacccuguagaaaucaggaugaacuuauuggccgggcuaggaucagucagggggccggauggucucugaaggagaccgcaugccucggcaagagcuaugcucaaauguggacucugauguacuuucaccgacgugacuugagauuagccgcaaacgccauauguuccgcgguuccuucacauugggugccaacaagucgcaccacuuggucuauccacgcuaaacacgaguggaugaccacagaagauaugcuggccgucuggaaccggguguggauucaggagaauccguggauggaagacaagacgcccguggagagcugggaagaggucccuuaucucgguaaaagggaggaccaguggugcgggucccuuaucggacugaccucaagagcaacuugggccaagaacauucagacagcuaucaaucaaguucgcagccuaauaggcaacgaagaguacaccgauuauaugccaucuaugaaacgguucaggcgagaagaggaagaggccggcgugcugugguga

SEQ ID NO: 14565 - RNA, 9876 nt, Artificial Sequence
  derived and/or modified CDS sequence (opt3) from DENV-2__GQ199874__SS-prME
accgccggagugaucgucaugcugauucccacagcuauggcauuccaccucacuacgagaaauggggagccucauaugauaguuggaaggcaggaaaaggguaaaagccuucuguuuaagaccgaggacggcgugaauaugugcaccuugauggccauggauuuaggggaacugugugaggacacuaucaccuacaaaugcccacuacuccggcaaaacgaaccggaggauauugacuguuggugcaauuccacaucuaccuggguaacuuauggaacauguaccacgacuggcgagcaccgccgagaaaagcguucaguggcgcuggucccccauguggguauggggcuugagaccaggacagaaacuuggaugaguagcgagggagcuuggaaacacguucagaggaucgagaccuggauucugcggcauccuggcuucacaaucauggccgcaauauuggccuacaccaucggcacgacucacuuucagcgcgcucucauuuucauccugcugacagcaguggccccauccaugaccaugagaugcauugggaucucuaacagggauuuugucgaaggagugucggguggcucauggguagacauaguucucgagcacgggagcugugugacuacaauggcuaagaauaagcccaccuuagauuucgaacugauuaaaacggaggccaagcagccugcgacccuucggaaauauugcaucgaagcaaaguugacaaacacuaccacagagagucgcuguccaacucaaggagagcccucccugaaugaggaacaggacaaacgauuuauuugcaagcauucuauggucgauagaggcugggguaacggguguggacuauucggcaagggcgggaucgugaccugcgccauguuuacaugcaaaaagaauauggaaggaaaagugguccagccugagaaccucgaauacaccaucguuauuacuccacacagcggugaggagcaugcugugggcaaugacacggggaagcacggaaaagaaauaaagaucacaccgcaguccucaauuaccgaggccgaacugacuggcuaugguaccguaacaauggaguguagucccaggaccgggcuugauuucaacgaaauggugcuguugcaaauggaggacaaagcauggcucguccaccggcagugguuucuggauuuaccucugccauggcuccccggcgcugacacucagggaagcaauuggauccagaaggagacacuugugacguucaagaacccucaugccaaaaagcaagacguugugguccugggcucucaggaaggggcgaugcacaccgccuugacuggagcaacagagauacagauguccucagguaaucuacuguuuaccggccaucucaaaugccgucugcgcauggauaaacuucaacugaaagggaugagcuacaguauguguacaggaaaguucaagauugugaaagaaaucgcugagacucagcacggcaccaucguaauuagaguucaguaugagggugacgggucuccaugcaagauccccuucgaaauuacggauuuggagaaaaggcaugugcucggccggcugauaaccgucaacccgaucgugacagaaaaggacuccccugucaacauugaggccgaacccccauuuggagauagcuacaucaucauuggcguggagccugggcaguuaaaacugaauugguucaagaagggaucgucuauaggucaaauguuugagacuaccaugcgaggcgcuaaacgcauggccauccuaggggacacagcaugggauuucggaucccucggcgguguuuuuacuucaauugggaaggcccugcaccagguguucggcgcuaucuacggagcggcauuuaguggcguaagcuggaccaugaaaauucuuaucggggucauaaucacguggauuggaaugaacuccagaucuacuagcuugucagugagucugguucucgugggcgucgugacccuguaucuuggugccaugguacaggcugacuccgggugugugguuagcuggaagaauaaagaacugaagugcggaucuggcaucuucauuacugauaacguccacacauggaccgagcaguacaaguuucaacccgaaucaccaaguaaauuggccagcgcaauccagaaggcccaugaggaagguauauguggcauuagguccgugacucggcucgagaaucugauguggaaacagaucacccccgaguuaaaccacauucugucugaaaaugaggugaagcuaacaaucaugacgggggacauacgcggaaucaugcaggcuggcaaaagaucgcucaggccucaaccaaccgaacugaaguauagcuggaaaacuugggggaaggccaagaugcuuuccacagagucacauaaccagaccuucuugauugauggaccggaaacagcagagugccccaauacuaaccgugcguggaauagucuggaggucgaagacuacggcuuugguguuuucaccacgaacaucuggcucaaacugcgggagaagcaggacguguuuugugauucuaaauuaaugagcgcugccauuaaggacaaucgagcagugcacgccgauaugggguauuggaucgaauccgcucugaacgacacauggaaaauggagaaggccucauucauagagguaaagagcugccacuggccuaaaucucauacccuuugguccaauggagucuuggaaagugagaugauuaucccaaagaacuucgcaggccccgugagccagcacaacuacagaccugguuaucauacucaaaccgcuggcccauggcaccucgggaaacuggaaauggauuuugaccuaugugagggaacaacuguuguggucaccgaagauugcggcaauagggggcccucucugcgcacaacgaccgccuccggaaagcucaucacugaguggugcugucggucaugcacacugccgccucuuagauacaggggcgaggacgguuguugguacgggauggaaauucgcccauugaaagagaaggaagagaaccuggugaauaguuuaguuaccgcgggacauggccagaucgauaacuucagccucggugugcugggcauggcccuuuuucuggaagagauguugcgaacucggauugggacaaagcacgcuauacuccugguagcagucucguucgugacccuaaucacgggaaauauguccuuucgugaccugggcagagugauggucaugguuggggccacuaugaccgaugacauuggaaugggcgugacauaucucgcucugcuugccgcauucaaaguaaggcccaccuuugcggccgguuugcuguuacgcaagcucacuucuaaagagcugaugauggcuacaaucgggauugcccuucugagccagucaaccaucccugaaacaauacuagagcucacugaugcacuggcuuugggaaugauggugcugaagaucguccggaacauggaaaaauaccaauuagccgugaccauuauggcaaucaguugcguucccaaugccgugauucuccagaacgcuuggaaggucuccuguacgauccuggcggccgugucuguuagcccacuucuguugacauccucacagcagaaggcagacuggauaccucucgcucugaccauuaaaggccuaaaucccacugccaucuuccugaccacacuuagcagaacaaguaagaaaaggucuuggccacucaacgaggccaucauggcugugggcauggucuccauucuggcaagcucguugcugaagaaugacauaccgaugaccgggccuuuaguagccggaggucuccugacggugugcuauguucuuacaggccgaucagcggaucuggaauuggagcgcgcugccgacgugaaaugggaggaucaagcagaaaucucugggaguucccccauucucagcaucaccauuucugaggacggaagcauguccaucaagaacgaagaggaggaacagacucugacaauacuaauccggaccggccugcuugucauuucagguguguuuccaguaaguauccccauuacugccgcugcaugguaccucugggaggugaaaaagcagagagccgggguccugugggauguuccuagcccacccccuguggaaaaggcggaguuggaagacggagcuuauaggaucaaacagcguggcauauuaggcuacucucaaauuggggccggaguguauaaggaggguacauuccacaccauguggcaugucacgcgcggcgcagugcugaugcaccgggggaaaagaaucgagccguccugggccgauguuaagaaagaccucaucucauacggaggcgguuggaagcuggaaggggaguggaaggaaggagaggaaguacaggugcuugcucuggagccaggcaaaaaucccagggccguccagacuaagccuggcauuuuuaaaaccaacacagggaccaucggagcagugaguuuggauuucagcccagguacauccggcucucccauaguugaccgaaaggggaaaguggucggacuauacggcaauggugugguaacucggucgggggcuuaugucagcgccauugcgcagaccgagaagucaaucgaagauaacccugagauugaagacgauaucuuucgcaagaaaagacugacgauaauggaccuccauccgggagccggcaagacaaaaagguaccugcccgcaauugugcgggaggcuaucaagcgaggccuuagaacuuuaauccuggccccaacccgcguuguggcugcagaaauggaggaggcccucaggggguugccuauucguuaucaaacaaccgccaucaaaacugaacacaccggacgggagauugucgaccugaugugucaugcuacauucacgaugagacuccugucccccgugaggguuccaaacuacaaucuuauaaucauggaugaagcgcacuucacugacccugcaaguauugccgcucgcgguuauaucucuacccgaguggagaugggcgaggccgcagggaucuuuaugacagccacacccccaggaagcagagauccguucccucaguccaacgcucccauuauggacgaagaacgggaaauaccagagaggucauggaacucuggccacgaaugggucacugauuuuaaggguaagacagugugguucguacccagcaucaaagcggggaacgacauugccgcaugccugcgcaagaauggcaagaaggugauccaguugagucguaaaaccuuugauuccgaguacguuaagacgagagcuaacgacugggauuucgucgugacuacagacauuagcgagaugggcgccaauuuuaaggcagaacgggugaucgauccuaggcgcuguaugaaaccagucauacuaaccgacggcgaggaacgaguaauccuggccgggcccaugccugugacccauucuucagcugcccaaagacggggaaggauuggucgcaacccgaagaaugagaacgaccaguauaucuacaugggcgaaccacucgagaaugaugaggacugcgcgcacuggaaagaagcaaagauguuacuggauaacauuaauacucccgaggggaucauaccuuccauguucgaacccgagagagaaaaaguugacgccauugauggagaguacaggcuucggggcgaggcucguaagacauuuguggaccugaugcgccgaggugaucucccagucugguuggccuauaaaguggcugcagaagggaucaacuacgccgacagaaagugguguuucgauggcauuaagaauaaccagauccuggaggaaaacauggagguugagauauggaccaaagaaggagagaggaagaaacucaagccucgguggcuggacgcucgcaucuauagugauccccuugcccuaaaagaauuuaaggaguucgcagcgggcagaaagagccugacauugaauuuaauuacugaaauggggaggcugccaacguucaugacccagaaagcccggaacgcucucgacaaucuggccgugcuucauacagcagaggcuggaggucgagccuacaaccacgcacugucggagcucccugaaacuuuggagacccugcuacugcucacacuucuggccaccgucacuggcgggaucuuuuuauucuugaugucuggaaagggcauugguaaaaugacgcuggggaugugcugcaucauaaccgcuuccauucuccugugguaugcgcaaauccagccgcacuggaucgccgcaagcauuauccuugaauuuuuccugauagugcucuugauucccgagccagaaaagcagagaacaccucaggauaaucaacugacuuacguagugaucgcuauuuuaaccguugucgccgccacaauggcaaacgagaugggcuuucuagagaaaaccaagaaggaccugggacucggcucaaucacuacacaggaaagugagucuaauauacuugacaucgaucugcgccccgcuuccgccuggacguuguaugcgguggcuaccacuuucgugacaccaaugcugaggcauagcauugaaaacucaagugucaauguuagccucaccgccaucgcaaaccaggccaccgugcugauggggcuuggaaaagguuggccucucuccaagauggacauuggcguaccccuguuggcuaucggguguuacucucaggugaauccgauuacacugacugcagccuuacuacugcucgucgcgcacuacgcuaucauaggaccaggccuucaagccaaagcaacgcgggaggcccagaagcgugcugccgcagguauuaugaaaaacccuaccguggaugggaucacaguuaucgaccuggaacccauuccauaugaucccaaguuugagaagcaguugggccaggugaugcugcucauacugugcgucacucaaguacuuaugaugagaaccacaugggcuuuaugugaggcccugacccucgcgacuggaccuaucagcacguugugggaaggcaauccggggagguucuggaacacaaccauugccguguccauggcaaauaucuuucgcggaucauaccuggcuggcgccggucuacuguucucuauuaugaaaaacacuaccaauacacggcgagggacuggaaacaucggcgagacccucggugaaaaguggaaaaguagacuuaacgcacugggcaagucggaguuucagauauauaaaaagagcgggauccaggagguugacaggacauuggcuaaagaaggaauuaagcgcggcgagacggaucaucacgccgugucccgggggucugccaagcugagaugguucgucgaacguaauauggugacccccgagggaaaagucguggaccucggcugcgguagagggggauggucauacuauuguggcggucugaagaacguucgggaagugaaaggcuuaacuaaagggggaccaggccaugaggagccuauccccaugagcacauacggguggaaucuuguacgccugcaauccggaguggaugucuuuuucaccccuccagaaaaaugcgacacucuccuaugugauauuggcgagaguucucccaacccuacaaucgaagcgggucgaacccugagaguuuugaaucugguggagaacuggcucaauaacaauacgcaguucugcauaaagguccuuaacccauauaugcccagcgugauugaaaagauggaggcucugcagaggaaauacgggggagcauugguacggaauccgcugucacgcaacuccacccacgagauguacugggugaguaaugccacaggcaacaucguuagcucugugaauaugaucuccagaaugcucauuaacagguuuacuaugaagcacaaaaaggcuaccuaugaaccugacgucgauuuaggcucagggacacgaaacauaggaaucgagagcgaaauuccaaaucuggacaucauugguaaacggaucgagaagauaaagcaggaacaugagacuucguggcacuacgaccaagaucaucccuauaaaaccugggccuaccacggcucuuaugagacaaagcagaccgggagugcauccagcauggugaacggagucgugcgucuucugacuaaaccuugggacguuguaccaauggugacgcagauggccaugacagauaccacucccuucggccagcaaagagucuuuaaggaaaaaguggacacccgcacacaggagccgaaggaagguacgaagaaacuaaugaagaucaccgcugaguggcucuggaaagagcuggggaagaaaaagacuccuaggauguguacacgggaagaguucaccagaaaaguucgcucaaaugcggccuugggagcaauuuuuacugaugaaaacaaguggaaguccgcuagggaggccguggaagacggccgauucugggagcuggucgaucgggagagaaaucuccaccuugaaggcaaaugcgagacauguguguacaacaugauggggaagagggagaagaagcugggagaguuugguaaagcaaagggcucucgcgccaucugguauaugugguuaggggcucguuuccuggaauuugaggccuugggauuccucaaugaggaccauugguuuagccggggcaacagucuguccgguguagaaggggagggacuacacagacuuggcuacauucugagggaugugggcaagaaagaagggggagcgauguacgcagacgauaccgccgguugggacacacgcaucacucucgaggaccugaagaaugaagagaugguuaccaaccauaugaaaggcgagcacaagaaauuggcugaagccauuuucaagcugacguaucagaauaaggucgugcgagugcagcggcccaccccaagagggacagucauggauauaaucagcaggcgcgaccaaagaggaucuggccagguugguacuuacgggcucaacaccuuuacaaauauggaggcacagcuuauucggcaaauggaaggagagggcaucuucaaaucaauccagcaucugacugcuaccgaggaaauugccgugcagaacugguuagcuaggguaggccgugagcgacugagucgcauggccauauccggggaugacugcguggucaagccuaucgaugacagauucgcaagcgcguugacggcccucaaugauaugggaaaagugcggaaggacauucagcaaugggaacccucuagggguuggaacgauuggacacagguuccauuuugcucgcaccacuuccaugagcuggugaugaaagacggccgcguccuagugguacccuguagaaaccaggaugaacuuaucgggcgggcuaggauuucacagggagccggcuggagccugaaggagaccgcaugccucgguaaguccuaugcucaaauguggacucugauguacuuucaccgacgugacuugagauuagccgcaaaugccaucuguagugcgguuccuucucauugggugccaacaagccgcaccacuugguccauacacgcuaaacacgaguggaugaccacagaagauaugcuggccgucuggaaccggguguggauccaggagaauccguggauggaagacaagacgcccguggagucaugggaagaggucccuuaucucgggaaaagggaggaccaguggugcggaagucuuauuggccugaccucuagagcaacuugggccaagaacauccagacagcuauuaaucaaguucgcagccuaaucggcaacgaagaguacaccgauuauaugccauccaugaaacgguucaggcgagaagaggaagaggccggggugcugugguga

SEQ ID NO: 14566 - RNA, 9876 nt, Artificial Sequence
  derived and/or modified CDS sequence (opt3) from DENV-2__EU482639__SS-prME
accgccggcgugaucgucaugcugauucccacagcuauggcauuccaccucacuacgagaaacggggagccucauaugauaguuggaaggcaggaaaaggguaaaagccuucuguuuaagaccgaggacggcgugaauaugugcacauugauggccaucgauuuaggggaacugugugaggacacuauuaccuacaaaugcccacuacuccggcaaaacgaaccggaggauaucgacuguuggugcaauuccacaucuaccuggguaacuuauggaacauguaccacgacuggcgagcaccgccgagaaaagcguucaguggcgcuggucccccauguggguauggggcuugagaccagaacagaaacuuggaugaguagcgagggagcuuggaaacacguucagaggauugagaccuggauccugcggcauccuggcuucacaauaauggccgcaaucuuggccuacaccauuggcacgacucacuuucagcgcgcucucaucuucauucugcugacagcaguggccccauccaugaccaugagaugcaucgggauaucuaacagggauuuugucgaaggagugucggguggcucauggguagacauuguucucgagcacgggagcugugugacuacaauggcuaagaauaagcccaccuuagauuucgaacugaucaaaacggaggccaagcagccugcgacccuucggaaauauugcauugaagcaaaguugacaaacacuaccacagagagucgcuguccaacucaaggagagcccucccugaaugaagagcaggacaaacgauuuaucugcaagcauucuauggucgauagaggcugggguaacggguguggacuauucggcaagggcgggaucgugaccugcgccauguuuacaugcaaaaagaauauggaaggaaaagugguccagccugagaaccucgaauacaccauuguuauaacuccacacagcggugaggagcaugcugugggcaaugacacggggaagcacggaaaagaaaucaagauuacaccgcaguccucaaucaccgaggccgaacugacuggcuaugguaccguaacaauggaguguagucccaggaccgggcuugauuucaacgaaauggugcuguugcaaauggaggacaaagcauggcucguccaccggcagugguuucuggauuuaccucugccauggcuccccggcgcugacacucagggaagcaauuggauacagaaggagacacuugugacguucaagaacccucaugccaaaaagcaagacguugugguccugggcucucaggaaggggcgaugcacaccgccuugacuggagcaacagagauucagauguccucagguaaucuacuguuuaccggccaucucaaaugccgucugcgcauggauaagcuucaacugaaagggaugagcuacaguauguguacaggaaaguucaagaucgugaaagaaaucgcugagacucagcacggcaccauuguaaucagaguucaguaugagggugacgggucuccaugcaagauucccuucgaaauaacggauuuggagaaaaggcaugugcucggccggcugaucaccgucaacccgauugugacagaaaaggacuccccugucaacaucgaggccgaacccccauuuggagauagcuacaucauuauaggcguggagccugggcaguuaaaacugaauugguucaagaagggaucgucuaucggucaaauguuugagacuaccaugcgaggcgcuaaacgcauggccauucuaggggacacagcaugggauuucggaucccucggcgguguuuuuacuucaaucgggaaggcccugcaccagguguucggcgcuauuuacggagcggcauuuaguggcguaagcuggaccaugaaaauccuuauaggggucaucauuacguggaucggaaugaacuccagaucuacaagcuugucagugagucugguucucgugggcgucgugacccuguaucuuggugccaugguacaggcugacuccgggugugugguuagcuggaagaauaaagaacugaagugcggaucuggcauuuucaucacugauaacguccacacauggaccgagcaguacaaguuucaacccgaaucaccaaguaaauuggccagcgcaauacagaaggcccaugaggaagguauuuguggcaucagguccgugacucggcucgagaaucugauguggaaacagauuacccccgaguuaaaccacauccugucugaaaaugaggugaagcuaacaauaaugacgggggacauccgcggaauuaugcaggcuggcaaaagaucgcucaggccucaaccaaccgaacugaaguauagcuggaaaacuugggggaaggccaagaugcuuuccacagagucacauaaccagaccuucuugaucgauggaccggaaacagcagagugccccaauacuaaccgugcguggaauagucuggaggucgaagacuacggcuuugguguuuucaccacgaacauuuggcucaaacugcgggagaagcaggacguguuuugugauucuaaauuaaugagcgcugccaucaaggacaaucgagcagugcacgccgauaugggguauuggauagaauccgcucugaacgacacauggaaaauggagaaggccucauucauugagguaaagagcugccacuggccuaaaucucauacccuuugguccaauggagucuuggaaagugagaugaucaucccaaagaacuucgcaggccccgugagccagcacaacuacagaccugguuaucauacucaaaccgcuggcccauggcaccucgggaaacuggaaauggauuuugaccuaugugagggaacaacuguuguggucaccgaagauugcggcaauagggggcccucucugcgcacaacgaccgccuccggaaagcucauuacugaguggugcugucggucaugcacacugccgccucuuagauacaggggcgaggacgguuguugguacgggauggaaauccgcccauugaaagagaaggaagagaaccuggugaauaguuuaguuaccgcgggacauggccagauugauaacuucagccucggugugcugggcauggcccuuuuucuggaagagauguugcgaacucggauagggacaaagcacgcuauccuccugguagcagucucguucgugacccuaauuacgggaaauauguccuuucgugaccugggcagagugauggucaugguuggggccacuaugaccgaugacaucggaaugggcgugacauaucucgcucugcuugccgcauucaaaguaaggcccaccuuugcggccgguuugcuguuacgcaagcucacuucuaaagagcugaugauggcuacaauugggaucgcccuucugagccagucaaccauaccugaaacaauccuagagcucacugaugcacuggcuuugggaaugauggugcugaagauuguccggaacauggaaaaauaccaauuagccgugaccaucauggcaauuaguugcguucccaaugccgugauccuccagaacgcuuggaaggucuccuguacgauacuggcggccgugucuguuagcccacuucuguugacauccucacagcagaaggcagacuggauuccucucgcucugaccaucaaaggccuaaaucccacugccaucuuccugaccacacuuagcagaacuaguaagaaaaggucuuggccacucaacgaggccauuauggcugugggcauggucuccauacuggcaagcucguugcugaagaaugacaucccgaugaccgggccuuuaguagccggaggucuccugacggugugcuauguucuuacaggccgaucagcggaucuggaauuggagcgcgcugccgacgugaaaugggaggaucaagcagaaauuucugggaguucccccauccucagcauuaccaucucugaggacggaagcauguccauaaagaacgaagaggaggaacagacucugacaauccuaauucggaccggccugcuugucaucucagguguguuuccaguaaguauucccaucacugccgcugcaugguaccucugggaggugaaaaagcagagagccgggguccugugggauguuccuagcccacccccuguggaaaaggcggaguuggaagacggagcuuauaggauaaaacagcguggcauuuuaggcuacucucaaaucggggccggaguguauaaggaggguacauuccacaccauguggcaugucacgcgcggcgcagugcugaugcaccgggggaaaagaaucgagccguccugggccgauguuaagaaagaccucauuucauacggaggcgguuggaagcuggaaggggaguggaaggaaggagaggaaguacaggugcuugcucuggagccaggcaaaaaucccagggccguccagacuaagccuggcaucuuuaaaaccaacacagggaccauaggagcagugaguuuggauuucagcccagguacauccggcucucccauuguugaccgaaaggggaaaguggucggacuauacggcaauggugugguaacucggucgggggcuuaugucagcgccaucgcgcagaccgagaagucaauugaagauaacccugagaucgaagacgauauauuucgcaagaaaagacugacgauuauggaccuccauccgggagccggcaagacaaaaagguaccugcccgcaaucgugcgggaggcuaucaagcgaggccuuagaacuuuaauucuggccccaacccgcguuguggcugcagaaauggaggaggcccucaggggguugccuauccguuaucaaacaaccgccauuaaaacugaacacaccggacgggagauagucgaccugaugugucaugcuacauucacgaugagacuccugucccccgugaggguuccaaacuacaaucuuaucauuauggaugaagcgcacuucacugacccugcaaguaucgccgcucgcgguuauaucucuacccgaguggagaugggcgaggccgcagggauuuuuaugacagccacccccccaggaagcagagauccguucccucaguccaacgcucccauaauggacgaagagcgggaaaucccagagaggucauggaauucuggccacgaaugggucacugauuuuaaggguaagacagugugguucguacccagcauuaaagcggggaacgacaucgccgcaugccugcgcaagaauggaaaaaaggugauucaguugagucguaaaaccuuugauuccgaguacguuaagacgagagcuaacgacugggauuucgucgugacuacagacaucagcgagaugggcgccaauuuuaaggcagaacgggugauagauccuaggcgcuguaugaaaccagucauccuaaccgacggcgaggaacgaguaauucuggccgggcccaugccugugacccauucuucagcugcccaaagacggggaaggaucggucgcaacccgaagaaugagaacgaccaguauauuuacaugggcgaaccacucgagaaugaugaggacugcgcgcacuggaaagaagcaaagauguuacuggauaacaucaauacucccgaggggauaauuccuuccauguucgaacccgagagagaaaaaguugacgccaucgauggagaguacaggcuucggggcgaggcucguaagacauuuguggaccugaugcgccgaggugaucucccagucugguuggccuauaaaguggcugcagaagggauuaacuacgccgacagaaagugguguuucgauggcaucaagaauaaccagauacuggaggaaaacauggagguugagaucuggaccaaagaaggagagaggaagaaacucaagccucgguggcuggacgcucgcauuuauagugauccccuugcccuaaaagaauuuaaggaguucgcagcgggcagaaagagccugacauugaauuuaaucacugaaauggggaggcugccaacguucaugacccagaaagcccggaacgcucucgacaaucuggccgugcuucauacagcagaggcuggaggucgagccuacaaccacgcacugucggagcucccugaaacuuuggagacccugcuacugcucacacuucuggccaccgucacuggcgggauuuuuuuauucuugaugucuggaaagggcaucgguaaaaugacgcuggggaugugcugcauaauuaccgcuuccauccuccugugguaugcgcaaauccagccgcacuggauugccgcaagcaucauacuugaauuuuuccugauugugcucuugauccccgagccagaaaagcagagaacaccucaggauaaucaacugacuuacguagugauugcuaucuuaaccguugucgccgccacaauggcaaacgagaugggcuuucuagagaaaaccaagaaggaccugggacucggcucaauaacuacacaggaaagugagucuaauauccuugacauugaucugcgccccgcuuccgccuggacguuguaugcgguggcuaccacucuggugacaccaaugcucaggcauagcaucgaaaacucaagugucaauguuagccugaccgccauugcaaaccaggccaccgugcuuauggggcucggaaaagguuggccucuguccaagauggacaucggcguacccuugcuggcuauuggguguuacucucaggugaauccgaucacauuaacugcagcccuacugcuccuugucgcgcacuacgcuauaauuggaccaggccugcaagccaaagcaacgcgggaggcccagaagcgugcugccgcagguaucaugaaaaacccuaccguggaugggaucacaguuauugacuuggaacccauaccauaugaucccaaguucgagaagcagcugggccaggugaugcuccugauccuuugcgucacucaaguauuaaugaugagaaccacaugggcucugugugaggcccucaccuuggcgacuggaccuauuagcacgcugugggaaggcaauccggggagguuuuggaacacaaccaucgccguguccauggcaaauauuuuccgcggaucauaccuagcuggcgccggucugcucuuuucuaucaugaaaaacacuaccaauacacggcgagggacuggaaacauaggcgagacccuuggugaaaaguggaaaaguagacugaacgcauugggcaagucggaguuccagaucuauaaaaagagcgggauucaggagguugacaggacacuggcuaaagaaggaaucaagcgcggcgagacggaucaucacgccgugucccgggggucugccaagcucagaugguuugucgaacguaauauggugacccccgagggaaaagucguggaccugggcugcgguagggggggauggucauacuauuguggcgguuuaaagaacguucgggaagugaaaggccuuacuaaggggggaccaggccaugaggagccuauucccaugagcacauacggguggaaucugguacgccuccaauccggaguggaugucuucuuuaccccuccagaaaaaugcgagacucuacugugugacaucggcgaaaguucucccaacccuacaauagaggcgggucgaaccuugagaguucugaaucucguggaaaacuggcuuaauaacaauacgcaguucugcauuaagguccugaacccauauaugcccagcgugaucgagaagauggaggcuuugcagaggaaauacgggggagcacugguacggaauccgcucucacgcaacuccacccacgaaauguacugggugaguaaugccacaggcaacaucguuagcucugugaauaugauuuccagaauguuaauaaacagguucacuaugaagcacaaaaaggcuaccuaugagccugaugucgaccugggcucagggacacgaaacaucggaauugaaagcgagaucccaaaucuugauauuaucgguaaacggauagaaaagaucaagcaggagcaugagacuucguggcacuacgaccaagaccaucccuauaaaaccugggccuaccacggcucuuaugaaacaaagcagaccgggagugcauccagcauggugaacggagucgugcgucugcuaacuaaaccuugggauguuguaccaauggugacgcagauggccaugacagacaccacucccuuuggccagcaaagagucuucaaggagaaaguggauacccgcacacaggaaccgaaggaggguacgaagaaacucaugaagauuaccgcugaguggcuguggaaagaauuggggaagaaaaagacuccuaggauguguacacgggaggaauuuaccagaaaaguucgcucaaaugcggcccugggagcaaucuucacugacgagaacaaguggaaguccgcuagggaagccguggaggauggccgauuuugggagcucgucgaccgggaaagaaaucuucaccuggagggcaaaugcgaaacauguguguacaacaugauggggaagagggagaaaaaguuaggagaauucgguaaagcaaagggcucucgcgccauuugguauauguggcugggggcucguuuuuuggaguucgaggcccucggauuucugaaugaagaucauugguucagccggggcaacagucuauccgguguagagggggaaggacuucacagacugggcuacauccucagggacgugggcaagaaagaggggggagcgauguacgcagaugacaccgccgguugggauacacgcauuacucuggaagacuugaagaaugaggagaugguuaccaaccauaugaaaggcgaacacaagaaacuggcugaggccauauuuaagcucacguaucagaauaaggucgugcgagugcagcggcccaccccaagagggacagucauggacaucauuagcaggcgcgaucaaagaggaucuggccagguugguacuuacgggcuuaacaccuucacaaauauggaagcacagcugauccggcaaauggagggagagggcaucuuuaaaucaauucagcauuuaacugcuaccgaagagauagccgugcagaacuggcuggcuaggguaggccgugaacgauugagucgcauggccaucuccggggacgauugcguggucaagccuauugacgauagauucgcaagcgcgcucacggcccugaaugacaugggaaaaauccggaaggauauucagcaaugggagcccucuagggguuggaacgacuggacacaggugccauucugcucgcaccacuuucaugaacuaguuaugaaagauggccgcgugcuugucgugcccuguagaaaccaggacgagcugaucgggcgggcuaggauaucacagggagccggcuggagccucaaggagaccgcaugccuggguaaguccuaugcucaaauguggacuuugauguacuuccaccgacgugauuuaagacuggccgcaaaugccaucuguagugcgguaccuucucauuggguuccaacaagccgcaccacuugguccauucacgcuaaacacgaauggaugaccacagaggacaugcucgccguguggaaccgggucuggauccaggaaaauccguggauggaggauaagacgcccguggaaucaugggaggaggugccuuaucuugggaaaagggaagaccaguggugcggaagucugauuggccuaaccucuagagcaacuugggccaagaacauccagacagcuauaaaucaaguccgcagccugauuggcaacgaggaauacaccgacuauaugccauccaugaaacgguuuaggcgagaggaagaggaggccgggguucucugguga

SEQ ID NO: 14567 - RNA, 9876 nt, Artificial Sequence
  derived and/or modified CDS sequence (opt3) from DENV-2__EU482766__SS-prME
accgccggcgugauaguaaugcugauucccacagcuauggcuuuccaccucacuacgagaaacggggaaccucauaugauaguuggaagacaggaaaaggguaaaagccuucuguuuaagaccgaagacggcgugaauaugugcacauugauggccaucgauuuaggggaacugugugaagacacuauuaccuacaaaugcccacuccuccggcaaaacgaaccggaagauaucgacuguuggugcaauuccacaucuaccuggguaacuuauggaacauguaccacgacuggcgagcaccgccgagaaaagcguucaguggcgcuggucccccauguggguauggggcuugagaccagaacagaaacuuggaugaguagcgagggagcuuggaaacacguucagaggauugagaccuggauccugcggcauccuggcuucacaauaauggccgcaaucuuggccuacaccauuggcacgacucacuuucagcgcgcucucaucuucauucugcugacagcaguggccccauccaugaccaugagaugcaucgggauaucuaacagggauuuugucgaaggagugucggguggcucauggguagacauuguucucgagcacgggagcugugugacuacaauggcuaagaauaagcccaccuuagauuucgaacugaucaaaacggaggccaagcagccugcgacccuucggaaauauugcauugaagcaaaguugacaaacacuaccacagagagucgcuguccaacucaaggagagcccucccugaaugaagaacaggacaaacgauuuaucugcaagcauucuauggucgauagaggcugggguaacggguguggacuauucggcaagggcgggaucgugaccugcgccauguuuacaugcaaaaagaauauggaaggaaaagugguccagccugagaaccucgaauacaccauuguuauaacuccacacagcggugaggagcaugcugugggcaaugacacggggaagcacggaaaagaaaucaagauuacaccgcaguccucaaucaccgaggccgaacugacuggcuaugguaccguaacaauggaguguaguagcaggaccgggcuugauuucaacgaaauggugcuguugcaaauggaggacaaagcauggcucguccaccggcagugguuucuggauuuaccccugccuuggcucccaggcgcugacacucagggaucuaauuggauacagaaggagacacuugugacguucaagaacccccaugccaaaaagcaagacguugugguccugggcucccaggaaggggcgaugcacaccgccuugacuggagcaacagagauucagaugucaagcgguaaucuacuguuuaccggccaucucaaaugccgucugcgcauggauaaacuucaacugaaagggaugaguuacucuauguguacaggaaaguucaagaucgugaaagaaaucgcugagacucagcacggcaccauuguaaucagaguucaguaugagggugacggguccccuugcaagauuccauucgaaauaacggauuuggagaaaaggcaugugcucggccggcugaucaccgucaaccccauugugacagaaaaggacagcccggucaacaucgaggccgaaccucccuuuggagauucguacaucauuauaggcguggagccagggcaguuaaaacugaauugguucaagaagggaucuuccaucggucaaauguuugagacuaccaugcgaggcgcuaaacgcauggccauucuaggggacacagcaugggauuucggaucacucggcgguguuuuuacaaguaucgggaaggcccugcaccagguguucggcgcuauuuacggagcggcauuuagcggcguauccuggaccaugaaaauccuuauaggggucaucauuacguggaucggaaugaacucuagaagcacaucauugagugugucccugguucucgugggcgucgugacccuguaucuuggugccguagugcaggcugacagcggguguguugucucuuggaagaauaaagaacugaagugcggaucaggcauuuucaucacugauaacgugcacacauggaccgagcaguacaaguuucaaccugaaagucccagcaaauuggccuccgcaauacagaaggcccaugaggaagguauuuguggcaucaggucugugacucggcucgagaaucugauguggaaacagauuaccccagaguuaaaccacauccugucggaaaaugaggucaagcuaacaauaaugacgggggacaucaaaggaauuaugcaggcuggcaagcgcagccucagaccccaaccuaccgaacugaaauauuccuggaagacuugggggaaggccaaaaugcuuucaacagagagucauaaccagaccuucuugaucgauggaccagaaacagcagagugcccgaauacuaacagggcguggaacucucuggagguugaagacuacggcuuugguguguucaccacgaacauuuggcucaagcugcgugagaaacaggacguguuuugugauagcaaguuaauguccgcugccaucaaagacaaucgggcaguacacgccgauaugggguauuggauagaaucagcucugaacgacacauggaagauggagaaggccagcuucauugaggucaaaucuugccacuggcccaagucccauacccuuuggaguaauggaguguuggaaagcgagaugaucaucccuaaaaacuucgcaggcccaguuucucagcacaacuaccgacccgguuaucauacucaaaccgcuggcccuuggcaccucgggaagcuggaaauggauuuugacuucugugagggaacaacuguggucgugaccgaagauugcggcaauagagggccaucccuaaggacaacgaccgccucaggaaaacugauuacugaguggugcugucgcaguugcacacuacccccgcugcgguacagaggcgaggacgguuguugguacgggauggaaaucaggccucuuaaggagaaggaagagaacuugguuaauagccuggugaccgcgggacauggccagauugauaacuuuucguuagguguacucggcauggcccuguuccuugaagagaugcugcgcacucgaauagggacaaaacacgcuaucuugcucgucgcaguguccuuugugacccugauuacgggaaauaugucuuuccgggaccuaggccgugucaugguuauggugggggccacuaugaccgaugacaucggaaugggcguaacauaucuggcucuccuggccgcauuuaaggugagaccaaccuucgcggccggucuuuugcugaggaaauuaacuagcaaggagcucaugauggcuacaauugggaucgcccugcuuucacagaguaccauacccgaaacaauccuggagcuaacugaugcacucgcucugggaaugauggucuugaaaauugugcgcaacauggaaaaguaccaacuggccguuaccaucauggcaauuuccugcgugccuaaugccgucaucuuacagaacgcuuggaaggugucuuguacgauacucgcggccguuagcgugagcccccugcuucugacaucaagccagcagaaagcagacuggauuccauuggcucucaccaucaagggccugaauccuacugccaucuuucuaaccacacugagucggacuucuaaaaagagauccuggccccuuaacgaggccauuauggcugucggcaugguaagcauacucgcaucgucacuguugaaaaaugacaucccaaugaccgggccgcugguggccggagguuuacucacgguuugcuaugugcugacaggcaggucugcggaucuugaacuggagcgagcugccgacgucaagugggaggaucaagcagaaauuaguggguccagcccuaucuugucuauuaccaucagcgaggacggauccaugucaaucaagaaugaagaggaggaacagacucucacaauccugauucgcaccggccuacuggugaucagugguguauuccccgugagcauuccaaucacugccgcugcaugguaccuuugggaggucaagaagcagcgggccgggguucucugggaugugcccucuccuccacccguggaaaaagcggagcuggaagacggagcuuauagaauaaagcagaggggcauuuugggcuacucccaaaucggggccggagucuauaaagaggguacauuucacaccauguggcaugugacgcguggcgcaguuuuaaugcaccgcgggaagcggaucgagccuucaugggccgaugucaagaaggaccugauuaguuacggaggcgguuggaagcucgaaggggaguggaaagaaggagaggaagugcagguccuggcucuugagccgggcaagaauccaagagccgugcagacuaaacccggcaucuucaagaccaacacagggaccauaggagcaguuagccuggauuuuuccccugguacaucuggcucgccaauuguggacaggaaagggaaggucgugggauuguacggcaaugguguagucacucgaagcggggcuuaugugucagccaucgcgcagaccgagaaguccauugaagauaaccccgagaucgaagacgauauauuccggaaaaagcgccuaacgauuauggaccugcauccuggagccggcaaaacaaagagauaccucccggcaaucguuagggaggcuaucaaacggggccugcgaacucuuauuuuagcccccaccagaguggucgcugcagaaauggaggaggcccugcgcgggcucccaaucagguaucaaacuccugccauuaagaccgaacacacuggacgugagauaguggacuugaugugucaugcuaccuucacaaugcggcugcucagucccguuagagugccaaacuacaaucugaucauuauggaugaagcgcacuuuacggacccugcaucuaucgccgcuagggguuauaucagcacucgcgucgagaugggcgaggccgcagggauuuucaugaccgccacacccccaggaucccgagauccguuuccucagucaaacgcucccauaauggacgaagagagagaaaucccagagcggucuuggaauagcggccacgaaugggugaccgauuucaaggguaaaacuguaugguuugugcccaguauuaaggcggggaacgacaucgccgcaugccuuaggaaaaauggaaagaaaguuauucagcugucccgcaagacauucgauagcgaguacgucaagacccgugcuaacgacugggauuuuguggugacgacugacaucucugagaugggcgccaauuucaaagcagaaagagucauagauccucggagguguaugaagccaguaaucuugacagacggcgaggaacgcgugauucuagccgggcccaugccuguuacccauucauccgcugcccaacgaagaggacggaucgguaggaacccgaaaaaugagaacgaccaguauauuuacaugggcgaaccacuggagaaugaugaggacugcgcgcacuggaaggaagcaaaaaugcucuuagauaacaucaauacccccgaggggauaauuccuaguauguuugaacccgagcgcgaaaagguggacgccaucgauggagaguacagacugaggggcgaggcucggaaaacuuucgucgaccuuaugcgucgcggugaucugccaguguggcucgccuauaagguugcugcagaagggauuaacuacgccgaccgaaagugguguuuugauggcaucaaaaauaaccagauauuggaggaaaacauggagguggagaucuggacaaaggaaggagagaggaagaagcugaaaccuagguggcucgacgcucggauuuauagcgauccccuggcccuuaaggaguucaaggaguucgcagcgggccgcaaaucgcuaacccugaauuugaucacagaaauggggagauuaccaacuuuuaugacgcagaaggccaggaacgcucuggacaaucucgccguccugcauaccgcagaggcuggaggucgggccuacaaccacgcacuuucugagcugccugaaacacucgagacuuugcugcuacugacccuccuugccacagugaccggcgggauuuuccuguuuuuaauguccggaaaaggcaucgguaagaugacuuuggggaugugcugcauaauuacggcuagcauccugcucugguaugcgcaaauccagccgcacuggauugccgcaucaaucauacuggaguucuuucuuauuguacugcucauccccgagccagaaaaacagcgaaccccucaggauaaucaauugacauacgugguuauugcuauccugacugucguggccgccaccauggcaaacgagaugggcuucuuagagaagacaaagaaagaccuaggacugggcaguauaaccacucaggaaucugaguccaauauccucgacauugaucuuagacccgcuagcgccuggacacuguaugcgguggcuacgaccuuugucacuccaauguugcgccauucaaucgaaaacaguagcguuaaugugucccugacagccauugcaaaccaggccaccguacucauggggcugggaaaggguuggccucuuucuaaaauggacaucggcgugccccuccuggcuauuggguguuacagccaggucaauccgaucaccuugacagcagcccuguuacuacugguggcgcacuacgcuauaauuggaccaggccuccaagccaaggcaacuagggaggcccagaaacgggcugccgcagguaucaugaagaacccuacgguugaugggaucaccgugauugaccuugaacccauaccauaugaucccaaguucgagaaacagcugggccaggucauguugcugauccucugcguaacacaagugcugaugaugcguacuaccugggcucuuugugaggccuuaacacuggcgaccggaccuauuuccacucucugggaaggcaauccggggagauuuuggaacacgacaaucgccguuucaauggcaaauauuuucaggggaucuuacuuggcuggcgccggucugcuauuuaguaucaugaagaacaccacuucgacccgccgggggacaggaaauauaggcgagacucugggugaaaaauggaagucccgacucaacgcacuuggcaaauccgaguuccagaucuauaagaaaucugggauucaggagguggacagaacccuggcuaaggaaggaaucaagaggggcgagacagaucaucacgccgucucacgcgggagcgccaaauugcggugguuuguggaaagaaacauggucacgcccgagggaaaggugguugaccugggcugcggucgugggggaugguccuacuauuguggcggucucaaaaaugugagggaaguaaagggccugaccaaagggggaccaggccaugaggagccuauucccaugaguacuuacggguggaacuuagugcggcuucaaucuggagucgauguuuucuucacaccuccagaaaagugcgacacccugcucugugauaucggcgagagcucacccaauccuacuauagaagcgggucgcacacuacgagugcugaacuuggucgagaauuggcugaacaauaacacccaguuuugcauuaaggugcucaauccauauaugcccuccguaaucgagaaaauggaggcacuucagagacaguacgggggagcacuggugaggaacccguugagucggaauagcacgcacgagauguacuggguuucuaacgccaccggcaauaucguguccucagucaacaugauuagccgcaugcugauaaauagauucacaaugaagcacaaaaaggcuacuuaugaaccugacguggaucucggcucggggaccaggaacaucggaauugagucugaaaucccaaacuuagacauuaucgguaaacgaauagagaagaucaagcaagaacaugagauuaguuggcacuacgaccaggaucaucccuauaaaacaugggccuaccacggcuccuaugagacuaagcagaccgggagcgcaucauccauggucaauggagugguucggcugcuuacaaaaccuugggacguagugccaauggucacccagauggccaugacugauacgacacccuuuggccaacagcguguguucaaggaaaaaguugacaccagaacucaggagccgaaggaagguaccaagaaacugaugaagaucacagcugaguggcuauggaaagagcucgggaagaaaaagacgccucgcauguguaccagggaagaguuuacucggaaagugagaucuaacgcggcccugggagcaauuuucacagaugaaaauaaguggaaaagcgcucgcgaggccgucgaagacggcagguuuugggaguugguggaucgagagcggaaccugcaccucgaaggcaaaugcgagaccuguguauacaauaugauggggaagagagagaagaaacuuggagaguucgguaaagcaaaaggcaguagggccaucugguauauguggcugggggcucgcuuuuuagaguucgaggcccugggauuuuugaacgaggaccauugguucucccguggcaauagccucucugguguggaaggggagggacugcaccggcuaggcuacauucuuagagauguuggcaagaaagaagggggagcgauguacgcagacgauacugccgguugggacacaaggauaacccuggaggaccucaagaacgaagagauggucacaaaucauaugaaaggcgagcacaagaaacuggcugaagccaucuuuaaguugacuuaucagaacaagguggugcgcguccaacgacccaccccacgggggacgguuauggauauuaucucaagaagggaccagcgcggaaguggccagguggguaccuacgggcugaauacauucacuaacauggaggcacaacucaucagacagauggaaggagagggcauuuucaaauccauacagcaucuuaccgcuacagaggaaaucgccguacagaauuggcuggcucgggugggcagggagcguuuaagccgaauggccauuucuggggaugacugcgucgugaagccuaucgaugaccgcuuugcaucggcgcugacugccuugaacgauaugggaaaaguuagaaaggacauucaacagugggaacccucacgggguuggaaugauuggacccaggugccauucugcagccaccacuuucaugagcucgucaugaaagacggcagggugcugguaguucccugucgcaaccaggaugaacuaaucgggagagcucggauaucccaaggagccggcuggagucuuaaggagacggcaugccuggguaagucuuaugcucagauguggacacucauguacuuccacaggcgagaccugcguuuggccgcaaacgccaucuguagcgcggugccuucccauugggucccaaccucaagaacuacauggaguauucacgcuaaacacgaguggaugaccacugaagauauguuagccguguggaaucgcguguggauccaggagaacccguggauggaagacaagacccccgucgagucuugggaagagguuccuuaucuggggaaacgggaggaccaguggugcggaagccucauuggccuuacauccagggcaacgugggccaagaauauccaaaccgcuauaaaccaggugagaucacugauuggcaaugaagaguacacugauuauaugccaagcaugaaacgcuuucggagggaagaggaagaggccgggguacuaugguga

SEQ ID NO: 14568 - RNA, 9876 nt, Artificial Sequence
  derived and/or modified CDS sequence (opt3) from DENV-2__EU482695__SS-prME
accgccggagugaucgucaugcugauucccacagcuauggcauuccaccucacuacgagaaauggggagccucauaugauaguuggaaggcaggaaaaggguaaaagccuucuguuuaagaccgaggacggcgugaauaugugcaccuugauggccaucgauuuaggggaacugugugaggacacuauuaccuacaaaugcccacuacuccggcaaaacgaaccggaggauaucgacuguuggugcaauuccacaucuaccuggguaacuuauggaacauguaccacgacuggcgagcaccgccgagaaaagcguucaguggcgcuggucccccauguggguauggggcuugagaccaggacagaaacuuggaugaguagcgagggagcuuggaaacacguucagaggauugagaccuggauccugcggcauccuggcuucacaauuauggccgcaaucuuggccuacaccauuggcacgacucacuuucagcgcgcucucaucuucauucugcugacagcaguggccccauccaugaccaugagaugcaucgggauaucuaacagggauuuugucgaaggagugucggguggcucauggguagacauuguucucgagcacgggagcugugugacuacaauggcuaagaauaagcccaccuuagauuucgaacugaucaaaacggaggccaagcagccugcgacccuucggaaauauugcauugaagcaaaguugacaaacacuaccacagagagucgcuguccaacucaaggagagcccucccugaaugaggaacaggacaaacgauuuaucugcaagcauucuauggucgauagaggcugggguaacggguguggacuauucggcaagggcgggaucgugaccugcgccauguuuacaugcaaaaagaauauggaaggaaaagugguccagccugagaaccucgaauacaccauuguuauaacuccacacagcggugaggagcaugcugugggcaaugacacggggaagcacggaaaagaaaucaagauuacaccgcaguccucaaucaccgaggccgaacugacuggcuaugguaccguaacaauggaguguagucccaggaccgggcuugauuucaacgaaauggugcuguugcaaauggaggacaaagcauggcucguccaccggcagugguuucuggauuuaccucugccauggcuccccggcgcugacacucagggaagcaauuggauacagaaggagacacuugugacguucaagaacccucaugccaaaaagcaagacguugugguccugggcucucaggaaggggcgaugcacaccgccuugacuggagcaacagagauucagauguccucagguaaucuacuguuuaccggccaucucaaaugccgucugcgcauggauaaacuucaacugaaagggaugagcuacaguauguguacaggaaaguucaagaucgugaaagaaaucgcugagacucagcacggcaccauuguaaucagaguucaguaugagggugacgggucuccaugcaagauucccuucgaaauaacggauuuggagaaaaggcaugugcucggccggcugaucaccgucaacccgauugugacagaaaaggacuccccugucaacaucgaggccgaacccccauuuggagauagcuacaucauuauaggcguggagccugggcaguuaaaacugaauugguucaagaagggaucgucuaucggucaaauguuugagacuaccaugcgaggcgcuaaacgcauggccauucuaggggacacagcaugggauuucggaucccucggcgguguuuuuacuucaaucgggaaggcccugcaccagguguucggcgcuauuuacggagcggcauuuaguggcguaagcuggaccaugaaaauccuuauaggggucaucauuacguggaucggaaugaacuccagaucuacuagcuugucagugagucugguucucgugggcgucgugacccuguaucuuggugccaugguacaggcugacuccgggugugugguuagcuggaagaauaaagaacugaagugcggaucuggcauuuucaucacugauaacguccacacauggaccgagcaguacaaguuucaacccgaaucaccaaguaaauuggccagcgcaauacagaaggcccaugaggaagguauuuguggcaucagguccgugacucggcucgagaaucugauguggaaacagauuacccccgaguuaaaccacauccugucugaaaaugaggugaagcuaacaauaaugacgggggacauccgcggaauuaugcaggcuggcaaaagaucgcucaggccucaaccaaccgaacugaaguauagcuggaaaacuugggggaaggccaagaugcuuuccacagagucacauaaccagaccuucuugaucgauggaccggaaacagcagagugccccaauacuaaccgugcguggaauagucuggaggucgaagacuacggcuuugguguuuucaccacgaacauuuggcucaaacugcgggagaagcaggacguguuuugugauucuaaauuaaugagcgcugccaucaaggacaaucgagcagugcacgccgauaugggguauuggauagaauccgcucugaacgacacauggaaaauggagaaggccucauucauugagguaaagagcugccacuggccuaaaucucauacccuuugguccaauggagucuuggaaagugagaugaucaucccaaagaacuucgcaggccccgugagccagcacaacuacagaccugguuaucauacucaaaccgcuggcccauggcaccucgggaaacuggaaauggauuuugaccuaugugagggaacaacuguuguggucaccgaagauugcggcaauagggggcccucucugcgcacaacgaccgccuccggaaagcucauuacugaguggugcugucggucaugcacacugccgccucuuagauacaggggcgaggacgguuguugguacgggauggaaauccgcccauugaaagagaaggaagagaaccuggugaauaguuuaguuaccgcgggacauggccagauugauaacuucagccucggugugcugggcauggcccuuuuucuggaagagauguugcgaacucggauagggacaaagcacgcuauccuccugguagcagucucguucgugacccuaauuacgggaaauauguccuuucgugaccugggcagagugauggucaugguuggggccacuaugaccgaugacaucggaaugggcgugacauaucucgcucugcuugccgcauucaaaguaaggcccaccuuugcggccgguuugcuguuacgcaagcucacuucuaaagagcugaugauggcuacaauugggaucgcccuucugagccagucaaccauaccugaaacaauccuagagcucacugaugcacuggcuuugggaaugauggugcugaagauuguccggaacauggaaaaauaccaauuagccgugaccaucauggcaauuaguugcguucccaaugccgugauccuccagaacgcuuggaaggucuccuguacgauacuggcggccgugucuguuagcccacuucuguugacauccucacagcagaaggcagacuggauuccucucgcucugaccaucaaaggccuaaaucccacugccaucuuccugaccacacuuagcagaacaaguaagaaaaggucuuggccacucaacgaggccauuauggcugugggcauggucuccauacuggcaagcucguugcugaagaaugacaucccgaugaccgggccuuuaguagccggaggucuccugacggugugcuauguucuuacaggccgaucagcggaucuggaauuggagcgcgcugccgacgugaaaugggaggaucaagcagaaauuucugggaguucccccauccucagcauuaccaucucugaggacggaagcauguccauaaagaacgaagaggaggaacagacucugacaauccuaauucggaccggccugcuugucaucucagguguguuuccaguaaguauucccaucacugccgcugcaugguaccucugggaggugaaaaagcagagagccgggguccugugggauguuccuagcccacccccuguggaaaaggcggaguuggaagacggagcuuauaggauaaaacagcguggcauuuuaggcuacucucaaaucggggccggaguguauaaggaggguacauuccacaccauguggcaugucacgcgcggcgcagugcugaugcaccgggggaaaagaaucgagccguccugggccgauguuaagaaagaccucauuucauacggaggcgguuggaagcuggaaggggaguggaaggaaggagaggaaguacaggugcuugcucuggagccaggcaaaaaucccagggccguccagacuaagccuggcaucuuuaaaaccaacacagggaccauaggagcagugaguuuggauuucagcccagguacauccggcucucccauuguugaccgaaaggggaaaguggucggacuauacggcaauggugugguaacucggucgggggcuuaugucagcgccaucgcgcagaccgagaagucaauugaagauaacccugagaucgaagacgauauauuucgcaagaaaagacugacgauuauggaccuccauccgggagccggcaagacaaaaagguaccugcccgcaaucgugcgggaggcuaucaagcgaggccuuagaacuuuaauucuggccccaacccgcguuguggcugcagaaauggaggaggcccucaggggguugccuauccguuaucaaacaaccgccauuaaaacugaacacaccggacgggagauagucgaccugaugugucaugcuacauucacgaugagacuccugucccccgugaggguuccaaacuacaaucuuaucauuauggaugaagcgcacuucacugacccugcaaguaucgccgcucgcgguuauaucucuacccgaguggagaugggcgaggccgcagggauuuuuaugacagccacacccccaggaagcagagauccguucccucaguccaacgcucccauaauggacgaagaacgggaaaucccagagaggucauggaacucuggccacgaaugggucacugauuuuaaggguaagacagugugguucguacccagcauuaaagcggggaacgacaucgccgcaugccugcgcaagaauggcaagaaggugauucaguugagucguaaaaccuuugauuccgaguacguuaagacgagagcuaacgacugggauuucgucgugacuacagacaucagcgagaugggcgccaauuuuaaggcagaacgggugauagauccuaggcgcuguaugaaaccagucauccuaaccgacggcgaggaacgaguaauucuggccgggcccaugccugugacccauucuucagcugcccaaagacggggaaggaucggucgcaacccgaagaaugagaacgaccaguauauuuacaugggcgaaccacucgagaaugaugaggacugcgcgcacuggaaagaagcaaagauguuacuggauaacaucaauacucccgaggggauaauuccuuccauguucgaacccgagagagaaaaaguugacgccaucgauggagaguacaggcuucggggcgaggcucguaagacauuuguggaccugaugcgccgaggugaucucccagucugguuggccuauaaaguggcugcagaagggauuaacuacgccgacagaaagugguguuucgauggcaucaagaauaaccagauacuggaggaaaacauggagguugagaucuggaccaaagaaggagagaggaagaaacucaagccucgguggcuggacgcucgcauuuauagugauccccuugcccuaaaagaauuuaaggaguucgcagcgggcagaaagagccugacauugaauuuaaucacugaaauggggaggcugccaacguucaugacccagaaagcccggaacgcucucgacaaucuggccgugcuucauacagcagaggcuggaggucgagccuacaaccacgcacugucggagcucccugaaacuuuggagacccugcuacugcucacacuucuggccaccgucacuggcgggauauuuuuauucuugaugucuggaaagggcaucgguaaaaugacgcuggggaugugcugcauaauuaccgcuuccauccuccugugguaugcgcaaauccagccgcacuggauugccgcaagcaucauacuugaauuuuuccugauugugcucuugauccccgagccagaaaagcagagaacaccucaggauaaucaacugacuuacguagugauugcuaucuuaaccguugucgccgccacaauggcaaacgagaugggcuuucuagagaaaaccaagaaggaccugggacucggcucaauaacuacacaggaaagugagucuaauauccuugacauugaucugcgccccgcuuccgccuggacguuguaugcgguggcuaccacuuucgugacaccaaugcugaggcauagcaucgaaaacucaagugucaauguuagccucaccgccauugcaaaccaggccaccgugcugauggggcuuggaaaagguuggccucucuccaagauggacaucggcguaccccuguuggcuauuggguguuacucucaggugaauccgaucacacugacugcagccuuacuacugcucgucgcgcacuacgcuauaauuggaccaggccuucaagccaaagcaacgcgggaggcccagaagcgugcugccgcagguaucaugaaaaacccuaccguggaugggaucacaguuauugaccuggaacccauaccauaugaucccaaguuugagaagcaguugggccaggugaugcugcucauccugugcgucacucaaguacuuaugaugagaaccacaugggcuuuaugugaggcccugacccucgcgacuggaccuauuagcacguugugggaaggcaauccggggagguucuggaacacaaccaucgccguguccauggcaaauauuuuucgcggaucauaccuggcuggcgccggucuacuguucucuaucaugaaaaacacuaccaauacacggcgagggacuggaaacauaggcgagacccucggugaaaaguggaaaaguagacuuaacgcacugggcaagucggaguuucagaucuauaaaaagagcgggauucaggagguugacaggacauuggcuaaagaaggaaucaagcgcggcgagacggaucaucacgccgugucccgggggucugccaagcugagaugguucgucgaacguaauauggugacccccgagggaaaagucguggaccucggcugcgguagagggggauggucauacuauuguggcggucugaagaacguucgggaagugaaaggcuuaacuaaagggggaccaggccaugaggagccuauucccaugagcacauacggguggaaucuuguacgccugcaauccggaguggaugucuuuuucaccccuccagaaaaaugcgacacucuccuaugugauaucggcgagaguucucccaacccuacaauagaagcgggucgaacccugagaguuuugaaucugguggagaacuggcucaauaacaauacgcaguucugcauuaagguccuuaacccauauaugcccagcgugaucgaaaagauggaggcucugcagaggaaauacgggggagcauugguacggaauccgcugucacgcaacuccacccacgagauguacugggugaguaaugccacaggcaacaucguuagcucugugaauaugauuuccagaaugcucauaaacagguuuacuaugaagcacaaaaaggcuaccuaugaaccugacgucgauuuaggcucagggacacgaaacaucggaauugagagcgaaaucccaaaucuggacauuaucgguaaacggauagagaagaucaagcaggaacaugagacuucguggcacuacgaccaagaucaucccuauaaaaccugggccuaccacggcucuuaugagacaaagcagaccgggagugcauccagcauggugaacggagucgugcgucuucugacuaaaccuugggacguuguaccaauggugacgcagauggccaugacagauaccacucccuucggccagcaaagagucuuuaaggaaaaaguggacacccgcacacaggagccgaaggaagguacgaagaaacuaaugaagauuaccgcugaguggcucuggaaagagcuggggaagaaaaagacuccuaggauguguacacgggaagaguucaccagaaaaguucgcucaaaugcggccuugggagcaaucuuuacugaugaaaacaaguggaaguccgcuagggaggccguggaagacggccgauucugggagcuggucgaucgggagagaaaucuccaccuugaaggcaaaugcgagacauguguguacaacaugauggggaagagggagaagaagcugggagaguuugguaaagcaaagggcucucgcgccauuugguauaugugguuaggggcucguuuccuggaauuugaggccuugggauuccucaaugaggaccauugguuuagccggggcaacagucuguccgguguagaaggggagggacuacacagacuuggcuacauccugagggaugugggcaagaaagaagggggagcgauguacgcagacgauaccgccgguugggacacacgcauuacucucgaggaccugaagaaugaagagaugguuaccaaccauaugaaaggcgagcacaagaaauuggcugaagccauauucaagcugacguaucagaauaaggucgugcgagugcagcggcccaccccaagagggacagucauggauaucauuagcaggcgcgaccaaagaggaucuggccagguugguacuuacgggcucaacaccuuuacaaauauggaggcacagcuuauccggcaaauggaaggagagggcaucuucaaaucaauucagcaucugacugcuaccgaggaaauagccgugcagaacugguuagcuaggguaggccgugagcgacugagucgcauggccaucuccggggaugacugcguggucaagccuauugaugacagauucgcaagcgcguugacggcccucaaugauaugggaaaagugcggaaggacauccagcaaugggaacccucuagggguuggaacgauuggacacagguuccauuuugcucgcaccacuuccaugagcuggugaugaaagacggccgcguccuagugguacccuguagaaaccaggaugaacuuauugggcgggcuaggaucucacagggagccggcuggagccugaaggagaccgcaugccucgguaaguccuaugcucaaauguggacucugauguacuuucaccgacgugacuugagauuagccgcaaaugccauauguagugcgguuccuucucauugggugccaacaagccgcaccacuugguccauccacgcuaaacacgaguggaugaccacagaagauaugcuggccgucuggaaccggguguggauucaggagaauccguggauggaagacaagacgcccguggagucaugggaagaggucccuuaucucgggaaaagggaggaccaguggugcggaagucuuaucggccugaccucuagagcaacuugggccaagaacauucagacagcuaucaaucaaguucgcagccuaauaggcaacgaagaguacaccgauuauaugccauccaugaaacgguucaggcgagaagaggaagaggccggggugcugugguga

SEQ ID NO: 14569 - RNA, 9876 nt, Artificial Sequence
  derived and/or modified CDS sequence (opt3) from DENV-2__EU482769__SS-prME
accgccggagugaucgucaugcugauucccacagcuauggcauuccaccucacuacgagaaauggggagccucauaugauaguuggaaggcaggaaaaggguaaaagccuucuguuuaagaccgaggacggcgugaauaugugcaccuugauggccaucgauuuaggggaacugugugaggacacuauuaccuacaaaugcccacuacuccggcaaaacgaaccggaggauaucgacuguuggugcaauuccacaucuaccuggguaacuuauggaacauguaccacgacuggcgagcaccgccgagaaaagcguucaguggcgcuggucccccauguggguauggggcuugagaccaggacagaaacuuggaugaguagcgagggagcuuggaaacacguucagaggauugagaccuggauccugcggcauccuggcuucacaauuauggccgcaaucuuggccuacaccauuggcacgacucacuuucagcgcgcucucaucuucauucugcugacagcaguggccccauccaugaccaugagaugcaucgggauaucuaacagggauuuugucgaaggagugucggguggcucauggguagacauuguucucgagcacgggagcugugugacuacaauggcuaagaauaagcccaccuuagauuucgaacugaucaaaacggaggccaagcagccugcgacccuucggaaauauugcauugaagcaaaguugacaaacacuaccacagagagucgcuguccaacucaaggagagcccucccugaaugaggaacaggacaaacgauuuaucugcaagcauucuauggucgauagaggcugggguaacggguguggacuauucggcaagggcgggaucgugaccugcgccauguuuacaugcaaaaagaauauggaaggaaaagugguccagccugagaaccucgaauacaccauuguuauaacuccacacagcggugaggagcaugcugugggcaaugacacggggaagcacggaaaagaaaucaagauuacaccgcaguccucaaucaccgaggccgaacugacuggcuaugguaccguaacaauggaguguagucccaggaccgggcuugauuucaacgaaauggugcuguugcaaauggaggacaaagcauggcucguccaccggcagugguuucuggauuuaccucugccauggcuccccggcgcugacacucagggaagcaauuggauacagaaggagacacuugugacguucaagaacccucaugccaaaaagcaagacguugugguccugggcucucaggaaggggcgaugcacaccgccuugacuggagcaacagagauucagauguccucagguaaucuacuguuuaccggccaucucaaaugccgucugcgcauggauaaacuucaacugaaagggaugagcuacaguauguguacaggaaaguucaagaucgugaaagaaaucgcugagacucagcacggcaccauuguaaucagaguucaguaugagggugacgggucuccaugcaagauucccuucgaaauaacggauuuggagaaaaggcaugugcucggccggcugaucaccgucaacccgauugugacagaaaaggacuccccugucaacaucgaggccgaacccccauuuggagauagcuacaucauuauaggcguggagccugggcaguuaaaacugaauugguucaagaagggaucgucuaucggucaaauguuugagacuaccaugcgaggcgcuaaacgcauggccauucuaggggacacagcaugggauuucggaucccucggcgguguuuuuacuucaaucgggaaggcccugcaccagguguucggcgcuauuuacggagcggcauuuaguggcguaagcuggaccaugaaaauccuuauaggggucaucauuacguggaucggaaugaacuccagaucuacuagcuugucagugagucugguucucgugggcgucgugacccuguaucuuggugccaugguacaggcugacuccgggugugugguuagcuggaagaauaaagaacugaagugcggaucuggcauuuucaucacugauaacguccacacauggaccgagcaguacaaguuucaacccgaaucaccaaguaaauuggccagcgcaauacagaaggcccaugaggaagguauuuguggcaucagguccgugacucggcucgagaaucugauguggaaacagauuacccccgaguuaaaccacauccugucugaaaaugaggugaagcuaacaauaaugacgggggacauccgcggaauuaugcaggcuggcaaaagaucgcucaggccucaaccaaccgaacugaaguauagcuggaaaacuugggggaaggccaagaugcuuuccacagagucacauaaccagaccuucuugaucgauggaccggaaacagcagagugccccaauacuaaccgugcguggaauagucuggaggucgaagacuacggcuuugguguuuucaccacgaacauuuggcucaaacugcgggagaagcaggacguguuuugugauucuaaauuaaugagcgcugccaucaaggacaaucgagcagugcacgccgauaugggguauuggauagaauccgcucugaacgacacauggaaaauggagaaggccucauucauugagguaaagagcugccacuggccuaaaucucauacccuuugguccaauggagucuuggaaagugagaugaucaucccaaagaacuucgcaggccccgugagccagcacaacuacagaccugguuaucauacucaaaccgcuggcccauggcaccucgggaaacuggaaauggauuuugaccuaugugagggaacaacuguuguggucaccgaagauugcggcaauagggggcccucucugcgcacaacgaccgccuccggaaagcucauuacugaguggugcugucggucaugcacacugccgccucuuagauacaggggcgaggacgguuguugguacgggauggaaauccgcccauugaaagagaaggaagagaaccuggugaauaguuuaguuaccgcgggacauggccagauugauaacuucagccucggugugcugggcauggcccuuuuucuggaagagauguugcgaacucggauagggacaaagcacgcuauccuccugguagcagucucguucgugacccuaauuacgggaaauauguccuuucgugaccugggcagagugauggucaugguuggggccacuaugaccgaugacaucggaaugggcgugacauaucucgcucugcuugccgcauucaaaguaaggcccaccuuugcggccgguuugcuguuacgcaagcucacuucuaaagagcugaugauggcuacaauugggaucgcccuucugagccagucaaccauaccugaaacaauccuagagcucacugaugcacuggcuuugggaaugauggugcugaagauuguccggaacauggaaaaauaccaauuagccgugaccaucauggcaauuaguugcguucccaaugccgugauccuccagaacgcuuggaaggucuccuguacgauacuggcggccgugucuguuagcccacuucuguugacauccucacagcagaaggcagacuggauuccucucgcucugaccaucaaaggccuaaaucccacugccaucuuccugaccacacuuagcagaacaaguaagaaaaggucuuggccacucaacgaggccauuauggcugugggcauggucuccauacuggcaagcucguugcugaagaaugacaucccgaugaccgggccuuuaguagccggaggucuccugacggugugcuauguucuuacaggccgaucagcggaucuggaauuggagcgcgcugccgacgugaaaugggaggaucaagcagaaauuucugggaguucccccauccucagcauuaccaucucugaggacggaagcauguccauaaagaacgaagaggaggaacagacucugacaauccuaauucggaccggccugcuugucaucucagguguguuuccaguaaguauucccaucacugccgcugcaugguaccucugggaggugaaaaagcagagagccgggguccugugggauguuccuagcccacccccuguggaaaaggcggaguuggaagacggagcuuauaggauaaaacagcguggcauuuuaggcuacucucaaaucggggccggaguguauaaggaggguacauuccacaccauguggcaugucacgcgcggcgcagugcugaugcaccgggggaaaagaaucgagccguccugggccgauguuaagaaagaccucauuucauacggaggcgguuggaagcuggaaggggaguggaaggaaggagaggaaguacaggugcuugcucuggagccaggcaaaaaucccagggccguccagacuaagccuggcaucuuuaaaaccaacacagggaccauaggagcagugaguuuggauuucagcccagguacauccggcucucccauuguugaccgaaaggggaaaguggucggacuauacggcaauggugugguaacucggucgggggcuuaugucagcgccaucgcgcagaccgagaagucaauugaagauaacccugagaucgaagacgauauauuucgcaagaaaagacugacgauuauggaccuccauccgggagccggcaagacaaaaagguaccugcccgcaaucgugcgggaggcuaucaagcgaggccuuagaacuuuaauucuggccccaacccgcguuguggcugcagaaauggaggaggcccucaggggguugccuauccguuaucaaacaaccgccauuaaaacugaacacaccggacgggagauagucgaccugaugugucaugcuacauucacgaugagacuccugucccccgugaggguuccaaacuacaaucuuaucauuauggaugaagcgcacuucacugacccugcaaguaucgccgcucgcgguuauaucucuacccgaguggagaugggcgaggccgcagggauuuuuaugacagccacacccccaggaagcagagauccguucccucaguccaacgcucccauaauggacgaagaacgggaaaucccagagaggucauggaacucuggccacgaaugggucacugauuuuaaggguaagacagugugguucguacccagcauuaaagcggggaacgacaucgccgcaugccugcgcaagaauggcaagaaggugauucaguugagucguaaaaccuuugauuccgaguacguuaagacgagagcuaacgacugggauuucgucgugacuacagacaucagcgagaugggcgccaauuuuaaggcagaacgggugauagauccuaggcgcuguaugaaaccagucauccuaaccgacggcgaggaacgaguaauucuggccgggcccaugccugugacccauucuucagcugcccaaagacggggaaggaucggucgcaacccgaagaaugagaacgaccaguauauuuacaugggcgaaccacucgagaaugaugaggacugcgcgcacuggaaagaagcaaagauguuacuggauaacaucaauacucccgaggggauaauuccuuccauguucgaacccgagagagaaaaaguugacgccaucgauggagaguacaggcuucggggcgaggcucguaagacauuuguggaccugaugcgccgaggugaucucccagucugguuggccuauaaaguggcugcagaagggauuaacuacgccgacagaaagugguguuucgauggcaucaagaauaaccagauacuggaggaaaacauggagguugagaucuggaccaaagaaggagagaggaagaaacucaagccucgguggcuggacgcucgcauuuauagugauccccuugcccuaaaagaauuuaaggaguucgcagcgggcagaaagagccugacauugaauuuaaucacugaaauggggaggcugccaacguucaugacccagaaagcccggaacgcucucgacaaucuggccgugcuucauacagcagaggcuggaggucgagccuacaaccacgcacugucggagcucccugaaacuuuggagacccugcuacugcucacacuucuggccaccgucacuggcgggauauuuuuauucuugaugucuggaaagggcaucgguaaaaugacgcuggggaugugcugcauaauuaccgcuuccauccuccugugguaugcgcaaauccagccgcacuggauugccgcaagcaucauacuugaauuuuuccugauugugcucuugauccccgagccagaaaagcagagaacaccucaggauaaucaacugacuuacguagugauugcuaucuuaaccguugucgccgccacaauggcaaacgagaugggcuuucuagagaaaaccaagaaggaccugggacucggcucaauaacuacacaggaaagugagucuaauauccuugacauugaucugcgccccgcuuccgccuggacguuguaugcgguggcuaccacuuucgugacaccaaugcugaggcauagcaucgaaaacucaagugucaauguuagccucaccgccauugcaaaccaggccaccgugcugauggggcuuggaaaagguuggccucucuccaagauggacaucggcguaccccuguuggcuauuggguguuacucucaggugaauccgaucacacugacugcagccuuacuacugcucgucgcgcacuacgcuauaauuggaccaggccuucaagccaaagcaacgcgggaggcccagaagcgugcugccgcagguaucaugaaaaacccuaccguggaugggaucacaguuauugaccuggaacccauaccauaugaucccaaguuugagaagcaguugggccaggugaugcugcucauccugugcgucacucaaguacuuaugaugagaaccacaugggcuuuaugugaggcccugacccucgcgacuggaccuauuagcacguugugggaaggcaauccggggagguucuggaacacaaccaucgccguguccauggcaaauauuuuucgcggaucauaccuggcuggcgccggucuacuguucucuaucaugaaaaacacuaccaauacacggcgagggacuggaaacauaggcgagacccucggugaaaaguggaaaaguagacuuaacgcacugggcaagucggaguuucagaucuauaaaaagagcgggauucaggagguugacaggacauuggcuaaagaaggaaucaagcgcggcgagacggaucaucacgccgugucccgggggucugccaagcugagaugguucgucgaacguaauauggugacccccgagggaaaagucguggaccucggcugcgguagagggggauggucauacuauuguggcggucugaagaacguucgggaagugaaaggcuuaacuaaagggggaccaggccaugaggagccuauucccaugagcacauacggguggaaucuuguacgccugcaauccggaguggaugucuuuuucaccccuccagaaaaaugcgacacucuccuaugugauaucggcgagaguucucccaacccuacaauagaagcgggucgaacccugagaguuuugaaucugguggagaacuggcucaauaacaauacgcaguucugcauuaagguccuuaacccauauaugcccagcgugaucgaaaagauggaggcucugcagaggaaauacgggggagcauugguacggaauccgcugucacgcaacuccacccacgagauguacugggugaguaaugccacaggcaacaucguuagcucugugaauaugauuuccagaaugcucauaaacagguuuacuaugaagcacaaaaaggcuaccuaugaaccugacgucgauuuaggcucagggacacgaaacaucggaauugagagcgaaaucccaaaucuggacauuaucgguaaacggauagagaagaucaagcaggaacaugagacuucguggcacuacgaccaagaucaucccuauaaaaccugggccuaccacggcucuuaugagacaaagcagaccgggagugcauccagcauggugaacggagucgugcgucuucugacuaaaccuugggacguuguaccaauggugacgcagauggccaugacagauaccacucccuucggccagcaaagagucuuuaaggaaaaaguggacacccgcacacaggagccgaaggaagguacgaagaaacuaaugaagauuaccgcugaguggcucuggaaagagcuggggaagaaaaagacuccuaggauguguacacgggaagaguucaccagaaaaguucgcucaaaugcggccuugggagcaaucuuuacugaugaaaacaaguggaaguccgcuagggaggccguggaagacggccgauucugggagcuggucgaucgggagagaaaucuccaccuugaaggcaaaugcgagacauguguguacaacaugauggggaagagggagaagaagcugggagaguuugguaaagcaaagggcucucgcgccauuugguauaugugguuaggggcucguuuccuggaauuugaggccuugggauuccucaaugaggaccauugguuuagccggggcaacagucuguccgguguagaaggggagggacuacacagacuuggcuacauccugagggaugugggcaagaaagaagggggagcgauguacgcagacgauaccgccgguugggacacacgcauuacucucgaggaccugaagaaugaagagaugguuaccaaccauaugaaaggcgagcacaagaaauuggcugaagccauauucaagcugacguaucagaauaaggucgugcgagugcagcggcccaccccaagagggacagucauggauaucauuagcaggcgcgaccaaagaggaucuggccagguugguacuuacgggcucaacaccuuuacaaauauggaggcacagcuuauccggcaaauggaaggagagggcaucuucaaaucaauucagcaucugacugcuaccgaggaaauagccgugcagaacugguuagcuaggguaggccgugagcgacugagucgcauggccaucuccggggaugacugcguggucaagccuauugaugacagauucgcaagcgcguugacggcccucaaugauaugggaaaagugcggaaggacauccagcaaugggaacccucuagggguuggaacgauuggacacagguuccauuuugcucgcaccacuuccaugagcuggugaugaaagacggccgcguccuagugguacccuguagaaaccaggaugaacuuauugggcgggcuaggaucucacagggagccggcuggagccugaaggagaccgcaugccucgguaaguccuaugcucaaauguggacucugauguacuuucaccgacgugacuugagauuagccgcaaaugccauauguagugcgguuccuucucauugggugccaacaagccgcaccacuugguccauccacgcuaaacacgaguggaugaccacagaagauaugcuggccgucuggaaccggguguggauucaggagaauccguggauggaagacaagacgcccguggagucaugggaagaggucccuuaucucgggaaaagggaggaccaguggugcggaaguaugaucggccuuaccucuagagcaacuugggccaagaacauucagacagcuaucaaucaaguucgcagccugauaggcaacgaagaguacauugauuauaugccauccaugaaacgguucaggcgagaagaggaagaggccggggugcuaugguga

SEQ ID NO: 14570 - RNA, 9876 nt, Artificial Sequence
  derived and/or modified CDS sequence (opt3) from DENV-2__EU482696__SS-prME
acagccggcgugaucgucaugcugauuccaacagcuauggcauuccaccucacuacgagaaacggggagccucauaugauaguuggaaggcaggaaaaggguaaaagccuucuguuuaagaccgaggacggcgugaauaugugcacauugauggccaucgauuuaggggaacugugugaggacacuauuaccuacaaaugcccacuacuccggcaaaacgaaccggaggauaucgacuguuggugcaauuccacaucuaccuggguuacuuauggaacauguaccacgacuggcgagcaccgccgagaaaagcguucaguggcgcuggucccacauguggguauggggcuugagaccagaacagaaacuuggaugaguagcgagggagcuuggaaacacguucagaggauugagaccuggauccugcggcauccuggcuucacaauuauggccgcaaucuuggccuacaccauuggcacgacucacuuucagcgcgcucucaucuucauucugcugacagcaguggccccauccaugaccaugagaugcaucgggauaucuaacagggauuuugucgaaggagugucggguggcucauggguagacauuguucucgagcacgggagcugugugacuacaauggcuaagaauaagcccaccuuagauuucgaacugaucaaaacggaggccaagcagccugcgacccuucggaaauauugcauugaagcaaaguugacaaacacuaccacagagagucgcuguccaacucaaggagagcccucccugaaugaagaacaggacaaacgauuuaucugcaagcauucuauggucgauagaggcugggguaacggguguggacuauucggcaagggcgggaucgugaccugcgccauguuuacaugcaaaaagaauauggaaggaaaagugguccagccugagaaccucgaauacaccauuguuauaacuccacacagcggugaggagcaugcugugggcaaugacacggggaagcacggaaaagaaaucaagauuacaccgcaguccucaaucaccgaggccgaacugacuggcuaugguaccguaacaauggaguguagucccaggaccgggcuugauuucaacgaaauggugcuguugcaaauggaggacaaagcauggcucguccaccggcagugguuucuggauuuaccucugccauggcuccccggcgcugacacucagggaagcaauuggauacagaaggagacacuugugacguucaagaacccucaugccaaaaagcaagacguugugguccugggcucucaggaaggggcgaugcacaccgccuugacuggagcaacagagauucagauguccucagguaaucuacuguuuaccggccaucucaaaugccgucugcgcauggauaaacuucaacugaaagggaugagcuacaguauguguacaggaaaguucaagaucgugaaagaaaucgcugagacucagcacggcaccauuguaaucagaguucaguaugagggugacgggucuccaugcaagauucccuucgaaauaacggauuuggagaaaaggcaugugcucggccggcugaucaccgucaacccgauugugacagaaaaggacuccccugucaacaucgaggccgaacccccauuuggagauagcuacaucauuauaggcguggagccugggcaguuaaaacugaauugguucaagaagggaucgucuaucggucaaauguuugagacuaccaugcgaggcgcuaaacgcauggccauucuaggggacacagcaugggauuucggaucccucggcgguguuuuuacuucaaucgggaaggcccugcaccagguguucggcgcuauuuacggagcggcauuuaguggcguaagcuggaccaugaaaauccuuauaggggucaucauuacguggaucggaaugaacuccagaucuaccagcuugucagugagucugguucucgugggcgucgugacccuguaucuuggugccaugguacaggcugacuccggguguguggccagcuggaagaauaaagaacugaagugcggaucuggcauuuucaucacugauaacguucacacauggaccgagcaguacaaguuucaacccgaaucaccaaguaaauuggcaagcgccauacagaaggcucaugaggaagguauuuguggcaucagguccgucacucggcucgagaaucugauguggaaacagauuacccccgaguuaaaccacauccugucugaaaaugaggugaagcuaacaauaaugacgggggacaucaaaggaauuaugcaggccggcaagcgcucgcucagaccucaaccaaccgaacugaaauauagcuggaagacuugggggaaggcaaaaaugcuuuccacagagucacauaaccagaccuucuugaucgauggaccggaaacagcggagugccccaauacuaacagggcuuggaauagucuggagguggaagacuacggcuuuggugucuucaccacgaacauuuggcucaagcugcgugagaaacaggacguauuuugugauucuaaguuaaugagcgccgcaaucaaagacaaucgggccgugcacgcugauaugggguauuggauagaauccgcccugaacgacacauggaagauggagaaggcaucauucauugaggugaaaagcugccacuggccuaagucucauacccuuugguccaauggaguauuggaaagugagaugaucauccccaagaauuucgcuggccccgucagccagcacaacuaccgaccugguuaucauacucaaaccgccggcccauggcaccucgggaagcuggaaauggauuuugaccuaugugagggaacaacugugguugugaccgaagauugcggcaauagagggcccucucugaggacaacgaccgcguccggaaaacucauuacugaguggugcugucgcucaugcacacugccgccucuucgguacagaggcgaggacgguuguugguacgggauggaaaucaggccauugaaggagaaggaagagaaccuggucaauaguuuagugaccgccggacauggccagauugauaacuucagccucgguguucugggcauggcucuuuuucuggaagagauguugcgcacucgaauagggacaaaacacgcaacccuccugguggccguaucguucgucacgcuaaucacuggaaauauguccuuucgggaccugggccgugugauggugauggucggggcuaccaugacagaugacauuggaaugggcguuaccuaucucgcccugcuugcagcguucaaggugagacccacuuuugccgcugguuugcuguuaaggaaacucacaucuaaggagcugaugauggccaccaucgggauugcacuucugagccagucaacaaucccugaaacuauacuagagcucaccgaugcucuggccuugggaaugaugguacugaaaaucgugcgcaacauggaaaaguaccaauuagcagucacgauuauggccaucaguugcgugcccaaugcuguuauucuccagaacgcguggaagguguccuguacaauccuggccgcagucucugugagcccacuucuguugaccuccucacagcagaaagcugacuggauaccucucgcccugacuauuaagggccuaaaucccaccgccaucuuccugacaacucuuagccggaccaguaaaaagagaucuuggccacucaacgaggcuaucauggcaguuggcaugguguccauucuggccagcucguugcugaaaaaugacauaccgaugacggggccuuuagucgcgggaggucuccugacaguaugcuaugugcuuaccggcaggucagcugaucuggaauuggagcgagccgcagacguuaagugggaggaucaagccgaaaucucugggaguucccccauucucagcaucacuauuucugaggacggaagcauguccaucaaaaacgaagaggaggaacagacacugaccauacuaauccgcacuggccugcuugugauuucaggugucuuuccagugaguauccccauuacagcugcagccugguaccucugggagguaaagaagcagcgggcgggggugcugugggaugucccuagcccacccccuguugaaaaagcugaguuggaagacggagccuauagaaucaagcagaggggcauauuaggcuacucucaaauuggggcaggaguguauaaagaggguaccuuccacacgauguggcaugugacucguggcgccguccugaugcaccgcgggaagcggaucgagccguccugggcugaugugaaaaaggaccucaucucauacggaggcgguuggaagcuggaaggggaguggaaagaaggagaggaaguucagguacuugcccuggagccaggcaagaaucccagagcagugcagaccaaaccuggcacauuuaagaccaacacagggacuauuggagcugucaguuuggauuucagcccagguaccuccggcucucccaucguggacaggaaagggaagguugugggacuauacggcaauggugucgugacgcgaucgggggccuauguaagcgcgauagcccagacagagaagucaauugaagauaacccugagaucgaagacgauauuuuucggaaaaagcgccugacuaucauggaccuccauccgggagcaggcaaaaccaagagauaccugcccgcuauagucagggaggccauuaaacggggccuucgaacauuaauccuggcuccaaccagagugguugcagccgaaauggaggaggcccuccgcggguugccuaucagguaucaaacucccgcuauuaagaccgaacacacaggacgugagaucguggaccugaugugucaugcgacguucacuaugcggcuccuguccccagucagagugccuaacuacaaucuuauuauaauggaugaagcacacuucaccgaccccgccaguaucgcugccagggguuauauuucuacacgcguugagaugggcgaggcagccgggaucuuuaugaccgcuacuccaccgggaagccgagauccuuucccccaguccaacgcgccaaucauggacgaagagagagaaauucccgagcggucauggaacucuggccacgaaugggugacagauuuuaaggguaaaaccgucugguucgugccuagcauaaaggccgggaacgacaucgcagcuugccugaggaaaaauggaaagaaaguaauucaguugagucgcaagacguuugauuccgaguacgugaagacucgugccaacgacugggauuucguugucacaaccgacaucagcgagaugggcgcaaauuuuaaagccgaaagagugauugauccacggagguguaugaagcccgugauccuaaccgacggcgaggaacgcgucauacuggcugggccuaugccgguaacucauucuucagccgcgcaacgaagaggacggaucgguaggaaccccaaaaaugagaacgaccaguauauuuacaugggcgaaccccucgagaaugaugaggacugcgcacacuggaaggaagccaaaauguuacuggauaacaucaauacaccugaggggauuauccccuccauguucgaaccagagcgcgaaaagguggacgcuauagauggagaguacagacuuaggggcgaggcccggaaaaccuuuguugaccugaugcgucgcggugaucucccugugugguuggcuuauaaggucgcagccgaagggauuaacuacgcugaccgaaagugguguuucgauggcaucaaaaauaaccagauucuggaggaaaacauggagguggagaucuggacaaaggaaggagagaggaaaaagcucaaacccagauggcuggacgcccggauauauagugauccacuugcacuaaaggaauuuaaggaguucgcggccggccgcaaaagccugacuuugaauuuaaucacggaaauggggagacugccuaccuucaugacacagaaggcuaggaacgcccucgacaaucuggcaguucuucauacugcugaggccggaggucgggcauacaaccacgcccugucggagcucccggaaaccuuggagacacugcuacugcucacccuucuggcuacugugacgggcgggauauuuuuauucuugaugucuggaaaaggcaucgguaagaugacccuggggaugugcugcauuaucacagcguccauacuccugugguaugcccaaauucagccccacuggaucgcagcuagcaucauucuugaauuuuuccugaucguccucuugauaccagagccugaaaaacagcgaacuccccaggauaaucaacugaccuacgugguaauugccaucuuaacagugguugccgcaaccauggcuaacgagaugggcuuucuagagaagacuaagaaagaccugggacucggcucaauuacaacgcaggaaagugagucuaauauccuugacauagaucugagaccagccuccgcguggaccuuguaugcugucgccacuacauucgugaccccuaugcugcgccauagcaucgaaaacucaagugugaaugucagccucaccgcaauugccaaccaggcuacaguucugauggggcuuggaaaggguuggccccucuccaaaauggacaucggcgugccgcuguuggcaauuggguguuacucucagguaaauccaaucacucugacggccgcguuacuacugcucguggcucacuacgccauuaucggaccuggccuucaagcaaaggccaccagggaggcucagaaacgggccgcagcugguauaaugaagaaccccacagucgaugggauuacugugaucgaccuggaaccaauccccuaugauccuaaguuugagaaacaguugggccagguuaugcugcucauucugugcgugacccaaguccuuaugaugcguacaaccugggccuuaugugaggcgcugacucucgccacgggaccgauaagcacauugugggaaggcaaucccgggagauucuggaacaccacuaucgcaguauccauggcuaauauuuuuaggggaucauaccuggccggcgcaggucuacuguucucuaucaugaagaacaccacaaguacucgccgggggaccggaaauauuggcgagacacucggugaaaaauggaagucgcgacuuaacgcucugggcaaaagcgaguuucagaucuauaagaaauccgggauacaggagguggacagaacguuggccaaggaaggaaucaagaggggcgagaccgaucaucacgccguuucucgcgggucagcgaaacugcggugguucguggaaagaaacauggucacuccagagggaaagguggucgaccucggcugcggucgugggggauggagcuacuauuguggcggucugaaaaaugugagggaaguuaagggcuuaacaaaagggggaccuggccaugaggagcccauuccuauguccaccuacggguggaaccuugugcggcugcaaaguggaguagauguguuuuucacuccacccgaaaagugcgacacacuccuaugugauaucggcgagucuagcccuaauccaaccauugaagcuggucgcacgcugcgagucuugaaccugguugagaauuggcucaacaauaacacccaguucugcaucaaggugcuuaaucccuauaugccgucagucauagagaaaauggaggcacugcagagaaaguacgggggagccuuggugaggaacccucugucccggaauaguacacacgagauguacuggguaagcaacgcuacuggcaauauugugucuuccguuaacaugaucucacgcaugcucaucaauagauuuaccaugaaacacaagaaagccacauaugaaccagacguggauuuaggcagcgggacuaggaacauuggaauagagucggaaauccccaaccuggacauuaucgguaagcgaauugagaagaucaaacaggaacaugagaccucuuggcacuacgaccaagaucauccuuauaagacaugggcauaccacggcaguuaugagaccaaacagacuggguccgccagcucaauggucaauggagugguccggcuucugacgaagccaugggacgugguucccaugguaacacagauggcuaugaccgauacuaccccguucggccagcaacguguguuuaaagaaaaggucgacacaagaacgcaggagccuaaggaagguaccaaaaagcuaaugaaaauaacugcggaguggcucuggaaggagcuggggaaaaagaaaacaccccgcauguguaccagggaagaguucacucggaaggugagauccaacgccgcauugggagcuaucuuuacagaugaaaauaaguggaaaucugcccgcgaggcaguugaagacggcagguucugggagcugguggaucgagagcggaaccuccaccuugaaggcaagugcgagaccugugucuacaauaugauggggaaaagagaaaagaaacugggagaguuugguaaggccaagggcagcagggcuauuugguauaugugguuaggggcccgcuuccuggaauuugaggcguugggauuccucaacgaggaccauugguuuagucguggcaauucccugagcgguguggaaggggagggacuacaccggcuuggcuacauccugagagauguaucuaaaaaggaaggcggggcaauguacgccgacgauacagcuggaugggacacuaggauuacccucgaggaccugaaaaacgaagagauggugacgaaucauaugaagggugagcacaaaaaguuggccgaagcaaucuucaagcugaccuaucagaacaaaguuguccgcgugcagcgaccaacaccucggggcauugugauggauauaaucucaagaagggaccaacgcgggaguggacaggucggcacuuacggucucaauaccuuuacaaacauggaggcucagcuuauuagacaaauggaaggggagggaaucuucaaguccauccagcaucugacugccgcugaggaaauuguugugcagaauugguuagcccggguaggcagggagcgucugagccgaauggcaauaucuggcgaugacugcguggucaaacccaucgaugaccgcuucgcgucggccuugaccgcucucaacgauauggggaaggugagaaaagacauucagcaaugggaaccaucacggggauggaaugauuggacgcagguucccuuuugcagccaccacuuccaugagcuggugaugaaggacgguaggguccuagugguaccuugucgcaaccaggaugaacuuaucggcagagcccggauuucccagggggcaggauggagucugaaggagacagcuugccucggcaaaucuuaugcccaaauguggacccugauguacuuucacaggcgagacuugcguuuagcagccaacgcgaucuguagcgcuguuccaucccauugggugccgacuucaagaacaaccuggaguauacacgccaagcacgaguggaugacuaccgaagauaugcuggcagucuggaaucgcguguggauccaggagaaccccuggauggaagacaaaacaccuguggagucuugggaagaggucccauaucucgguaagcgggaggaccaguggugcgggagccuuauuggacugacguccagggccaccugggcuaaaaauauccagacugccauuaaccaaguuagaucacuaaucggcaaugaagaguacacagauuauaugcccagcaugaagcgcuuccggagggaagaggaagaggcaggcgugcugugguga

SEQ ID NO: 14571 - RNA, 9876 nt, Artificial Sequence
  derived and/or modified CDS sequence (opt3) from DENV-2__KC294207__SS-prME
accgccggcgugaucgucaugcugauucccacagcuauggcauuccaccucacuacgcggaauggggagccucauaugauaguuggaaggcaggaaaaggguaaaagccuucuguuuaagaccgaggacggcgugaauaugugcacauugauggccaucgauuuaggggaacugugugaggacacuauuaccuacaaaugcccacuacuccggcaaaacgaaccggaggauaucgacuguuggugcaauuccacaucuaccuggguuacuuauggaacauguaccacgacuggcgagcaccgccgagaaaagcguucaguggcgcuggucccccauguggguauggggcuugagacccggacagaaacuuggaugaguagcgagggagcuuggaaacacguucagaggauugagaccuggauccugcggcauccuggcuucacaauaauggccgcaaucuuggccuacaccauuggcacgacucacuuucagcgcgcucucaucuucauucugcugacagcaguggccccauccaugaccaugagaugcaucgggauaucuaacagggauuuugucgaaggagugucggguggcucauggguagacauuguucucgagcacgggagcugugugacuacaauggcuaagaauaagcccaccuuagauuucgaacugaucaaaacggaggccaagcagccugcgacccuucggaaauauugcauugaagcaaaguugacaaacacuaccacagagagucgcuguccaacucaaggagagcccucccugaaugaagaacaggacaaacgauuuaucugcaagcauucuauggucgauagaggcugggguaacggguguggacuauucggcaagggcgggaucgugaccugcgccauguuuacaugcaaaaagaauauggaaggaaaaauugugcagccugagaaccucgaauacaccauagucaucacuccacacagcggugaggagcaugcuguuggcaaugacacggggaagcacggaaaagaaauuaagaucacaccgcaguccucaaccacugaggccgaacugaccggcuaugguacagugaccauggaguguagucccaggacugggcuugauuucaacgaaaugguacuguugcaaauggaggacaaagcauggcucgugcaccggcagugguuucuggauuuaccucugccauggcuccccggcgcugacacacagggaagcaauuggauacagaaggagacgcuugucaccuucaagaacccucaugccaaaaagcaagacgugguugugcugggcucucaggaaggggcgaugcacacugccuugacaggagcaaccgagauucagauguccucagguaaucuacuguuuacaggccaucucaaaugccgucugcgcauggauaaacuucaacugaaagggaugagcuacuguaugugcacuggaaaguucaagaucgucaaagaaaucgcugagacccagcacggcacgauugugaucagaguacaguaugagggugacgggaguccauguaagauucccuucgaaauaaccgauuuggagaaaaggcauguucucggccggcugaucacagugaacccgauugucacugaaaaggacucuccugugaacaucgaggccgaacccccauuuggagauuccuacaucauugucggcguggagccugggcaguuaaaacugaauugguucaagaagggaagcucgauaggucaaauguuugagaccacaaugcgaggcgcuaaacgcauggccauccuaggggacacugcaugggauuucggaucucucggcgguguuuuuaccuccauugggaaggcccugcaccagguguucggcgcuaucuacggagcggcauuuucaggcguaaguuggacgaugaaaauucuuaucggggucauaaucacauggauuggaaugaacagcagauccaccucuuugagcgugucacugguucucgugggcgucgugacucuguaucuuggugccaugguacaggcugacagugggugcaucguguccuggaagaauaaagaacugaaguguggaagcggcauuuucaucacagauaacguucacaccuggacugagcaguacaaguuucaacccgaaucuccaucaaaauuggccagugcaauacagaaggcccaugaggaagguauuugcggcaucaggagcgucacccggcucgagaaucugauguggaaacagauuacacccgaguuaaaccacauccuguccgaaaaugaggugaagcuaacgauaaugaccggggacaucaaaggaauuaugcaggcuggcaagcgcucucucagaccucaaccaacugaacugaaauauucguggaagacaugggggaaggccaaaaugcuuagcaccgagucccauaaccagacauucuugaucgauggaccggaaacugcagagugucccaauaccaacagggcguggaacucacuggagguggaagacuacggcuuuggugucuucacgacaaacauuuggcucaagcugcgugagaaacaggacguauuuugcgauaguaaguuaaugucugcugccaucaaagacaaucgggcagugcacgccgauaugggguauuggauagaaagcgcucugaacgacaccuggaagauggagaaggccuccuucauugaggugaaaucaugucacuggccuaagagccauacucuuuggucuaauggaguauuggaauccgagaugaucauccccaagaauuucgcaggccccgucagucagcacaacuaccgaccugguuaucauacccaaacagcuggcccagggcaccucggaaagcuggaaauggauuuugaccuaugcgagggcacuaccgugguugugacagaagauugcgggaauagaggacccagccugaggacgaccacugccucuggcaaacucauuacagagugguguugccgcuccuguacccugccgccucuucgguacagaggugaggacgggugcugguacggaauggaaaucaggccauugaaggagaaggaagagaaccuggucaauucauuagugacugcgggccauggucagauugauaacuucagucucggcguucuggggauggcccuuuuucuggaagagauguugcgcacacgagugggaaccaaacacgcuauacuccugguagcacugagcuucgucacguuaaucacuggcaauaugucguuucgggaccucgggcgugugauggugauggucggagccaccaugacagaugacauuggcauggguguuaccuaucuggcucuuuuggccgcauucaaggugagacccacuuuugcggccgggcuguuacucaggaaacugacauccaaggagcuuaugauggcuaccaucggaauugcccugcuaucucagagcacacucccugaaacuauccuggaguugaccgaugcacuggcuuuaggcaugauggcccucaaaauaguacgcaacauggaaaaguaccaacuggcagugacgaucauggccauuucauguguccccaaugcugugauccuucagaacgcguggaagguuaguugcacaauucuggccgcaguguccgucucuccauugcuccugaccagcucccagcagaaagcugacuggaucccucuagcccugacuauaaagggccuuaaucccaccgccauuuuccucacaacucugucacggaccagcaaaaagagaaguuggccauugaacgaggcuaucauggcaguggggaugguuucuauccuggccuccagcuuacucaaaaaugacauuccgaugacgggaccucugguggcggguggccuucugacagucuguuauguauugaccgggaggucggcugaucucgaacuggagcgagccgcagacgugaagugggaggaucaagccgaaauaucaggaucuagucccauccuauccauuacuaucagcgaggacggcucuaugagcauuaaaaacgaagaggaggaacagacacugaccauccuuauacgcacuggucuccugguuaucuccgggguguuuccagucucaauucccaucacagcugcagccugguacuugugggaggugaagaagcagcgggcgggaguauuaugggaugugccuaguccacccccugucggcaaagcugaacuggaggacggcgccuauagaauuaagcagagggggauccucggauacagccaaauaggugcaggcguuuauaaagaagggaccuuccacacgauguggcaugugacucguggagccgugcugaugcaccgcggcaagcggauugagccgucuugggcugaugucaaaaaggaccuuaucuccuacggugggggauggaagcuggagggcgaauggaaagagggcgaagaggugcagguuuuggcccuagaaccagggaagaaucccagagcaguacagaccaaaccuggaaucuuuaagacaaacaccgguacaauuggcgcugugucacuggauuucaguccagggacuagcggaucccccaucgucgacaggaaaggcaaggugguuggucucuacgggaauggaguggucacccgaucuggcgccuaugugucggcgauagcccagacggaaaagagcauugaggauaacccugaaaucgaggacgauauuuuucggaaaaagcgccugacaaucauggaccuucauccgggcgcagggaaaacuaagagauacuuacccgcuauaguaagggaagccauuaaacggggacugcgaacccucaucuuggcuccaacaagagucguggcagccgagauggaagaggcccugcgcggucucccuaucagguaucaaacccccgcuauucgugcggagcacacuggccgggaaaucguugaccugaugugccaugcaaccuucacaaugagacuucugucaccagugagggucccuaacuacaauuugauuauaauggaugaggcccacuucacggaccccgcuuccaucgccgcacgcggguauauuaguacucgaguggaaaugggagaggccgcuggcaucuuuaugaccgcgacaccaccggguucuagagauccuuucccccagagcaacgccccaaucauggacgaggaacgggagauucccgaaagguccuggaacucagggcacgaguggguuaccgauuuuaagggaaagacugugugguucgucccuucuauaaaagcaggcaacgacaucgcugccugucuacgcaagaauggcaaaaaggugauucagcugagccguaaaacauuugauagugaauacguaaagaccagagcaaacgacugggauuucgugguuacgacugacaucuccgagaugggggccaauuuuaaggcugagcgggucauugauccaaggcgcugcaugaaacccgugauccucacagacggagaagaacgagugauauuagccgguccuaugccggucacccauagcucugcggcacaaagacggggcaggaucgggcgcaacccaaagaaugaaaacgaccaguauauuuacaugggagagccccuggaaaaugaugaggacugugcccacuggaaagaggcuaagaugcuucuggauaacaucaauaccccugaaggcauuauccccucaauguucgagccagaaagagagaaaguagacgccauagauggugaauacaggcucagaggggaagcucguaagacuuuuguggacuugaugcgccgaggcgaucugccuguuuggcucgcauauaaaguggccgcugagggaauuaacuacgccgacagaaaguggugcuucgauggcaucaagaauaaccagauucuggaagagaacgucgaaguggagaucuggacaaaagagggggaaaggaagaaacuuaagccccgguggcuagacgcacgcauauauuccgauccacuggcguugaaagaguuuaaggaguucgccgcuggaagaaagaguuuaacccugaaucucaucacagagauggguaggcugccuacuuucaugacgcagaaagcccggaacgcacuugacaaucuggcuguucuccauaccgccgaagugggcgggaaggcauacacacacgccuugagcgagcugccggagacucuagaaacccugcuccuucugacauuauuggcugcggucaccggaggcauuuuucuguuccucaugucggguaaaggggugggcaagaugacucugggaaugugcuguaucauuacggccucuauccuucugugguaugcacaaauacagccccacuggauugcugccuccaucauccucgaguuuuucuugauuguacuguuaaucccagaaccugagaaacagcgaaccccacaggauaaccaacuaacauacgugguuauagccauucugacugucguggcagcuaccauggccaaugaaaugggcuuucucgagaagacaaagaaagaccuuggguucggaagcaucaccacucaggagucagaaaguaacauucuggacaucgauuugagaccagcgucugcuuggacacuguaugccguggcaacgaccuuugucacuccuaugcuccgccauuccauagagaauagcucaguuaacgugagucugacagccaucgcuaaucaggcaaccguacuuaugggucucggcaagggguggccccugagcaaaauggacauuggagugccguugcuggccaucggcugcuacucccaggucaacccaauuaccuuaacagcggcucuacugcuccuuguggcccacuacgcaaucauugguccugggcugcaagccaaggcuacuagggaagcccagaaacgggcagcugccggcaucaugaagaaucccacgguugauggaauaaccgugauugacuuggagccaauccccuaugauccuaaguucgaaaaacagcugggccaggucaugcuccugauccuuuguguaacacaaguguuaaugaugcguacuaccugggcgcugugcgaggcccucacauuggcaaccgggccgauuucuacucugugggagggaaaccccggcagauuuuggaauacgacaauagcuguuagcauggccaacaucuucagggguuccuaccuagcaggggcuggacugcucuuuucaauuaugaagaauaccacuaacacccgccggggcacagguaaugugggcgaaacucuuggggagaaauggaagucucgacugaacgccuugggaaaaagugaguuccagaucuauaagaaaucgggcauucaggaggucgacagaacccuggccaaggaggggaucaagaggggagaaacagaucaucacgcggugagccgcggcuccgcuaaacuccggugguuugucgagagaaacauggugacgccagaagguaagguuguggaccugggguguggacguggcgguuggucuuacuauugcggcgggcuaaagaauguaagggaggugaaaggacuuaccaaaggcgggccuggacaugaagaacccauaccuaugucaacuuacggcuggaaccugguccggcuccaaagcgguguugauguguucuucacaccacccgagaagugugacacccuacugugcgauaucggggaauccaguccuaauccaacuauugaggcaggacgcacauugcgaguccugaaccucguggaaaauuggcuuaacaauaacacccaguuuuguaucaagguacugaaucccuauaugccgucugugauugagaaaauggaaacguugcagagaaaguacggcggcgcccugguuaggaacccucucagcagaaauucaacccacgagauguacuggguguccaacgcuacagggaauaucgucaguagcgugaacaugauaucucgcauguuaauuaauagauucacuaugaaacacaagaaagccaccuaugagccagacgucgaucugggauccgguacaaggaacaucggcaucgaaucagagauucccaaccuugacauaguggggaagcgaaucgaaaagauuaaacaggagcaugaaacuagcuggcacuacgaccaagaucauccuuauaagaccugggcauaccacggaucguaugagacaaaacagaccggcucugccaguuccaugguuaaugguguagugcggcugcuaacuaagccaugggacgucgugcccaugguuacgcagauggcuaugacagauaccacuccguuugggcagcaacguguguucaaagagaaggucgacaccagaacacaggaaccuaaggagggaacgaaaaagcucaugaaaaucaccgcggaauggcuguggaaggaguugggcaaagagaagacuccccgcaugugcacaagggaagaguuuacccggaaagugagaagcaacgccgcacugggcgcuguauucacugaugaaaauaaguggaagucagcccgcgaggcaguggaagacgggagguuuugggagcucguugaucgagagcggaaccuucaccuggaaggaaaaugugagacaugcgucuacaauaugauggguaagagagagaaaaaguuaggcgaguucgggaaagccaagggauccagggcuauuugguauauguggcugggcgcccgcuuuuuggaguucgaggcgcucgguuuucugaacgaggaccauugguucucucgugggaauagccuaaguggaguggaaggcgagggccuucaccggcugggguacauccucagagaagugggaaagaaagaggguggcgcaauguacgccgaugacaccgcugggugggauacaaggauaacucuggaagacuugaagaacgaggagauggucaccaaucauaugaaaggagaacacaagaaacuggccgaggcaaucuuuaagcucacguaucagaacaagguugugcgcguacagcgaccaaccccucggggcacagugauggacauuaucuccagaaaagaucaaagggguagcgggcaggucggaacuuacggccuuaauaccuucacaaacauggaagcucagcugauucgccaaauggagggcgaggggaucuucaagucuauucagcauuuaacugccaccgaagagauagcugugcagaauuggcuggccagaguuggacgggaaagguugucacguauggcaaucaguggugacgauugcguggucaaacccauugacgaucgauuugcguccgcccucacggcucugaacgacaugggcaaggugcgcaaagauauccagcaaugggagccaagcagaggguggaaugacuggacacagguacccuucuguucucaccacuuucaugagcuaguuaugaaggauggacgggugcuugucgugccuugcaggaaccaggacgagcugaucggccgcgccagaauuucgcagggugcaggguggucacucaaggagaccgcuugucugggaaaaagcuaugcccaaauguggacuuugauguacuuccaccggagggauuuacgacuggcagccaacgcgauaugcuccgcugugccaagucauugggucccgacaucucguaccacuuggagcauccacgccaagcacgaauggaugaccacagaggacaugcucguuguguggaauagaguauggauucaggaaaaccccuggauggaggauaaaacgccuguggaauccugggaggaggucccauaucuuggcaagcgcgaagaccagugguguggcucacugaucgggcuaaccagucgggcaacuugggccaaaaauauucagacagcuaucaaccaagugaggucucugauaggaaaugaggguuacaccgacuauaugcccagcaugaagagauuucgccgggaagaggaagaggccggcguucucugguga

SEQ ID NO: 14572 - RNA, 9876 nt, Artificial Sequence
  derived and/or modified CDS sequence (opt3) from DENV-2__KC294208__SS-prME
accgcaggcgugaucgucaugcugauucccacagcuauggcauuccaccucacuacgaggaacggggagccucauaugauaguuggaaggcaggaaaaggguaaaagccuucuguuuaagaccgaggacggcgugaauaugugcacauugauggccaucgauuuaggggaacugugugaggacacuauuaccuacaaaugcccauuacuccggcaaaacgaaccggaggauaucgacuguuggugcaauuccacaucuaccuggguuacuuauggaacauguaccacgacuggcgagcaccgccgagaaaagcguucaguggcgcuggucccccauguggguauggggcuugagaccagaacagaaacuuggaugaguagcgagggagcuuggaaacacguucagaggauugagaccuggauccugcggcauccuggcuucacaauaauggccgcaaucuuggccuacaccauuggcacgacucacuuucagcgcgcucucaucuucauucugcugacagcaguggccccauccaugaccaugagaugcaucgggauaucuaacagggauuuugucgaaggagugucggguggcucauggguagacauuguucucgagcacgggagcugugugacuacaauggcuaagaauaagcccaccuuagauuucgaacugaucaaaacggaggccaagcagccugcgacccuucggaaauauugcauugaagcaaaguugacaaacacuaccacagagagucgcuguccaacucaaggagagcccucccugaaugaggaacaggacaaacgauuuaucugcaagcauucuauggucgauagaggcugggguaacggguguggacuauucggcaagggcgggaucgugaccugcgccauguuuacaugcaaaaagaauauggaaggaaaaauugugcagccugagaaccucgaauacaccauagucaucacuccacacagcggugaggagcaugcuguuggcaaugacacggggaagcacggaaaagaaauuaagaucacaccgcaguccucaaccacugaggccgaacugaccggcuaugguacagugaccauggaguguagucccaggacugggcuugauuucaacgaaaugguacuguugcaaauggaggacaaagcauggcucgugcaccggcagugguuucuggauuuaccucugccauggcuccccggcgcugacacacagggaagcaauuggauacagaaggagacgcuugucaccuucaagaacccucaugccaaaaagcaagacgugguugugcugggcucucaggaaggggcgaugcacacugccuugacaggagcaaccgagauucagauguccucagguaaucuacuguuuacaggccaucucaaaugccgucugcgcauggauaaacuucaacugaaagggaugagcuacaguauguguacuggaaaguucaagaucgucaaagaaaucgcugagacccagcacggcacgauugugaucagaguacaguaugagggugacgggucuccaugcaagauucccuucgaaauaaccgauuuggagaaaaggcauguucucggccggcugaucacagugaacccgauugucacugaaaaggacuccccugugaacaucgaggccgaacccccauuuggagauagcuacaucauugucggcguggagccugggcaguuaaaacugaauugguucaagaagggaucgucuauaggucaaauguuugagaccacaaugcgaggcgcuaaacgcauggccauccuaggggacacugcaugggauuucggaucccucggcgguguuuuuaccucaauugggaaggcccugcaccagguguucggcgcuaucuacggagcggcauuuaguggcguaagcuggacgaugaaaauucuuaucggggucauaaucacauggauuggaaugaacuccagaucuaccagcuugucagugagucugguucucgugggcgucgugacucuguaucuuggugccaugguacaggcugacuccggguguaucgugagcuggaagaauaaagaacugaagugcggaucuggcauuuucaucacagauaacguucacaccuggacugagcaguacaaguuucaacccgaaucaccaaguaaauuggccagcgcaauacagaaggcccaugaggaagguauuuguggcaucagguccgucacccggcucgagaaucugauguggaaacagauuacacccgaguuaaaccacauccugucugaaaaugaggugaagcuaacgauaaugaccggggacaucaaaggaauuaugcaggcuggcaagcgcucgcucagaccucaaccaacugaacugaaauauagcuggaagacaugggggaaggccaaaaugcuuuccaccgagucacauaaccagacauucuugaucgauggaccggaaacugcagagugccccaauaccaacagggcguggaauagucuggagguggaagacuacggcuuuggugucuucacgacaaacauuuggcucaagcugcgugagaaacaggacguauuuugugauucuaaguuaaugagcgcugccaucaaagacaaucgggcagugcacgccgauaugggguauuggauagaauccgcucugaacgacaccuggaagauggagaaggccucauucauugaggugaaaagcugccacuggccuaagucucauacucuuugguccaauggaguauuggaaagugagaugaucauccccaagaauuucgcaggccccgucagccagcacaacuaccgaccugguuaucauacccaaacagcuggcccauggcaccucgggaagcuggaaauggauuuugacuucugugagggaacuaccgugguugugacagaagauugcggcaauagagggcccucucuaaggacgaccacugccuccggaaaacugauuacagaguggugcugucgcucaugcacccucccgccucugcgguacagaggcgaggacgguuguugguacgggauggaaaucaggccacuuaaggagaaggaagagaacuuggucaauagucuggugacugcgggacauggccagauugauaacuuuagcuuagguguucucggcauggcccuguuccuugaagagaugcugcgcacacgaguggggaccaaacacgcuauauugcucguagcacugucguuugucacgcuaaucacuggaaauauguccuuccgggaccugggccgugugauggugauggucggggccaccaugacagaugacauuggaaugggcguuaccuaucucgcucugcuugccgcauuuaaggugagacccacuuucgcggccgguuugcuguuaaggaaacucacaucuaaggagcugaugauggcuaccaucgggauugcccuucugagccagucaacacuaccugaaacuauccucgagcugaccgaugcauuggcucugggaaugauggccuuaaaaauaguacgcaacauggaaaaguaccaacucgcagugacgaucauggccauuaguugcguccccaaugcugugauccugcagaacgcguggaagguuuccuguacaauucuugccgcagugucugucagcccacuguugcucaccuccucacagcagaaagcugacuggaucccucuggcccuaacuauaaagggccugaaucccaccgccauuuuucuuacaacucucagccggaccaguaaaaagagaucuuggccacugaacgaggcuaucauggcagugggcaugguuuccaucuuggccagcucgcugcuaaagaaugacauuccgaugacggggccucucguggcgggaggucugcuuacagucugcuauguacugaccggcaggucagcugauuuggaacucgagcgagccgcagacgugaagugggaggaucaagccgaaauaucugggaguucccccauccugagcauuacuaucucugaggacggaagcauguccauuaaaaacgaagaggaggaacagacacuaaccauccugauacgcacuggccuucucguuaucucagguguguucccagucaguauucccaucacagcugcagccugguaccugugggaggugaagaagcagcgggcggggguauugugggaugugccuagcccacccccugucggaaaagcugaauuagaggacggcgccuauagaauuaagcagaggggcauccugggguacucucaaauaggagccgguguuuauaaagaaggcaccuuucacacgauguggcaugugacucguggggcagugcucaugcaccgcggaaagcggauugagccguccugggcugaugucaaaaaggaccugaucucauacggcgguggguggaaacuugagggagaauggaaagagggcgaagaggugcagguucuggccuuggaaccaggcaagaaucccagagcaguacagaccaaaccugggaucuucaagacaaacaccggaacaauuggugcugugagucuagauuuuagcccaggcacuuccgggucucccaucgucgacaggaaaggaaaggugguuggccuguacgguaaugggguggucacccgaucgggagccuaugugagcgcgauagcccagacggagaagucaauugaggauaacccugaaaucgaggacgauauuuuccggaaaaagcgccucacaaucauggaccugcauccgggcgcaggcaaaacuaagagauaccuucccgcuauaguaagggaagccauuaaacggggguuacgaacccugauccucgcuccaacaagagucguggcagccgagauggaagaggccuugcgcggacugccuaucagguaucaaacccccgcuauucgugcggagcacacuggucgggaaaucguugaccucaugugucaugcaaccuucacaaugagacugcuuuccccagugagggucccuaacuacaaucugauuauaauggaugaggcccacuuuacggaccccgcuaguaucgccgcacgcggcuauauuucuacucgaguggaaaugggggaggccgcuggaaucuucaugaccgcgacaccaccgggcagcagagauccuuuuccccaguccaacgccccaaucauggacgaggaacgggagauucccgaaaggucauggaacucuggucacgaguggguuaccgauuucaaggggaagacugugugguuugucccuagcauaaaagcaggaaacgacaucgcugccugcuugcgcaagaauggcaaaaaggugauucagcuaagucguaaaacauucgauuccgaauacguaaagaccagagcaaacgacugggauuuugugguuacgacugacaucagcgagaugggcgccaauuucaaggcugagcgggucauugauccaaggcgcuguaugaaacccgugauccugacagacggggaagaacgagugauacucgccggaccuaugccggucacccauucuucagcggcacaaagacgggguaggaucggccgcaacccaaagaaugaaaacgaccaguauauuuacaugggggagcccuuagaaaaugaugaggacugcgcccacuggaaagaggcuaagaugcugcuugauaacaucaauaccccugaaggaauuauccccuccauguuugagccagaaagagagaaaguagacgccauagauggcgaauacaggcugcggggugaggcucguaagacuuucguggaccucaugcgccgaggggauuugccuguuuggcuggcauauaaaguggccgcugagggcauuaacuacgccgacagaaagugguguuuugauggaaucaagaauaaccagauucucgaagagaacgucgaaguggagaucuggacaaaagagggcgaaaggaagaaacugaagccccgguggcuugacgcacgcauauauagugauccacuagcgcugaaagaguucaaggaguucgccgcugggagaaagagcuugaccuuaaaucugaucacagagaugggaaggcucccuacuuuuaugacgcagaaagcccggaacgcacuggacaaucuugcuguucugcauaccgccgaaguggguggcaaggcauacacacacgcccucucggaguugccggagacucuggaaacccuacugcuccuuacacuguuagcugcggucaccgggggaauuuucuuguuucugaugucuggcaaagguaucgggaagaugacucucggcaugugcugcauuaucacggccuccauacugcuuugguaugcacaaauucagccccacuggaucgcugccagcaucauucuggaguucuuucucaucguguugcugauaccagaaccugagaaacagcgaaccccacaggauaaccaauuaacauacguagugauugccauccuaacuguugucgcagcuaccauggccaaugaaaugggauuccuggagaagacaaagaaagaccucggcuuugggucaauuaccacucaggagagugaaucuaacauccuugacauagaucugagaccagcguccgcuuggacauuguaugccguggcaacgaccuucgugacuccuaugcugcgccauagcaucgaaaauucaagugucaacguuagccucacagccauugcuaaucaggcaaccgugcugaugggacuugguaagggcuggccccucuccaaaauggacaucgggguaccgcuguuggccauuggauguuacucucaggugaacccaaucacccugacagcggcuuuacuacugcucgucgcccacuacgcaauuaucggcccuggucuucaagccaaggcuacuagggaagcccagaaacgggcagcugccgggauaaugaagaaucccacgguggauggcauuaccguuaucgaccuggagccaauccccuaugauccuaaguuugaaaaacaguugggacaggugaugcugcucauucugugcgucacacaaguacuuaugaugcguacuaccugggcguuaugugaggcccugacacucgcaaccggcccgauaagcacuuugugggagggggaccccggaagauucuggaacacgacaaucgcuguguccauggccaauauuuuuaggggcucauaccuggccggugcugggcuacuguucucuaucaugaagaacaccacuaauacccgccggggaacaggcaacguuggugaaacucucggcgagaaauggaagagucgacuuaaugcccuggggaaaucggaauuucagauuuauaagaaaagcggaauccaggagguggauagaaccuuggccaaggagggcauaaagagaggggaaacagaccaucacgcggucucccgcggaucugcuaaacugcggugguucguggagagaaacauggucacgccagaaggcaaggugguugaucucgguugcgggcguggaggcuggucauacuauugugguggccugaaaaacgugagggagguaaagggguuaaccaaaggaggcccugggcaugaggaacccaucccuaugagcacuuacggauggaaucuugugcggcugcaauccggcgucgacguuuucuuuacaccacccgagaagugcgauacccuccuaugugacauuggugaaaguucuccuaacccaacuaucgaggcagggcgcacacugcgaguguugaaucuggucgaaaacuggcucaauaacaauacccaguucugcauuaaggugcuuaaccccuauaugccgagcguaaucgagaaaauggaaacgcugcagagaaaguacggaggcgccuuggugaggaauccucugucacggaacuccacccacgagauguacuggguuaguaaugcuacaggcaacauagugagcucugucaauaugauuucccgcaugcucaucaacagauuuacuaugaaacacaagaaagccaccuaugagccagauguggacuuagggucaggaacaaggaauaucgguauugaaagcgagauacccaaccuggacaucgucggcaagcgaauugaaaagaucaaacaggagcaugaaacuucguggcacuacgaucaagaccauccuuauaagaccugggcauaccacgggucuuaugagacaaaacagaccggaagugccuccagcauggugaacggcguuguacggcuucugacuaagccaugggaugugguccccauggugacgcagauggcuaugacagacaccacuccguucggucagcaacguguuuuuaaagagaagguggauaccagaacacaggaaccuaaggaggggacgaaaaagcuaaugaaaauuaccgcggaauggcucuggaaggagcugggaaaagagaagacuccccgcauguguacaagggaagaguucacccggaaagucagaucaaaugccgcauugggcgcuguguuuacugacgaaaacaaguggaaguccgcccgcgaggcaguagaagauggcagguucugggagcugguggaccgagagcggaaucuccaccuugaagggaaaugcgagacauguguuuacaacaugaugggaaagagagagaaaaagcugggugaguuuggcaaagccaaggggucuagggcuaucugguauaugugguuaggagcccgcuuccuggaauuugaggcguugggcuuccucaaugaggaucauugguuuagccgugguaacagucuguccggggucgaaggagagggccuacaccggcuuggcuacauacugagagaaguggggaagaaagagggaggugcaauguacgccgacgauaccgcuggcugggacacaaggaucacucucgaagaccugaagaaugaggagauggugaccaaccauaugaaaggggaacacaagaaauuggccgaggcaauuuucaagcugacguaucagaauaaggucguucgcgugcagcgaccaaccccucggggaacaguaauggauaucauuagcagaaaagaccaaaggggcucuggucagguggggacuuacggacucaacaccuucacaaauauggaagcucagcuuauccgccaaauggagggcgagggcauuuuuaagucaauacagcaucugacugccaccgaagagaucgcuguccagaacugguuagccagaguggggcgggaaaggcugagucguauggcaauuuccggagaugacugcguugugaaacccaucgaugaccgauucgcgagcgccuugacggcucucaaugauauggguaagguccgcaaagacauccagcaaugggagccaucuagaggcuggaacgauuggacacaggugcccuuuugcucgcaccacuuccaugaacugguaaugaaggacgggcggguucuaguggucccuuguaggaaucaggaugagcuuauuggacgcgccagaauaucacagggcgcagguuggagccugaaggagaccgcuugccucgggaaauccuaugcccaaauguggacucugauguacuuucaccggagggacuugcgauuagcagccaacgcgaucuguagugcugugccaucucauugggugccgacaagccguaccacuugguccauucacgccaagcacgaauggaugaccacagaggauaugcuggucguuuggaacagaguguggauccaggaaaaucccuggauggaggacaaaacgccuguagaaucaugggaggaggugccauaucucggaaagcgcgaagaccaguggugcggcagucuuauuggccugaccucucgggcaacuugggccaaaaacauccagacagcuauaaaucaagucaggagccuaaucgggaacgagggauacaccgauuauaugcccuccaugaagagauuccgccgggaagaggaagaggccggugugcugugguga

SEQ ID NO: 14573 - RNA, 9876 nt, Artificial Sequence
  derived and/or modified CDS sequence (opt3) from DENV-2__KC294209__SS-prME
accgcaggagugaucgucaugcugauucccacagcuauggcauuccaccucacuacgaggaacggggagccucauaugauaguuggaaggcaggaaaaggguaaaagccuucuguuuaagaccgaggacggcgugaauaugugcacauugauggccaucgauuuaggggaacugugugaggacacuauuaccuacaaaugcccauuacuccggcaaaacgaaccggaggauaucgacuguuggugcaauuccacaucuaccuggguuacuuauggaacauguaccacgacuggcgagcaccgccgagaaaagcguucaguggcgcuggucccccauguggguauggggcuugagacccggacagaaacuuggaugaguagcgagggagcuuggaaacacguucagaggauugagaccuggauccugcggcauccuggcuucacaauaauggccgcaaucuuggccuacaccauuggcacgacucacuuucagcgcgcucucaucuucauucugcugacagcaguggccccauccaugaccaugagaugcaucgggauaucuaacagggauuuugucgaaggagugucggguggcucauggguagacauuguucucgagcacgggagcugugugacuacaauggcuaagaauaagcccaccuuagauuucgaacugaucaaaacggaggccaagcagccugcgacccuucggaaauauugcauugaagcaaaguugacaaacacuaccacagagagucgcuguccaacucaaggagagcccucccugaaugaggaacaggacaaacgauuuaucugcaagcauucuauggucgauagaggcugggguaacggguguggacuauucggcaagggcgggaucgugaccugcgccauguuuacaugcaaaaagaauauggaaggaaaaauugugcagccugagaaccucgaauacaccauagucaucacuccacacagcggugaggagcaugcuguuggcaaugacacggggaagcacggaaaagaaauuaagaucacaccgcaguccucaaccacugaggccgaacugaccggcuaugguacagugaccauggaguguagucccaggacugggcuugauuucaacgaaaugguacuguugcaaauggaggacaaagcauggcucgugcaccggcagugguuucuggauuuaccucugccauggcuccccggcgcugacacacagggaagcaauuggauacagaaggagacgcuugucaccuucaagaacccucaugccaaaaagcaagacgugguugugcugggcucucaggaaggggcgaugcacacugccuugacaggagcaaccgagauucagauguccucagguaaucuacuguuuacaggccaucucaaaugccgucugcgcauggauaaacuucaacugaaagggaugagcuacaguauguguacuggaaaguucaagaucgucaaagaaaucgcugagacccagcacggcacgauugugaucagaguacaguaugagggugacgggucuccaugcaagauucccuucgaaauaaccgauuuggagaaaaggcauguucucggccggcugaucacagugaacccgauugucacugaaaaggacuccccugugaacaucgaggccgaacccccauuuggagauagcuacaucauugucggcguggagccugggcaguuaaaacugaauugguucaagaagggaucgucuauaggucaaauguuugagaccacaaugcgaggcgcuaaacgcauggccauccuaggggacacugcaugggauuucggaucccucggcgguguuuuuaccucaauugggaaggcccugcaccagguguucggcgcuaucuacggagcggcauuuaguggcguaagcuggacgaugaaaauucuuaucggggucauaaucacauggauuggaaugaacuccagaucuaccagcuugucagugagucugguucucgugggcgucgugacucuguaucuuggugccaugguacaggcugacuccggguguaucgugagcuggaagaauaaagaacugaagugcggaucuggcauuuucaucacagauaacguucacaccuggacugagcaguacaaguuucaacccgaaucaccaaguaaauuggccagcgcaauacagaaggcccaugaggaagguauuuguggcaucagguccgucacccggcucgagaaucugauguggaaacagauuacacccgaguuaaaccacauccugucugaaaaugaggugaagcuaacgauaaugaccggggacaucaaaggaauuaugcaggcuggcaagcgcucgcucagaccucaaccaacugaacugaaauauagcuggaagacaugggggaaggccaaaaugcuuuccaccgagucacauaaccagacauucuugaucgauggaccggaaacugcagagugccccaauaccaacagggcguggaauagucuggagguggaagacuacggcuuuggugucuucacgacaaacauuuggcucaagcugcgugagaaacaggacguauuuugugauucuaaguuaaugagcgcugccaucaaagacaaucgggcagugcacgccgauaugggguauuggauagaauccgcucugaacgacaccuggaagauggagaaggccucauucauugaggugaaaagcugccacuggccuaagucucauacucuuugguccaauggaguauuggaaagugagaugaucauccccaagaauuucgcaggccccgucagccagcacaacuaccgaccugguuaucauacccaaacagcuggcccauggcaccucgggaagcuggaaauggauuuugacuucugugagggaacuaccgugguugugacagaagauugcggcaauagagggcccucucuaaggacgaccacugccuccggaaaacugauuacagaguggugcugucgcucaugcacccucccgccucugcgguacagaggcgaggacgguuguugguacgggauggaaaucaggccacuuaaggagaaggaagagaacuuggucaauagucuggugacugcgggacauggccagauugauaacuuuagcuuagguguucucggcauggcccuguuccuugaagagaugcugcgcacacgaguggggaccaaacacgcuauauugcucguagcacugucguuugucacgcuaaucacuggaaauauguccuuccgggaccugggccgugugauggugauggucggggccaccaugacagaugacauuggaaugggcguuaccuaucucgcucugcuugccgcauuuaaggugagacccacuuucgcggccgguuugcuguuaaggaaacucacaucuaaggagcugaugauggcuaccaucgggauugcccuucugagccagucaacacuaccugaaacuauccucgagcugaccgaugcauuggcucugggaaugauggccuuaaaaauaguacgcaacauggaaaaguaccaacucgcagugacgaucauggccauuaguugcguccccaaugcugugauccugcagaacgcguggaagguuuccuguacaauucuugccgcagugucugucagcccacuguugcucaccuccucacagcagaaagcugacuggaucccucuggcccuaacuauaaagggccugaaucccaccgccauuuuucuuacaacucucagccggaccaguaaaaagagaucuuggccacugaacgaggcuaucauggcagugggcaugguuuccaucuuggccagcucgcugcuaaagaaugacauuccgaugacggggccucucguggcgggaggucugcuuacagucugcuauguacugaccggcaggucagcugauuuggaacucgagcgagccgcagacgugaagugggaggaucaagccgaaauaucugggaguucccccauccugagcauuacuaucucugaggacggaagcauguccauuaaaaacgaagaggaggaacagacacuaaccauccugauacgcacuggccuucucguuaucucagguguguucccagucaguauucccaucacagcugcagccugguaccugugggaggugaagaagcagcgggcggggguauugugggaugugccuagcccacccccugucggaaaagcugaauuagaggacggcgccuauagaauuaagcagaggggcauccugggguacucucaaauaggagccgguguuuauaaagaaggcaccuuucacacgauguggcaugugacucguggggcagugcucaugcaccgcggaaagcggauugagccguccugggcugaugucaaaaaggaccugaucucauacggcgguggguggaaacuugagggagaauggaaagagggcgaagaggugcagguucuggccuuggaaccaggcaagaaucccagagcaguacagaccaaaccugggaucuucaagacaaacaccggaacaauuggugcugugagucuagauuuuagcccaggcacuuccgggucucccaucgucgacaggaaaggaaaggugguuggccuguacgguaaugggguggucacccgaucgggagccuaugugagcgcgauagcccagacggagaagucaauugaggauaacccugaaaucgaggacgauauuuuccggaaaaagcgccucacaaucauggaccugcauccgggcgcaggcaaaacuaagagauaccuucccgcuauaguaagggaagccauuaaacggggguuacgaacccugauccucgcuccaacaagagucguggcagccgagauggaagaggccuugcgcggacugccuaucagguaucaaacccccgcuauucgugcggagcacacuggucgggaaaucguugaccucaugugucaugcaaccuucacaaugagacugcuuuccccagugagggucccuaacuacaaucugauuauaauggaugaggcccacuuuacggaccccgcuaguaucgccgcacgcggcuauauuucuacucgaguggaaaugggggaggccgcuggaaucuucaugaccgcgacaccaccgggcagcagagauccuuuuccccaguccaacgccccaaucauggacgaggaacgggagauucccgaaaggucauggaacucuggucacgaguggguuaccgauuucaaggggaagacugugugguuugucccuagcauaaaagcaggaaacgacaucgcugccugcuugcgcaagaauggcaaaaaggugauucagcuaagucguaaaacauucgauuccgaauacguaaagaccagagcaaacgacugggauuuugugguuacgacugacaucagcgagaugggcgccaauuucaaggcugagcgggucauugauccaaggcgcuguaugaaacccgugauccugacagacggggaagaacgagugauacucgccggaccuaugccggucacccauucuucagcggcacaaagacgggguaggaucggccgcaacccaaagaaugaaaacgaccaguauauuuacaugggggagcccuuagaaaaugaugaggacugcgcccacuggaaagaggcuaagaugcugcuugauaacaucaauaccccugaaggaauuauccccuccauguuugagccagaaagagagaaaguagacgccauagauggcgaauacaggcugcggggugaggcucguaagacuuucguggaccucaugcgccgaggggauuugccuguuuggcuggcauauaaaguggccgcugagggcauuaacuacgccgacagaaagugguguuuugauggaaucaagaauaaccagauucucgaagagaacgucgaaguggagaucuggacaaaagagggcgaaaggaagaaacugaagccccgguggcuugacgcacgcauauauagugauccacuagcgcugaaagaguucaaggaguucgccgcugggagaaagagcuugaccuuaaaucugaucacagagaugggaaggcucccuacuuuuaugacgcagaaagcccggaacgcacuggacaaucuugcuguucugcauaccgccgaaguggguggcaaggcauacacacacgcccucucggaguugccggagacucuggaaacccuacugcuccuuacacuguuagcugcggucaccgggggaauuuucuuguuucugaugucuggcaaagguguggggaagaugacucucggcaugugcugcaucauuacggccuccauccugcuuugguaugcacaaauacagccccacuggauugcugccagcaucauccuggaguucuuucucauuguauugcugaucccagaaccugagaaacagcgaaccccacaggauaaccaauuaacauacgugguuauagccauucuaacugucguggcagcuaccauggccaaugaaaugggauuccuggagaagacaaagaaagaccucggcuuugggucaaucaccacucaggagagugaaucuaacauucuugacaucgaucugagaccagcguccgcuuggacauuguaugccguggcaacgaccuucgucacuccuaugcugcgccauagcauagaaaauucaaguguuaacgugagccucacagccaucgcuaaucaggcaaccguacugaugggacuugguaagggcuggccccucuccaaaauggacauuggggugccgcuguuggccaucggauguuacucucaggucaacccaauuacccugacagcggcuuuacuacugcucguggcccacuacgcaaucauuggcccuggucuucaagccaaggcuacuagggaagcccagaaacgggcagcugccgggaucaugaagaaucccacgguugauggcauaaccgugauugaccuggagccaauccccuaugauccuaaguuugaaaaacaguugggacaggucaugcugcucauccugugcguaacacaagugcuuaugaugcguacuaccugggcguuaugugaggcccugacacucgcaaccggcccgauuagcacuuugugggaggggaaccccggaagauucuggaauacgacaauagcuguuuccauggccaacaucuuuaggggcucauaccuggccggugcugggcuacuguucucuauuaugaagaauaccacuaacacccgccggggaacaggcaaugugggugaaacucucggcgagaaauggaagagucgacuuaacgcccuggggaaaucggaauuucagaucuauaagaaaagcggcauucaggaggucgacagaaccuuggccaaggagggcaucaagagaggggaaacagaucaucacgcggugucccgcggaucugcuaaacugcggugguucgucgagagaaacauggugacgccagaaggcaagguuguggaccucgguugcgggcguggaggcuggucauacuauugugguggccugaaaaauguaagggaggugaagggguuaaccaaaggaggcccugggcaugaggaacccauaccuaugagcacuuacggauggaaccuuguccggcugcaauccggcguugauguguucuuuacaccacccgagaagugcgacacccuccuaugugauaucggugaaaguucuccuaauccaacuauugaggcagggcgcacacugcgagucuugaaccugguggaaaauuggcucaacaauaacacccaguucugcaucaagguacuuaaucccuauaugccgagcgugauugagaaaauggaaacgcugcagagaaaguacggaggcgccuugguuaggaacccucugucaagaaauuccacccacgagauguacugggugaguaacgcuacaggcaauaucgucagcucugugaacaugauaucccgcaugcucauuaauagauuuacuaugaaacacaagaaagccaccuaugagccagacgucgauuuagggucaggaacaaggaacaucgguaucgaaagcgagauucccaaccuggacauagugggcaagcgaaucgaaaagauuaaacaggagcaugaaacuucguggcacuacgaccaagaucauccuuauaagaccugggcauaccacgggucuuaugagacaaaacagaccggaagugccuccagcaugguuaauggcguagugcggcuucugacuaagccaugggacgucgugcccaugguuacgcagauggcuaugacagauaccacuccguucggucagcaacguguguuuaaagagaaggucgacaccagaacacaggaaccuaaggaggggacgaaaaagcuaaugaaaaucaccgcggaauggcucuggaaggagcugggaaaagagaagacuccccgcauguguacaagggaagaguucacccggaaagugagaucaaacgccgcauugggcgcuguauuuacugaugaaaauaaguggaaguccgcccgcgaggcaguggaagacggcagguucugggagcugguugaucgagagcggaaccuccaccuugaagggaaaugcgagacaugugucuacaauaugaugggaaagagagagaaaaagcugggugaguuuggcaaagccaaggggucuagggcuauuugguauaugugguuaggagcccgcuuccuggaauuugaggcguugggcuuccucaacgaggaccauugguuuagccgugguaauagucuguccgggguggaaggagagggccuacaccggcuuggcuacauccugagagaaguggggaagaaagagggaggugcaauguacgccgaugacaccgcuggcugggauacaaggauaacucucgaagaccugaagaacgaggagauggucaccaaucauaugaaaggggaacacaagaaauuggccgaggcaaucuucaagcugacguaucagaacaagguugugcgcguacagcgaccaaccccucggggaacagugauggacauuaucagcagaaaagaucaaaggggcucuggucaggucgggacuuacggacucaauaccuucacaaacauggaagcucagcuuauucgccaaauggagggcgagggcaucuuuaagucaauucagcaucugacugccaccgaagagauagcugugcagaauugguuagccagaguugggcgggaaaggcugagucguauggcaaucuccggagacgauugcguggucaaacccauugacgaucgauucgcgagcgccuugacggcucucaacgacauggguaaggugcgcaaagauauccagcaaugggagccaucuagaggcuggaaugacuggacacagguacccuuuugcucgcaccacuuccaugaacugguuaugaaggaugggcgggugcuagucgugccuuguaggaaccaggacgagcuuaucggacgcgccagaauuucacagggcgcagguuggagccugaaggagaccgcuugccucgggaaauccuaugcccaaauguggacucugauguacuuucaccggagggauuugcgauuagcagccaacgcgauauguagugcugugccaucucauugggucccgacaagccguaccacuugguccauccacgccaagcacgaauggaugaccacagaggacaugcugguuguguggaauagaguauggauucaggaaaaccccuggauggaggauaaaacgccuguggaaucaugggaggaggucccauaucucggaaagcgcgaagaccaguggugcggcagucuuaucggccugaccucucgggcaacuugggccaaaaauauucagacagcuaucaaccaagugaggagccuaauagggaaugagggauacaccgacuauaugcccuccaugaagagauuccgccgggaagaggaagaggccgguguucugugguga

SEQ ID NO: 14574 - RNA, 9876 nt, Artificial Sequence
  derived and/or modified CDS sequence (opt3) from DENV-2__KC294214__SS-prME
accgcaggcgugaucgucaugcugauucccacagcuauggcauuccaccucacuacgagaaauggggagccucauaugauaguuggaaggcaggaaaaggguaagagccuucuguuuaagaccgaggacggcgugaauaugugcacauugauggccaucgauuuaggggaacugugugaggacacuauuaccuacaaaugcccacuacuccggcaaaacgaaccggaggauaucgacuguuggugcaauuccacaucuaccuggguuacuuauggaacauguaccacgacuggcgagcaccgccgagaaaagcguucaguggcgcuggucccccauguggguauggggcuugagaccagaacagaaacuuggaugaguagcgagggagcuuggaaacacguucagaggauugagaccuggauccugcggcauccuggcuucacaauaauggccgcaaucuuggccuacaccauuggcacgacucacuuucagcgcgcucucaucuucauucugcugacagcaguggccccauccaugaccaugagaugcaucgggauaucuaacagggauuuugucgaaggagugucggguggcucauggguggacauuguucucgagcacgggagcugugugacuacaauggcuaagaauaagcccaccuuagauuucgaacugaucaaaacggaggccaagcagccugcgacccuucggaaauauugcauugaagcaaaguugacaaacacuaccacagagagucgcuguccaacucaaggagagcccucccugaaugaggaacaggacaaacgauuuaucugcaagcauucuauggucgauagaggcugggguaacggguguggacuauucggcaagggcgggaucgugaccugcgccauguuuacaugcaaaaagaauauggaaggaaaaauugugcagccugagaaccucgaauacaccauagucaucacuccacacagcggugaggagcaugcuguuggcaaugacacggggaagcacggaaaagaaauuaagaucacaccgcaguccucaaccacugaggccgaacugaccggcuaugguacagugaccauggaguguagucccaggacugggcuugauuucaacgaaaugguacuguugcaaauggaggacaaagcauggcucgugcaccggcagugguuucuggauuuaccucugccauggcuccccggcgcugacacacagggaagcaauuggauacagaaggagacgcuugucaccuucaagaacccucaugccaaaaagcaagacgugguugugcugggcucucaggaaggggcgaugcacacugccuugacaggagcaaccgagauucagauguccucagguaaucuacuguuuacaggccaucucaaaugccgucugcgcauggauaaacuucaacugaaagggaugagcuacaguauguguacuggaaaguucaagaucgucaaagaaaucgcugagacccagcacggcacgauugugaucagaguacaguaugagggugacgggucuccaugcaagauucccuucgaaauaaccgauuuggagaaaaggcauguucucggccggcugaucacagugaacccgauugucacugaaaaggacuccccugugaacaucgaggccgaacccccauuuggagauagcuacaucauugucggcguggagccugggcaguuaaaacugaauugguucaagaagggaucgucuauaggucaaauguuugagaccacaaugcgaggcgcuaaacgcauggccauccuaggggacacugcaugggauuucggaucccucggcgguguuuuuaccucaauugggaaggcccugcaccagguguucggcgcuaucuacggagcggcauuuaguggcguaagcuggacgaugaaaauucuuaucggggucauaaucacauggauuggaaugaacuccagaucuaccagcuugucagugagucugguucucgugggcgucgugacucuguaucuuggugccaugguacaggcugacuccggguguaucgugagcuggaggaauaaggaacugaaaugcggaucuggcauuuucaucacagauaacguucacaccuggacugagcaguacaaguuucaacccgaaucaccaaguaaguuggccagcgcaauacagaaagcccaugaggaagguauuuguggcauccgguccgucacccgccucgagaaucugauguggaagcagauuacacccgaguuaaaccacauccugucugaaaaugaggugaaacuaacgauaaugaccggggacaucaagggaauuaugcaggcuggcaaaagaucgcucaggccucaaccaacugaacugaaguauagcuggaaaacaugggggaaggccaagaugcuuuccaccgagucacauaaccagacauucuugaucgauggaccggaaacugcagagugccccaauaccaaccgugcguggaauagucuggagguggaagacuacggcuuuggugucuucacgacaaacauuuggcucaaacugcgggagaagcaggacguauuuugugauucuaaauuaaugagcgcugccaucaaggacaaucgagcagugcacgccgauaugggguauuggauagaauccgcucugaacgacaccuggaaaauggagaaggccucauucauugagguaaagagcugccacuggccuaaaucucauacucuuugguccaauggaguauuggaaagugagaugaucaucccaaagaacuucgcaggccccgucagccagcacaacuacagaccugguuaucauacccaaacagcuggcccauggcaccucgggaaacuggaaauggauuuugacuucugugagggaacuaccgugguugugacagaagauugcggcaauagggggcccucucuacgcacgaccacugccuccggaaagcugauuacagaguggugcugucggucaugcacccucccgccucugagauacaggggcgaggacgguuguugguacgggauggaaauccgcccacuuaaagagaaggaagagaacuuggucaauagucuggugacugcgggacauggccagauugauaacuuuagcuuagguguucucggcauggcccuguuccuugaagagaugcugcgaacacggguggggaccaagcacgcuauauugcucguagcacugucguuugucacgcuaaucacuggaaauauguccuuccgugaccugggcagagugauggugauggucggggccaccaugacagaugacauuggaaugggcguuaccuaucucgcucugcuugccgcauuuaaagugaggcccacuuucgcggccgguuugcuguuacgcaagcucacaucuaaagagcugaugauggcuaccaucgggauugcccuucugagccagucaacacuaccugaaacuauccucgagcugaccgaugcauuggcucugggaaugauggccuuaaagauaguacggaacauggaaaaauaccaacucgcagugacgaucauggccauuaguugcguccccaaugcugugauccugcagaacgcguggaagguuuccuguacaauucuugccgcagugucugucagcccacuguugcucaccuccucacagcagaaggcugacuggaucccucuggcccuaacuauaaaaggccugaaucccaccgccauuuuucuuacaacucucagcagaaccaguaagaaaaggucuuggccacugaacgaggcuaucauggcagugggcaugguuuccaucuuggccagcucgcuguuaaagaaugacauuccgaugacggggccucucguggcgggaggucugcuuacagucugcuauguacugaccggccgaucagcugauuuggaacucgagcgcgccgcagacgugaaaugggaggaucaagccgaaauaucugggaguucccccauccugagcauuacuaucucugaggacggaagcauguccauuaagaacgaagaggaggaacagacacuaaccauccugauacggacuggccuucucguuaucucagguguguucccagucaguauucccaucacagcugcagccugguaccugugggaggugaaaaagcagagagcggggguauugugggaugugccuagcccacccccugucggaaaggcugaauuagaggacggcgccuauaggauuaaacagcguggcauccugggguacucucaaauaggagccgguguuuauaaggaaggcaccuuucacacgauguggcaugugacucgcggggcagugcucaugcaccggggaaaaagaauugagccguccugggcugaugucaagaaagaccugaucucauacggcgguggguggaaacuugagggagaauggaaggagggcgaagaggugcagguucuggccuuggaaccaggcaaaaaucccagggcaguacagaccaagccugggaucuucaaaacaaacaccggaacaauuggugcugugagucuagauuuuagcccaggcacuuccgggucucccaucgucgaccgaaagggaaaagugguuggccuguacgguaaugggguggucacccggucgggagccuaugugagcgcgauagcccagacggagaagucaauugaggauaacccugaaaucgaggacgauauuuuccgcaagaaaagacucacaaucauggaccugcauccgggcgcaggcaagacuaaaagguaccuucccgcuauaguacgggaagccauuaagcgaggguuaagaacccugauccucgcuccaacacgcgucguggcagccgagauggaagaggccuugaggggacugccuauccguuaucaaacccccgcuauucgggcggagcacacugguagagaaaucguugaccucaugugucaugcaaccuucacaaugaggcugcuuuccccagugcgcgucccuaacuacaaucugauuauaauggaugaggcccacuuuacggaccccgcuaguaucgccgcacgaggcuauauuucuacuagaguggaaaugggggaggccgcuggaaucuucaugaccgcgacaccaccgggcagccgggauccuuuuccccaguccaacgccccaaucauggacgaggaaagggagauucccgaacgcucauggaacucuggucacgaguggguuaccgauuucaaagggaagacugugugguuugucccuagcauaaaggcaggaaacgacaucgcugccugcuugcguaaaaauggcaagaaagugauucagcuaaguagaaagacauucgauuccgaauacguaaaaacccgggcaaacgacugggauuuugugguuacgacugacaucagcgagaugggcgccaauuucaaggcugagagggucauugauccacgccgauguaugaagcccgugauccugacagacggggaagagagagugauacucgccggaccuaugccggucacccauucuucagcggcacaacggaggggucgcaucggcagaaaccccaagaaugaaaacgaccaguauauuuacaugggggagcccuuagaaaaugaugaggacugcgcccacuggaaggaggcuaaaaugcugcuugauaacaucaauaccccugaaggaauuauccccuccauguuugagccagaaagggagaagguagacgccauagauggcgaauaccggcugcguggugaggcucgcaaaacuuucguggaccucaugcgaagaggggauuugccuguuuggcuggcauauaagguggccgcugagggcauuaacuacgccgacaggaaaugguguuuugauggaaucaagaauaaccagauucucgaagagaacgucgaaguggagaucuggacaaaggagggcgaacggaaaaagcugaaaccccgcuggcuugacgcaagaauauauagugauccacuagcgcugaaggaguucaaagaguucgccgcugggagaaagagcuugaccuuaaaucugaucacagagaugggacggcucccuacuuuuaugacgcagaaggcccgaaacgcacuggacaaucuugcuguucugcauaccgccgaaguggguggcaaagcauacacacacgcccucucggaguugccggagacucuggaaacccuacugcuccuuacacuguuagcugcggucaccgggggaauuuucuuguuucugaugucuggcaaggguaucgggaaaaugacucucggcaugugcugcauuaucacggccuccauacugcuuugguaugcacaaauucagccccacuggaucgcugccagcaucauucuggaguucuuucucaucguguugcugauaccagaaccugagaagcagagaaccccacaggauaaccaauuaacauacguagugauugccauccuaacuguugucgcagcuaccauggccaaugaaaugggauuccuggagaaaacaaagaaggaccucggcuuugggucaauuaccacucaggagagugaaucuaacauccuugacauagaucugcgcccagcguccgcuuggacauuguaugccguggcaacgaccuucgugacuccuaugcugaggcauagcaucgaaaauucaagugucaacguuagccucacagccauugcuaaucaggcaaccgugcugaugggacuugguaaaggcuggccccucuccaagauggacaucgggguaccgcuguuggccauuggauguuacucucaggugaacccaaucacccugacagcggcuuuacuacugcucgucgcccacuacgcaauuaucggcccuggucuucaagccaaagcuacucgggaagcccagaagcgugcagcugccgggauaaugaaaaaucccacgguggauggcauuaccguuaucgaccuggagccaauccccuaugauccuaaguuugaaaagcaguugggacaggugaugcugcucauucugugcgucacacaaguacuuaugaugagaacuaccugggcguuaugugaggcccugacacucgcaaccggcccgauaagcacuuugugggaggggaaccccggaagguucuggaauacgacaaucgcuguguccauggccaacauuuuucgcggcucauaccuggccggugcugggcuacuguucucuaucaugaaaaauaccacuaacacccggcgaggaacaggcaauguuggugaaacucucggcgagaaguggaaaaguagacuuaacgcccuggggaagucggaauuucagauuuauaaaaagagcggaauccaggagguggacaggaccuuggccaaagagggcauaaagcgcggggaaacagaucaucacgcggucucccggggaucugcuaagcugagaugguucguggagcguaacauggucacgccagaaggcaaagugguugaccucgguugcgggaggggaggcuggucauacuauugugguggccugaagaaugugcgggagguaaaaggguuaaccaagggaggcccugggcaugaggaacccaucccuaugagcacuuacggauggaaccuugugcgccugcaauccggcgucgauguuuucuuuacaccacccgagaaaugcgacacccuccuaugugauauuggugaaaguucuccuaauccaacuaucgaggcagggcgaacacugagaguguugaaccuggucgaaaauuggcucaacaauaacacccaguucugcauuaaggugcuuaaucccuauaugccgagcguaaucgagaagauggaaacgcugcagaggaaauacggaggcgccuuggugcggaacccucugucacgcaauuccacccacgagauguacuggguuaguaacgcuacaggcaauauagugagcucugucaacaugauuuccagaaugcucaucaauagguuuacuaugaagcacaaaaaggccaccuaugagccagacguggauuuagggucaggaacacgaaacaucgguauugaaagcgagauacccaaccuggacaucgucggcaaacggauugaaaagaucaagcaggagcaugaaacuucguggcacuacgaccaagaucauccuuauaaaaccugggcauaccacgggucuuaugagacaaagcagaccggaagugccuccagcauggugaauggcguuguacgucuucugacuaaaccaugggacgugguccccauggugacgcagauggcuaugacagauaccacuccguucggucagcaaagaguuuuuaaggagaaaguggacacccgcacacaggaaccuaaggaggggacgaagaaacuaaugaagauuaccgcggaauggcucuggaaagagcugggaaaggagaaaacucccaggauguguacacgggaagaguucaccagaaagguccgcucaaacgccgcauugggcgcuguguuuacugaugaaaauaaauggaaguccgccagggaggcaguagaagacggccgauucugggagcugguggaucgggagagaaaccuccaccuugaagggaagugcgagacauguguuuacaauaugaugggaaaaagggaaaagaaacugggugaguuuggcaaggccaaagggucucgcgcuaucugguauaugugguuaggagcccguuuccuggaauuugaggcguugggcuuccucaacgaggaccauugguuuagccgggguaauagucuguccggggucgaaggagagggccuacacagacuuggcuacauacugagggaaguggggaagaaggagggaggugcaauguacgccgaugacaccgcuggcugggauacacgcaucacucucgaagaccugaaaaacgaggagauggugaccaaucauaugaagggggaacacaaaaaguuggccgaggcaauuuucaaacugacguaucagaacaaggucguucgagugcagcggccaaccccuagaggaacaguaauggacaucauuagcaggaaggaucaacgcggcucuggucagguggggacuuacggacucaauaccuucacaaacauggaagcucagcuuaucagacaaauggagggcgagggcauuuuuaaaucaauacagcaucugacuaccacggaagagaucgccguccagaauugguuagcucggguggggagggaacgucugagucgaauggccauuuccggagacgauugcguugugaagcccaucgacgaucgcuucgcaagcgcguugacagcccucaacgacauggguaaagucagaaaggauauccagcaaugggagccaucucggggcuggaaugacuggacccaggugcccuuuugcucgcaccacuuccaugaacugguaaugaaagaugggaggguucuaguggucccuugucgcaaccaggacgagcuuauuggaagggcucggauaucacagggcgccgguuggagccugaaggagacugcaugccucgggaaguccuaugcucaaauguggacacugauguacuuucacaggcgagauuugcguuuagccgcaaacgccaucuguagugcggugccaucucauugggugccgaccagcagaacuaccugguccauucacgcuaaacacgaauggaugacaacggaggacaugcuggucguuuggaaucgcguguggauccaggaaaaccccuggauggaggauaagaccccuguagaaucaugggaggaggugccauaucucggaaaacgggaagaccaguggugcggcagucuuauuggccugacuucuagggccacaugggcaaagaauauccagaccgccauaaaccaagucagaagccuaaucgggaaugagggauacacugacuauaugcccuccaugaaacgcuuccggagggaagaggaagaggcuggugugcugugguga

SEQ ID NO: 14575 - RNA, 9876 nt, Artificial Sequence
  derived and/or modified CDS sequence (opt3) from DENV-2__KC294205__SS-prME
accgcaggcgugaucgucaugcugauucccacagcuauggcauuccaccucacuacgaggaacggggagccucauaugauaguuggaaggcaggaaaaggguaaaagccuucuguuuaagaccgaggacggcgugaauaugugcacauugauggccaucgauuuaggggaacugugugaggacacuauuaccuacaaaugcccauuacuccggcaaaacgaaccggaggauaucgacuguuggugcaauuccacaucuaccuggguuacuuauggaacauguaccacgacuggcgagcaccgccgagaaaagcguucaguggcgcuggucccccauguggguauggggcuugagaccagaacagaaacuuggaugaguagcgagggagcuuggaaacacguucagaggauugagaccuggauccugcggcauccuggcuucacaauaauggccgcaaucuuggccuacaccauuggcacgacucacuuucagcgcgcucucaucuucauucugcugacagcaguggccccauccaugaccaugagaugcaucgggauaucuaacagggauuuugucgaaggagugucggguggcucauggguagacauuguucucgagcacgggagcugugugacuacaauggcuaagaauaagcccaccuuagauuucgaacugaucaaaacggaggccaagcagccugcgacccuucggaaauauugcauugaagcaaaguugacaaacacuaccacagagagucgcuguccaacucaaggagagcccucccugaaugaggaacaggacaaacgauuuaucugcaagcauucuauggucgauagaggcugggguaacggguguggacuauucggcaagggcgggaucgugaccugcgccauguuuacaugcaaaaagaauauggaaggaaaaauugugcagccugagaaccucgaauacaccauagucaucacuccacacagcggugaggagcaugcuguuggcaaugacacggggaagcacggaaaagaaauuaagaucacaccgcaguccucaaccacugaggccgaacugaccggcuaugguacagugaccauggaguguagucccaggacugggcuugauuucaacgaaaugguacuguugcaaauggaggacaaagcauggcucgugcaccggcagugguuucuggauuuaccucugccauggcuccccggcgcugacacacagggaagcaauuggauacagaaggagacgcuugucaccuucaagaacccucaugccaaaaagcaagacgugguugugcugggcucucaggaaggggcgaugcacacugccuugacaggagcaaccgagauucagauguccucagguaaucuacuguuuacaggccaucucaaaugccgucugcgcauggauaaacuucaacugaaagggaugagcuacaguauguguacuggaaaguucaagaucgucaaagaaaucgcugagacccagcacggcacgauugugaucagaguacaguaugagggugacgggucuccaugcaagauucccuucgaaauaaccgauuuggagaaaaggcauguucucggccggcugaucacagugaacccgauugucacugaaaaggacuccccugugaacaucgaggccgaacccccauuuggagauagcuacaucauugucggcguggagccugggcaguuaaaacugaauugguucaagaagggaucgucuauaggucaaauguuugagaccacaaugcgaggcgcuaaacgcauggccauccuaggggacacugcaugggauuucggaucccucggcgguguuuuuaccucaauugggaaggcccugcaccagguguucggcgcuaucuacggagcggcauuuaguggcguaagcuggacgaugaaaauucuuaucggggucauaaucacauggauuggaaugaacuccagaucuaccagcuugucagugagucugguucucgugggcgucgugacucuguaucuuggugccaugguacaggcugacuccggguguaucgugagcuggaagaauaaagaacugaagugcggaucuggcauuuucaucacagauaacguucacaccuggacugagcaguacaaguuucaacccgaaucaccaaguaaauuggccagcgcaauacagaaggcccaugaggaagguauuuguggcaucagguccgucacccggcucgagaaucugauguggaaacagauuacacccgaguuaaaccacauccugucugaaaaugaggugaagcuaacgauaaugaccggggacaucaaaggaauuaugcaggcuggcaagcgcucgcucagaccucaaccaacugaacugaaauauagcuggaagacaugggggaaggccaaaaugcuuuccaccgagucacauaaccagacauucuugaucgauggaccggaaacugcagagugccccaauaccaacagggcguggaauagucuggagguggaagacuacggcuuuggugucuucacgacaaacauuuggcucaagcugcgugagaaacaggacguauuuugugauucuaaguuaaugagcgcugccaucaaagacaaucgggcagugcacgccgauaugggguauuggauagaauccgcucugaacgacaccuggaagauggagaaggccucauucauugaggugaaaagcugccacuggccuaagucucauacucuuugguccaauggaguauuggaaagugagaugaucauccccaagaauuucgcaggccccgucagccagcacaacuaccgaccugguuaucauacccaaacagcuggcccauggcaccucgggaagcuggaaauggauuuugacuucugugagggaacuaccgugguugugacagaagauugcggcaauagagggcccucucuaaggacgaccacugccuccggaaaacugauuacagaguggugcugucgcucaugcacccucccgccucugcgguacagaggcgaggacgguuguugguacgggauggaaaucaggccacuuaaggagaaggaagagaacuuggucaauagucuggugacugcgggacauggccagauugauaacuuuagcuuagguguucucggcauggcccuguuccuugaagagaugcugcgcacacgaguggggaccaaacacgcuauauugcucguagcacugucguuugucacgcuaaucacuggaaauauguccuuccgggaccugggccgugugauggugauggucggggccaccaugacagaugacauuggaaugggcguuaccuaucucgcucugcuugccgcauuuaaggugagacccacuuucgcggccgguuugcuguuaaggaaacucacaucuaaggagcugaugauggcuaccaucgggauugcccuucugagccagucaacacuaccugaaacuauccucgagcugaccgaugcauuggcucugggaaugauggccuuaaaaauaguacgcaacauggaaaaguaccaacucgcagugacgaucauggccauuaguugcguccccaaugcugugauccugcagaacgcguggaagguuuccuguacaauucuugccgcagugucugucagcccacuguugcucaccuccucacaccagaaagcugacuggaucccucuggcccuaacuauaaagggccugaaucccaccgccauuuuucuuacaacucucagccggaccaguaaaaagagaucuuggccacugaacgaggcuaucauggcagugggcaugguuuccaucuuggccagcucgcugcuaaagaaugacauuccgaugacggggccucucguggcgggaggucugcuuacagucugcuauguacugaccggcaggucagcugauuuggaacucgagcgagccgcagacgugaagugggaggaucaggccgaaauaucugggaguucccccauccugagcauuacuaucucugaggacggaagcauguccauuaaaaacgaagaggaggaacaaacacuaaccauccugauacgcacuggccuucucguuaucucagguguguucccagucaguauucccaucacagcugcagccugguaccugugggaggugaagaagcagcgggcggggguauugugggaugugccuagcccacccccugucggaaaagcugaauuagaggacggcgccuauagaauuaagcagaggggcauccugggguacucucagauaggagccgguguuuauaaagaaggcaccuuucauacgauguggcacgugacucguggggcagugcucaugcaucgcggaaagcggauugagccguccugggcugaugucaaaaaggaccugaucucauacggcgguggguggaaacuugagggagaauggaaagagggcgaagaggugcaaguucuggccuuggaaccaggcaagaaucccagagcaguacagaccaaaccugggaucuucaagacaaacaccggaacaauuggugcugugagucuagauuuuagcccaggcacuuccgggucucccaucgucgacaggaaaggaaaggugguuggccuguacgguaaugggguggucacccgaucgggagccuaugugagcgcgauagcccagacggagaagucaauugaggauaacccugaaaucgaggacgauauuuuccggaaaaagcgccucacaaucauggaccugcacccgggcgcaggcaaaacuaagagauaccuucccgcuauaguaagggaagccauuaaacggggguuacgaacccugauccucgcuccaacaagagucguggcagccgagauggaagaggccuugcgcggacugccuaucagguaucagacccccgcuauucgugcggagcauacuggucgggaaaucguugaccucaugugucacgcaaccuucacaaugagacugcuuuccccagugagggucccuaacuacaaucugauuauaauggaugaggcccacuuuacggaccccgcuaguaucgccgcacgcggcuauauuucuacucgaguggaaaugggggaggccgcuggaaucuucaugaccgcgacaccaccgggcagcagagauccuuuuccccaauccaacgccccaaucauggacgaggaacgggagauucccgaaaggucauggaacucuggucaugaguggguuaccgauuucaaggggaagacugugugguuugucccuagcauaaaagcaggaaacgacaucgcugccugcuugcgcaagaauggcaaaaaggugauucagcuaagucguaaaacauucgauuccgaauacguaaagaccagagcaaacgacugggauuuugugguuacgacugacaucagcgagaugggcgccaauuucaaggcugagcgggucauugauccaaggcgcuguaugaaacccgugauccugacagacggggaagaacgagugauacucgccggaccuaugccggucacccacucuucagcggcacagagacgggguaggaucggccgcaacccaaagaaugaaaacgaccaauauauuuacaugggggagcccuuagaaaaugaugaggacugcgcccauuggaaagaggcuaagaugcugcuugauaacaucaauaccccugaaggaauuauccccuccauguuugagccagaaagagagaaaguagacgccauagauggcgaauacaggcugcggggugaggcucguaagacuuucguggaccucaugcgccgaggggauuugccuguuuggcuggcauauaaaguggccgcugagggcauuaacuacgccgacagaaagugguguuuugauggaaucaagaauaaccagauucucgaagagaacgucgaaguggagaucuggacaaaagagggcgaaaggaagaaacugaagccccgguggcuugacgcacgcauauauagugauccacuagcgcugaaagaguucaaggaguucgccgcugggagaaagagcuugaccuuaaaucugaucacagagaugggaaggcucccuacuuuuaugacgcagaaagcccggaacgcacuggacaaucuugcuguucugcacaccgccgaaguggguggcaaggcauacacacacgcccucucggaguugccggagacucuggaaacccuacugcuccuuacacuguuagcugcggucaccgggggaauuuucuuguuucugaugucuggcaaagguaucgggaagaugacucucggcaugugcugcauuaucacggccuccauacugcuuugguaugcacagauucaaccccauuggaucgcugccagcaucauucuggaguucuuucucaucguguugcugauaccagaaccugagaaacagcgaaccccacaggauaaccaguuaacauacguagugauugccauccuaacuguugucgcagcuaccauggccaaugaaaugggauuccuggagaagacaaagaaagaccucggcuuugggucaauuaccacucaagagagugaaucuaacauccuugacauagaucugagaccagcguccgcuuggacauuguaugccguggcaacgaccuucgugacuccuaugcugcgccacagcaucgaaaauucaagugucaacguuagccucacagccauugcuaaucaggcaaccgugcugaugggacuugguaagggcuggccccucuccaaaauggacaucgggguaccgcuguuggccauuggauguuacucucaggugaacccaaucacccugacagcggcuuuacuacugcucgucgcccauuacgcaauuaucggcccuggucuucaggccaaggcuacuagggaagcccaaaaacgggcagcugccgggauaaugaagaaucccacgguggauggcauuaccguuaucgaccuggagccaauccccuaugauccuaaguuugaaaaacaguugggacaggugaugcugcucauucugugcgucacacagguacuuaugaugcguacuaccugggcguuaugugaggcccugacacucgcaaccggcccgauaagcacuuugugggaggggaaccccggaagauucuggaauacgacaaucgcuguguccauggccaacauuuuuaggggcucauaccuggccggugcugggcuacuguucucuaucaugaagaauaccacuaacacccgccggggaacaggcaauguuggugaaacucucggcgagaaauggaagagucgacuuaacgcccuggggaaaucggaauuucaaauuuauaagaaaagcggaauccaggagguggacagaaccuuggccaaggagggcauaaagagaggggaaacagaucaccaugcggucucccgcggaucugcuaaacugcggugguucguggagagaaacauggucacgccagaaggcaaggugguugaccucgguugcgggcguggaggcuggucauacuauugugguggccugaaaaaugugagggagguaaagggguuaaccaaaggaggcccugggcacgaggaacccaucccuaugagcacuuacggauggaaccuugugcggcugcaguccggcgucgauguuuucuuuacaccacccgagaagugcgacacccuccuaugugauauuggugaaaguucuccuaauccaacuaucgaggcagggcgcacacugcgaguguugaaccuggucgaaaauuggcucaacaccaauacgcaauucugcauuaaggugcuuaaccccuauaugccgagcguaaucgagaaaauggaaacccugcagagaaaguacggaggcgccuuggugaggaauccucugucacggaacuccacacacgagauguacuggguuaguaaugcuacuggcaacauagugagcucugucaauaugauuucccgcaugcucaucaacagauuuaccaugaaacauaagaaagccacauaugagccagacguggauuuagggucaggaacuaggaauaucgguauugaaagcgagauacccaaccuggacaucgucggcaagcgaauugaaaagaucaaacaggagcacgaaaccucguggcauuacgaccaggaucacccuuauaagacaugggcauaccacgggucuuaugagaccaaacaaacuggaagugccuccagcauggugaacggcguuguacggcuucugacgaagccaugggacgugguccccauggugacacagauggcuaugaccgauacuaccccguucggucagcagcguguuuuuaaagagaagguggacacaagaacgcaagaaccuaaggaggggaccaaaaagcuaaugaaaauuacugcggaauggcucuggaaggagcugggaaaagagaagacaccccgcauguguaccagggaagaguucacucggaaagucagaucaaaugccgcauugggcgcuguguuuacagaugaaaacaaguggaaguccgcccgcgaggcaguagaagacggcagguucugggagcugguggaucgagagcggaaucuccaucuugaagggaaaugcgagaccuguguuuacaacaugaugggaaagagagagaaaaagcugggugaguuuggcaaagccaaggggucuagggcuaucugguauaugugguuaggagcccgcuuccuggaauuugaggcguugggcuuccucaaugaggaccacugguuuagccgugguaacagucuguccggggucgaaggagagggccuacaucggcuuggcuacauacugagagaaguggggaagaaagagggaggugcaauguacgccgaugacacagcuggcugggauacuaggaucacccucgaagaccugaagaaugaggagauggugacgaaccacaugaaaggggaacauaagaaauuggccgaggcaauuuucaagcugaccuaucagaauaaggucguucgcgugcagcgaccaacaccucggggaacuguaauggacaucauuagcagaaaagaucagaggggcucuggucaaguggggaccuacggacucaacacauucacuaauauggaagcucagcuuauccgccagauggagggcgagggcauuuuuaagucaauacaacaccugaccgccacggaagagaucgcuguccagaacugguuagccagaguggggcgggaaaggcugagucguauggcaauuuccggagacgauugcguugugaaacccaucgacgaucgauucgcgagcgccuugacagcucucaaugacauggguaagguccgcaaagauauccagcagugggagccaucuagaggcuggaacgacuggacccaagugcccuuuugcucgcaccauuuccacgaacugguaaugaaggaugggcggguucuaguggucccuuguaggaaucaggacgagcuuauuggacgcgccagaauaucacagggcgcagguuggagccugaaggagacugcuugccucgggaaauccuaugcccagauguggacacugauguacuuucaucggagggauuugcgauuagcagccaacgcgaucuguagugcugugccaucucacugggugccgaccagccguacuaccugguccauucacgccaagcaugaauggaugacaacggaggacaugcuggucguuuggaacagaguguggauccaagaaaaucccuggauggaggauaaaaccccuguagaaucaugggaggaggugccauaucucggaaagcgcgaagaccaguggugcggcagucuuauuggccugacuucucgggcaacaugggccaaaaacauccagaccgcuauaaaucaggucaggagccuaaucgggaacgagggauacacugacuauaugcccuccaugaagagauuccgccgggaagaggaagaggccggugugcugugguga

SEQ ID NO: 14576 - RNA, 9876 nt, Artificial Sequence
  derived and/or modified CDS sequence (opt3) from DENV-2__KC294210__SS-prME
accgcaggcgugaucgucaugcugauucccacugcuauggcauuccaccucacuacgaggaacggggagccucauaugauaguuggaaggcaggaaaaggguaaaagccuucuguuuaagaccgaggacggcgugaauaugugcaccuugauggcaaucgauuuaggggaacugugugaggacacuauuaccuacaaaugcccauuacuccggcaaaacgaaccggaggauaucgacuguuggugcaauuccacaucuaccuggguuacuuauggaacauguaccacgacuggcgagcaccgccgagaaaagcguucaguggcgcuggucccccauguggguauggggcuugagaccagaacagaaacuuggaugaguagcgagggagcuuggaaacacguucagaggauugagaccuggauccugcggcauccuggcuucacaauaauggccgcaaucuuggccuacaccauuggcacgacucacuuucagcgcgcucucaucuucauucugcugacagcaguggccccauccaugaccaugagaugcaucgggauaucuaacagggauuuugucgaaggagugucggguggcucauggguagacauuguucucgagcacgggagcugugugacuacaauggcuaagaauaagcccaccuuagauuucgaacugaucaaaacggaggccaagcagccugcgacccuucggaaauauugcauugaagcaaaguugacaaacacuaccacagagagucgcuguccaacucaaggagagcccucccugaaugaagaacaggacaaacgauuuaucugcaagcauucuauggucgauagaggcugggguaacggguguggacuauucggcaagggcgggaucgugaccugcgccauguuuacaugcaaaaagaauauggaaggaaaaauugugcagccugagaaccucgaauacaccauagucaucacuccacacagcggugaggagcaugcuguuggcaaugacacggggaagcacggaaaagaaauuaagaucacaccgcaguccucaaccacugaggccgaacugaccggcuaugguacagugaugauggagaguagccccaggaccgggcuugauuucaacgaaaugguacuguugcaaauggaggacaaagcauggcucgugcaccggcagugguuucuggauuuaccucugccauggcuccccggcgcugacacucagggaucuaauuggauacagaaggagacacuugucacguucaagaacccucaugccaaaaagcaagacgugguugugcugggcucccaggaaggggcgaugcacaccgccuugacuggagcaacagagauucagaugucaagcgguaaucuacuguuuaccggccaucucaaaugucgucugcgcauggauaaacuucaacugaaagggaugaguuacucuaugugcacaggaaaguucaagaucgucaaagaaaucgcugagacucagcacggcaccauugugaucagaguacaguaugagggugacggguccccauguaagauucccuucgaaauaacggauuuggagaaaaggcauguucucggccggcugaucaccgugaacccgauugucacagaaaaggacagcccugugaacaucgaggccgaacccccauuuggagauucguacaucauugucggcguggagccugggcaguuaaaacugaauugguucaagaagggaucuuccauaggucaaauguuugagacuaccaugcgaggcgcuaaacgcauggccauccuaggggacacagcaugggauuucggaucacucggcgguguuuuuacaaguauugggaaggcccugcaccagguguucggcgcuaucuacggagcggcauuuagcggcguauccuggaccaugaaaauucuuaucggggucauaaucacguggauuggaaugaacucuagaagcacaucauugagugugucccugguucucgugggcgucgugacccuguaucuuggugccaugguacaggcugacagcgggugcaucgugucuuggaagaauaaagaacugaaguguggaucaggcauuuucaucacugauaacguucacacauggaccgagcaguacaaguuucaacccgaaaguccaagcaaauuggccuccgcaauacagaaggcccaugaggaagguauuugcggcaucaggucugucacucggcucgagaaucugauguggaaacagauuacccccgaguuaaaccacauccugucggaaaaugaggugaagcuaacaauaaugacgggggacaucaaaggaauuaugcaggcuggcaagcgcagccucagaccucaaccaaccgaacugaaauauuccuggaagacuugggggaaggccaaaaugcuuucaacagagagucauaaccagaccuucuugaucgauggaccggaaacagcagagugucccaauacuaacagggcguggaacucucuggagguggaagacuacggcuuuggugucuucaccacgaacauuuggcucaagcugcgugagaaacaggacguauuuugcgauagcaaguuaauguccgcugccaucaaagacaaucgggcagugcacgccgauaugggguauuggauagaaucagcucugaacgacacauggaagauggagaaggccagcuucauugaggugaaaucuugucacuggccuaagucccauacccuuuggaguaauggaguauuggaaagcgagaugaucauccccaagaauuucgcaggccccgucucucagcacaacuaccgaccugguuaucauacucaaaccgcuggcccauggcaccucgggaagcuggaaauggauuuugacuucugcgagggaacaacugugguugugaccgaagauuguggcaauagagggcccucccuaaggacaacgaccgccucaggaaaacugauuacugaguggugcugccgcaguuguacacucccgccucugcgguacagaggcgaggacgguugcugguacgggauggaaaucaggccacuuaaggagaaggaagagaacuuggucaauagccuggugaccgcgggacauggccagauugauaacuuuucguuagguguucucggcauggcccuguuccuugaagagaugcugcgcacucgaguggggacaaaacacgcuauauugcucguagcacuguccuuugucacccuaaucacgggaaauaugucuuuccgggaccugggccgugugauggugauggucggggccacuaugaccgaugacauuggaaugggcguuacauaucucgcucugcuugccgcauuuaaggugagacccaccuucgcggccgguuugcuguuaaggaaacucacuagcaaggagcugaugauggcuacaaucgggauugcccuucugucacagaguacccuaccugaaacaauccucgagcugacugaugcauuggcucugggaaugauggccuuaaaaauaguacgcaacauggaaaaguaccaacucgcagugaccaucauggccauuuccuguguccccaaugcugugauccugcagaacgcguggaagguuucuugcacgauucuugccgcagugagcgucuccccacuguugcucacaucaagccagcagaaagcugacuggaucccucuggcccuaaccauaaagggccugaaucccacugccauuuuucuuaccacacucagucggacuucuaaaaagagauccuggccacugaacgaggcuaucauggcagugggcaugguuagcaucuuggccucgucacugcuaaagaaugacauuccgaugaccgggccucucguggcgggaggucugcuuacggucuguuauguacugacaggcaggucugcugauuuggaacucgagcgagccgcagacgugaagugggaggaucaagccgaaauaaguggguccagccccauccugucuauuaccaucagcgaggacggauccaugucaauuaaaaacgaagaggaggaacagacucuaacaauccugauacgcaccggccuucucguuaucagugguguguucccagucagcauucccaucacugcugcagccugguaccugugggaggugaagaagcagcgggcggggguauugugggaugugccuucuccacccccugucggaaaagcugaauuagaggacggcgccuauagaauuaagcagaggggcauccugggguacucccaaauaggagccgguguuuauaaagaaggcacauuucacaccauguggcaugugacgcguggggcagugcucaugcaccgcggaaagcggauugagccgucaugggcugaugucaaaaaggaccugaucaguuacggcgguggguggaaacuugagggagaauggaaagagggcgaagaggugcagguucuggccuuggaaccaggcaagaaucccagagcaguacagacuaaaccugggaucuucaagaccaacacaggaaccauuggugcugugagccuagauuuuuccccaggcacaucugggucgcccaucgucgacaggaaaggaaaggugguuggccuguacgguaaugggguggucacucgaagcggagccuaugugucagcgauagcccagaccgagaaguccauugaggauaacccugaaaucgaggacgauauuuuccggaaaaagcgccucacgaucauggaccugcauccgggcgcaggcaaaacaaagagauaccuucccgcuauaguaagggaagccauuaaacggggguuacgaacucugauccucgcuccaaccagagucguggcagccgagauggaagaggccuugcgcggacugccuaucagguaucaaacacccgcuauucgugcggagcacaccggucgggaaaucguugaccucaugugccaugcaacuuucaccaugagacugcuuaguccagugagggucccuaacuacaaucugauuauaauggaugaggcccacuuuacagaccccgcuucuaucgccgcacgcggcuauauuagcacgcgaguggaaaugggggaggccgcuggaaucuucaugacugcgaccccaccgggcuccagagauccuuuuccccagucaaacgccccaaucauggacgaggaacgggagauucccgaaaggucuuggaauagcggucacgaguggguuacagauuucaaggggaagaccgugugguuugucccuaguauaaaagcaggaaacgacaucgcugccuguuugcgcaagaauggcaaaaaggugauucagcuaucccguaaaacuuucgauagcgaauacguaaagacaagagcaaacgacugggauuuugugguuaccacggacaucucugagaugggcgccaauuucaaggcugagcgggucauugauccaaggcgcugcaugaaacccgugauccugacugacggggaagaacgagugauacucgccggaccuaugccggucacacauucauccgcggcacaaagacgggguaggaucggccgcaacccaaagaaugaaaacgaccaguauauuuacaugggggagcccuuagaaaaugaugaggacugugcccacuggaaagaggcuaagaugcugcuugauaacaucaauaccccugaaggaauuauccccaguauguuugagccagaaagagagaaaguagacgccauagauggcgaauacaggcugcggggugaggcucguaagaccuucguggaccucaugcgccgaggggauuugccuguuuggcuggcauauaaaguggccgcugagggcauuaacuacgccgacagaaaguggugcuuugauggaaucaagaauaaccagauucucgaagagaacgucgaaguggagaucuggacuaaagagggcgaaaggaagaaacugaagccccgguggcuugacgcacgcauauauagcgauccacuagcgcugaaagaguucaaggaguucgccgcugggagaaagucguugacauuaaaucugaucaccgagaugggaaggcucccuacauuuaugacucagaaagcccggaacgcacuggacaaucuugcuguucugcauacggccgaaguggguggcaaggcauacacccacgcccucucugaguugccggagacacuggaaacucuacugcuccuuacccuguuagcugcggucacagggggaauuuucuuguuucugauguccggcaaagguaucgggaagaugacccucggcauguguugcauuaucacugccagcauacugcuuugguaugcacaaauucagccccacuggaucgcugccucaaucauucuggaguucuuucucaucguguugcugauaccagaaccugagaaacagcgaacgccccaggauaaccaauuaaccuacguagugauugccauccuaacaguugucgcagcuacuauggccaaugaaaugggauuccuggagaagaccaagaaagaccucggcuuugggaguauuacaacccaggagucugaauccaacauccuugacauagaucugagaccagcgagcgcuuggacuuuguaugccguggcaacaacguucgugaccccuaugcugcgccauucaaucgagaauaguagcgucaacguuucccucacugccauugcuaaucaggcaacagugcugaugggacuugguaagggcuggccccucucuaaaauggacaucgggguaccgcuguuggccauuggaugcuacagccaggugaacccaaucacccugaccgcggcuuuacuacugcucgucgcccacuacgcaauuaucggcccuggucuucaagccaaggcuacaagggaagcccagaaacgggcagcugccgggauaaugaagaaucccacuguggauggcauuacgguuaucgaccuggagccaauccccuaugauccuaaguuugaaaaacaguugggacaggugaugcugcucauucugugugucacccaaguacuuaugaugcguacaacuugggcguuaugcgaggcccugacccucgcaacaggcccgauauccaccuugugggaggggaaccccggaagauucuggaauacuacgaucgcugugucaauggccaacauuuuuaggggcucuuaccuggccggugcugggcuacuguucaguaucaugaagaauacaaccaacacucgccggggaaccggcaauguuggugaaacacucggcgagaaauggaagucgcgacuuaacgcccuggggaaaagcgaauuucagauuuauaagaaauccggaauccaggagguggacagaacuuuggccaaggagggcauaaagagaggggaaaccgaucaucacgcggucucucgcggaucagcuaaacugcggugguucguggagagaaacauggucacaccagaaggcaaggugguugaccucgguugugggcguggaggcuggagcuacuauugcgguggccugaaaaaugugagggagguaaagggguuaacgaaaggaggcccugggcaugaggaaccaaucccuauguccaccuacggauggaaccuugugcggcugcaaaguggcgucgauguuuucuuuacuccacccgagaagugugacacacuccuaugcgauauuggugaaucuagcccuaauccaaccaucgaggcagggcgcacucugcgaguguugaaccuggucgaaaauuggcucaacaauaacacacaguucuguauuaaggugcuuaaucccuauaugccgucaguaaucgagaaaauggaaacccugcagagaaaguacggaggcgccuuggugaggaacccucugucccggaauaguacgcacgagauguacuggguuagcaacgcuaccggcaauauagugucuuccgucaacaugauuucacgcaugcucaucaauagauuuacaaugaaacacaagaaagccacuuaugagccagacguggauuuagggagcggaaccaggaacaucgguauugaaucggagauacccaaccuggacaucgucggcaagcgaauugaaaagaucaaacaggagcaugaaacaucuuggcacuacgaccaagaucauccuuauaagacuugggcauaccacgggaguuaugagaccaaacagacaggauccgccagcucaauggugaauggcguuguacggcuucugaccaagccaugggacgugguccccauggugacucagauggcuaugacggauacaaccccguucggucagcaacguguuuuuaaagagaagguggacacuagaacccaggaaccuaaggaggggacgaaaaagcuaaugaaaauuacagcggaauggcucuggaaggagcugggaaaagagaagacaccccgcaugugcacuagggaagaguucacacggaaagucagauccaacgccgcauugggcgcuguguuuaccgaugaaaauaaguggaagucugcccgcgaggcaguagaagacggcagguucugggagcugguggaucgagagcggaaccuccaccuugaagggaaaugugagacuugcguuuacaauaugaugggaaagagagagaaaaagcugggugaguuuggcaaagccaaggggagcagggcuaucugguauaugugguuaggagcccgcuuccuggaauuugaggcguugggcuuccucaacgaggaccauugguuuagucgugguaauucccugagcggggucgaaggagagggccuacaccggcuuggcuacauacugagagaaguggggaagaaagagggaggugcaauguacgccgaugacacagcuggcugggauaccaggaucacacucgaagaccugaagaacgaggagauggugacuaaucauaugaaaggggaacacaagaaauuggccgaggcaauuuucaagcugaccuaucagaacaaggucguucgcgugcagcgaccaacgccucggggaaccguaauggacaucauuucuagaaaagaucaaaggggcucaggucagguggggacauacggacucaauacuuucaccaacauggaagcucagcuuauccgccaaauggagggcgagggcauuuuuaagaguauacagcaucugacagccacugaagagaucgcuguccagaauugguuagugagaguugggcgggaaaggcugucccguauggccauuagcggagacgauuguguggucaaacccaucgacgaucgauucgcaucugcguugaccgcccucaacgacauggguaaggugcgcaaagauauccagcaaugggagccaucgagaggcuggaaugacuggacgcagguacccuuuugcucacaccacuuccaugaacugguuaugaaggaugggcgggugcuagucgugccuugcaggaaccaggacgagcuuauuggacgcgcuagaauaagccagggcgccgguuggucccugaaggagacagcaugucucgggaaaaguuaugcucaaauguggacccugauguacuuucaccggagggauuugcgauuagccgcaaacgccaucugcucugcggugccaagccauugggucccgacuucccguacaaccuggucaauucacgcuaagcacgaauggaugacuaccgaggacaugcugguuguguggaauagaguauggauccaggaaaaccccuggauggaggauaaaacaccuguggaaaguugggaggaggucccauaucucggaaagcgcgaagaccagugguguggcucucuuauuggccugacgagccgggccaccugggccaaaaauauccagacugccauaaaccaagugaggucccuaaucgggaaugagggauacacagacuauaugcccucaaugaagagauuccgccgggaagaggaagaggcugguguucugugguga

SEQ ID NO: 14577 - RNA, 9876 nt, Artificial Sequence
  derived and/or modified CDS sequence (opt3) from DENV-2__KC294215__SS-prME
accgcaggcgugaucgucaugcugauucccacagcuauggcauuccaccucacuacgaggaacggggagccucauaugauaguuggaaggcaggaaaaggguaaaagccuucuguuuaagaccgaggacggcgugaauaugugcacauugauggccaucgauuuaggggaacugugugaggacacuauuaccuacaaaugcccauuacuccggcaaaacgaaccggaggauaucgacuguuggugcaauuccacaucuaccuggguuacuuauggaacauguaccacgacuggcgagcaccgccgagaaaagcguucaguggcgcuggucccccauguggguauggggcuugagacccggacagaaacuuggaugaguagcgagggagcuuggaaacacguucagaggauugagaccuggauccugcggcauccuggcuucacaauaauggccgcaaucuuggccuacaccauuggcacgacucacuuucagcgcgcucucaucuucauucugcugacagcaguggccccauccaugaccaugagaugcaucgggauaucuaacagggauuuugucgaaggagugucggguggcucauggguagacauuguucucgagcacgggagcugugugacuacaauggcuaagaauaagcccaccuuagauuucgaacugaucaaaacggaggccaagcagccugcgacccuucggaaauauugcauugaagcaaaguugacaaacacuaccacagagagucgcuguccaacucaaggagagcccucccugaaugaggaacaggacaaacgauuuaucugcaagcauucuauggucgauagaggcugggguaacggguguggacuauucggcaagggcgggaucgugaccugcgccauguuuacaugcaaaaagaauauggaaggaaaaauugugcagccugagaaccucgaauacaccauagucaucacuccacacagcggugaggagcaugcuguuggcaaugacacggggaagcacggaaaagaaauuaagaucacaccgcaguccucaaccacugaggccgaacugaccggcuaugguacagugaccauggaguguagucccaggacugggcuugauuucaacgaaaugguacuguugcaaauggaggacaaagcauggcucgugcaccggcagugguuucuggauuuaccucugccauggcuccccggcgcugacacacagggaagcaauuggauacagaaggagacgcuugucaccuucaagaacccucaugccaaaaagcaagacgugguugugcugggcucucaggaaggggcgaugcacacugccuugacaggagcaaccgagauucagauguccucagguaaucuacuguuuacaggccaucucaaaugccgucugcgcauggauaaacuucaacugaaagggaugagcuacaguauguguacuggaaaguucaagaucgucaaagaaaucgcugagacccagcacggcacgauugugaucagaguacaguaugagggugacgggucuccaugcaagauucccuucgaaauaaccgauuuggagaaaaggcauguucucggccggcugaucacagugaacccgauugucacugaaaaggacuccccugugaacaucgaggccgaacccccauuuggagauagcuacaucauugucggcguggagccugggcaguuaaaacugaauugguucaagaagggaucgucuauaggucaaauguuugagaccacaaugcgaggcgcuaaacgcauggccauccuaggggacacugcaugggauuucggaucccucggcgguguuuuuaccucaauugggaaggcccugcaccagguguucggcgcuaucuacggagcggcauuuaguggcguaagcuggacgaugaaaauucuuaucggggucauaaucacauggauuggaaugaacuccagaucuaccagcuugucagugagucugguucucgugggcgucgugacucuguaucuuggugccaugguacaggcugacuccggguguaucgugagcuggaagaauaaagaacugaagugcggaucuggcauuuucaucacagauaacguucacaccuggacugagcaguacaaguuucaacccgaaucaccaaguaaauuggccagcgcaauacagaaggcccaugaggaagguauuuguggcaucagguccgucacccggcucgagaaucugauguggaaacagauuacacccgaguuaaaccacauccugucugaaaaugaggugaagcuaacgauaaugaccggggacaucaaaggaauuaugcaggcuggcaagcgcucgcucagaccucaaccaacugaacugaaauauagcuggaagacaugggggaaggccaaaaugcuuuccaccgagucacauaaccagacauucuugaucgauggaccggaaacugcagagugccccaauaccaacagggcguggaauagucuggagguggaagacuacggcuuuggugucuucacgacaaacauuuggcucaagcugcgugagaaacaggacguauuuugugauucuaaguuaaugagcgcugccaucaaagacaaucgggcagugcacgccgauaugggguauuggauagaauccgcucugaacgacaccuggaagauggagaaggccucauucauugaggugaaaagcugccacuggccuaagucucauacucuuugguccaauggaguauuggaaagugagaugaucauccccaagaauuucgcaggccccgucagccagcacaacuaccgaccugguuaucauacccaaacagcuggcccauggcaccucgggaagcuggaaauggauuuugacuucugugagggaacuaccgugguugugacagaagauugcggcaauagagggcccucucuaaggacgaccacugccuccggaaaacugauuacagaguggugcugucgcucaugcacccucccgccucugcgguacagaggcgaggacgguuguugguacgggauggaaaucaggccacuuaaggagaaggaagagaacuuggucaauagucuggugacugcgggacauggccagauugauaacuuuagcuuagguguucucggcauggcccuguuccuugaagagaugcugcgcacacgaguggggaccaaacacgcuauauugcucguagcacugucguuugucacgcuaaucacuggaaauauguccuuccgggaccugggccgugugauggugauggucggggccaccaugacagaugacauuggaaugggcguuaccuaucucgcucugcuugccgcauuuaaggugagacccacuuucgcggccgguuugcuguuaaggaaacucacaucuaaggagcugaugauggcuaccaucgggauugcccuucugagccagucaacacuaccugaaacuauccucgagcugaccgaugcauuggcucugggaaugauggccuuaaaaauaguacgcaacauggaaaaguaccaacucgcagugacgaucauggccauuaguugcguccccaaugcugugauccugcagaacgcguggaagguuuccuguacaauucuugccgcagugucugucagcccacuguugcucaccuccucacagcagaaagcugacuggaucccucuggcccuaacuauaaagggccugaaucccaccgccauuuuucuuacaacucucagccggaccaguaaaaagagaucuuggccacugaacgaggcuaucauggcagugggcaugguuuccaucuuggccagcucgcugcuaaagaaugacauuccgaugacggggccucucguggcgggaggucugcuuacagucugcuauguacugaccggcaggucagcugauuuggaacucgagcgagccgcagacgugaagugggaggaucaagccgaaauaucugggaguucccccauccugagcauuacuaucucugaggacggaagcauguccauuaaaaacgaagaggaggaacagacacuaaccauccugauacgcacuggccuucucguuaucucagguguguucccagucaguauucccaucacagcugcagccugguaccugugggaggugaagaagcagcgggcggggguauugugggaugugccuagcccacccccugucggaaaagcugaauuagaggacggcgccuauagaauuaagcagaggggcauccugggguacucucaaauaggagccgguguuuauaaagaaggcaccuuucacacgauguggcaugugacucguggggcagugcucaugcaccgcggaaagcggauugagccguccugggcugaugucaaaaaggaccugaucucauacggcgguggguggaaacuugagggagaauggaaagagggcgaagaggugcagguucuggccuuggaaccaggcaagaaucccagagcaguacagaccaaaccugggaucuucaagacaaacaccggaacaauuggugcugugagucuagauuuuagcccaggcacuuccgggucucccaucgucgacaggaaaggaaaggugguuggccuguacgguaaugggguggucacccgaucgggagccuaugugagcgcgauagcccagacggagaagucaauugaggauaacccugaaaucgaggacgauauuuuccggaaaaagcgccucacaaucauggaccugcauccgggcgcaggcaaaacuaagagauaccuucccgcuauaguaagggaagccauuaaacggggguuacgaacccugauccucgcuccaacaagagucguggcagccgagauggaagaggccuugcgcggacugccuaucagguaucaaacccccgcuauucgugcggagcacacuggucgggaaaucguugaccucaugugucaugcaaccuucacaaugagacugcuuuccccagugagggucccuaacuacaaucugauuauaauggaugaggcccacuuuacggaccccgcuaguaucgccgcacgcggcuauauuucuacucgaguggaaaugggggaggccgcuggaaucuucaugaccgcgacaccaccgggcagcagagauccuuuuccccaguccaacgccccaaucauggacgaggaacgggagauucccgaaaggucauggaacucuggucacgaguggguuaccgauuucaaggggaagacugugugguuugucccuagcauaaaagcaggaaacgacaucgcugccugcuugcgcaagaauggcaaaaaggugauucagcuaagucguaaaacauucgauuccgaauacguaaagaccagagcaaacgacugggauuuugugguuacgacugacaucagcgagaugggcgccaauuucaaggcugagcgggucauugauccaaggcgcuguaugaaacccgugauccugacagacggggaagaacgagugauacucgccggaccuaugccggucacccauucuucagcggcacaaagacgggguaggaucggccgcaacccaaagaaugaaaacgaccaguauauuuacaugggggagcccuuagaaaaugaugaggacugcgcccacuggaaagaggcuaagaugcugcuugauaacaucaauaccccugaaggaauuauccccuccauguuugagccagaaagagagaaaguagacgccauagauggcgaauacaggcugcggggugaggcucguaagacuuucguggaccucaugcgccgaggggauuugccuguuuggcuggcauauaaaguggccgcugagggcauuaacuacgccgacagaaagugguguuuugauggaaucaagaauaaccagauucucgaagagaacgucgaaguggagaucuggacaaaagagggcgaaaggaagaaacugaagccccgguggcuugacgcacgcauauauagugauccacuagcgcugaaagaguucaaggaguucgccgcugggagaaagagcuugaccuuaaaucugaucacagagaugggaaggcucccuacuuuuaugacgcagaaagcccggaacgcacuggacaaucuugcuguucugcauaccgccgaaguggguggcaaggcauacacacacgcccucucggaguugccggagacucuggaaacccuacugcuccuuacacuguuagcugcggucaccgggggaauuuucuuguuucugaugucuggcaaagguaucgggaagaugacucucggcaugugcugcauuaucacggccuccauacugcuuugguaugcacaaauucagccccacuggaucgcugccagcaucauucuggaguucuuucucaucguguugcugauaccagaaccugagaaacagcgaaccccacaggauaaccaauuaacauacguagugauugccauccuaacuguugucgcagcuaccauggccaaugaaaugggauuccuggagaagacaaagaaagaccucggcuuugggucaauuaccacucaggagagugaaucuaacauccuugacauagaucugagaccagcguccgcuuggacauuguaugccguggcaacgaccuucgugacuccuaugcugcgccauagcaucgaaaauucaagugucaacguuagccucacagccauugcuaaucaggcaaccgugcugaugggacuugguaagggcuggccccucuccaaaauggacaucgggguaccgcuguuggccauuggauguuacucucaggugaacccaaucacccugacagcggcuuuacuacugcucgucgcccacuacgcaauuaucggcccuggucuucaagccaaggcuacuagggaagcccagaaacgggcagcugccgggauaaugaagaaucccacgguggauggcauuaccguuaucgaccuggagccaauccccuaugauccuaaguuugaaaaacaguugggacaggugaugcugcucauucugugcgucacacaaguacuuaugaugcguacuaccugggcguuaugugaggcccugacacucgcaaccggcccgauaagcacuuugugggaggggaaccccggaagauucuggaauacgacaaucgcuguguccauggccaacauuuuuaggggcucauaccuggccggugcugggcuacuguucucuaucaugaagaauaccacuaacacccgccggggaacaggcaauguuggugaaacucucggcgagaaauggaagagucgacuuaacgcccuggggaaaucggaauuucagauuuauaagaaaagcggaauccaggagguggacagaaccuuggccaaggagggcauaaagagaggggaaacagaucaucacgcggucucccgcggaucugcuaaacugcggugguucguggagagaaacauggucacgccagaaggcaaggugguugaccucgguugcgggcguggaggcuggucauacuauugugguggccugaaaaaugugagggagguaaagggguuaaccaaaggaggcccugggcaugaggaacccaucccuaugagcacuuacggauggaaccuugugcggcugcaauccggcgucgauguuuucuuuacaccacccgagaagugcgacacccuccuaugugauauuggugaaaguucuccuaauccaacuaucgaggcagggcgcacacugcgaguguugaaccuggucgaaaauuggcucaacaauaacacccaguucugcauuaaggugcuuaaucccuauaugccgagcguaaucgagaaaauggaaacgcugcagagaaaguacggaggcgccuuggugaggaacccucugucaagaaauuccacccacgagauguacuggguuaguaacgcuacaggcaauauagugagcucugucaacaugauuucccgcaugcucaucaauagauuuacuaugaaacacaagaaagccaccuaugagccagacguggauuuagggucaggaacaaggaacaucgguauugaaagcgagauacccaaccuggacaucgucggcaagcgaauugaaaagaucaaacaggagcaugaaacuucguggcacuacgaccaagaucauccuuauaagaccugggcauaccacgggucuuaugagacaaaacagaccggaagugccuccagcauggugaauggcguuguacggcuucugacuaagccaugggacgugguccccauggugacgcagauggcuaugacagauaccacuccguucggucagcaacguguuuuuaaagagaagguggacaccagaacacaggaaccuaaggaggggacgaaaaagcuaaugaaaauuaccgcgaaguggcucuggaaagaacugggaaaggagaaaacuccccgcauguguacaagggaggaguucacccggaaggucagaucaaacgccgcauugggcgcuguguuuacugaugagaauaaguggaaauccgcccgcgaagcaguagaggacggcagguucugggaacugguggaucgagagcggaaccuccaccuugaggggaagugcgaaacauguguuuacaauaugaugggaaaaagagagaagaaacugggugaauuuggcaaggccaaggggucuagggcuaucugguauaugugguuaggagcccgcuuccuggaguuugaagcguugggcuuccucaacgaggaccauugguuuagccgugguaauagucuguccggggucgagggagaaggccuacaccggcuuggcuacauacugagagagguggggaaaaaggaaggaggugcaauguacgccgaugacaccgcuggcugggauacaaggaucacucucgaggaccugaaaaacgaagagauggugaccaaucauaugaagggggagcacaaaaaguuggccgaagcaauuuucaagcugacguaucagaacaaagucguucgcgugcagcgaccaaccccucggggaacaguaauggacaucauuagcagaaaggaucaaaggggcucuggucagguggggacuuacggacucaauaccuucacaaacauggaggcucagcuuauccgccaaauggaaggcgagggcauuuuuaaaucaauacagcaucugacugccaccgaggaaaucgcuguccagaauugguuagccagaguggggcgggagaggcugagucguauggcaauuuccggagacgauugcguugugaagcccaucgacgaucgauucgcgagcgccuugacggcucucaacgacauggguaaaguccgcaaggauauccagcaaugggaaccaucuagaggcuggaaugacuggacacaggugcccuuuugcucgcaccacuuccaugagcugguaaugaaggaugggcggguucuaguggucccuuguaggaaccaggacgaacuuauuggacgcgccagaauaucacagggcgcagguuggagccugaaagagaccgcuugccucgggaaguccuaugcccaaauguggacucugauguacuuucaccggagggauuugcgauuagcagccaacgcgaucuguagugcugugccaucucauugggugccgacaagccguaccacuugguccauucacgccaaacacgaguggaugaccacagaagacaugcuggucguuuggaauagaguguggauccaggagaaccccuggauggaagauaagacgccuguagagucaugggaagaggugccauaucucggaaaacgcgaggaccaguggugcggcagucuuauuggccugaccucucgggcaacuugggccaagaauauccagacagcuauaaaccaagucaggagccuaaucgggaaugaaggauacaccgacuauaugcccuccaugaagagauuccgccgggaggaagaggaagccggugugcugugguga

SEQ ID NO: 14578 - RNA, 9876 nt, Artificial Sequence
  derived and/or modified CDS sequence (opt3) from DENV-2__KC294216__SS-prME
accgccggagugaucauuaugcugauacccaccgcuauggcauuccaccucacuacgagaaauggggagccucauaugaucguaggaaggcaggaaaaggguaaaagccuucuguucaagaccgaggacggcguuaauaugugcacauugauggccauugauuuaggggaacugugugaggacacuaucaccuacaaaugcccacuacuccggcaaaacgaaccggaggauauugacuguuggugcaauuccacaucuaccugggugacuuauggaacauguaccacgacuggcgagcaccgccgagaaaagcguucaguagcgcuggugccccaugucgguauggggcuugagacccggacagaaacuuggaugaguagcgagggagcuuggaaacacgugcagaggaucgagaccuggauacugcggcauccuggcuucgccaucauggcagccauuuuggcuuacacaaucggcaccacgcacuuucagcgcgcacucauuuucauccugcugacugccguugcuccauccaugacaaugagaugcauagggauuucuaacagggauuuuguggaaggagucucggguggcucauggguggacaucguacucgagcacgggagcuguguuaccacuauggccaagaauaagcccacauuagaucuggaacuuauuaaaaccgaggcgaagcagccugcaacguugcggaaauauugcaucgaagccaagcugaccaacacaacuaccgagagucgcuguccaacacaaggagagcccucccuaaaugaggaacaggacaaacgauucaucugcaagcauucuaugguggauagaggcugggguaacggguguggacucuuuggcaagggcgggauugucacuugcgcuauguuuaccugcaaaaagaauauggaaggaaaaguggugcugccugagaaccuugaauacacaauagucaucaccccacacagcggugaggagcaugccguuggcaaugacacugggaagcacggagaagagauuaaaaucacgccgcaguccucaauaacagaagcagagcugaccggcuaugguacugugaccauggaauguagucccaggacaggguuggauuuuaacgagaugguacuccugcagauggaggaaaaggcuugguuagugcaccggcaaugguuccuggaccucccucuuccauggcugcccggcgccgauacccagggaagcaauuggauucagaaagagacuuuggucacauuuaagaacccucaugcgaagaaacaggacgugguugugcuaggcucucaagaaggggccaugcacacggcacugaccggagcuacugagauccagauguccucagguaaucuccuguucacaggccaucuuaagugccgucugcgcauggacaaauugcagcucaaggggaugagcuacaguauguguaccggaaaauuuaagaucgucaaggagauugccgaaacacaacacggcacuaucgugauuagaguacaguaugagggugaugggucuccaugcaaaauacccuucgaaaucauggaccuggagaagaggcauguuuuaggccggcugauuaccgugaacccgaucgucacggaaaaagauuccccugugaacaucgaggcugagcccccauucggagacagcuacauuauaaucggcgucgaaccugggcagcuaaagcucaauugguuuaaaaagggaucgucuauuggucagauguucgagaccacaaugcgaggcgccaagcgcauggcaauccugggggauacugccugggacuuuggaucccuuggcgguguguucaccucaauugggaaggcuuugcaccaaguuuuuggcgcgaucuacggagcagccuucaguggcgugagcuggacaaugaagauacugaucgggguaauuaucacuuggauuggaaugaacuccagaucuaccagccucucagucagucuggugcuuguuggcguggucacgcuguauuugggugcuauggugcaggccgauuccggguguguagugagcuggaaaaauaaggaacucaaaugcggaucuggcaucuuuauaacagacaacguucacaccuggacugagcaguacaaguuccagcccgaaucaccaaguaagcuggcaagcgccauucaaaaagcucaugaggaggguaucuguggcauuagguccgucacacgguuagaaaaucugauguggaagcagaucacccccgagcuaaaccacauacucucugaaaaugaggugaaacugacuaucaugaccggggauauuaagggaaucaugcaggccggcaaacgcucgcuuagaccucagccaacagaauugaaguauagcuggaaaacgugggggaaggcaaagaugcuguccaccgagucacauaaccaaacuuuucucauugacggaccggagacagcggaaugccccaauaccaacagggcuuggaauagucuggagguggaagauuacggcuucggugucuuuacaacuaacaucugguuaaaacugcgugagaagcaggacguuuucugugacucuaaacuuaugagcgccgcaauaaaggauaaucgggccgugcacgcugacaugggguauuggauugaguccgccuugaacgauaccuggaaaauggaaaaggcaucauuuaucgaggugaaaagcugccacuggccuaaaucucauacgcucugguccaauggaguacuggaaagugagaugaucauuccaaagaacuucgcuggccccgucagccagcacaacuaccgaccugguuaucauacacagaccgccggcccauggcaccuagggaaacuggaaauggacuucgauuuuugugagggaacuaccgugguugugacagaggacugcggcaauagagggcccucucucaggacuaccacagcguccggaaagcugaucacggaauggugcugucgcucaugcacccuuccgccuuugcgguacagaggcgaggaugguuguugguacgggauggaaauuaggccacugaaagagaaggaagagaacuuagucaauagucucgugacugccggacauggccaaauagacaacuucagccuggguguucuuggcauggcucuguuuuuggaggaaaugcuccgcacacgaguggggaccaagcacgcaauccugcuaguagccgucucguuccugacucucauuacaggaaauauguccuuucgggaucugggccgugugauggugauggucgggguugcuaugaccgacgauaucggaaugggcgugacguaucuugccuugcuggcagcguucaaaguaagacccacuuuugccgcugguuuacuccugaggaaacuuaccucuaaagagcugaugauggccacaauugggaucacccuacucagccagucaacuacaccugaaaccauacuggaguugacagacgcacuggcuuuaggaaugauggugcucaagaucguccgcaacauggaaaaauaccagcuggccgugacuauuaugaccaucaguugcguucccaaugcaaugauucuuaucaacgccuggaagguguccuguacgauacuggcugucgugucuguuagcccauugcuccugacauccucacaacagaagaccgauuggauuccucuagcgcugacuaucaaaggccuuaaucccaccgccaucuuccucacaacucugagccggaccaguaagaaaagaucuuggccauugaacgaggcagugauggcugucggcaugguauccauucuggccagcucguuacucaagaaugacauaccgaugacggggccucugguggccggaggucuucugacaguuugcuauguguugaccggcaggucagcugaccucgagcuggaacgagcagccgaugucaaaugggaggaccaggcggaaaucucugggaguucccccauucuaagcaucacuauuucugaggauggaagcauguccaucaagaacgaggaagaggaacagacacugaccauacuuauccgcacuggccuccuggugauuucagguguauuuccagugaguauccccauuacagcugccgcaugguacuugugggagguccggaaacaaagagccgggguuuuaugggacgugccuagcccacccccuguggaaaaggcugagcuggaggauggagcauauaggaucaagcagcguggcauacucggcuacucucagauuggggccggagucuauaaagaagguaccuuccacacgauguggcaugugacucgcggcgcgguucugaugcaccgggggaagagaaucgagccguccugggcugacgucaagaaggaucuuaucucauacggaggcgguuggaaacuggaaggggaguggaaggaaggagaggaggugcaggucuuggcccuagaaccaggcaagaaucccagggcagugcaaaccaaaccuggccuguuuaagacaaacaccgggacaauuggagccguuagucucgacuucagcccagguacuuccggcucucccaucguggaucgaaaagggaaggucgugggacuguacggcaaugguguagucacccggucgggggcuuaugugagcgccauagcacagacggagaaaucaauugaagacaacccugagaucgaagaugacauuuuucgcaagaagagacuuacaaucauggauuuacauccgggagcuggcaaaacuaagagguaccugcccgccauaguucgggaggcgauuaaacgaggccucagaaccuugauccuggccccaacacgcguggucgcagcugagauggaagaggcccucagggggcugccuauccguuaucagacccccgcuauucgggcagaacacacuggaagagagaucguggaccuuaugugucaugccaccuucacaaugaggcuguuguccccaguucgcgugccuaacuacaaucuaauuauaauggacgaggcccacuucacggaucccgcuaguaucgcggcacgagguuauauuucuacuagagucgaaaugggcgaggccgcugggaucuuuaugaccgccacaccaccgggaagccgggacccuuucccccaguccaacgcaccaaucauggaugaagagagggaaauucccgagcgcucauggaacucuggccacgagugggugaccgacuuuaaggguaaaacuguaugguucgugccuagcauaaaggccgggaacgauaucgcugcgugccugcguaagaauggcaagaagguuauucaacucaguagaaaaacauuugacuccgaauacgucaagacccgggccaacgauugggacuucguggugacgacugauaucagcgagaugggcgcaaauuuuagggcugaacgcgucauugacccacgaagauguaugaaacccguaaucuuaacagauggcgaggaacgggugauacuggccgggccuaugccgguuacccauucuucagcagcccagaggcgcggaagaguggguaggaacccaaagaaugagaacgaccaguauaucuacaugggcgagccccuugaaaaugacgaggauugcgcucacuggaaggaagccaaaaugcugcucgacaacauuaauaccccugaggggaucauucccuccauguucgaaccagagcgggagaaggucgaugcgaucgacggagaauaccguuugcgcggcgaggcacgaaaaacuuuuguggaucugaugagaaggggugaccucccuguuuggcuggccuaucggguggcugccgaagggauaaacuacgcugaucgcagaugguguuucgacggcauuaagaauaaccaaauccuugaggagaacgucgaaguggagauuuggacaaaagaaggagagaggaagaaacuaaagccccgguggcuggaugcacgaaucuauagugacccauuggccuuaaaggaauuuaaagaguucgcugccggcagaaagagccugacccucaaucugauaacagagauggggcgccuuccuacuuucaugacgcagaaagcaaggaacgcgcuggauaaucucgccguauugcauaccgcugaagccggaggucgggcauacaaccacgcucugucggagcuaccggaaacacuggagacucuccuucuguuaaccuugcuggccacagugaccggcgggaucuuucucuuccugaugucuggaaagggcauugguaaaaugacucuugggaugugcugcaucauuacggcauccauccugcucugguaugcccagauacagccccacuggauugcugcgagcaucaucuuggaauuuuuccugauuguuuuacuaaucccagagccugagaagcaacguacaccccaggacaaucagcugacauacgucgugauagccauucucacuguggucgcagcuaccauggccaacgaaaugggcuuucuugagaagacaaaaagagaucugggauugggcucaaucaccacucaggaaagugagucuaauauucuggacaucgaccucaggccagccuccgcauggacacuguaugcuguugccacgaccuucgugacuccuaugcuucgccauagcauagaaaacucaaguguaaaugugagccucacagcgaucgcuaaccaagccaccguccugaugggguugggaaaggguuggccccuguccaaaauggauauuggcgugccguuacuagcaaucggguguuacucucagguuaauccaauuacccugacagccgcucuccuucuguugguggcacacuacgccaucauuggaccuggccugcaggcgaaggcuacucgggaggcccagaaacgagcagccgcugguaucaugaagaaccccacggucgacgggauaaccguaauugaucucgagccaauccccuaugacccuaaguuugaaaaacaacugggccaggugaugcuuuuaauccugugcguuacacaggugcucaugaugagaacuaccugggccuugugugaggcacugacacuagcuaccggaccgauuagcacucugugggaaggcaaucccgggagguucuggaacacgacaauagccgucuccauggcgaauaucuuucgcggaucauaccucgccggcgcaggucuucuguucucuauuaugaagaacaccacuaauacccggagagggacaggaaacaucggcgagacuuugggugagaaauggaagagucgucugaacgcucucggcaaaucggaauuucagauuuauaagaggagcgggauccaagagguggaucggacccuggccaaggaaggaauaaaacgcggcgagacagaccaucacgcagucucccgagggucugcuaaguuaagaugguucguggaaaggaauaugguuacgccagagggaaaagugguagaucuuggcugcgguagagggggauggucauacuauuguggcggucugaagaacgugcgcgaggucaaaggccucaccaaagggggaccuggccaugaggaacccaucccuaugagcacuuacggguggaaucuaguuagacugcaguccggaguggacgucuuuuucacaccacccgaaaaaugcgauaccuugcugugugacauuggcgagaguucuccuaacccaacuaucgaagccgguaggacacuccgagugcuuaaucugguagagaacugguugaauaacaauacccaguucugcauuaaggugcugaaccccuauaugccgagcguuaucgagaagauggaaacgcuccaacggaaauacgggggagccuuagugcguaauccucugucaagaaacuccacccacgagauguacugggucaguaaugcgacaggcaacauagugagcucugucaauaugauuucccgcaugcuuaucaacagguuuacuaugaagcacaaaaaggcuaccuaugaaccagauguggaccugggcucagggacacggaacaucggaauugagagcgaaauacccaaucuagcaaucauugguaaaagaaucgagaagauuaagcaggagcaugaaacuucguggcacuacgaucaggaccauccuuauaaaaccugggccuaccacggcucuuaugagacaaagcagaccgggagugcuuccagcaugguuaacggaguagugcgccuccugacuaaaccaugggacgucgugcccaugguuacgcaaauggccaugacagauaccacuccguucggccagcagaggguguuuaaggaaaaagucgacacccgaacacaggagccuaaggaggguacgaagaaauugaugcggaucaccgcagaauggcuguggaaggagcucgggaaaaagaaaacucccagaauguguacaagggaagaguucacccgcaaggugcguucaaaugccgcucuuggagcgauauuuacugaugaaaacaaguggaaauccgcccgggaggcaguagaggacucuagauucugggaacugguggauagggagcgcaauuuacaccuggaaggcaagugcgagacauguguuuacaacaugaugggcaaacgagaaaagaaauugggggaguuuggaaaggcuaaagguagccgggccaucugguauauguggcucggcgcaagauuccuggaguuugaagcccuaggguuccuuaaugaggaccauugguuuaguaggggaaacucccugagcggcgucgaaggugaggggcuccaccgccugggauacauuuugagagaugugucuaagaaggaaggcggcgcuauguacgccgacgauaccgcggggugggacacacggaucacucuggaggaucucaaaaaugaggaaauggugaccaaccauaugaagggagagcacaagaaacuugcagaagccgucuucaaacugacguaucaaaauaagguugugaggguacagcguccaaccccucgagguacagugauggacauuaucucacgcagagaccagcggggcagugggcaggucggaacuuacggcuuaaacaccuuuacaaauauggaggcucaacugauuaggcagauggagggugaagggauauucaaguccauccagcauuugacugccaccgaggaaauugcagugcaaaacuggcucgcucgcguuggaagagagcggcugagcaggauggccaucucuggcgaugacugcguggucaaaccccuagaugaccgauucgcuucggcccuuacggcacugaaugauaugggcaaggugcguaaagacauccagcagugggaaccaucaagaggguggaacgauuggacacagguacccuuuugcagccaccacuuccaugagcucguuaugaaggacggacgcgugcuggucgugccuugucggaaccaagaugaguugauugguagggcgagaauaucccagggcgccggguggaguuuaaaagaaaccgcuugccugggaaagucuuaugcccagauguggacucucauguacuuucaccgccgggaccuuaggcuggcagcuaaugccaucuguagcgcagugccaucccauugggucccgacaucacgaaccacuuggaguauucacgccaagcacgaguggaugaccacagaagauaugcuagcgguuuggaacagaguguggauccaggagaaucccuggauggaagacaaaacgccuguagagucuugggaggaagugccauaucugggcaagcgggaggaucaauggugcgguagccucauuggguugaccuccagggcuacuugggccaaaaacauccagacagcaauaaaucagguccgcucacugaucggaaacgaagaguacaccgacuauaugcccagcaugaagcguuucagacgagaagaggaggaagccggcgugcuuugguga

SEQ ID NO: 14579 - RNA, 9876 nt, Artificial Sequence
  derived and/or modified CDS sequence (opt3) from DENV-2__KC294218__SS-prME
accgcaggcgugaucgucaugcugauucccacagcuauggcauuccaccucacuacgaggaacggggaaccucauaugauaguuggaaggcaggaaaaggguaaaagccuucuguuuaagaccgaggacggcgugaauaugugcacauugauggcaaucgauuuaggggaacugugugaggacacuauuaccuacaaaugcccacugcuccggcaaaacgaaccggaggauaucgacuguuggugcaauuccacaucuaccuggguaacuuauggaacauguaccacgacuggcgagcaccgccgagaaaagcguucaguggcgcuggucccccauguggguauggggcuugagacccggacagaaacuuggaugaguagcgagggagcuuggaaacacguucagaggauugagaccuggauccugcggcauccuggcuucacaauaauggccgcaaucuuggccuacaccauuggcacgacucacuuucagcgcgcucucauccugauucugcucacagcaguggccccauccaugaccaugagaugcaucgggauaucuaacagggauuucgucgaaggagugucggguggcucauggguagacauuguuuuagagcacgggagcugugugacuacaauggcuaagaauaagcccacccuggauuuugaacuuaucaaaacggaggccaagcagccugcgaccuugcggaaauauugcauugaagcaaagcugacaaacacuaccacagagagucgcuguccaacucaaggagagcccucccuaaaugaagaacaggacaaacgauucaucugcaagcauucuauggucgauagaggcugggguaacggguguggacucuuuggcaagggcgggaucgugaccugcgccauguucacaugcaaaaagaauauggaaggaaaaauugugcagccugagaaccuggaauacaccauagucaucacuccacacagcggugaggagcaugcuguuggcaaugacacggggaagcacggaaaagaaauuaagaucacaccgcaguccucaaccacugaggccgaacuuaccggcuaugguacagugaccauggaguguagucccaggacugggcuggauuuuaacgaaaugguauugcuccaaauggaggacaaagcauggcuggugcaccggcagugguucuuagaucugccucucccauggcuucccggcgcugacacacagggaagcaauuggauacagaaggagacgcuggucaccuuuaagaacccucaugccaaaaagcaagacgugguuguguugggcucucaggaaggggcgaugcacacugcccuaacaggagcaaccgagauucagauguccucagguaaucuacucuucacaggccaucugaaaugccgucuucgcauggauaagcugcaauugaaagggaugagcuacaguauguguacuggaaaguuuaagaucgucaaagaaaucgcugagacccagcacggcacgauugugaucagaguacaguaugagggugacgggucuccaugcaagauucccuucgaaauaaccgaucucgagaaaaggcauguucugggccgguuaaucacagugaacccgauugucacugaaaaggacuccccugugaacaucgaggccgaacccccauucggagauagcuacaucauugucggcguggagccugggcagcugaaacuaaauugguuuaagaagggaucgucuauaggucaaauguucgagaccacaaugcgaggcgcuaaacgcauggccauccucggggacacugcaugggauuuuggaucccugggcgguguuuucaccucaauugggaaggcccuucaccagguguuuggcgcuaucuacggagcggcauucaguggcguaagcuggacgaugaaaauuuugaucggggucauaaucacauggauuggaaugaacuccagaucuaccagccugucagugagucucguucuggugggcgucgugacucuuuaucugggugccaugguacaggcugacuccggguguaucgugagcuggaagaauaaagaauugaagugcggaucuggcauuuuuaucacagauaacguucacaccuggacugagcaguacaaguuccaacccgaaucaccaaguaaacucgccagcgcaauacagaaggcccaugaggaagguauuuguggcaucagguccgucacccggcuggagaauuuaauguggaaacagauuacacccgagcugaaccacauccuaucugaaaaugaggugaagcucacgauaaugaccggggacaucaaaggaauuaugcaggcuggcaagcgcucgcugagaccucaaccaacugaacuuaaauauagcuggaagacaugggggaaggccaaaauguuguccaccgagucacauaaccagacauuucugaucgauggaccggaaacugcagagugccccaauaccaacagggcguggaauagucucgagguggaagacuacggcuucggugucuuuacgacaaacauuuggcugaaguuacgugagaaacaggacguuuucugugauucuaagcugaugagcgcugccaucaaagacaaucgggcagugcacgccgauaugggguauuggauagaauccgcucuuaacgacaccuggaagauggagaaggccucauuuauugaggugaaaagcugccacuggccuaagucucauacuuugugguccaauggaguacucgaaagugagaugaucauccccaaaaauuucgcaggccccgucagccagcacaacuaccgaccugguuaucauacccaaacagcuggcccauggcaccuggggaagcuagaaauggauuucgacuuuugugagggaacuaccgugguugugacagaagauugcggcaauagagggcccucucugaggacgaccacugccuccggaaaacucauuacagaguggugcugucgcucaugcacccugccgccucuucgguacagaggcgaggacgguuguugguacgggauggaaaucaggccauugaaggagaaggaagagaaccuggucaauaguuuagugacugcgggacauggccagauugauaacuucagccucgguguucugggcauggcccuuuuucuggaagagauguugcgcacacgaguggggaccaaacacgcuauacuccugguagcacuaucguucgucacgcugaucacuggaaauauguccuuucgggaccucggccgugugauggugauggucggggccaccaugacagaugacauuggaaugggcguuaccuaucuggcucuuuuggccgcauucaaggugagacccacuuuugcggccggucuguuacucaggaaacugacaucuaaggagcuuaugauggcuaccaucgggauugcccugcuaagccagucaacacucccugaaacuauccuggaguugaccgaugcacuggcuuuaggaaugauggcccucaaaauaguacgcaacauggaaaaguaccaacuggcagugacgaucauggccauuaguugcguccccaaugcugugauccuucagaacgcguggaagguuuccuguacaauucuggccgcagugucugucagcccauugcuccugaccuccucacagcagaaagcugacuggaucccucuagcccugacuauaaagggccuuaaucccaccgccauuuuccucacaacucugagccggaccaguaaaaagagaucuuggccauugaacgaggcuaucauggcagugggcaugguuuccauccuggccagcucguuacucaaaaaugacauuccgaugacggggccucugguggcgggaggucuucugacagucugcuauguauugaccggcaggucagcugaucucgaacuggagcgagccgcagacgugaagugggaggaucaagccgaaauaucugggaguucccccauccuaagcauuacuaucucugaggacggaagcauguccauuaaaaacgaagaggaggaacagacacugaccauccuuauacgcacuggccuccugguuaucucagguguguuuccagucaguauucccaucacagcugcagccugguacuugugggaggugaagaagcagcgggcggggguauuaugggaugugccuagcccacccccugucggaaaagcugaacuggaggacggcgccuauagaauuaagcagaggggcauccucggguacucucaaauaggagccgguguuuauaaagaaggcaccuuccacacgauguggcaugugacucguggggccgugcugaugcaccgcggaaagcggauugagccguccugggcugaugucaaaaaggaccuuaucucauacggcgguggguggaagcuggagggagaauggaaagagggcgaagaggugcagguuuuggcccuagaaccaggcaagaaucccagagcaguacagaccaaaccugggaucuuuaagacaaacaccggaacaauuggugcugugagucuggauuucagcccaggcacuuccgggucucccaucgucgacaggaaaggaaaggugguuggccucuacgguaaugggguggucacccgaucgggagccuaugugagcgcgauagcccagacggagaagucaauugaggauaacccugaaaucgaggacgauauuuuucggaaaaagcgccugacaaucauggaccuucauccgggcgcaggcaaaacuaagagauacuuacccgcuauaguaagggaagccauuaaacgggggcugcgaacccucaucuuggcuccaacaagagucguggcagccgagauggaagaggcccugcgcggacucccuaucagguaucaaacccccgcuauucgugcggagcacacuggucgggaaaucguugaccugaugugucaugcaaccuucacaaugagacuucuguccccagugagggucccuaacuacaauuugauuauaauggaugaggcccacuucacggaccccgcuaguaucgccgcacgcggcuauauuucuacucgaguggaaaugggggaggccgcuggaaucuuuaugaccgcgacaccaccgggcagcagagauccuuucccccaguccaacgccccaaucauggacgaggaacgggagauucccgaaaggucauggaacucuggucacgaguggguuaccgauuuuaaggggaagacugugugguucgucccuagcauaaaagcaggaaacgacaucgcugccugccuacgcaagaauggcaaaaaggugauucagcugagucguaaaacauuugauuccgaauacguaaagaccagagcaaacgacugggauuucgugguuacgacugacaucagcgagaugggcgccaauuuuaaggcugagcgggucauugauccaaggcgcuguaugaaacccgugauccucacagacggggaagaacgagugauauuagccggaccuaugccggucacccauucuucagcggcacaaagacgggguaggaucggccgcaacccaaagaaugaaaacgaccaguauauuuacaugggggagccccuggaaaaugaugaggacugcgcccacuggaaagaggcuaagaugcuucuggauaacaucaauaccccugaaggaauuauccccuccauguucgagccagaaagagagaaaguagacgccauagauggcgaauacaggcuccggggugaggcucguaagacuuuuguggacuugaugcgccgaggggaucugccuguuuggcucgcauauaaaguggccgcugagggcauuaacuacgccgacagaaagugguguuucgauggaaucaagaauaaccagauucuggaagagaacgucgaaguggagaucuggacaaaagagggcgaaaggaagaaacuuaagccccgguggcuagacgcacgcauauauagugauccacuggcguugaaagaguuuaaggaguucgccgcugggagaaagagcuuaacccugaaucucaucacagagaugggaaggcugccuacuuucaugacgcagaaagcccggaacgcacuugacaaucuggcuguucuccauaccgccgaaguggguggcaaggcauacacacacgccuugucggagcugccggagacucuagaaacccugcuccuucugacauuauuggcugcggucaccgggggaauuuuucuguuccucaugucuggcaaagguaucgggaagaugacucugggcaugugcugcauuaucacggccuccauacuucugugguaugcacaaauucagccccacuggaucgcugccagcaucauucucgaguuuuucuugaucgugcuguuaauaccagaaccugagaaacagcgaaccccacaggauaaccaacuaacauacguagugauugccauccugacuguugucgcagcuaccauggccaaugaaaugggauuucucgagaagacaaagaaagaccuuggcuucgggucaauuaccacucaggagagugaaucuaacauccuggacauagauuugagaccagcguccgcuuggacacuguaugccguggcaacgaccuuugugacuccuaugcuccgccauagcaucgaaaauucaagugucaacguuagccugacagccauugcuaaucaggcaaccgugcuuaugggacucgguaagggcuggccccuguccaaaauggacaucgggguaccguugcuggccauuggauguuacucucaggugaacccaaucaccuuaacagcggcucuacugcuccuugucgcccacuacgcaauuaucggcccuggucugcaagccaaggcuacuagggaagcccagaaacgggcagcugccgggauaaugaagaaucccacgguggauggcauuaccguuaucgacuuggagccaauccccuaugauccuaaguucgaaaaacagcugggacaggugaugcuccugauucuuugcgucacacaaguauuaaugaugcguacuaccugggcgcugugugaggcccucacauuggcaaccggcccgauaagcacucugugggaggggaaccccggaagauuuuggaauacgacaaucgcuguguccauggccaacauuuucaggggcucauaccuagccggugcugggcugcucuuuucuaucaugaagaauaccacuaacacccgccggggaacaggcaauguuggugaaacucuuggcgagaaauggaagagucgacugaacgccuuggggaaaucggaguuccagauuuauaagaaaagcggaauccaggagguggacagaacccuggccaaggagggcauaaagagaggggaaacagaucaucacgcggucucccgcggaucugcuaaacuccggugguuuguggagagaaacauggucacgccagaaggcaaggugguugaccuggguugcgggcguggaggcuggucauacuauugugguggccuuaaaaaugugagggagguaaaggggcuaaccaaaggaggcccugggcaugaagaacccaucccuaugagcacuuacggauggaaccuggugcggcuccaauccggcgucgauguuuucuucacaccacccgagaagugcgacacccuacugugugauauuggugaaaguucuccuaauccaacuaucgaggcagggcgcacauugcgagugcugaaccucgucgaaaauuggcuuaacaauaacacccaguuuugcauuaaggugcugaaucccuauaugccgagcguaaucgagaaaauggaaacguugcagagaaaguacggaggcgcccuggugaggaacccucucucaagaaauuccacccacgagauguacuggguuaguaacgcuacaggcaauauagugagcucugucaacaugauuucccgcauguuaaucaauagauucacuaugaaacacaagaaagccaccuaugagccagacguggaucuggggucaggaacaaggaacaucgguauugaaagcgagauacccaaccuugacaucgucggcaagcgaauugaaaagaucaaacaggagcaugaaacuucguggcacuacgaccaagaucauccuuauaagaccugggcauaccacgggucuuaugagacaaaacagaccggaagugccuccagcauggugaauggcguuguacggcugcuaacuaagccaugggacgugguccccauggugacgcagauggcuaugacagauaccacuccguuuggucagcaacguguuuucaaagagaagguggacaccagaacacaggaaccuaaggaggggacgaaaaagcucaugaaaauuaccgcggaauggcuguggaaggaguugggaaaagagaagacuccccgcauguguacaagggaagaguuuacccggaaagucagaucaaacgccgcacugggcgcuguguucacugaugaaaauaaguggaaguccgcccgcgaggcaguagaagacggcagguuuugggagcucguggaucgagagcggaaccuucaccuggaagggaaaugcgagacauguguuuacaauaugaugggaaagagagagaaaaaguuaggugaguucggcaaagccaaggggucuagggcuaucugguauauguggcugggagcccgcuuuuuggaguucgaggcgcucggcuuucugaacgaggaccauugguucagccgugguaauagucuauccggggucgaaggagagggccuucaccggcugggcuacauacucagagaaguggggaagaaagagggaggugcaauguacgccgaugacaccgcuggcugggauacaaggaucacucuggaagacuugaagaacgaggagauggugaccaaucauaugaaaggggaacacaagaaacuggccgaggcaauuuuuaagcucacguaucagaacaaggucguucgcgugcagcgaccaaccccucggggaacaguaauggacaucauuagcagaaaagaucaaaggggcucuggucagguggggacuuacggacuuaauaccuucacaaacauggaagcucagcugauccgccaaauggagggcgagggcauuuucaagucaauacagcauuuaacugccaccgaagagaucgcuguccagaauuggcuggccagaguggggcgggaaagguugagucguauggcaauuuccggagacgauugcguugugaaacccaucgacgaucgauuugcgagcgcccucacggcucugaacgacauggguaagguccgcaaagauauccagcaaugggagccaucuagaggcuggaaugacuggacacaggugcccuucugcucgcaccacuuucaugaguuaguaaugaaggaugggcggguucuuguggucccuuguaggaaccaggacgagcugauuggacgcgccagaauaucacagggcgcagguuggagccucaaggagaccgcuugccuggggaaauccuaugcccaaauguggacuuugauguacuuccaccggagggauuuacgacuggcagccaacgcgaucuguagugcugugccaucucauugggugccgacaagccguaccacuugguccauucacgccaagcacgaauggaugaccacagaggacaugcucgucguuuggaauagaguguggauccaggaaaaccccuggauggaggauaaaacgccuguagaaucaugggaggaggugccauaucuuggaaagcgcgaagaccaguggugcggcagucugauuggccuaaccucucgggcaacuugggccaaaaauauccagacagcuauaaaccaagucaggagccugaucgggaaugagggauacaccgacuauaugcccuccaugaagagauuucgccgggaagaggaagaggccggugugcucugguga

SEQ ID NO: 14580 - RNA, 9876 nt, Artificial Sequence
  derived and/or modified CDS sequence (opt3) from DENV-2__KC294220__SS-prME
accgcaggcgugaucgucaugcugauucccacagcuauggcauuccaccucacuacgaggaacggggagccucauaugauaguuggaaggcaggaaaaggguaaaagccuucuguuuaagaccgaggacggcgugaauaugugcacauugauggccaucgauuuaggggaacugugugaggacacuauuaccuacaaaugcccauuacuccggcaaaacgaaccggaggauaucgacuguuggugcaauuccacaucuaccuggguuacuuauggaacauguaccacgacuggcgagcaccgccgagaaaagcguucaguggcgcuggucccccauguggguauggggcuugagacccggacagaaacuuggaugaguagcgagggagcuuggaaacacguucagaggauugagaccuggauccugcggcauccuggcuucacaauaauggccgcaaucuuggccuacaccauuggcacgacucacuuucagcgcgcucucaucuucauucugcugacagcaguggccccauccaugaccaugagaugcaucgggauaucuaacagggauuuugucgaaggagugucggguggcucauggguagacauuguucucgagcacgggagcugugugacuacaauggcuaagaauaagcccaccuuagauuucgaacugaucaaaacggaggccaagcagccugcgacccuucggaaauauugcauugaagcaaaguugacaaacacuaccacagagagucgcuguccaacucaaggagagcccucccugaaugaggaacaggacaaacgauuuaucugcaagcauucuauggucgauagaggcugggguaacggguguggacuauucggcaagggcgggaucgugaccugcgccauguuuacaugcaaaaagaauauggaaggaaaaauugugcagccugagaaccucgaauacaccauagucaucacuccacacagcggugaggagcaugcuguuggcaaugacacggggaagcacggaaaagaaauuaagaucacaccgcaguccucaaccacugaggccgaacugaccggcuaugguacagugaccauggaguguagucccaggacugggcuugauuucaacgaaaugguacuguugcaaauggaggacaaagcauggcucgugcaccggcagugguuucuggauuuaccucugccauggcuccccggcgcugacacacagggaagcaauuggauacagaaggagacgcuugucaccuucaagaacccucaugccaaaaagcaagacgugguugugcugggcucucaggaaggggcgaugcacacugccuugacaggagcaaccgagauucagauguccucagguaaucuacuguuuacaggccaucucaaaugccgucugcgcauggauaaacuucaacugaaagggaugagcuacaguauguguacuggaaaguucaagaucgucaaagaaaucgcugagacccagcacggcacgauugugaucagaguacaguaugagggugacgggucuccaugcaagauucccuucgaaauaaccgauuuggagaaaaggcauguucucggccggcugaucacagugaacccgauugucacugaaaaggacuccccugugaacaucgaggccgaacccccauuuggagauagcuacaucauugucggcguggagccugggcaguuaaaacugaauugguucaagaagggaucgucuauaggucaaauguuugagaccacaaugcgaggcgcuaaacgcauggccauccuaggggacacugcaugggauuucggaucccucggcgguguuuuuaccucaauugggaaggcccugcaccagguguucggcgcuaucuacggagcggcauuuaguggcguaagcuggacgaugaaaauucuuaucggggucauaaucacauggauuggaaugaacuccagaucuaccagcuugucagugagucugguucucgugggcgucgugacucuguaucuuggugccaugguacaggcugacuccggguguaucgugagcuggaagaauaaagaacugaagugcggaucuggcauuuucaucacagauaacguucacaccuggacugagcaguacaaguuucaacccgaaucaccaaguaaauuggccagcgcaauacagaaggcccaugaggaagguauuuguggcaucagguccgucacccggcucgagaaucugauguggaaacagauuacacccgaguuaaaccacauccugucugaaaaugaggugaagcuaacgauaaugaccggggacaucaaaggaauuaugcaggcuggcaagcgcucgcucagaccucaaccaacugaacugaaauauagcuggaagacaugggggaaggccaaaaugcuuuccaccgagucacauaaccagacauucuugaucgauggaccggaaacugcagagugccccaauaccaacagggcguggaauagucuggagguggaagacuacggcuuuggugucuucacgacaaacauuuggcucaagcugcgugagaaacaggacguauuuugugauucuaaguuaaugagcgcugccaucaaagacaaucgggcagugcacgccgauaugggguauuggauagaauccgcucugaacgacaccuggaagauggagaaggccucauucauugaggugaaaagcugccacuggccuaagucucauacucuuugguccaauggaguauuggaaagugagaugaucauccccaagaauuucgcaggccccgucagccagcacaacuaccgaccugguuaucauacccaaacagcuggcccauggcaccucgggaagcuggaaauggauuuugacuucugugagggaacuaccgugguugugacagaagauugcggcaauagagggcccucucuaaggacgaccacugccuccggaaaacugauuacagaguggugcugucgcucaugcacccucccgccucugcgguacagaggcgaggacgguuguugguacgggauggaaaucaggccacuuaaggagaaggaagagaacuuggucaauagucuggugacugcgggacauggccagauugauaacuuuagcuuagguguucucggcauggcccuguuccuugaagagaugcugcgcacacgaguggggaccaaacacgcuauauugcucguagcacugucguuugucacgcuaaucacuggaaauauguccuuccgggaccugggccgugugauggugauggucggggccaccaugacagaugacauuggaaugggcguuaccuaucucgcucugcuugccgcauuuaaggugagacccacuuucgcggccgguuugcuguuaaggaaacucacaucuaaggagcugaugauggcuaccaucgggauugcccuucugagccagucaacacuaccugaaacuauccucgagcugaccgaugcauuggcucugggaaugauggccuuaaaaauaguacgcaacauggaaaaguaccaacucgcagugacgaucauggccauuaguugcguccccaaugcugugauccugcagaacgcguggaagguuuccuguacaauucuugccgcagugucugucagcccacuguugcucaccuccucacagcagaaagcugacuggaucccucuggcccuaacuauaaagggccugaaucccaccgccauuuuucuuacaacucucagccggaccaguaaaaagagaucuuggccacugaacgaggcuaucauggcagugggcaugguuuccaucuuggccagcucgcugcuaaagaaugacauuccgaugacggggccucucguggcgggaggucugcuuacagucugcuauguacugaccggcaggucagcugauuuggaacucgagcgagccgcagacgugaagugggaggaucaagccgaaauaucugggaguucccccauccugagcauuacuaucucugaggacggaagcauguccauuaaaaacgaagaggaggaacagacacuaaccauccugauacgcacuggccuucucguuaucucagguguguucccagucaguauucccaucacagcugcagccugguaccugugggaggugaagaagcagcgggcggggguauugugggaugugccuagcccacccccugucggaaaagcugaauuagaggacggcgccuauagaauuaagcagaggggcauccugggguacucucaaauaggagccgguguuuauaaagaaggcaccuuucacacgauguggcaugugacucguggggcagugcucaugcaccgcggaaagcggauugagccguccugggcugaugucaaaaaggaccugaucucauacggcgguggguggaaacuugagggagaauggaaagagggcgaagaggugcagguucuggccuuggaaccaggcaagaaucccagagcaguacagaccaaaccugggaucuucaagacaaacaccggaacaauuggugcugugagucuagauuuuagcccaggcacuuccgggucucccaucgucgacaggaaaggaaaggugguuggccuguacgguaaugggguggucacccgaucgggagccuaugugagcgcgauagcccagacggagaagucaauugaggauaacccugaaaucgaggacgauauuuuccggaaaaagcgccucacaaucauggaccugcauccgggcgcaggcaaaacuaagagauaccuucccgcuauaguaagggaagccauuaaacggggguuacgaacccugauccucgcuccaacaagagucguggcagccgagauggaagaggccuugcgcggacugccuaucagguaucaaacccccgcuauucgugcggagcacacuggucgggaaaucguugaccucaugugucaugcaaccuucacaaugagacugcuuuccccagugagggucccuaacuacaaucugauuauaauggaugaggcccacuuuacggaccccgcuaguaucgccgcacgcggcuauauuucuacucgaguggaaaugggggaggccgcuggaaucuucaugaccgcgacaccaccgggcagcagagauccuuuuccccaguccaacgccccaaucauggacgaggaacgggagauucccgaaaggucauggaacucuggucacgaguggguuaccgauuucaaggggaagacugugugguuugucccuagcauaaaagcaggaaacgacaucgcugccugcuugcgcaagaauggcaaaaaggugauucagcuaagucguaaaacauucgauuccgaauacguaaagaccagagcaaacgacugggauuuugugguuacgacugacaucagcgagaugggcgccaauuucaaggcugagcgggucauugauccaaggcgcuguaugaaacccgugauccugacagacggggaggaacgagugauacucgccggaccuaugccggucacccauucuucagcggcacaaagacgggguaggaucggccgcaacccaaagaaugaaaacgaccaguauauuuacaugggggagcccuuagaaaaugaugaggacugcgcccacuggaaagaggcuaagaugcugcuugauaacaucaauaccccugaaggaauuauccccuccauguuugagccagaaagagagaaaguagacgccauagauggcgaauacaggcugcggggugaggcucguaagacuuucguggaccucaugcgccgaggggauuugccuguuuggcuggcauauaaaguggccgcugagggcauuaacuacgccgacagaaagugguguuuugauggaaucaagaauaaccagauucucgaagagaacgucgaaguggagaucuggacaaaagagggcgaaaggaagaaacugaagccccgguggcuugacgcacgcauauauagugauccacuagcgcugaaagaguucaaggaguucgccgcugggagaaagagcuugaccuuaaaucugaucacagagaugggaaggcucccuacuuuuaugacgcagaaagcccggaacgcacuggacaaucuugcuguucugcauaccgccgaaguggguggcaaggcauacacacacgcccucucggaguugccggagacucuggaaacccuacugcuccuuacacuguuagcugcggucaccgggggaauuuucuuguuucugaugucuggcaaagguaucgggaagaugacucucggcaugugcugcauuaucacggccuccauacugcuuugguaugcacaaauucagccccacuggaucgcugccagcaucauucuggaguucuuucucaucguguugcugauaccagaaccugagaaacagcgaaccccacaggauaaccaauuaacauacguagugauugccauccuaacuguugucgcagcuaccauggccaaugaaaugggauuccuggagaagacaaagaaagaccucggcuuugggucaauuaccacucaggagagugaaucuaacauccuugacauagaucugagaccagcguccgcuuggacauuguaugccguggcaacgaccuucgugacuccuaugcugcgccauagcaucgaaaauucaagugucaacguuagccucacagccauugcuaaucaggcaaccgugcugaugggacuugguaagggcuggccccucuccaaaauggacaucgggguaccgcuguuggccauuggauguuacucucaggugaacccaaucacccugacagcggcuuuacuacugcucgucgcccacuacgcaauuaucggcccuggucuucaagccaaggcuacuagggaagcccagaaacgggcagcugccgggauaaugaagaaucccacgguggauggcauuaccguuaucgaccuggagccaauccccuaugauccuaaguuugaaaaacaguugggacaggugaugcugcucauucugugcgucacacaaguacuuaugaugcguacuaccugggcguuaugugaggcccugacacucgcaaccggcccgauaagcacuuugugggaggggaaccccggaagauucuggaauacgacaaucgcuguguccauggccaacauuuuuaggggcucauaccuggccggugcugggcuacuguucucuaucaugaagaauaccacuaacacccgccggggaacaggcaauguuggugaaacucucggcgagaaauggaagagucgacuuaacgcccuggggaaaucggaauuucagauuuauaagaaaagcggaauccaggagguggacagaaccuuggccaaggagggcauaaagagaggggaaacagaucaucacgcggucucccgcggaucugcuaaacugcggugguucguggagagaaacauggucacgccagaaggcaaggugguugaccucgguugcgggcguggaggcuggucauacuauugugguggccugaaaaaugugagggagguaaagggguuaaccaaaggaggcccugggcaugaggaacccaucccuaugagcacuuacggauggaaccuugugcggcugcaauccggcgucgauguuuucuuuacaccacccgagaugugcgacacccuccuaugugauauuggugaaaguucuccuaauccaacuaucgaggcagggcgcacacugcgaguguugaaccuggucgaaaauuggcucaacaauaacacccaguucugcauuaaggugcuuaaucccuauaugccgagcguaaucgagaagauggaaacgcugcagagaaaauacggaggcgccuuggugaggaacccucugucaagaaauuccacccacgagauguacuggguuaguaacgcuacaggcaauauagugagcucugucaacaugauuucccgcaugcucaucaauagauuuacuaugaagcacaaaaaggccaccuaugagccagacguggauuuagggucaggaacaaggaacaucgguauugaaagcgagauacccaaccuggacaucgucggcaaacgaauugaaaagaucaagcaggagcaugaaacuucguggcacuacgaccaagaucauccuuauaaaaccugggcauaccacgggucuuaugagacaaagcagaccggaagugccuccagcauggugaauggcguuguacggcuucugacuaaaccaugggacgugguccccauggugacgcagauggcuaugacagauaccacuccguucggucagcaacguguuuuuaaggagaaaguggacaccagaacacaggaaccuaaggaggggacgaagaaacuaaugaagauuaccgcggaauggcucuggaaagagcugggaaaggagaaaacuccccgcauguguacaagggaagaguucacccggaaggucagaucaaacgccgcauugggcgcuguguuuacugaugaaaauaaauggaaguccgcccgcgaggcaguagaagacggcagguucugggagcugguggaucgagagcggaaccuccaccuugaagggaagugcgagacauguguuuacaauaugaugggaaaaagagaaaagaaacugggugaguuuggcaaggccaaagggucuagggcuaucugguauaugugguuaggagcccgcuuccuggaauuugaggcguugggcuuccucaacgaggaccauugguuuagccgugguaauagucuguccggggucgaaggagagggccuacaccggcuuggcuacauacugagagaaguggggaagaaggagggaggugcaauguacgccgaugacaccgcuggcugggauacaaggaucacucucgaagaccugaaaaacgaggagauggugaccaaucauaugaagggggaacacaaaaaguuggccgaggcaauuuucaaacugacguaucagaacaaggucguucgcgugcagcgaccaaccccucggggaacaguaauggacaucauuagcagaaaggaucaaaggggcucuggucagguggggacuuacggacucaauaccuucacaaacauggaagcucagcuuauccgccaaauggagggcgagggcauuuuuaaaucaauacagcaucugacugccaccgaagagaucgcuguccagaauugguuagccagaguggggcgggaaaggcugagucguauggcaauuuccggagacgauugcguugugaagcccaucgacgaucgauucgcgagcgccuugacggcucucaacgacauggguaaaguccgcaaggauauccagcaaugggagccaucuagaggcuggaaugacuggacacaggugcccuuuugcucgcaccacuuccaugaacugguaaugaaagaugggcggguucuaguggucccuuguaggaaccaggacgagcuuauuggacgcgccagaauaucacagggcgcagguuggagccugaaggagaccgcuugccucgggaaguccuaugcccaaauguggacucugauguacuuucaccggagggauuugcgauuagcagccaacgcgaucuguagugcugugccaucucauugggugccgacaagccguaccacuugguccauucacgccaaacacgaauggaugaccacagaggacaugcuggucguuuggaauagaguguggauccaggaaaaccccuggauggaggauaagacgccuguagaaucaugggaggaggugccauaucucggaaaacgcgaagaccaguggugcggcagucuuauuggccugaccucucgggcaacuugggccaagaauauccagacagcuauaaaccaagucaggagccuaaucgggaaugagggauacaccgacuauaugcccuccaugaaaagauuccgccgggaagaggaagaggccggugugcugugguga

SEQ ID NO: 14581 - RNA, 9876 nt, Artificial Sequence
  derived and/or modified CDS sequence (opt3) from DENV-2__KC294221__SS-prME
accgccggagugaucgucaugcugauucccacggcuauggcauuccaccucacuacgagaaacggggagccucauaugauaguuggaaggcaggaaaaggguaaaagccuucuguuuaagaccgaggacggcgugaauaugugcacauugauggccaucgauuuaggggaacugugugaggacacuauuaccuacaaaugcccauuacuccggcaaaacgaaccggaggauaucgacuguuggugcaauuccacaucuaccuggguuacuuauggaacauguaccacgacuggcgagcaccgccgagaaaagcguucaguggcgcuggucccccauguggguauggggcuugagaccagaacagaaacuuggaugaguagcgagggagcuuggaaacacguucagaggauugagaccuggauccugcggcauccuggcuucacaauaauggccgcaaucuuggccuacaccauuggcacgacucacuuucagcgcgcucucaucuucauucugcugacagcaguggccccauccaugaccaugagaugcaucgggauaucuaacagggauuuugucgaaggagugucggguggcucauggguagacauuguucucgagcacgggagcugugugacuacaauggcuaagaauaagcccaccuuagauuucgaacugaucaaaacggaggccaagcagccugcgacccuucggaaauauugcauugaagcaaaguugacaaacacuaccacagagagucgcuguccaacucaaggagagcccucccugaaugaagaacaggacaaacgauuuaucugcaagcauucuauggucgauagaggcugggguaacggguguggacuauucggcaagggcgggaucgugaccugcgccauguuuacaugcaaaaagaauauggaaggaaaaauugugcagccugagaaccucgaauacaccauagucaucacuccacacagcggugaggagcaugcuguuggcaaugacacggggaagaggggaaaagaaauuaagaucacaccgcaguccucaaccacugaggccgaacugaccggcuaugguacagugaccauggaguguaguccccggacugggcuugauuucaacgaaaugguacuguugcaaauggaggacaaagcauggcucgugcaccgucagugguuucuggauuuaccucugccauggcuccccggcgcugacacacagggaagcaauuggauacagaaggagacgcuugucaccuucaagaacccucacgccaaaaagcaagacgugguugugcugggcucucaggaaggggcgaugcauacugccuugacaggagcaaccgagauucagauguccucagguaaucuacuguuuacaggccaccucaaaugccgccugagaauggauaaacuucaacugaaagggaugagcuacaguauguguacuggaaaguucaagaucgucaaagaaaucgcugagacccagcauggcacgauugugaucaggguacaguaugagggugacgggucuccaugcaagauucccuucgaaauaaccgauuuggagaaacggcacguucucggccgacugaucacagugaacccgauugucacugaaaaggacuccccugugaacaucgaggccgaacccccauuuggagauagcuacaucauugucggcguggagccugggcaguuaaaacugaauugguucaagaagggaucgucuauaggucaaauguuugagaccacaaugcgcggcgcuaaaagaauggccauccuaggggacacugcaugggauuucggaucccucggcgguguuuuuaccucaauugggaaggcccugcaucagguguucggcgcuaucuacggagcggcauuuaguggcguaagcuggacgaugaaaauucuuaucggggucauaaucacauggauuggaaugaacuccaggucuaccagcuugucagugagucugguucucgugggcgucgugacucuguaucuuggugccaugguacaggcugacuccggguguaucgugagcuggaagaauaaagaacugaagugcggaucuggcauuuucaucacagauaacguucacaccuggacugagcaguacaaguuucaacccgaaucaccaaguaaauuggccagcgcaauacagaaggcccacgaggaagguauuuguggcauccgguccgucacccgccucgagaaucugauguggaaacagauuacacccgaguuaaaccauauccugucugaaaaugaggugaagcuaacgauaaugaccggggacaucaaaggaauuaugcaggcuggcaagagaucgcucaggccucaaccaacugaacugaaauauagcuggaagacaugggggaaggccaaaaugcuuuccaccgagucacacaaccagacauucuugaucgauggaccggaaacugcagagugccccaauaccaaccgugcguggaauagucuggagguggaagacuacggcuuuggugucuucucuacgaacauuuggcucaagcugcgggagaaacaggacguauuuugugauagcaaguuaauguccgcugccaucaaagacaaucgagcagugcaugccgauaugggguauuggauagaaucagcucugaacgacacauggaagauggagaaggccagcuucauugaggugaaaucuugccacuggccuaagucccacacccuuuggaguaauggaguauuggaaagcgagaugaucauccccaagaacuucgcaggccccgucucucagcauaacuacagaccugguuaucacacucaaaccgcuggcccauggcaucucgggaagcuggaaauggauuuugacuucugugagggaacaacugugguugugaccgaagauugcggcaauagggggcccucccuacgcacaacgaccgccucaggaaaacugauuacugaguggugcugucggaguugcacacucccgccucugagauacaggggcgaggacgguuguugguacgggauggaaauccgcccacuuaaggagaaggaagagaacuuggucaauagccuggugaccgcgggacacggccagauugauaacuuuucguuagguguucucggcauggcccuguuccuugaagagaugcugcgaacucggguggggacaaaacaugcuauauugcucguagcacuguccuuugucacccuaaucacgggaaauaugucuuuccgugaccugggcagagugauggugauggucggggccacuaugaccgaugacauuggaaugggcguuacauaucucgcucugcuugccgcauuuaaggugaggcccaccuucgcggccgguuugcuguuacgcaaacucacuagcaaggagcugaugauggcuacaaucgggauugcccuucugucacagaguacccuaccugaaacaauccucgagcugacugaugcauuggcucugggaaugauggccuuaaaaauaguacggaacauggaaaaguaccaacucgcagugaccaucauggccauuuccugcguccccaaugcugugauccugcagaacgcguggaagguuucuuguacgauucuugccgcagugagcgucuccccacuguugcucacaucaagccagcagaaagcugacuggaucccucuggcccuaaccauaaagggccugaaucccacugccauuuuucuuaccacacucaguagaacuucuaaaaagagguccuggccacugaacgaggcuaucauggcagugggcaugguuagcaucuuggccucgucacugcuaaagaaugacauuccgaugaccgggccucucguggcgggaggucugcuuacggucugcuauguacugacaggccgaucugcugauuuggaacucgagcgcgccgcagacgugaagugggaggaucaagccgaaauaaguggguccagccccauccugucuauuaccaucagcgaggacggauccaugucaauuaaaaacgaagaggaggaacagacucuaacaauccugauacggaccggccuucucguuaucagugguguguucccagucagcauucccaucacugcugcagccugguaccugugggaggugaagaagcagagagcggggguauugugggaugugccuucuccacccccugucggaaaagcugaauuagaggacggcgccuauaggauuaagcagcguggcauccugggguacucccaaauaggagccgguguuuauaaagaaggcacauuucacaccauguggcacgugacgcgcggggcagugcucaugcaucggggaaagagaauugagccgucaugggcugaugucaaaaaggaccugaucaguuacggcgguggguggaaacuugagggagaauggaaagagggcgaagaggugcagguucuggccuuggaaccaggcaagaaucccagggcaguacagacuaaaccugggaucuucaagaccaacacaggaaccauuggugcugugagccuagauuuuuccccaggcacaucugggucgcccaucgucgaccgaaaaggaaaggugguuggccuguacgguaaugggguggucacucggagcggagccuaugugucagcgauagcccagaccgagaaguccauugaggauaacccugaaaucgaggacgauauuuuccgcaaaaagagacucacgaucauggaccugcacccgggcgcaggcaaaacaaagagguaccuucccgcuauaguacgggaagccauuaaacgaggguuaagaacucugauccucgcuccaacccgcgucguggcagccgagauggaagaggccuugaggggacugccuauccguuaucaaacacccgcuauucgggcggagcauaccgguagagaaaucguugaccucaugugucacgcaacuuucaccaugaggcugcuuaguccagugcgcgucccuaacuacaaucugauuauaauggaugaggcccauuuuacagaccccgcuucuaucgccgcacgaggcuauauuagcacgagaguggaaaugggggaggccgcuggaaucuucaugacugcgaccccaccgggcucccgggauccuuuuccccagucaaacgccccaaucauggacgaggaaagggagauucccgaacgcucuuggaauagcggucacgaguggguuacagauuucaaggggaagaccgugugguuugucccuaguauaaaagcaggaaacgacaucgcugccugcuugcguaagaauggcaaaaaggugauucagcuauccagaaaaacuuucgauagcgaauacguaaagacacgggcaaacgacugggauuuugugguuaccacggacaucucugagaugggcgccaauuucaaggcugagagggucauugauccacgccgauguaugaaacccgugauccugacugacggggaagagagagugauacucgccggaccuaugccggucacacacucauccgcggcacaacggaggggucgcaucggcagaaacccaaagaaugaaaacgaccaguauauuuacaugggggagcccuuagaaaaugaugaggacugcgcccauuggaaagaggcuaagaugcugcuugauaacaucaauaccccugaaggaauuauccccaguauguuugagccagaaagggagaaaguagacgccauagauggcgaauaccggcugcguggugaggcucgcaagaccuucguggaccucaugcgaagaggggauuugccuguuuggcuggcauauaaaguggccgcugagggcauuaacuacgccgacaggaagugguguuuugauggaaucaagaauaaccagauucucgaagagaacgucgaaguggagaucuggacuaaagagggcgaacggaagaaacugaagccccgcuggcuugacgcaagaauauauagcgauccacuagcgcugaaagaguucaaggaguucgccgcugggaggaagucguugacauuaaaucugaucaccgagaugggacggcucccuacauuuaugacucagaaagcccgaaacgcacuggacaaucuugcuguucugcacacggccgaaguggguggcaaggcauacacccaugcccucucugaguugccggagacacuggaaacucuacugcuccuuacccuguuagcugcggucacagggggaauuuucuuguuucugauguccggcaaagguaucgggaagaugacccucggcaugugcugcauuaucacugccagcauacugcuuugguaugcacaaauucagccccacuggaucgcugccucaaucauucuggaguucuuucucaucguguugcugauaccagaaccugagaaacagagaacgccccaggauaaccaauuaaccuacguagugauugccauccuaacaguugucgcagcuacuauggccaaugaaaugggauuccuggagaagaccaagaaagaccucggcuuugggaguauuacaacccaggagucugaauccaacauccuugacauagaucugcgcccagcgagcgcuuggacuuuguaugccguggcaacaacguucgugaccccuaugcugaggcacucaaucgagaauaguagcgucaacguuucccucacugccauugcuaaucaggcaacagugcugaugggacuugguaagggcuggccccucucuaaaauggacaucgggguaccgcuguuggccauuggauguuacagccaggugaacccaaucacccugaccgcggcuuuacuacugcucgucgcccauuacgcaauuaucggcccuggucuucaagccaaggcuacacgggaagcccagaaacgugcagcugccgggauaaugaagaaucccacuguggauggcauuacgguuaucgaccuggagccaauccccuaugauccuaaguuugaaaaacaguugggacaggugaugcugcucauucugugcgucacccaaguacuuaugaugagaacaacuugggcguuaugugaggcccugacccucgcaacaggcccgauauccaccuugugggaggggaaccccggaagguucuggaauacuacgaucgcugugucaauggccaacauuuuucgcggcucuuaccuggccggugcugggcuacuguucaguaucaugaagaauacaaccaacacucggcgaggaaccggcaauguuggugaaacacucggcgagaaauggaagucgagacuuaacgcccuggggaaaagcgaauuucagauuuauaagaaauccggaauccaggagguggacaggacuuuggccaaggagggcauaaagcgcggggaaaccgaucaccaugcggucucucggggaucagcuaaacugagaugguucguggagcguaacauggucacaccagaaggcaaggugguugaccucgguugcgggaggggaggcuggagcuacuauugugguggccugaaaaaugugcgggagguaaagggguuaacgaaaggaggcccugggcacgaagaaccaaucccuauguccaccuacggauggaaccuugugcgccugcaaaguggcgucgauguuuucuuuacuccacccgagaagugcgacacacuccuaugugauauuggugaaucuagcccuaauccaaccaucgaggcagggcgaacucugagaguguugaaccuggucgaaaauuggcucaacaauaacacacaguucugcauuaaggugcuuaaucccuauaugccgucaguaaucgagaaaauggaaacccugcagaggaaguacggaggcgccuuggugcggaacccucugucccgcaauaguacgcaugagauguacuggguuagcaacgcuaccggcaauauagugucuuccgucaacaugauuucaagaaugcucaucaauagguuuacaaugaaacacaagaaagccacuuaugagccagacguggauuuagggagcggaacccgaaacaucgguauugaaucggagauacccaaccuggacaucgucggcaagcggauugaaaagaucaaacaggagcacgaaacaucuuggcauuacgaccaagaucacccuuauaagacuugggcauaccaugggaguuaugagaccaaacagacaggauccgccagcucaauggugaauggcguuguacgucuucugaccaagccaugggacgugguccccauggugacucagauggcuaugacggauacaaccccguucggucagcaaagaguuuuuaaagagaagguggacacucgcacccaggaaccuaaggaggggacgaaaaagcuaaugaaaauuacagcggaauggcucuggaaggagcugggaaaagagaagacccccaggauguguacucgggaagaguucacaagaaaaguccgcuccaacgccgcauugggcgcuguguuuaccgaugaaaauaaguggaagucugccagggaggcaguagaagacggccgauucugggagcugguggaucgggagagaaaccuccaccuugaagggaaaugcgagacuuguguuuacaauaugaugggaaagagggagaaaaagcugggugaguuuggcaaagccaaggggagccgcgcuaucugguauaugugguuaggagcccguuuccuggaauuugaggcguugggcuuccucaacgaggaccacugguuuagucgggguaauucccugagcggggucgaaggagagggccuacauagacuuggcuacauacugagggaaguggggaagaaagagggaggugcaauguacgccgaugacacagcuggcugggauacccgcaucacacucgaagaccugaagaacgaggagauggugacuaaucacaugaaaggggaacauaagaaauuggccgaggcaauuuucaagcugaccuaucagaacaaggucguucgagugcagcggccaacgccuagaggaaccguaauggacaucauuucuaggaaagaucaacgcggcucaggucagguggggacauacggacucaauacuuucaccaacauggaagcucagcuuaucagacaaauggagggcgagggcauuuuuaagaguauacagcaccugacagccacugaagagaucgcuguccagaauugguuagcccggguggggagggaacgucugucccgaauggcaauuagcggagacgauugcguugugaaacccaucgacgaucgcuucgcgucugccuugaccgcucucaacgacauggguaaggucagaaaagauauccagcaaugggagccaucgcggggcuggaaugacuggacacaggugcccuuuugcucacaucacuuccacgaacugguaaugaaggaugggaggguucuaguggucccuugucgcaaccaggacgagcuuauuggcagagcacggauaagccagggcgcagguuggucccugaaggagacagcuugccucgggaaaaguuaugcccaaauguggacccugauguacuuucauaggcgagauuugcguuuagcagccaacgcgaucuguucugcugugccaagccacugggugccgacuuccagaacaaccuggucaauucaugccaagcacgaauggaugacuaccgaggacaugcuggucguuuggaaucgcguguggauccaggaaaaccccuggauggaggauaaaacaccuguagaaaguugggaggaggugccauaucucggaaagcgggaagaccaguggugcggcucucuuauuggccugacgagcagggcaaccugggccaaaaauauccagacugcuauaaaccaagucagaucccuaaucgggaaugagggauacacagacuauaugcccucaaugaagcgcuuccggagggaagaggaagaggccggugugcugugguga

SEQ ID NO: 14582 - RNA, 9876 nt, Artificial Sequence
  derived and/or modified CDS sequence (opt3) from DENV-2__KC294223__SS-prME
accgcaggcgugaucgucaugcugauucccacagcuauggcauuccaccucacuacgaggaacggggagccucauaugauaguuggaaggcaggaaaaggguaaaagccuucuguuuaagaccgaggacggcgugaauaugugcacauugauggccaucgauuuaggggaacugugugaggacacuauuaccuacaaaugcccauuacuccggcaaaacgaaccggaggauaucgacuguuggugcaauuccacaucuaccuggguuacuuauggaacauguaccacgacuggcgagcaccgccgagaaaagcguucaguggcgcuggucccccauguggguauggggcuugagacccggacagaaacuuggaugaguagcgagggagcuuggaaacacguucagaggauugagaccuggauccugcggcauccuggcuucacaauaauggccgcaaucuuggccuacaccauuggcacgacucacuuucagcgcgcucucaucuucauucugcugacagcaguggccccauccaugaccaugagaugcaucgggauaucuaacagggauuuugucgaaggagugucggguggcucauggguagacauuguucucgagcacgggagcugugugacuacaauggcuaagaauaagcccaccuuagauuucgaacugaucaaaacggaggccaagcagccugcgacccuucggaaauauugcauugaagcaaaguugacaaacacuaccacagagagucgcuguccaacucaaggagagcccucccugaaugaggaacaggacaaacgauuuaucugcaagcauucuauggucgauagaggcugggguaacggguguggacuauucggcaagggcgggaucgugaccugcgccauguuuacaugcaaaaagaauauggaaggaaaaauugugcagccugagaaccucgaauacaccauagucaucacuccacacagcggugaggagcaugcuguuggcaaugacacggggaagcacggaaaagaaauuaagaucacaccgcaguccucaaccacugaggccgaacugaccggcuaugguacagugaccauggaguguagucccaggacugggcuugauuucaacgaaaugguacuguugcaaauggaggacaaagcauggcucgugcaccggcagugguuucuggauuuaccucugccauggcuccccggcgcugacacacagggaagcaauuggauacagaaggagacgcuugucaccuucaagaacccucaugccaaaaagcaagacgugguugugcugggcucucaggaaggggcgaugcacacugccuugacaggagcaaccgagauucagauguccucagguaaucuacuguuuacaggccaucucaaaugccgucugcgcauggauaaacuucaacugaaagggaugagcuacaguauguguacuggaaaguucaagaucgucaaagaaaucgcugagacccagcacggcacgauugugaucagaguacaguaugagggugacgggucuccaugcaagauucccuucgaaauaaccgauuuggagaaaaggcauguucucggccggcugaucacagugaacccgauugucacugaaaaggacuccccugugaacaucgaggccgaacccccauuuggagauagcuacaucauugucggcguggagccugggcaguuaaaacugaauugguucaagaagggaucgucuauaggucaaauguuugagaccacaaugcgaggcgcuaaacgcauggccauccuaggggacacugcaugggauuucggaucccucggcgguguuuuuaccucaauugggaaggcccugcaccagguguucggcgcuaucuacggagcggcauuuaguggcguaagcuggacgaugaaaauucuuaucggggucauaaucacauggauuggaaugaacuccagaucuaccagcuugucagugagucugguucucgugggcgucgugacucuguaucuuggugccaugguacaggcugacuccggguguaucgugagcuggaagaauaaagaacugaagugcggaucuggcauuuucaucacagauaacguucacaccuggacugagcaguacaaguuucaacccgaaucaccaaguaaauuggccagcgcaauacagaaggcccaugaggaagguauuuguggcaucagguccgucacccggcucgagaaucugauguggaaacagauuacacccgaguuaaaccacauccugucugaaaaugaggugaagcuaacgauaaugaccggggacaucaaaggaauuaugcaggcuggcaagcgcucgcucagaccucaaccaacugaacugaaauauagcuggaagacaugggggaaggccaaaaugcuuuccaccgagucacauaaccagacauucuugaucgauggaccggaaacugcagagugccccaauaccaacagggcguggaauagucuggagguggaagacuacggcuuuggugucuucacgacaaacauuuggcucaagcugcgugagaaacaggacguauuuugugauucuaaguuaaugagcgcugccaucaaagacaaucgggcagugcacgccgauaugggguauuggauagaauccgcucugaacgacaccuggaagauggagaaggccucauucauugaggugaaaagcugccacuggccuaagucucauacucuuugguccaauggaguauuggaaagugagaugaucauccccaagaauuucgcaggccccgucagccagcacaacuaccgaccugguuaucauacccaaacagcuggcccauggcaccucgggaagcuggaaauggauuuugacuucugugagggaacuaccgugguugugacagaagauugcggcaauagagggcccucucuaaggacgaccacugccuccggaaaacugauuacagaguggugcugucgcucaugcacccucccgccucugcgguacagaggcgaggacgguuguugguacgggauggaaaucaggccacuuaaggagaaggaagagaacuuggucaauagucuggugacugcgggacauggccagauugauaacuuuagcuuagguguucucggcauggcccuguuccuugaagagaugcugcgcacacgaguggggaccaaacacgcuauauugcucguagcacugucguuugucacgcuaaucacuggaaauauguccuuccgggaccugggccgugugauggugauggucggggccaccaugacagaugacauuggaaugggcguuaccuaucucgcucugcuugccgcauuuaaggugagacccacuuucgcggccgguuugcuguuaaggaaacucacaucuaaggagcugaugauggcuaccaucgggauugcccuucugagccagucaacacuaccugaaacuauccucgagcugaccgaugcauuggcucugggaaugauggccuuaaaaauaguacgcaacauggaaaaguaccaacucgcagugacgaucauggccauuaguugcguccccaaugcugugauccugcagaacgcguggaagguuuccuguacaauucuugccgcagugucugucagcccacuguugcucaccuccucacagcagaaagcugacuggaucccucuggcccuaacuauaaagggccugaaucccaccgccauuuuucuuacaacucucagccggaccaguaaaaagagaucuuggccacugaacgaggcuaucauggcagugggcaugguuuccaucuuggccagcucgcugcuaaagaaugacauuccgaugacggggccucucguggcgggaggucugcuuacagucugcuauguacugaccggcaggucagcugauuuggaacucgagcgagccgcagacgugaagugggaggaucaagccgaaauaucugggaguucccccauccugagcauuacuaucucugaggacggaagcauguccauuaaaaacgaagaggaggaacagacacuaaccauccugauacgcacuggccuucucguuaucucagguguguucccagucaguauucccaucacagcugcagccugguaccugugggaggugaagaagcagcgggcggggguauugugggaugugccuagcccacccccugucggaaaagcugaauuagaggacggcgccuauagaauuaagcagaggggcauccugggguacucucaaauaggagccgguguuuauaaagaaggcaccuuucacacgauguggcaugugacucguggggcagugcucaugcaccgcggaaagcggauugagccguccugggcugaugucaaaaaggaccugaucucauacggcgguggguggaaacuugagggagaauggaaagagggcgaagaggugcagguucuggccuuggaaccaggcaagaaucccagagcaguacagaccaaaccugggaucuucaagacaaacaccggaacaauuggugcugugagucuagauuuuagcccaggcacuuccgggucucccaucgucgacaggaaaggaaaggugguuggccuguacgguaaugggguggucacccgaucgggagccuaugugagcgcgauagcccagacggagaagucaauugaggauaacccugaaaucgaggacgauauuuuccggaaaaagcgccucacaaucauggaccugcauccgggcgcaggcaaaacuaagagauaccuucccgcuauaguaagggaagccauuaaacggggguuacgaacccugauccucgcuccaacaagagucguggcagccgagauggaagaggccuugcgcggacugccuaucagguaucaaacccccgcuauucgugcggagcacacuggucgggaaaucguugaccucaugugucaugcaaccuucacaaugagacugcuuuccccagugagggucccuaacuacaaucugauuauaauggaugaggcccacuuuacggaccccgcuaguaucgccgcacgcggcuauauuucuacucgaguggaaaugggggaggccgcuggaaucuucaugaccgcgacaccaccgggcagcagagauccuuuuccccaguccaacgccccaaucauggacgaggaacgggagauucccgaaaggucauggaacucuggucacgaguggguuaccgauuucaaggggaagacugugugguuugucccuagcauaaaagcaggaaacgacaucgcugccugcuugcgcaagaauggcaaaaaggugauucagcuaagucguaaaacauucgauuccgaauacguaaagaccagagcaaacgacugggauuuugugguuacgacugacaucagcgagaugggcgccaauuucaaggcugagcgggucauugauccaaggcgcuguaugaaacccgugauccugacagacggggaagaacgagugauacucgccggaccuaugccggucacccauucuucagcggcacaaagacgggguaggaucggccgcaacccaaagaaugaaaacgaccaguauauuuacaugggggagcccuuagaaaaugaugaggacugcgcccacuggaaagaggcuaagaugcugcuugauaacaucaauaccccugaaggaauuauccccuccauguuugagccagaaagagagaaaguagacgccauagauggcgaauacaggcugcggggugaggcucguaagacuuucguggaccucaugcgccgaggggauuugccuguuuggcuggcauauaaaguggccgcugagggcauuaacuacgccgacagaaagugguguuuugauggaaucaagaauaaccagauucucgaagagaacgucgaaguggagaucuggacaaaagagggcgaaaggaagaaacugaagccccgguggcuugacgcacgcauauauagugauccacuagcgcugaaagaguucaaggaguucgccgcugggagaaagagcuugaccuuaaaucugaucacagagaugggaaggcucccuacuuuuaugacgcagaaagcccggaacgcacuggacaaucuugcuguucugcauaccgccgaaguggguggcaaggcauacacacacgcccucucggaguugccggagacucuggaaacccuacugcuccuuacacuguuagcugcggucaccgggggaauuuucuuguuucugaugucuggcaaagguaucgggaagaugacucucggcaugugcugcauuaucacggccuccauacugcuuugguaugcacaaauucagccccacuggaucgcugccagcaucauucuggaguucuuucucaucguguugcugauaccagaaccugagaaacagcgaaccccacaggauaaccaauuaacauacguagugauugccauccuaacuguugucgcagcuaccauggccaaugaaaugggauuccuggagaagacaaagaaagaccucggcuuugggucaauuaccacucaggagagugaaucuaacauccuugacauagaucugagaccagcguccgcuuggacauuguaugccguggcaacgaccuucgugacuccuaugcugcgccauagcaucgaaaauucaagugucaacguuagccucacagccauugcuaaucaggcaaccgugcugaugggacuugguaagggcuggccccucuccaaaauggacaucgggguaccgcuguuggccauuggauguuacucucaggugaacccaaucacccugacagcggcuuuacuacugcucgucgcccacuacgcaauuaucggcccuggucuucaagccaaggcuacuagggaagcccagaaacgggcagcugccgggauaaugaagaaucccacgguggauggcauuaccguuaucgaccuggagccaauccccuaugauccuaaguuugaaaaacaguugggacaggugaugcugcucauucugugcgucacacaaguacuuaugaugcguacuaccugggcguuaugugaggcccugacacucgcaaccggcccgauaagcacuuugugggaggggaaccccggaagauucuggaauacgacaaucgcuguguccauggccaacauuuuuaggggcucauaccuggccggugcugggcuacuguucucuaucaugaagaauaccacuaacacccgccggggaacaggcaauguuggugaaacucucggcgagaaauggaagagucgacuuaacgcccuggggaaaucggaauuucagauuuauaagaaaagcggaauccaggagguggacagaaccuuggccaaggagggcauaaagagaggggaaacagaucaucacgcggucucccgcggaucugcuaaacugcggugguucguggagagaaacauggucacgccagaaggcaaggugguugaccucgguugcgggcguggaggcuggucauacuauugugguggccugaaaaaugugagggagguaaagggguuaaccaaaggaggcccugggcaugaggaacccaucccuaugagcacuuacggauggaaccuugugcggcugcaauccggcgucgauguuuucuuuacaccacccgagaagugcgacacccuccuaugugauauuggugaaaguucuccuaauccaacuaucgaggcagggcgcacacugcgaguguugaaccuggucgaaaauuggcucaacaauaacacccaguucugcauuaaggugcuuaaucccuauaugccgagcguaaucgagaaaauggaaacgcugcagagaaaguacggaggcgccuuggugaggaacccucugucaagaaauuccacccacgagauguacuggguuaguaacgcuacaggcaauauagugagcucugucaacaugauuucccgcaugcucaucaauagauuuacuaugaaacacaagaaagccaccuaugagccagacguggauuuagggucaggaacaaggaacaucgguauugaaagcgagauacccaaccuggacaucgucggcaagcgaauugaaaagaucaaacaggagcaugaaacuucguggcacuacgaccaagaucauccuuauaagaccugggcauaccacgggucuuaugagacaaaacagaccggaagugccuccagcauggugaauggcguuguacggcuucugacuaagccaugggacgugguccccauggugacgcagauggcuaugacagauaccacuccguucggucagcaacguguuuuuaaagagaagguggacaccagaacacaggaaccuaaggaggggacgaaaaagcuaaugaaaauuaccgcggaauggcucuggaaggagcugggaaaagagaagacuccccgcauguguacaagggaagaguucacccggaaagucagaucaaacgccgcauugggcgcuguguuuacugaugaaaauaaguggaaguccgcccgcgaggcaguagaagacggcagguucugggagcugguggaucgagagcggaaccuccaccuugaagggaaaugcgagacauguguuuacaauaugaugggaaagagagagaaaaagcugggugaguuuggcaaagccaaggggucuagggcuaucugguauaugugguuaggagcccgcuuccuggaauuugaggcguugggcuuccucaacgaggaccauugguuuagccgugguaauagucuguccggggucgaaggagagggccuacaccggcuuggcuacauacugagagaaguggggaagaaagagggaggugcaauguacgccgaugacaccgcuggcugggauacaaggaucacucucgaagaccugaagaacgaggagauggugaccaaucauaugaaaggggaacacaagaaauuggccgaggcaauuuucaagcugacguaucagaacaaggucguucgcgugcagcgaccaaccccucggggaacaguaauggacaucauuagcagaaaagaucaaaggggcucuggucagguggggacuuacggacucaauaccuucacaaacauggaagcucagcuuauccgccaaauggagggcgagggcauuuuuaagucaauacagcaucugacugccaccgaagagaucgcuguccagaauugguuagccagaguggggcgggaaaggcugagucguauggcaauuuccggagacgauugcguugugaaacccaucgacgaucgauucgcgagcgccuugacggcucucaacgacauggguaagguccgcaaagauauccagcaaugggagccaucuagaggcuggaaugacuggacacaggugcccuuuugcucgcaccacuuccaugaacugguaaugaaggaugggcggguucuaguggucccuuguaggaaccaggacgagcuuauuggacgcgccagaauaucacagggcgcagguuggagccugaaggagaccgcuugccucgggaaauccuaugcccaaauguggacucugauguacuuucaccggagggauuugcgauuagcagccaacgcgaucuguagugcugugccaucucauugggugccgacaagccguaccacuugguccauucacgccaagcacgaauggaugaccacagaggacaugcuggucguuuggaauagaguguggauccaggaaaaccccuggauggaggauaaaacgccuguagaaucaugggaggaggugccauaucucggaaagcgcgaagaccaguggugcggcagucuuauuggccugaccucucgggcaacuugggccaaaaauauccagacagcuauaaaccaagucaggagccuaaucgggaaugagggauacaccgacuauaugcccuccaugaagagauuccgccgggaagaggaagaggccggugugcugugguga

SEQ ID NO: 14583 - RNA, 9876 nt, Artificial Sequence
  derived and/or modified CDS sequence (opt3) from DENV-2__FJ906959__SS-prME
accgccggcaugaucauuaugcugauacccacagugauggcuuuccaccucacuacgagaaacggggagccucauaugaucgucagcaggcaggaaaagggaaaaucccuucuguuuaagaccgaggacgguguuaauaugugcacauugauggcaauggauuuaggcgaacugugugaggacacuauuaccuacaaaugcccauuccuaaagcaaaacgaaccggaggauaucgacuguuggugcaauucuacaucaaccugggugacuuaugggacauguaccacgacuggagagcaccggcgcgaaaaacgaaguguagcccucgugccccaugucggcaugggucuggagacccguacagaaacuuggaugagcuccgagggggcguggaagcacgcucagagaauugagaccuggauccuuaggcauccuggauuuacaauaauggccgcaauccuggccuacaccauuggcacgacucacuuccagcgggcuuugaucuuuauucuccugacagcaguggccccaucuaugaccaugcgcugcaucggcauaucgaacagagauuucguugaaggggugucaggagguagcugggucgacauugugcuggagcacggcaguuguguaacuacaauggcuaagaauaaacccacccucgauuuugaauuaaucaagacggaggccaaacagccugcgacccugaggaaguauugcauugaagcaaaacuuacaaacacuaccacagacucccgguguccaacucaaggggagcccucuuugaaugaggaacaggauaagcgcuucguuugcaagcauagcaugguggaccgaggauggggcaacgguugugggcuguuuggaaaaggcggcaucgucaccugcgccauguucacaugcaagaaaaauaugaaggggaaaguggugcagccugagaaccuagaauacaccaucgucauuacuccacacuccggagaggaacaugcuguugguaaugauacgggcaagcacgggaaagagauaaagaucacaccgcagucaaguauuaccgaggccgaacucacuggauauggcaccgugacaauggaguguagccccagaaccggucuggacuuuaacgaaaugguacuucugcaaauggagaauaaggcaugguuggugcacaggcagugguuccucgaucugccuuuaccauggcugcccggggcugacacucagggcucuaacuggauccagaaagaaacacucgucacguuuaagaauccucaugccaaaaagcaagacgugguugugcuuggaucccaggagggcgcgaugcacaccgcccugacuggggcaacagagauacagaugucaagcggaaacuugcuauucaccggucaucugaaaugccggcuccguauggauaagcugcaacuuaagggcaugaguuacucuauguguacagggaaauucaaggucgugaaagaaauugcugagacucagcacggaaccaucguaauccgcguucaguaugaaggcgacgguuccccaugcaagauucccuuugagaucauggaucuggagaaaagacauguguuggggaggcucauuacggucaacccgauagugaccgaaaaggacagcccugucaauaucgaggccgaacccccauucggcgauucguacauuaucaucggaguggagccuggccagcugaaguuaaacugguuuaaaaaggggucuuccauuggacaaaugauagaaacaacuaugcggggugcuaaacgaauggccauccugggcgacaccgcaugggauuucgggucacuaggaggcguuuuuacaaguauugguaaggcccuccaccagguguucggggcuaucuacggcgcggcauuuagcggaguauccuggauuaugaaaauccugauaggcgucaucauuacuuggaucgggaugaauucucgcagcaccucacuuaguguguccuugguucuggugggagucgugacgcucuaucugggcguaauggugcaggccgacagcgguuguguugucucuuggaagaacaaggagcuuaaaugcgggucaggaauuuucaucacagauaaugugcacaccuggacugagcaguacaaguuucaacccgaaaguccaagcaaacuggcuuccgccauacagaaggcacaugaggaaggcauuugugguaucagaucugugacaagguuggagaaccucauguggaaacagauuacccccgaacugaaucacaucuuaucggagaacgaggucaagcugacuauaaugaccggcgacaucaaagggauuaugcaggccggaaagcggagccuacaaccucagccaacagaacucaaguauuccuggaaaacguggggcaaggcuaaaaugcugucaaccgagagucauaaucagacuuuccuuaucgaugggccggaaacagccgagugccccaacaccaaucgcgcauggaacucuuuggaaguugaggacuacggauuuggcguguucacaacuaauauuuggcugaagcucagagagaaacaggacguguuuugugauagcaagcugauguccgcggcuaucaaggacaacagggccguacacgcagauauggguuauuggauagaaucagccuuaaaugacaccuggaaaauugagaaggcuagcuucaucgaagucaaaucuugccacuggccuaagucccauacgcuguggaguaacggggugcuugagagcgagaugaucauuccaaaaaacuucgccggacccguuucucaacacaauuaccguccuggcuaucauacacagaccgcagguccauggcacuugggcaagcucgaaauggauuuugacuucugugaggggacuaccguggucgugacagaagauugcggaaaccggggccccucccugcgaacuaccacagcuucagggaagcuaaucacggaguggugcuguagaaguugcacccugccgccucucagguaccgcggagaagacggcuguugguacgguauggagauucggccacugaaagagaaggaagagaaucuuguuaacagcuuggugacugccgggcauggacagauagauaauuuuucgcugggcguauuagguauggcgcucuuccuggaagagaugcuuagaacaagggucggcaccaaacacgccauccuguugguggcuguguccuuugucacucucauuacagggaacaugucuuuccgcgaccugggacgaguuauggugaugguaggcgcaaccaugacggaugacaucgggaugggagugacuuaucuagcccugcucgcugccuuuaagguccggcccaccuucgcagcgggccugcuuuugcguaaacugacaagcaaggaauuaaugaugaccacuauugguaucgugcuccugucacaaaguacaauaccugagaccauccuugagcugacagaugcccuagcucucgggaugaugguucugaagauggugagaaaaauggaaaaguaccaguuggccgucacuauuauggcaauccugugcgugcccaaugcuguuauuuuacagaacgccuggaaaguguccuguaccauccucgcagucguaucugugagcccacuguuucuuacguccucacagcaaaaggccgacuggauaccucuggcuuugacaauuaaaggacucaaucccaccgcgaucuuccugacuacccuaagcaggacaaacaagaaacgcaguuggccacugaaugaggccaucauggcaguuggcauggugucuauucuugcuuccagccuccugaagaacgacauaccgaugacuggcccuuuggucgccgggggacuguuaaccgugugcuauguacucacgggucggucggccgaucuggaacuugagagagcugcagacgugaagugggaagaucaggccgagaucucaggcucuagucccauucuguccaucacaauuagcgaggacgggucuaugagcaucaaaaaugaagaggaagagcagaccuugacuauacucaucaggacaggacugcuagucauuuccggccuguuuccaguuucaauccccauuaccgcggcugccugguaccuuugggaggugaagaaacagcgagcaggugugcucugggaugucccuaguccacccccuguggggaaggccgaacuggaggacggagcuuaucgcaucaaacaaaagggcauauugggcuacagccagauuggggcaggaguuuauaaggaagguacuuuccacacaauguggcauguaacccggggcgccguguuaaugcacaaagggaagagaaucgagccgucuugggcggaugucaaaaaggaccugaucuccuacggaggcgguuggaaacucgaaggggaguggaaggagggagaagaggugcagguucuggcucuugaaccaggcaagaaccccagggccgugcagacgaaaccuggccuguuuaagacuaaugcagggaccauuggagccgucucauuggauuucaguccagguacaagcggcucccccaucauagacaaaaaggggaaagugguaggacuauacggcaacggugucgugacccguucuggggcuuauguuucggccauugcacaaacagagaagagcaucgaagauaacccugagauugaggacgauaucuuccgcaagcggaaacugacuauaauggaccuccauccgggagcuggcaagaccaaaagauaccugcccgccauugugagggaagcgaucaagcgaggccuucggacguuaauccuggccccaacacgcgucguggcagcugagauggaagaggcccucagaggguugccuauuagguaucagacucccgcuauccgggcagaacacaccggacgagagauuguugaccugaugugucaugccacauuuaccaugagacuccugucaccagugcgcgucccuaauuacaaccuuauaaucauggaugaggcccacuucacugaccccgcuuccauugcggcaagggguuauaucaguacccguguggaaaugggcgaggccgcugggaucuuuaugacagccacgccaccgggaucucgggauccuuucccccagagcaaugcaccaauuauggacgaagagagagagauacccgaaagguccuggucaucuggccacgaguggguaacugauuuuaaagguaagaccgugugguucguuccuagcaucaaggccgggaacgacauugcugcgugccugcgcaaaaauggaaagaaagucauccaauugagucgaaagacauuugauuccgaauacgugaaaaccagaacuaacgacugggauuucguggucacaaccgacauuagcgagaugggcgccaauuuuaaggcagaacggguaaucgauccaaggcgcuguaugaaacccgugauacuaacggacggcgaggagcguguuauccuggcugggccuaugccggugacucauucuucagccgcacagagacggggaaggauuggucgcaacccaaagaaugaaaacgaccaguauaucuacaugggcgagccccucgaaaaugaugaggacugcgcccacuggaaggaagcuaaaauguuacuggauaacauuaauacaccugaggggaucauacccuccauguucgagccagaacgagagaaggucgacgccauugauggagaauacagacuucggggcgaggcgaggaaaaccuuuguggaccugaugcgcagaggugaucucccuguuugguuggcauauaggguggccgcugaagggaucaacuacgccgaccggcguugguguuucgauggcauuaagaauaaccagauccuggaggagaacgucgaaguggagauauggaccaaagaaggagagcgcaagaagcucaaaccccgauggcuggacgcuagaaucuauagugauccacuugcacuaaaggaguucaaagaauuugccgcuggcaggaagagccugacuuugaauuuaauuacagagauggggcggcugccuaccuucaugacacaaaaagcccgcgacgcacucgauaaccuggcgguacuucauacugccgaagcuggagguagagccuacaaucacgcacugucggagcucccggaaacguuggagacccugcuacugcucacacuucuggcuacugugaccggcgggaucuuuuuauucuugaugucuggaaggggcauugguaagaugacacuggggaugugcugcaucauaaccgccuccauucuccugugguaugcacagauccagccccacuggaucgccgcuagcauuauccuugaguuuuuccugauaguucucuugauuccagaaccugagaagcagcggacuccccaagacaaccagcugacguacgucgugaucgcgauuuuaaccguggucgccgcaacaauggcuaaugaaaugggcuuucuagagaaaacuaagaaagaccugggacucggcucaaucaccacacagcagccagaaaguaacauacuugauaucgaccugcgaccugccucugccuggaccuuguaugcaguugcuacuacauucgugacgcccaugcugagacauuccauugagaauagcucaguaaacgugagucucaccgccaucgcgaaucaagcuacuguccugauggggcuuggaaaggguuggccgcucagcaaaauggauauuggcgugccacuguuggccaucggguguuacucccagguuaacccuauuacacugaccgcagccuuauuucuacugguggcucacuacgcaaucauaggacccggccuccaggccaaggcgacccgcgaggcucagaagagggccgcagccgguauuaugaaaaauccaacagucgacgggaucacuguaaucgaucuugaccccauuccuuaugauccgaaguucgaaaaacaacugggccaggugauguugcugguucucugcgugacgcagguccugaugaugcggaccacaugggcucuuugugaggccuuaacucuggcaaccggacccauaucuacacucugggaaggcaacccagggcguuuuuggaauaccacuaucgcugugagcauggccaacauuuucagaggauccuacuuggcgggcgccggucugcuauuuucaaucaugaagaauacgacaaacaccaggcgcgggacuggaaauauuggcgagacccugggugaaaaauggaagucucggcucaacgcacuuggcaaaagugaguuccaaaucuauaagaagucggggauacaggaggucgaccgaacacuggcuaaagaaggaaucaagagaggcgagacugaucaucacgccgugagcaggggguccgcaaaauugcgcugguucguugaacggaacauggugaccccugagggaaagguaguggaccugggcugcgguagagggggauggucuuacuauuguggcggucucaaaaauguccgugagguuaagggccugacaaaggggggacccggccaugaagagccuauuccaaugucaacguacggguggaacuuagugaggcuucagagcggagucgauguguuuuucacccccccugaaaaaugcgacacucugcucugugauaucggcgaguccaguccaaaucccacaguagaagcuggucggacccuacgcgugcugaacuugguugagaauuggcugaacaauaacacucaguuuugcauuaaggugcucaauccguauaugccuucugucaucgagaaaauggaagcccuucaacgaaaguacgggggagcccuggugagaaacccauugagcaggaauucaacacacgagauguacugggucuccaacgcgaguggcaauauagugagcucuguuaacaugauuucccggaugcugaucaaucgcuucaccaugagacacaaaaaggcuacguaugaacccgacguagaccucggcucagggaccaggaacaucggaauugagagcgaaauaccuaacuuagauaucauugguaagcgaaucgagaaaauuaagcaggagcaugaaacaucguggcacuacgaccaggaucauccauauaaaacuugggcauaccacggcucuuaugagaccaagcagacagggagugccuccagcauggugaauggagucgugcggcugcuuacuaaacccugggacguugugccgauggucacccaaauggcuaugacagauaccacuccuuuuggccagcagcguguguucaaggaaaagguagacacgagaacacaggagcccaaagaagguaccaagaaacugaugaagaucacugccgaguggcuauggaaagagcucgggaagaaaaagaccccacgcauguguacaagggaagaguuuacgcggaaggugagaucaaacgcagcccugggagcuauauucaccgaugaaaauaaauggaaguccgcgcgcgaggccguugaggacucuagguuuugggaauuggucgauaaagagcgaaaccugcaccucgaaggcaagugcgagacuuguguguacaauaugaugggcaaacgggaaaagaagcuuggggaguucggaaaagcaaaggguagcagagcuaucugguauauguggcugggcgccagguuuuuagaguucgaagcacugggguuuuugaacgaggaccauugguucagucgcgaaaauucccucagcggaguggagggcgaaggucugcacaaacuaggguacauucuucgugaugucucuaagaaagagggaggcgccauguacgcugacgacacagccggcugggauacccggaucacucuggaggaccucaagaacgaagagaugguuacaaaucauauggaaggggagcacaagaaacuggcggaagcaauuuucaaguugaccuaucaaaacaaagugguaagagugcagaggccuacaccccgcggaacugucauggauaucauuucacgacgggaccagagagguaguggccaaguggggaccuacggacugaauacguuuaccaacauggaggcccagcucauaaggcagauggagggcgaagguguuuucaaguccauccagcaucuuacagugacugaggaaauugcuguccaaaauuggcuggcccgcguggggagagagcgguuaagcaggauggcaaucucuggagaugacugcguaguuaaaccacuggaugaccguuuugcuucggccuugaccgcucucaacgauaugggcaaggugcgaaaggacauccagcagugggagcccucacgcggcuggaaugauuggacacaggucccuuucugcagccaccacuuucaugaacugauuaugaaagacgggagagugcuaguggucccaugucggaaccaagaugagcuuauaggaagggcccgcaucucccagggugcaggcuggagucugagagaaacugcgugccucgggaagucuuaugcccagauguggagccugauguacuuccaccggagggacuugcgauuagcugccaacgcaauuuguuccgcuguuccgucacauugggugcccaccagucguacgacauggucuauccacgccaaacacgaguggaugaccacugaagacaugcugacaguauggaauagaguguggauucaggagaacccuuggauggaggauaagaccccagucgaaagcugggaggaaauccccuaucucggaaaacgcgaggaccaauggugcggcucccuuauaggucugacuucacgggcaaccugggccaagaauauccagacagcgauuaaccaggugaggagccuaaucgggaaugaagaguacacggauuauaugccuucuaugaagagauuucgccgggaggaagaggaagcuggaguucugugguga

SEQ ID NO: 14584 - RNA, 9876 nt, Artificial Sequence
  derived and/or modified CDS sequence (opt3) from DENV-2__KF360005__SS-prME
accgcaggagugaucauuaugaggauacccacugcuauggcauuccaccugacuacgaggaacggggaaccucauaugaucgucagcaagcaggaaaaggggaagucccuccuuuuuaaaaccgaagacgguguuaauaugugcacacugauggccauggauuugggagaauuaugugaagacacuauuaccuacaacugcccacugcugcggcaaaaugaaccggaagauaucgacuguuggugcaacucuacaucaaccugggugacuuaugggacauguaccgcgacgggagaacaccgccgagaaaagcguaguguagcucucgugccccaugucggcaugggucuggagacuagaaccgaaacauggaugagcuccgagggggccuggaaacacgcacagaggauugagacuuggauccuucggcauccuggauucaccauaauggccgcuauccuggcauacacaauuggcaccacguauuuucagcgcguguugaucuucauucuccugacugccguugcuccaucuaugacaaugagaugcaucggcauaucgaauagggauuuuguggaaggggucucaggagguagcuggguggacauuguacuggagcacggcaguuguguuaccacuauggccaagaacaagcccacacucgauuucgaauuaaucaaaaccgaggcgaagcagccugcaacgcugcggaaauacugcauugaagccaaacuuaccaauacaacuaccgcuucccgcuguccaacacaaggggagcccucuuugaacgaggaacaggacaaacgauuugugugcaagcacagcauggucggaagaggcuggggugauggguguggacuguucggcaagggcgggaucgugacuugcgccauguuuaccugcaaaaagaauauggagggaaaaaucgugcagccugaaaaccuagaguauacaauugucguuaccccacauuccggugaagagaaugcagugggcaacgacacugggaagcacggaaaagagauaaagguaacgccgcagucaaguaucacagaagcugagcucaccggcuacgguacugugaccauggaauguagccccaggacagggcuggauuucaaugagaugguccuucugcaaauggaaaacaaagccugguuggugcaucggcagugguuucucgaccugccuuuaccauggcugcccggcgcggauauucagggaucuaauuggauccagaaggagacccucguuacuuucaagaacccucacgccaaaaagcaagacguggucgugcuuggcucccaggagggggcacugcacacagcuuugacgggagccaccgaaauacagaugucaagcgguaaccuacuguuuacuggccaucucaaaugccgucugcgcauggacaaacuucaacugaaagggaugaguuauucuauguguacaggaaaguucaagguaguuaaagagauugcugaaacccagcacggcacaaucguggucagaauccaguacgagggugauggguccccaugcaagauucccuucgagaucauggacuuggagaagaggcaugugcucggccggcugauuacugucaauccgauagugaccgagaaggauagcccuguuaacaucgaagccgagcccccauuuggagacucguacauuaucaucggcguggaaccugggcaguuaaaacugucuugguucaagaagggauccucaauuggucaaauguuugagacgaccaugcgaggcgcaaaacgcauggccauacuaggggauacagcuugggacuucggaagucucggcgguguauuuacuagcaucgggaaggcgcugcaccaggucuucggcgcaauuuauggagccgcuuuuuccggcgugucuuggaccaugaaaauccuuauugggguugugaucacauggauaggaaugaauagcagaucaacaaguuuguccgucagccuggugcucguaggcgugguuacccuguaccuuggugucauggugcaggccgauucuggguguguggucucauggaggaacaaggagcugaaaugcggaaguggcaucuucauuacggacaauguucauacauggaccgaacaguauaaguuucaacccgagagcccauccaaguuggcaucugccauccagaaagcucacgaagaggguauuuguggcauccggucggugacucgccucgaaaaccugauguggaagcagauaacacccgaguuaaaucacauucugagcgagaacgaagugaaacuauccaucaugaccggggauauuaagggaaucaugcaggccggcaaaagaucacucaggccucaaccaacugagcugaaguacaguuggaaaaccugggggaaggcaaagaugcuuucuacagaaccgcauaaucagacguucuugauagacggacccgagaccgcggaaugcccuaacacuaaucgugcuuggaacagccuggagguagaggauuauggcuuuggugucuucacaaccaauaucuggcucaaacugaaggaacggcaggacguguuuugugacuccaaauuaaugucagccgcaauuaaggauaaccgagccguucacgcugacaugggguacuggaucgagagcgcccugaaugauacauggaaaauugaaaaggcaucuuucaucgaggugaaguccugccauuggccaaaaagucacacucuuuggagcaacggagucuuggagucugaaaugauaauucccaagaacuucgcuggcccugugucccagcacaauuauagaccagguuaccauacccaaacggccggccccuggcaccucgggaaacuggagauggacuuugauuucugugaaggaacaaccguugugguaacugaggacugcggcaacagggggccgucacuacgcaccacaacugcgaguggaaagcugaucaccgaauggugcugucggagcugcacacucccuccacugagauacaggggcgaggaugguuguugguaugggauggagauccgcccccuuaaagaaaaggaggaaaauuuggucaacucgcuggugacggccggacauggccagauugacaauuuuuccuuaggugugcucggcauggcucuguuccuugaggaaaugcugcgaacccgggucgggacuaagcacgcaguuuugcucguggccguaucuuuuaugacacugaucaccggaaacaugagcuuccgugaucuaggcagagugauggucauggugggggcugccaugacugacgauauuggaaugggcguuacauaccuggcacuccuggcggccuuuaaagugaggccuaccuucgcugccggucuuuugcugcgcaaguuaacgucaaaagagcucaugaugacuaccauagggaucguccugcuuagucaguccacaacccccgagacuauucuggaacuaacagacgcacucgcucugggaaugaugaucuugaagauugugcggaauauggagaaauaucaacuggccguuaccaucauggcaauauuaugcgugccaaacgccgucauccuccagaaugcuuggaagguaucuuguacaauucuggcggccgugagcguuuccccucuucuguugacuucaagccagcagaaggcagauuggaucccccucgcucugaccauuaaaggccuaaacccaacggccaucuuucugacaacccuuaguagaacuaauaagaaaaggucuuggccgcucaacgaagccauaauggcugugggcauggucuccauucuggcaagcucguugcugaagaaugacaucccuaugaccgggcccuuaguggccggaggucuccugacaguaugcuacgugcuuacuggccgaucagcggaccuggaguuggaacgcgcugccgauguccggugggaggaccaagcagagguuucugggaguuccccaauccucagcauuaccauaucugaagauggaagcauguccaucaaaaacgaggaagaggagcagacgcugacaauucuaaucagaaccggccugcuugugauuucaggucucuuccccgugaguaucccuauaacugccgcugcaugguaucugugggaagucaagaaacagagggccgggguguugagcgcgguuccaucucccccuccgguaggaaaggcugaguuagaagacggcgccuaccguaucaagcagaaaggcauucugggguauucccaaaucggagccgguguguacaaggagggcacauuucauaccauguggcacgucacucgcggggcagugcucaugcacaaaggaaagcggauugaaccaucaugggcugauguuagaaaagaccugaucaguuacggcggugggaggaaacuugagggagaguggaaggaaggcgaggaagugcagguccuggccuuggagcccggcaaaaauccucgagcagugcagacaaagccagggcuauucaaaaccaacacgggaacuauaggugcuguaagccuggauuuuucccccggcgccucugggucgccuauugucgacaagaaaggaaaggugguuggccucuaugguaacgggguggucacccggagcggaacauacgugucagcgaucgcccagaccgaaaaguccaucgaggauaauccggagauugaagacgauaucuuccgcaaaaagagacugacaauaauggaccuucaucccggcgcaggcaaaacuaagagguauuuaccagcuauuguucgggaggccaucaaacgagggcugagaacccucauuuuggcuccuacgcgcguggucgcagccgaaauggaggaagcccugaggggacuccccauccguuaccaaacaccagcuauacgggcggagcacacugguagagagauuguggaucugaugugucaugcaaccuucacaaugaggcuucugaguccuguacgcgugcccaacuauaauuugaucaucauggacgaagcccacuuuaccgacccagcuucuauugccgcacgaggcuacaucagcacuagaguugagaugggggaagccgcuggaauuuucaugaccgcgacaccgccuggcucccgggaucccuuuccacagucaaacgcccccauaauggacgaggagagggaaaucccugagcgcucuuggaauagcggucaugaaugggucacggauuucaaggggaagacugugugguuugugccaaguauuaaagcaggaaacgacaucgcugccugccuacguaagaauggcaaaaaggucauccagcuguccagaaaaaccuucgauagcgaguauauuaagacacggaccaacgacugggauuuuguagugacuacagacauaucugaaaugggcgcaaauuucaaggccgagaggguuaucgauccccgccgauguaugaaaccugugauucucaccgacggggaggaaagagucaucuuagcuggaccgaugccagugacgcacucauccgccgcgcaacggaggggucgcauuggcagaaaccccaagaaugagaacgaucaguacaucuacaugggggaaccucuggagaaugacgaagacugcgcacacuggaaagaggccaagaugcuucuggauaacauaaauacucccgagggaaucauuccaaguauguuugaaccugagagggaaaaaguugacgcuaucgauggcgaguaucggcuccguggugaagcccgcaagacauucguggacuugaugcgaagaggggaucugcccgucuggcucgcuuacaggguggcagccgagggcauuaacuaugcugaccggcgcugguguuuugauggaaucaaaaacaaucagauacuggaggaaaacguagagguggaaauuuggaccaaggagggcgagagaaagaaacuuaagccaagguggcuagacgcccggaucuacagcgauccucuggcauugaaagaguucaaggaguucgcggccgggcgaaaaucguuaacccugaaucucauuacugaaaugggaagacugccgacauuuaugacccagaaggcucgcaacgcccuugacaaucuggcaguucuccauacagcugaggccgguggcagggcauauaaccacgccuugucugaacugcccgagacucuagagacgcugcuccuucugaccuuauuggcuacagucacugggggaaucuuccuguuucucauguccggcaaggguauagggaaaaugacccugggcaugugcugcaucauuacagcgagcauccuucugugguacgcccaaauucagccacauuggaucgcagcuucaauaauucucgaguucuuuuugaucgugcuguuaaucccugagcccgaaaagcagcggaccccacaggauaaucaacuaacuuauguggucauugccauccugacgguuguggccgcaaccauggcuaacgagaugggauuccucgaaaagacuaagaaagacuuuggccuugggaguauagccacucagcagccugagucuaauauucuggauaucgacuugcgucccgcguccgcuuggacccuguacgccguagcaacaaccuucauuacuccgaugcucagacacagcaucgagaacucaagugugaaugucagccugacagccauagcuaaccaggcaacggugcuuaugggacucgguaagggcuggccacuguccaagauggacaucgggguuccuuugcuggccauuggauguuacucucaagugaaucccaucaccuuaacugcggcucuacugcuccuugucgcccacuaugcaauuaucggcccaggucugcaggccaaagcuacaagggaagcccagaagcgcgcagcugccgggauuaugaaaaaccccaccgcggauggcaucaccguaauagacuuggauccuauuccguacgaccccaaguuugagaaacagcugggacaagugaugcuccugguucuuugcgugacacaggucuuaaugaugcggacuacgugggcccugugugaagcacucaccuuggcuacaggcccaaucagcacucugugggagggguccccuggacgauucuggaauaccacaaucgccgugucaauggcaaacauuuuuagaggcucuuaucuagcuggugccgggcuacucuucaguauaaugaagaauaccacuaacacgaggcgcggaacaggcaacaccggugaaacucuuggcgagaaguggaaaaaucggcugaacucguugggaaagagcgaguuucagaucuacaaaagauccggcauucaagaagucgaucguacccuggccaaggagggcaucaaaagaggggaaacagaccaucacgcggugucucggggaucagcuaagcuccgcugguucguugagcgaaaucuggugacucccgagggcaaaguaguggauuuagguugcgggagaggaggcuggagcuauuacugugguggccuuaagaacgucagggaaguucgggggcugaccaagggaggcccugggcaugaggaaccaauucccauguccacauauggauggaaucucgugcgccuacagaguggcgucgacguguucuuuacgccuccagagaaaugcgauacccuguugugugacaucggugaaucuagccccaacccgacuguagaggcagggagaacacugagggugcucaaucuuguugagaacuggcugaauaacaauacccaguucugcauaaagguguugaacccuuacaugccaucagucaucgagaagauggagacucugcagcgaaaguacggaggcgcccucgugcggaaucccuuaucccguaacaguacacacgaaauguauugggucagcaaugcuucuggcaacauuguguccucaguuaacaugaucagcagaaugcugauuaaucgcuuuaccaugaggcauaaaaaggccacguacgagccugauguagaccuugggucgggaacccggaacaucgguauagaaucugagacaccaaaucuggauauuaucggcaagagaaucgagaaaauuaagcaagaacacgagacaaguuggcacuaugaccaggaccaucccuacaaaaccugggcauaucacggguccuacgaaacaaagcagacuggaagcgccucauccguggucaacggcgugguucgccuacucaccaaaccgugggaugugauaccuauggucacacagauggcuaugaccgacacuacgcccuucggucaacagaggguguuuaaggagaagguagauacacgaacccaggaaccaaaagaggggacuaagaaacugaugaagaucaccgcggagugguuguggaaagaacugggaaagaagaaaacaccucggauguguacgagagaggaguucgccaggaaggugcgcucuaaugcagcucucggcgccauuuuuaccgacgagaacaaauggaaaagcgcacgugaggccguugaagauagucgguucugggagcuugucgacaaagaaagaaaucugcauuuagagggcaagugcgaaacuuguguguauaacaugauggggaaaagggagaagaagaucggagaguuugguaaagcuaagggcucccgcgccgugugguacauguggcugggggcgcgauucuuggaauuugaggcacucggauuccugaaugaagaucacugguuuagccgggagaacucucuaucaggcgucgaaggugaggggcuucacaaacugggauacauucucagagagguuaguaagaaagaaggcggcgccauguaugcugacgauacagccgggugggacaccaggaucacucuggaggauuugaagaaugaagagauggugacaaaccauauggaaggagagcacaagaaacuggcagaggcuauauucaagcucaccuaccagaauaaaguagugcgcguccaaagacccacaccacgggguacugugauggacaucauuuccaggcgugaccagcgaagcucuggccagguugggaccuauggacuuaacacguucaccaauaugggcgcccaacugauccgccagauggaaggugaggggguguuuaagggcauucagcauuuaacagcuacugaagaggucgccgugcaggauuggcuggcaagaguaggccgggagagguugucgcgcauggcgaucucaggcgacgauugcguugugaaaccccucgacgauagauucgccagcgcucugaccgcccuaaacgacauggggaagguccggaaggauauucaacagugggaaccuuccaggggauggaacgacuggacacaggugccauuuugcagucaccauuuccacgagcuuauaaugaaagauggucgagugcuggucguuccgugucguaaucaggacgaacucaucggcagagcacgcauuucucaaggggcuggauggagccugcgggagacugccugcuugggcaaguccuacgcacagauguggucauuaauguauuuucacaggagaggucugcgccucgccgcgaacgcuaucuguagugccgugcccucucauuggguaccuaccagccggacgacaugguccauccacgcaaggcaugaauggaugaccacugaggauaugcuuacaguguggaaucgagucuggauucaggagaacccauggauggaagacaaaacccccguggagucaugggaagagauaccuuaccuggggaagagaggagaucaguggugcggcagccuaaucggccugacuucucgggccaccugggcuaggaauauucaaacagccaucaaccgcguucguucccucauugggagugaaggauauacggacuacaugccaagcaugaaaagauuccgaagggaggaggacgaagccgguguguugugguga

SEQ ID NO: 14585 - RNA, 9876 nt, Artificial Sequence
  derived and/or modified CDS sequence (opt3) from DENV-2__KJ010185__SS-prME
accgcaggcgugaucauuaugcugauacccacugcuauggcauuccaccucacuacgagaaauggggaaccucauaugaucgucagcaagcaggaaaaaggaaagucccuucuguuuaaaaccgaagacgguguuaauaugugcaccuugauggccauggauuuaggcgaacugugugaagacacuauuaccuacaacugcccacuacucaggcaaaaugaaccggaagauaucgacuguuggugcaacgcgacaucuaccugggugacuuaugggacauguaccgcuacgggagaacaccggcgcgaaaagcgaucaguagcccuggugccccaugucggcaugggucuugagacucguaccgaaacauggaugaguagcgagggggcauggaaacacgcccagagaauugagacuuggauccugaggcauccuggauucaccauaauggcugcaaucuuggccuacacaauuggcaccacguauuuucagcgggugcucaucuucauucugcugacugcuguugccccauccaugacaaugcgcugcaucggcauaucuaauagagauuuuguggaaggggucucgggagguucauggguggacauuguacucgagcacggcagcuguguuaccacuauggcgaagaacaagcccacauuagauuucgaacugaucaaaaccgaggcaaagcagccugccacgcuuaggaaauacugcauugaagcuaaguugaccaauacaacuaccgccagucgguguccaacacaaggggagcccucccugaacgaggaacaggacaaacgcuuugugugcaagcacucuauggucgaucgaggauggggcaaugguugugggcuauucggaaagggcggcaucgugacuugcgcaauguuuaccugcaaaaagaacauggaggggaaaaucgugcagccugaaaaucucgaguauacaauugucguuaccccacauagcggagaagagaacgcuguggguaaugacacuggcaagcacgggaaagagauaaagguaacgccgcaguccucaaucacagaagccgagcugaccggauacggcacugugaccauggaauguagucccagaacaggucuugauuucaacgagaugguccuguugcaaauggaaaauaaagcguggcucgugcauaggcagugguuucuggacuuaccucugccauggcuccccggggccgauauucagggcagcaacuggauccagaaggagacccuuguuacuuucaagaacccucacgccaagaagcaagacguggucgugcugggaucucaggagggcgcuaugcacacagccuugacgggggcuaccgaaauacagauguccucaggaaauccacuauuuacuggucaucugaaaugccggcuccguauggacaagcugcaacuuaaaggcaugagcuauaguauguguacagggaaguucaagguaguuaaagagauugccgaaacccagcacggaacaaucgugguccgcauccaguacgagggcgaugguucucccugcaagauuccguucgagaucauggaccuggagaaaagacauguguuggggaggcucauuacugucaacccuauagugaccgagaaggauucccccguuaauaucgaagcagagccaccuuuuggcgacagcuacauuaucaucggaguggaacccggccagcugaaauuaucgugguucaagaaggggucuuccauuggacaaauguuugagacgaccaugcggggugccaaacgaauggcuauacugggcgauacagcgugggacuucgggucacuaggaggcguauuuacaaguaucgguaaggcacuccaccaggucuucggggccauuuauggcgcugccuuuagcggaguguccuggaccaugaaaauccugauuggcguugugaucacauggauagggaugaacucucgcagcacuucacuuagugucuccuuggugcugguaggagugguuacccucuaccugggcgucauggugcaggcagauagcgguuguguggucucuuggaagaauaaagagcuuaagugcgggucaggaaucuucuuuacggacaacguucauacauggaccgaacaguauaaguuccaaccagagagucccagcaaacuggccuccgcuauucagaaggcccacgaagagggcaucugugguauuagaucuaucacuagguuggauaaucucauguggaaacagauaacaccugaacugaaccacauuuuaucggagaaugaggugaagcugagcaucaugaccggcgacauuaaagggaucaugcaggcaggaaagcggucccuacgcccacaaccgacugaacucaaauacucauggaagaccuggggcaaggcgaaaaugcugaguacagagccccauaaccagacguuucuuauagaugggccugaaaccgcucagugcccaaauacuaacagagccuggaacucuuuggagguggaagacuauggauucggcguauuuacaaccaacaucuggcugaagcucaaagagaggcaggacgucuucugugauagcaagcugauguccgcagccauuaaagacaaucgugcugugcacgccgauauggguuacuggaucgagucagcauuaaacgacacauggaagauugaaaaggcuagcuucaucgagguuaaaucuugccauuggcccaagucccacacucuguggaguaacggggugcuugaaagcgagaugauaauuccuaaaaauuuugccggaccagucucucaacacaacuaucggcccggcuaccauacccagacggcggguccguggcacuugggcaagcucgagauggauuucgacuuuugugaagggacaaccgugguugugacugaggauugcggaaaucgaggcccuucccugagaaccacaacugccucagggaaacuaaucaccgaauggugcuguaggaguugcacacugccaccccuccgcuaccggggagaggacggcuguugguaugguauggaaaucagaccucugaaggagaaggaggaaaaccuuguaaauagcuuggucacggcugggcauggacagauugauaacuucucgcugggcguguuagguauggcacucuuucuggaggaaaugcuuaggacccgcgugggcacuaaacacgccguccuguugguugcuguguccuucaugacacucaucaccgggaauaugucuuuucgagaccugggacggguaauggugauggucggcgccgcaaugacugaugacauugggaugggagugacauaccuagcgcugcucgccgcuuucaagguucgucccaccuuugccgcaggccugcuuuugagaaaacugacgagcaaggaguuaaugaugacuaccauagguaucgugcuccugucacaaaguacaaccccagaaacuauucuugagcugacagaugcucuagcccucgggaugaugauccugaaaauugucaggaacauggagaaguaucaguuggcagugaccaucauggccauacugugcguuccuaaugcugugaucuuacagaacgcguggaaggucuccuguacaauucucgccgcaguaucugugagcccccugcuucugacuuccucacagcaaaaagcugacuggaucccauuggcccucaccauuaagggacugaauccgacggccaucuuccuaacaacccugagccgcacuaacaaaaagcggaguuggccucuuaaugaagcuauaauggcaguuggcauggugucuauucucgccuccagccuguugaaaaacgacauccccaugaccggcccacuggucgcugggggauuacucacagugugcuacguacugacugguagaucggcggaucuugagcuggaaagggccgcagacgugcgaugggaggaucaggccgaaaucucaggcucuagucccauuuuguccauaaccaucagcgaggacgggucuaugagcauuaagaaugaggaagaggaacagacgcucacaauccugauucgcaccggacuacuggucaucuccggccuuuuuccuguuucaauaccaaucacugcugcagccugguaucucugggaggugaaaaagcagcgggcgggugugcugugggauguccccaguccuccgccaguggggaaggcugaguuggaagacggagccuacagaauuaaacaaaagggcaucuuaggcuauagccagauuggggcaggaguuuacaaagaggguacauuccauaccauguggcacguaacuaggggcgccgugcugaugcacaaggggaaacguaucgaacccucuugggcugauguccgcaaggaccucauauccuacggaggcgguuggaagcuggagggggaauggaaagagggagaggaagugcagguucuugcccuggagccuggcaagaacccacgggcagugcagacaaaacccggcuuguuuaagaccaacacggggacuauuggagcugucucacuagauuucaguccugguaccagcggcuccccgaucguggacaaaaaggggaagguagucggacuguauggcaauggugugguuacaagaucugggaccuacgugucggccaucgcgcaaacagagaaaagcauugaggauaaccccgaaaucgaggacgauauauucaggaagaaacgacucacuauuauggaccugcauccaggagccggcaagaccaaacgguaucuuccugcaaucguccgcgaggcuauuaagagaggcuuaaggacgcugauccucgcccccacacgggugguugcugcagaaauggaggaagccuugcgagggcugccaauaagauaccagacuccugccauucgcgcugagcacaccggaagggaaaucguggaccucaugugucaugcgacauuuaccaugcgucugcuuucacccguccgggugccaaauuauaaccugaucauuauggaugaggcacacuucacugacccggccuccaucgcugccagagguuacauuaguaccaggguagagaugggcgaagcagccgggauauuuaugacagcuacgccucccggaucucgcgauccauucccccagagcaaugcgccuaucauggacgaggaacgagagauuccagagagauccuggaacucaggccaugaaugggugacugauuuuaaggguaaaaccguuugguucguccccucuaucaaggccgggaaugacaucgcagcuugcuugcggaaaaacggaaagaaagugauucaacuaagcaggaagacauuugauagugaguauauaaagacccgcacuaaugacugggauuucguggucacaaccgacaucuccgaaaugggcgccaacuuuaaagcagagcguguaauugauccuagacgguguaugaagccggugauccugacggacggcgaagagaggguuauucucgccgggccaaugcccgugacucacagcucugcugcccagcgccgaggaagaaucggucggaauccuaaaaacgagaaugaccaguacauauacaugggcgaacccuuagagaacgaugaagacugcgcgcacuggaaggaggcaaaaaugcugcuugauaauaucaacacaccagaagggauuaucccuucaauguucgagcccgagagggaaaaggucgacgccauugauggagaguaucgccugagaggcgaagcuaggaaaaccuuuguggaccucaugcggcguggugauuugccaguuuggcuggccuaccgcguggcugcagaggggaucaacuaugccgaccgaagaugguguuucgauggcauaaagaauaaccagauucucgaagagaaugucgagguggaaaucuggaccaaggagggagaaaggaaaaagcugaaaccucgguggcuugacgcucgcauuuacuccgauccgcuagcccugaaggaguucaaagaguuugcagcgggcagaaagaguuugacuuuaaaccugaucacagaaauggggaggcuccccaccuucaugacacaaaaggcccggaaugcucuggacaaccuugccguacugcauacugcagaggcuggaggucgagccuauaaucacgcacucagcgaauugccagagacgcuggaaacccuacugcuccuuacacuguuagccacugugaccggcgggauauuuuuguuccugaugucgggaaaaggcaucgguaagaugacacucgggaugugcugcauuaucaccgcuucuauucugcuuugguacgcgcagauccagccucauuggauagccgcauccauuauccuggaguuuuuccucaucguuuugcugauucccgagccagaaaaacagagaacuccucaagauaaccaguuaacguaugucgugaucgcuauacuaaccguggucgccgccacaauggcaaaugagaugggcuuucuggaaaagacuaaaaaggacuucggacucggcagcauugcuacccagcagcccgagucaaacauccuugacauugaucugcgcccggccagugcguggacauuguacgcuguugccaccacuuuuaucacaccaaugcugaggcacucuauagaaaauuccagcgugaacguaucacucacggcaaucgccaaucaagcuaccgugcugauggggcuuggaaaggguuggccucucaguaaaauggacauuggcgucccccuguuggcaaucggguguuacagccaggugaacccaauuacucugacagccgcguuacuacugcucguugcucacuaugccaucauuggacccggccuucaggcaaaggccucccgggaggcucagaaacgugccgcagcugguaucaugaagaauccuaccguggaugggauaaccgucauugaccuggauccgauccccuacgacccaaaauucgagaagcaauugggccagguaaugcugcucauccugugcgugacacagguucuuaugaugagaacuacgugggccuuaugugaagcgcugacccucgccacaggaccuauuucuacuuugugggagggcaaccccgggagguuuuggaauaccacaauagcagugagcauggcuaacaucuuccgcggauccuaucuggccggcgcaggucuacuguuuucaauuaugaagaacaccacuaauacgcggcgagggacaggaaacaccggcgaaacucucggugagaaauggaagaauagagucucucuucugggcaaaagugaguuccaaaucuacaagaggucggggauucaggagguggaucgcaccuuggcuaaagagggaaucaagcggggcgaaacagaccaucacgccgucagcagaggguccgccaaacugcguugguucguggagaggaaccucguuacuccugaaggaaaggugguagaucugggcugcggucgcgggggauggucuuauuacuguggcgguuuaaagaaugugcgggaggucaaaggccuuaccaaagggggaccaggccaugaggaacccauaccuaugucaacauauggguggaaccugguucgacuccuaacgggagcggacguguuuuucaccccacccgagaaaugcgauacucuguugugugacaucggcgaaagcuccccgaauccuacagucgaggcugguagaacccugagggugcucaaccuuguagaaaauuggcugaacaauaacacucaguuuugcauuaagguguugaauccauacaugcccaguguuaucgagaaaauggagacacugcagcggaaguacgggggagcacucgugcgcaacccuuuaucuagaaauagcacccacgaaauguauugggucucaaacgccuccggcaacauugugaguagcgucaauaugaucucuaggaugcugauaaaccgauucacgaugcggcauaagaaagcuaccuacgauccagacguggaccuuggcuccgggacacguaauauuggaaucgagucagaaacucccaaccuggauaucauugguaagagaauagagaaaaucaagcaagaacacgagaccagccgccacuaugaccaggaucauccguacaaaacaugggccuaucacggcucguacgagacuaagcagaccgggucugcaaguuccacaguuaauggaguagugaggcuacucaccaagccuugggacgucauucccauggugacucagauggccaugacggauacaaccccauuuggccaacagcggguuuucaaagaaaagguggacacuagaacccaggagccuaaagaagguacaaagaaacugaugaagaucacggcugagugguuguggaaggaacuggggaaaaagaaaacaccccgcauguguacuagggaggaguuugcgcgaaagguccggagcaacgccgcacucggagcuauuuucacagaugaaaauaaauggaagucagccagagaggcaguggaagacuccagguuuugggagcuuguagauaaagagcgcaaccugcauuuagaaggcaagugcgagaccuguguguauaauaugaugggcaagcgugagaaaaagaucggggaguucggaaaagccaaggguucucgggcuauaugguacauguggcugggcgccagauuuuuggaguucgaggcgcucggguuucugaacgaggaccacugguucagcagggaaaauagucuauccggaguugagggcgaaggucuucacaaacugggguacauccuccgcgaggucagcaagaaggaaggaggcgcaauguaugccgaugacacugcuggcugggacacacgaauuacccuggaggauuugaaaaacgaggaaauggugacaaaucauauggagggggaacacaagaaacuggccgaggcaaucuucaagcucacuuaccagaacaaagugguccggguucaaagaccaacccccaggggaacggugauggacauuaucucucgcagagaucagcgggguucaguacaggugggcaccuaugggcuuggaacauuuacuaauaugggcgcucaacugauuaggcagauggaaggugagggggucuucaagggaauacagcauuuaaccgccacagaggaaguggcuguucaggacuggcuggcccgugugggccgagagcgcuugaguagaauggcaaucuccggcgaugacugcgucgugaagccucucgaugaccgguuugcgagcgcccugacugcucuaaacgauauggggaaaguaaggaaggacauucaacagugggaaccaucucgcggauggaacgauuggacccagguuccguucugcucgcaccauuuucacgagcuuaucaugaaagacgguagagugcuggucgugcccugucggaaucaggaugagcucaucggcagggcccgaauuucacaaggggcaggauggagccugcgugaaacggcuugcuugggcaaguccuacgcccagauguggaguuuaauguauuuccacagacgcgaccugcggcucgcagccaacgcgauauguucugcugugccuagccauugggucccaacauccaggaccacuuggucaauccacgccggucaugaguggaugacaaccgaagacaugcuuacuguuuggaauagaguguggauucaggagaaccccuggauggaagauaaaaccccuguagagaguugggaggaaaucccauaccuggggaagcgcgaggaccaguggugcggaucucuaauuggccugacaagccgggcaacgugggccaggaauauccaaaccgcuauaaaccaggugcgaucccucaucggcucagaagaguauacugauuacaugcccagcaugaagagauuugggcgggaagaggaggaagccggagucuugugguga

SEQ ID NO: 14586 - RNA, 9876 nt, Artificial Sequence
  derived and/or modified CDS sequence (opt3) from DENV-2__KJ010186__SS-prME
accgccggcgugaucauuaugcugauacccacagcuauggcauuccaccucacuacgagaaacggggagccucauaugaucgucagcaagcaggaaaaaggaaagucccuucuguuuaaaaccgaggacgguguuaauaugugcacauugauggccauggauuuaggcgaacugugugaggacacuauuaccuacaacugcccacuacucaggcaaaaugaaccggaggauaucgacuguuggugcaacgcgacaucuaccugggugacuuaugggacauguaccgcuacgggagagcaccggcgcgaaaagcgaucaguagcccuggugccccaugucggcaugggucuugagacucguaccgaaacauggaugaguagcgagggggcauggaaacacgcccagagaauugagacuuggauccugaggcauccuggauucaccauaauggcugcaaucuuggccuacacaauuggcaccacguauuuucagcgggugcucaucuucauucugcugacugcuguugccccauccaugacaaugcgcugcaucggcauaucuaauagagauuuuguggaaggggucucgggagguucauggguggacauuguacucgagcacggcagcuguguuaccacuauggcgaagaacaagcccacauuagauuucgaacugaucaaaaccgaggcaaagcagccugccacgcuuaggaaauacugcauugaagcucgguugaccaauacaacuaccgccagucgcuguccaacacaaggggagcccucccugaacgaggaacaggacaagcgauuugugugcaaacacucuauggucgauagaggauggggcaaugguugugggcuauucggaaagggcggcaucgugacuugcgcaauguuuaccugcaagaaaaacauggaggggaagaucgugcagccugaaaaucucgaguauacaauugucguuaccccacauagcggagaagagaacgcuguggguaaugacacuggcaaacacgggaaggagauaaaaguaacgccgcaguccucaaucacagaagccgagcugaccggauacggcacugugaccauggaauguagucccaggacaggucuugauuucaacgagaugguccuguugcaaauggaaaauaaggcguggcucgugcaucggcagugguuucuggacuuaccucugccauggcuccccggggccgauauucagggcagcaacuggauccagaaagagacccuuguuacuuucaagaagccucacgcaaaaaagcaagacguggucgugcugggaucucaggagggcgcuaugcacacagccuugacgggggcuaccgaaauacagauguccucaggaaaccuacuguuuacuggucaucucaaaugccgucugcgcauggacaagcuucaacugaaaggcaugagcuauaguauguguacagggaaguucaagguaguuaaagagauugccgaaacccagcacggaacaaucguggucagagugcaguacgagggcgaugguucuccaugcaagauccccuucgagauuauggacuuggaaaaaaggcauguccucgggcggcugaucacugugaauccgauuguuaccgagaaggauuccccugugaacauagaagcagagcccccauuuggcgacagcuacaucauuaucggaguagaaccuggccaguuaaaacugucgugguucaagaaggggucuuccaucggacaaauguuugagacgaccaugcgaggugccaaacgcauggcuauucuaggcgauacagcgugggacuucgggucacucggaggcgucuuuacuaguauagguaaggcacugcaccagguguucggggccaucuauggcgcugccuuuagcggaguuuccuggaccaugaaaauucuuaucggcguggucauuacauggaucgggaugaauucuagaagcacuucauugagugugucccugguacucgugggaguugucacccuguaccuuggcgugauggugcaggcagauagcgguugugucguuucuuggaagaacacggcccugaaaugcgggucaggaauauucaucacagacaaugugcauaccuggacugagcaguauaaguuucaacccgaaaguccaagcaaguuggcuuccgccauucagaaagcacacgaggaaggcaucugugguauuaggucugugacacggcucgagaaccugauguggaagcagaucacccccgaauuaaaucacauacugucggagaacgagguaaaacuaagcauuaugacuggcgauaucaaggggauucuccaggcgggaaaacgcucccugagaccucaaccaaccgaacuuaaguacucauggaaaacauggggcaaggcuaagauguugaguacggagucucauaaucagaccuuccugaucgacgggccggaaacugccgagugccccaacacaaauagggcauggaacagccucgaagucgaggauuauggauuuggcguguucaccacaaauauauggcugaaauuaaaggagcgucaggacguuuuuugugacuccaaacugaugucagccgcuaucaaggauaaccgggccgugcacgcagacauggguuacuggauugaaagcgcucuuaaugauacuuggaaaaucgagaaggccucuuucauugaagucaaguccugccauuggccuaaaagucacaccuuguggagcaacggggugcucgagucugagaugaucauaccaaagaacuucgcgggacccguuucccagcacaauuaucgaccuggcuaccauacgcaaacagccgguccauggcaccugggcaaacuagaaauggacuuugauuucugugaggggaccacugugguagucaccgaagacugcggaaacagaggccccucacugaggacaacuaccgcuagugggaagcucauuacagaguggugcugucgcagcugcacgcugccgccucuucgguacagaggagaagauggcuguugguaugguauggagaucaggccauugaaagagaaggaagagaaucuggugaacucguuagugaccgcagggcauggacagaucgacaauuuuucccucggcguccuggguauggcccuuuuccuggaagagauguugcgcacucgaguuggcacaaagcacgcugugcuccugguagccgugucuuuuaugacccuaauuacugggaacaugagcuuccgggaucugggacgugucauggugaugguuggcgcagcgaugacagacgauaucgggaugggagugaccuaccucgcccugcuugcugccuuuaaagucagacccacguucgcagcuggcuugcuguuaaggaagcucacuucaaaagaacugaugaugaccacaauugguauagugcuucugagucaguccaccacuccugagacaauccuagagcucaccgacgcccuggcauuggggaugaugauucugaagaucguucgcaauauggaaaaauaucaauuagccgugacaauuauggcuauccucugcguccccaacgcgguaauacugcagaaugccuggaaggugucuuguacuauccuugcagcuguuagcguguccccacuguugcucaccucaagccagcagaaggccgauuggauuccucuggcccuaacgaucaaaggacugaaccccacagcuauuuuucuuaccacucucagucggaccaauaagaaaagaucuuggccacugaacgaggcaaucauggccgucggcaugguguccauauuggcgagcucgcuguuaaagaaugacauuccgaugacaggcccucucguagcugggggacugcuuacugugugcuacguccugaccgguaggucagccgacuuggaacucgagcgagcagccgauguucgcugggaagaccaagcugagaucucuggcaguucccccauccugagcauuacgauaucugaggaugggagcauguccaucaaaaacgaagaggaagagcagacacuaaccauucugauccggacuggacuucucgugauuucaggccuguucccagugaguauccccauaacagcagccgcgugguauuugugggaggucaagaaacagagagcugguguguuaugggacguuaggagcuacccuccaguagggaaggccgaacuggaggauggagcauaucguaucaagcagaaaggcauucucggcuacucucaaaucggggccggaguguacaaggaagguaccuuucauacuauguggcacgucacacgcggcgcugugcugaugcacaaagggaagcggauugagcccuccugggccgacguuagaaaagaucuuaucucauauggaggcgguuggaagcuggaaggggaguggaaggagggagaagaggugcaggucuuggcacuagaaccuggcaaaaauccgagggcugugcagaccaagccaggccuguucaaaacgaacacugggaccauaggagccguaagucucgacuuuagccccgguacauccggcucuccuauugucgauaagaaagggaaggugguuggacuguacggcaacgguguggucacccgaucggggacauaugugagcgcgaucgcccagacugagaagucaaucgaagacaauccagagauugaggaugacaucuuccggaaaaagcgccuuaccauaauggauuuacaucccggagcaggcaaaacgaagagauaccugccugcuauuguuagggaagccaucaaacggggccuccgaacauugauucuggcuccgacuagaguggucgcagccgagauggaagaggcccuccgcgggcugcccaucagguaucaaaccccagcuauacgugcggaacacacaggacgggagauuguggaccuuaugugucaugcaaccuucacuaugagacuguuguccccuguaagggugcccaacuacaaucuaaucaucauggacgaggcccacuuuaccgauccagcuaguauugccgcacgcgguuauaucucuacacgaguugaaaugggcgaggccgcugggauuuucaugacggcgacuccucccggaagcagagacccauuuccgcaguccaacgccccuauaauggaugaagagcgggagauccccgaaaggucauggaauucuggccaugagugggucaccgacuucaaggguaagacagugugguuugugccaagcauuaaagcagggaacgauaucgcugccugccugcgcaagaauggaaaaaaggucauccagcucagucguaaaaccuucgacuccgaauacauuaagacuagaacaaacgauugggacuuuguagugaccacggauauaagcgagaugggcgcaaauuucaaggccgaacggguuaucgaccccaggcgcuguaugaaaccugugauuuuaacugauggcgaggagcgagucauccuggcugggccaaugcccgugacacacucuucagccgcgcaaagacggggaaggauuggucgcaacccuaagaaugaaaacgaccaguacaucuauaugggcgagccgcuugaaaaugacgaggauugcgcacacuggaaagaagccaagaugcugcucgacaacauaaauaccccagaggggaucauucccuccauguuugagccugaaagagagaaaguugaugcuaucgacggagaauacagguugcggggcgaggcccguaagaccuucguggaucugaugcgccgaggugaccuccccgucuggcuggcuuauagaguggcagccgaagggauuaacuacgcugauaggcggugguguuuugacggcaucaaaaacaaucagauacuugaggagaacguagaaguggagauuuggacuaaggaaggagagcgcaagaaacuaaagccaagauggcuggaugccaggaucuauagugacccuuuggcauuaaaagaguucaaggaauucgcggccggccggaaaagccugacacucaaucugauuaccgagauggggcgacuucccacauuuaugacucagaaggcuagaaacgcccuggauaaucucgcaguuuugcauacggcugaagccggaggucgcgcauacaaccacgcccugucggagcuaccagaaacccuggagacacuccuucuguuaacuuugcuggcuaccgucacaggcgggaucuuccucuuucugaugucuggaaagggcauagguaaaaugacccuugggaugugcugcaucauuacugcguccauccugcucugguaugcccaaauucagccucauuggaucgcagcuagcauaauuuuggaguucuuucugaucguguuacuaaucccggaacccgagaagcagaggacgccacaggacaaucaacugaccuacguggucauugccauccucacaguuguggccgcaacuauggcuaacgaaaugggcuuccuugagaaaaccaagaaagauuuuggacugggcucaauagccacacagcagccugaaaguaauauuuuggacaucgaccugcggcccgcgucugcuuggacccucuacgccguagcaacuacauucauuacgccaaugcugcgucacuccaucgagaacagcucagugaaugucagucuuaccgccauagcuaaccaggcaacugugcucauggggcugggaaaggguuggccuuugagcaagauggauaucggcguuccccuguuagccauuggguguuauucccaagugaauccgaucacacuaaccgcggcucugcuccuucuggucgcccacuacgcaauuaucggaccaggcuugcaggccaaagcuaccagagaggcccagaagagggcagcugccgguauuaugaaaaacccuacaguagacgggaucacugugauagaucuggaccccauuccauaugaucccaaguuugaaaaacagcucggccaaguuaugcugcuuguguuaugcgucacgcaggugcugaugaugcgcaccacaugggcgcucugugaggccuugacucuggcaaccggaccuaucucuacacuaugggaaggcaauccggggcgguucuggaacaccacuaucgcugucagcauggccaauauuuuucgaggauccuaccuggcaggcgcuggucuccuuuucucaauaaugaagaacacgacaaacaccagaagggggacuggaaauaccggcgagacacugggugaaaaguggaaaaaccgcuugaauucucugggcaagagugaguuucagaucuauaaacggucggggauucaagagguggacagaacucucgccaaggaaggaaucaaacguggcgagaccgaucaucacgccguuagcaggggguccgcgaagcugcggugguucguggaacgcaacuuaguaacacccgagggaaaaguggucgaccuuggcugcggucgagggggauggucuuacuauuguggcggucugaagaauguuagagaggugaagggccucacgaaagggggaccaggccaugaagagccuauucccaugucaaccuacggguggaaccuagucaggcugcagagcggaguggauguauucuuuacuccuccagaaaagugcgacacauugcugugugauaucggcgaguccagucccaauccuaccguggaagcuggucggacucuccgcguucuuaaccugguggagaauugguugaacaauaacacacaguucugcauaaaaguccugaauccauacaugcccucugugaucgagaagauggaaacccuccagagaaaauaugggggagcauuagucaggaacccgcugagccgaaauucaacgcacgagauguacuggguguccaacgccaguggcaacauuguuagcucuguaaauaugaucucccggaugcuuauuaaccguuuuaccaugagacauaagaaggcuacauaugaaccugacguggaucugggcucagggacucgcaauaucggaauagagagcgaaaccccaaaccuagacauuaucgguaaaaggaucgagaagauuaaacaagagcacgaaacaucguggcacuacgaccaggaucaucccuauaagacuugggccuaccacggcucuuaugagaccaaacagacagggagugcauccagcauggucaauggagugguucggcuccugaccaagccuugggacgugauaccaauggucacucagauggccaugacggauacaacccccuucggccaacagagaguguuuaaggaaaaaguagacacucgcacccaggagccgaaggaagguacaaaaaaguugaugaaaaucacggcugaguggcuguggaaggagcucgggaagaaaaagaccccuaggauguguacucgagaagaguucgcgcggaaagugagaucaaacgccgcacuuggagcuauuuuuacagaugaaaauaaguggaaauccgccagggaggcaguugaggacucucgcuucugggaacuggucgauaaggagcguaacuuacaucuggaaggcaaaugcgagaccuguguguacaauaugaugggcaagcgggaaaagaaaaucggggaguuuggaaaggccaaagguagcagagcuauuugguacaugugguugggcgccagguuccucgaguuugaagcgcugggguuccuaaacgaggaccacugguuuagucgcgaaaauucccuuagcggaguggagggcgaaggucugcacaagcucggguauauccugcgagaggucucuaaaaaggagggaggcgcaauguacgccgaugacacugcuggcugggauacacggauaaccuuggaagaccugaagaacgaggaaaugguuacaaaucauauggagggggaacacaaaaagcucgccgaggcaaucuucaaacuuacuuaucagaacaaggugguaagagugcaaaggcccaccccacgcggaacggucauggacauuaucucaagacgggaucagagggguaguggccagguggggaccuacggacugaauacauucacuaacaugggcgcucaauuaauucgucagauggagggugaagggguuuuuaaaggaauccagcaucugaccgccacagaggaaguggcuguccaggacugguuggcccgagugggccgcgagagacucucccggauggcaauuagcggcgaugacugcguaguuaagccucuggaugacagguucgcgaacgcccuaacugcucuuaaugauauggggaaggugcgcaaagacauacaacagugggagcccucuagaggauggaacgauuggacccaggucccauuuugcucgcaccauuuccacgaacugaucaugaaggacggucgggugcucgugguccccuguaggaaucaggaugagcugauuggccgagcccguaucucacaaggggcaggauggagcuugagagaaacggcuugcuuaggcaaauccuaugcccagauguggagucugauguacuuucaccgccgggaccucaggcuugcagccaacgcgaucuguucugcuguuccuagccauugggugccaacauccagaaccacuuggucaauucacgcccgccaugaguggaugacaaccgaagauaugcugacuguauggaaucggguguggauacaggagaacccguggauggaggacaagacccccgucgaaaguugggaggaaaucccuuaucuagguaaaagggaggaccaguggugcgggucucugauuggacucacaagccgagcaacgugggccagaaauauccaaaccgcuauuaaccaggugcgguccuugaucggcucagaagaguacacugauuacaugccaagcaugaagagguuccgccgugaggaagaggaagccggcguucugugguga

SEQ ID NO: 14587 - RNA, 9876 nt, Artificial Sequence
  derived and/or modified CDS sequence (opt3) from DENV-2__KF955364__SS-prME
accgcaggcgugauaauuaugcugauaccaacggcuauggcauuccaccucacuacgcggaacggggaaccucauaugaucgucggaaggcaggaaaaggguaaaagccuucuguuuaagaccgaagacggcguuaauaugugcacauugauggccauugauuuaggggaacugugugaagacacuaucaccuacaaaugcccauuacuccggcaaaacgaaccggaggauauugacuguuggugcaauuccacaucuaccugggugacuuauggaacauguaccacgacuggcgagcaccgccgagaaaagcguucaguagcgcuggugccacaugucgguauggggcuugagaccagaacagaaacuuggaugaguagcgagggagcuuggaaacacgugcagaggaucgagaccuggauacugcggcauccuggcuucacaaucauggccgcaauuuuggccuacaccaucggcacgacucacuuucagcgcgcucucauuuucauccugcugacagcaguugccccauccaugaccaugagaugcauagggauuucuaacagggauuuuguggaaggagucucggguggcucauggguggacaucguacucgagcacgggagcuguguuacuacaauggcuaagaauaagcccaccuuagauuucgaacugauuaaaacggaggccaagcagccugcgacccuucggaaauauugcaucgaagcaaaguugacaaacacuaccacagagagucgcuguccaacucaaggagagcccucccugaaugaagaacaggacaaacgauuuaucugcaagcauucuaugguggauagaggcugggguaacggguguggauuauucggcaagggcgggauuguaaccugcgccauguuuacaugcaaaaagaauauggaaggaaaaguggugcucccugagaaccuggaauacaccauagucaucacuccacacagcggugaggagcaugcuguuggcaaugacacggggaagcacggaaaagaaauuaagaucacaccgcaguccucaauaaccgaggccgaacuuacuggcuaugguaccgugacaauggaguguagucccaggaccgggcuggauuucaacgaaaugguauugcuccagauggaggacaaagcauggcuggugcaccggcaaugguuuuuagaucugccucucccauggcuucccggcgcugacacucagggaagcaauuggauucagaaggagacacuggucacguucaagaacccucaugccaaaaagcaggacgugguuguguugggcucucaagaaggggcgaugcacaccgcccuaacuggagcaacagagauccagauguccucagguaaucugcucuuuaccggccaucugaaaugccgucuucgcauggauaagcugcaguugaaagggaugagcuacaguauguguacaggaaaguucaagaucgucaaagaaauugcugagacucaacacggcaccaucgugauuagaguacaguaugagggugacgggucuccaugcaagauacccuucgaaaucauggaucucgagaaaaggcauguucugggccgguuaauuacggugaacccgaucgucaccgaaaaggacuccccugugaacaucgaggccgaacccccauuuggagauagcuacauuauaaucggcgucgagccugggcagcugaaacuaaauugguucaagaagggaucgucuauuggucagauguuugagacaacuaugcgaggcgcuaaacgcauggccauccucggggacaccgcaugggauuucggaucccugggcgguguguuuacaucaauugggaaggcccuucaccaaguuuucggcgcuaucuacggagcggcauuuaguggcgugagcuggacuaugaaaauauugaucgggguaauuaucaccuggauuggaaugaacuccagaucuacgagccugucagucagucucgugcugguuggcguggucacacuuuaucugggugugaugguacaggccgacaccgggugugugguuuccuggaagaauaaagaauugaagugcggaagcggcaucuucauaacugauaacguccacacauggaccgagcaguacaaguuucagcccgaaucuccaucaaaacucgcuagugccauucaaaaggcacaugaggaagguaucuguggcauuaggagcgugacucggcuggagaauuuaauguggaaacagaucacccccgagcugaaccacauacuauccgaaaauggggugaagcucacaaucaugacgggagacauuaaaggcaucaugcaggccgggaagcgcucucugagaccucagccaaccgagcuuaaauauucguggaagacuuggggaaaggcuaaaauguugagcacagaaucccauaaccaaaccuuccugauugauggcccggagacagccgaaugccccaauacuaacagggcauggaacucacucgaggucgaggacuacgguuuugggguuuucaguaccaacaucuggcugaaguuacgugaaaaacaggacgugcugugugauucuaaacuuaugagcgcggcuauaaaagacaaucgggccgugcacgcagauaugggauauuggauugaguccgccuugaacgacacguggaagauggaaaaggcuucauuuaucgagaucaaaagcugccacuggccuaagucucauacacucugguccaauggcguacuggagagugaaaugauuauccccaagaauuucgccggucccgucagccagcacaacuaccgaccuggcuaucauacccagacugcagggccauggcaccuaggaaagcuggagauggauuucgacuuuugugaaggcaccacagugguugugacugaggauugcgggaauagaggacccucucucaggaccacaacggcuuccggcaaacugauuaccgaauggugcugucgcucaugcacucuuccgccuuugcgguacagaggugaggacggguguugguacggaauggagauaaggccacugaaggaaaaggaggaaaacuuagucaauagucucgugacagccggccauggucaaaucgauaacuucagccugggcguucuugggauggcgcuguuuuuggaggaaaugcuccgcacccgagugggaacuaaauaugccauucugcuaguagcugucucguucgugacacugaucaccggcaauauguccuuucgggaccucgggcgugugauggucaugguuggagcaacgaugacugaugacauuggcaugggugugaccuaccuggcccuuuuggcugccuucaagguaagacccacauuugcagcggggcuguuacucaggaaacugaccucuaaggagcuuaugauggccacuaucggaauagcucugcuaagccagucaacaaucccugagaccauucucgaacugacagaugccuuggcacugggcaugaugguguuaaaaaucguccgcaacauggagaaguaucagcucgcugugacuauuauggccaucaguugcguucccaaugcagugauacugcaaaacgccuggaaggucuccuguaccauucuugcugcggugucuguuagcccacuguugcucacguccucacagcagaaagccgacuggaucccucuggcacuaacaaucaagggccugaaucccaccgcuauuuuccuuacuacccucagccggacaaguaaaaagagaucuuggccacugaacgaagccgugauggccgucgggaugguauccauauuggcuagcucgcugcucaaaaaugacaucccgaugacuggaccucuaguggccgguggccugcuuaccguuugcuacgugcugacggggaggucagccgauuuggagcucgaacgagcggcugacgucaagugggaggaucaggccgagauuucuggaaguucccccauccugagcauuacaaucucugaagacggcagcauguccaucaaaaaugaggaagaggagcacacccuaacuauccugauucgcacaggucuucucgugaucucagggguauuuccagugaguauucccaucaccgcagccgcuugguaucugugggaagucaagaagcaacgggcaggaguuuugugggaugugccuagcccacccccugugggcaaagccgaguuagaagacggcgcguacagaauaaagcagagggggauuuucggauauucucagaucggugcuggcgucuacaaagaggggacuuuucacacaauguggcaugugacccguggagccguucugaugcaccgcggcaagcggaucgaaccguccugggcagaugucaaaaaggaccucauuucauacggugggggauggaagcuggagggcgaguggaaagaaggcgaggaagugcagguccuugcccuggagccagggaagaaucccagagcugugcaaacgaaaccuggauuguucaagacuaacaccgguacaaucggcgccguuagucuagauuuuagcccagggaccuccggaucucccauaguggacaggaaaggcaaggucgugggucuguaugggaauggaguagucacacgaucgggcgcauacgugagcgcuauugcccagacugaaaagucaaucgaggauaacccugagauugaagacgauaucuuccggaaaaagcgccucaccauaauggaccugcauccgggcgcggggaaaacgaagagauaucuucccgccauuguuagggaggcaaucaaacggggauuacgaacacugauccucgcuccaacuagaguggucgccgcugaaauggaggaagcauugcgcggucugccuauuagguaccagacccccgccauccgugccgagcacacaggccgggagauuguggaccucaugugucaugcuaccuucacuaugagacugcuuuccccaguuagggugccuaacuauaaucugauaaucauggaugaagcgcacuuuaccgaccccgcaaguauugccgcucgcggguacaucucuacacgagucgagaugggagaagccgcaggcaucuucaugacggccacuccaccggguagcagagauccuuuuccccaguccaacgcuccaauuauggacgaggagcgggaaauacccgagaggucauggaacucugggcacgaaugggugaccgauuucaagggaaagacaguaugguuugugccuagcaucaaagcgggcaacgacauugccgcaugcuugcgcaagaauggcaaaaagguuauccaacuaagucguaaaaccuucgauuccgaguaugucaagacuagagcuaacgacugggauuuuguggugacaaccgacauuagcgaaaugggggccaauuuccgggcagagagggucaucgauccacgccgauguaugaagcccguaauacugacggacggagaggaaagagugauccucgccgguccuaugccgguuacucauucuucagcugcccagcggaggggccgcauugggagaaaccccaaaaaugagaacgaccaguacaucuacaugggagaacccuuagagaaugaugaagacugcgcgcacuggaaggaggcaaaaaugcugcuugauaacauuaauacaccugagggcaucauacccuccauguuugaaccagagagggaaaagguggacgccauugauggugaguaucggcugcguggggaagcucgcaaaaccuucgucgaccucaugcgaagaggcgauuugccuguguggcuggccuacaggguugcugcagagggaaucaacuaugccgaccggcgcugguguuuugauggcauuaagaauaaccaaauccucgaggaaaacguggaggucgaaauauggaccaaagagggggagagaaagaagcugaaacccagguggcuugacgcucggaucuacagugauccacuagcccugaaggaguucaaagaguucgcagcgggacgaaagagcuugacuuuaaaucugauuacagaaauggguagacucccuaccuuuaugacacagaaagcccgcgacgcucuggauaaccuugccgugcugcauacugcagagguaggcgggagggcuuauaaucacgcccucucggaauugccggagacgcuggagacccuacugcuccuuacacuguuagcaacugugaccggaggcaucuucuuguuucugaugucugguaaggggauuggcaagaugacacucggaaugugcugcaucauaaccgccuccauucugcuuugguacgcucagauccagccccacuggaucgcggccagcauuauccuggaguucuuucucauaguuuugcugauuccagagccugaaaaacaacggacuccccaggacaaccaguuaacguaugucgugaucgcaauucuaaccguggucgcugccacaauggccaaugagaugggcuuccuggaaaagacuaaaaaggaccucgggcuuggaucaaucaccacacaggagagugagucuaacauacuggauaucgacuugcguccagcauccgcuuggacccuguacgccguugcgacuacauuugugacgccuaugcucagacauagcauugaaaauucaaguguaaacgugagccugaccgcuaucgccaaucaagcaacuguccuuaugggucucggcaggggguggccccuguccaaaauggauauuggagugccguugcuggccaucggcuguuacucucagguuaacccaauuacauuaaccgcugcacuacugcuccuuguggcccacuaugcgaucauagguccugggcugcaggcuaaggccacccgcgaggcacagaagcggacagccgcuggcauuaugaaaaaucccacugucgacggaaucacgguaaucgauuuggaaccaauucccuacgacccuaaguucgagaaacaacugggccaggugaugcuccugguucuuugcgugacccaggucuuaaugaugcgaacaacuugggcccugugugaagcacucaccuuggcuacagggccgauaagcacccugugggagggaaaccccggcagauuuuggaauacuacgaucgccguguccauggcgaacauuuucagggguucauaucuagccggggcaggacugcucuuuucuaucaugaagaauacaaccaacacucgccggggcaccgguaauauuggcgagacacuuggggaaaaauggaagaguagacugaacgcuuugggaaagucggaguuccagaucuacaaaaagagcggcauacaagaagucgaucguacucuggccaaagaggggaucaagaggggagagaccgaccaucacgcagugucccggggcucugcuaaacuccgcugguuuguugaacgaaacauggugacaccagaggguaagguaguggaucuggggugcggaagaggcgguuggucauauuacuguggcgggcuuaaaaaugucagggaaguuaagggacuaacgaagggcgggccuggacaugaggaacccauuccuaugagcaccuauggcuggaaccuggugcggcuccaguccggugucgacguguucuucacuccacccgagaaaugcgauacacuacugugugacaucggggagaguucuccuaauccaaccauugaagccggacgcacuuugagaguacugaaccucguggagaauuggcuuaacaauaacacacaguuuugcguuaaggugcugaaucccuacaugccgagcgucaucgagaaaauggagaccuugcaaaggaaguacggcggcgcccuggugcgaaacccucucucaagaaauuccacgcacgaaauguauugggucaguaacgcgaccgggaauauagugagcucuguuaacaugauuucccguauguuaaucaauagauucacaaugaaacacaagaaggcuacuuacgagccagauguagaccugggaucagguacccgcaacaucggcauugagaacgaaauacccaaucuugacaucauugggaaaaggaucgagaagauuaaacaggaacaugagacaagcuggcacuaugaucaggaccauccuuacaagacuugggcauaucacggaucguacgaaaccaaacagacaggcucugccaguuccauggugaacggugucgugaagcugcuaaccaagccaugggauguugugcccauggucacucaaauggcuaugacggacacaaccccguuugggcagcagcggguguucaaagagaagguagauacuagaacccaggagccuaaagaaggaacaaagaaacucaugcgcaucacggccgaguggcuguggaaggaauugggcaagaaaaagacccccaggauguguacucgagaggaguuuacacggaaagugagaagcaaugcagcccugggcgcuauauucaccgacgaaaacaaguggaaaucagcgagggaggccguugaagauucccgcuuuugggagcucgucgaccgugaacggaaucuucaccuggaggggaagugcgagacuuguguguauaacaugaugggaaaaagagaaaagaaguuaggugaguucggcaaagcaaaggggucuagggcuaucugguacauguggcugggagcccgcuuuuuggaguucgaggcacucggcuuucugaaugaagaucauugguucagccgagguaacagucuauccgggguggagggagagggccuucacaaacugggcuacauucuccgggacgucagcaagaaagaagggggagccauguaugcugaugacacagccgguugggacaccagaaucacacuggaggauuugaagaaugaagagaugguuacuaaccauaugaagggcgaacacaaaaagcuggcggaggcaauuuuuaaacucaccuaccaaaauaaggugguaagggugcagcgcccaacgccuagagggaccgucauggacaucauuucucggaaagaucagaggggaucaggccagguggguacauaugggcuuaacacuuucaccaauauggaggcccaacugauacgucagauggaaggagagggcaucuucaagaguauucagcgauuaacaguuacugaagagaucgcugugcaaaacuggcuggcccgcgucggcagagagcgguuguccaggauggcaaucagcggggacgauugcgugguaaagccccucgacgaucgcuuugcuucugcccugaccgcucuaaaugacaugggaaaaguuagaaaggauauucagcagugggaaccaucgcgggguuggaacgacuggacacaggugcccuucugcucacaucacuuucacgagcuugucaugaaagauggcagggugcugguggucccuugucgaaaccaagacgaacucauagggcgugccagaaucagccagggagcaggcuggucccugaaggagacagcgugcuuggguaaaaguuacgcccagauguggaccuuaauguauuuccaucgccgggaucugaggcucgcugccaaugcaauuuguucugcuguuccaagccacugggugccgacuuccagaacaaccuggucaauccaugccaagcacgaauggaugacuaccgaggacaugcuugcaguauggaaccgcguguggauucaggagaaucccuggauggaagacaagacaccugucgagaguugggaagaggugccauaccuggggaaacgggaagaucaauggugcggaucucuaaucggccugacgagcagggccaccugggcgaagaacauacagacugcuaucaaucagguucgaucccucauuggcaacgaggaguauacagacuacaugcccucaaugaaaagauuucggaaggaagaggaagaggccgggguguugugguga

SEQ ID NO: 14588 - RNA, 9876 nt, Artificial Sequence
  derived and/or modified CDS sequence (opt3) from DENV-2__KF955372__SS-prME
accgccggcgugaucauuaugcugauacccacagcuauggcauuccaccucacuacgagaaacggggagccucauaugaucgucggaaggcaggaaaaggguaaaagccuucuguuuaagaccgaggacggcguuaauaugugcacauugauggccauugauuuaggggaacugugugaggacacuaucaccuacaaaugcccacuacuccggcaaaacgaaccggaggauauugacuguuggugcaauuccacaucuaccugggugacuuauggaacauguaccacgacuggcgagcaccgccgagaaaagcguucaguagcgcuggugccccaugucgguauggggcuugagaccagaacagaaacuuggaugaguagcgagggagcuuggaaacacgugcagaggaucgagaccuggauacugcggcauccuggcuucacaaucauggccgcaauuuuggccuacaccaucggcacgacucacuuucagcgcgcucucauuuucauccugcugacagcaguugccccauccaugaccaugagaugcauagggauuucuaacagggauuuuguggaaggagucucggguggcucauggguggacaucguacucgagcacgggagcuguguuacuacaauggcuaagaauaagcccaccuuagauuucgaacugauuaaaacggaggccaagcagccugcgacccuucggaaauauugcaucgaagcaaaguugacaaacacuaccacagagagucgcuguccaacucaaggagagcccucccugaaugaagagcaggacaaacgauuuaucugcaagcauucuaugguggauagaggcugggguaacggguguggacuauucggcaagggcgggauugucaccugcgccauguuuacaugcaaaaagaauauggaaggaaaaguggugcucccugagaaccuggaauacaccauagucaucacuccacacagcggugaggaguaugcuguuggcaaugacacggggaagcauggaaaagaaauuaagaucacaccgcaguccucaauaaccgaggccgaacuuacuggcuacgguaccgugacaauggaguguagucccaggaccgggcuggauuucaacgaaaugguauugcuccagauggaggacaaagcauggcuggugcaccggcaaugguuuuuagaucugccucucccauggcuucccggcgcugacacucagggaagcaauuggauucagaaggagacacuggucacguucaagaacccucacgccaaaaagcaggacgugguuguguugggcucucaagaaggggcgaugcauaccgcccuaacuggagcaacagagauccagauguccucagguaaucugcucuuuaccggccaccugaaaugccgucuucgcauggauaagcugcaguugaaagggaugagcuauaguauguguacaggaaaguucaagaucgucaaagaaauugcugagacucaacauggcaccaucgugauuagaguacaguacgagggugacgggucuccaugcaagauacccuucgaaaucauggaucucgagaaaaggcacguucugggccgguuaauuacggugaacccgaucgucaccgaaaaggacuccccugugaacgucgaggccgaacccccauuuggagauagcuacaucauuauaggcguggagccugggcagcugaaacuaaauugguucaagaagggaucgucuaucggucagauguuugagacaacuaugcgaggcgcuaaacgcauggccauucucggggacaccgcaugggauuucggaucccugggcgguguuuuuacaucaaucgggaaggcccuucaucaaguguucggcgcuauuuauggagcggcauuuaguggcguaagcuggacuaugaaaaucuugauaggggucaucauuaccuggaucggaaugaacuccagaucuacgagccugucagugagucucguucuggugggcgucgugacacuuuaccuggguguaauggugcaggccgacuccggguguguugucagcuggaagaauaaagaauugaagugcggaucuggcauuuucaucaccgauaacgugcacacuuggacagagcaguauaaguuucagcccgaaucaccaaguaaacucgcuagcgccauacaaaaggcacacgaggaagguauuuguggcaucagguccgugacccggcuggagaauuuaauguggaaacagauuacucccgagcugaaccauauccuaucugaaaaugaggucaagcucaccauaaugacaggggacaucaaaggaauuaugcaggccggcaagcgcucgcugagaccucagccaacggaacuuaaauacagcuggaagaccugggggaaggcuaaaauguuguccacugagucacacaaccaaacauuccugaucgauggaccggaaaccgccgagugccccaauacaaacagggcauggaauagucucgagguugaagacuauggcuuugguguguucucuacuaacauuuggcugaaguuacgugagaaacaggacguguuuugugauagcaagcugauguccgcggcuaucaaagacaaucgggccguacaugcagauaugggguacuggauagaaucagcccuuaacgacaccuggaagauggagaaggcuagcuucauugaggucaaaucuugccacuggccuaagucccacacguuguggaguaauggagugcucgaaagcgagaugaucaucccaaaaaacuucgccggccccguuucucagcauaacuaucgaccugguuaccacacacagaccgcaggcccauggcaucuggggaagcuagaaauggauuuugacuucugugagggaacuaccguggucgugacagaagauugcggcaauagagggcccucccugaggacuaccacagcuucaggaaaacucauuacggaguggugcugucgcaguugcacccugccgccucuucgguacagaggcgaggacgguuguugguaugggauggaaaucaggccauugaaggagaaggaagagaaccugguuaauagcuuagugacugccggacacggccaaauugauaacuuuucgcucgguguacugggcauggcgcuuuuccuggaagagauguugcgcacacgagucgggaccaaacaugccauacuccugguggcuguguccuuugucacucuaaucacaggaaauaugucuuuccgggaccugggccguguuauggugaugguaggggcaaccaugacggaugacauuggaaugggcgugacuuaccucgcccugcuugcugccuuuaaggucagacccaccuucgcagcggguuugcuguuaaggaaacucacaagcaaggagcugaugauggccaccaucgggauugcucuucugucacagaguacuaucccugaaacaauacuagagcucaccgaugcccuggcauugggaaugauggugcugaaaaucguucgcaacauggaaaaguaucaguuagcugugacaauuauggccaucuccugcguccccaaugcagugauucuccaaaacgccuggaagguuucuuguacuauccuggcugcggugagcgucuccccacuucuguugaccucaagccagcagaaagccgacuggauaccucucgcacugacgauuaagggccuaaaucccacagcuaucuuucugaccacucuuagucggaccucuaaaaagagauccuggccacucaacgaggccguaauggccgugggcaugguuagcauccuggcuucgucauugcugaaaaaugacauuccgaugacagggccuuuaguggcaggaggucuccugacugucugcuacgugcuuaccggcaggucugccgaucuggaauuggagcgagcggcugacguaaagugggaggaucaggccgaaauaaguggguccagccccauccucucuauuacgaucagcgaggacggauccaugucaauuaaaaacgaagaggaggaacaaacacugaccauccuaauacgcacuggccugcuugugaucaguggugucuucccaguuagcauucccaucacagcagccgcuugguaucucugggaggugaagaagcagcgggcaggggugcugugggaugucccuucuccacccccugugggaaaagccgaauuggaggacggcgcguacagaauuaagcagaggggcaucuuuggguauucccagauaggagcugguguuuacaaagaaggcaccuuccacacuauguggcacguaacacguggggccguguuaaugcaucgcggaaagcggauugagccgucaugggcagaugucaaaaaggaccugaucaguuacggcgguggguggaagcucgagggagaauggaaagagggcgaagaggugcaaguucuggcccuugaaccaggcaagaaucccagagcugugcagaccaaaccugggcuguuuaagacgaacacuggaaccaucggugccgucagcuuggauuucuccccaggcacaucugggucgcccauuguggacaggaaaggaaagguagucggccuauaugguaauggggugguuacccgaagcggagcauacgugucagcuaucgcccagacagagaaguccauagaggauaacccugaaauugaggacgauaucuuccggaaaaagcgccugacuauuauggaccuccacccgggcgcgggcaaaaccaagagauaucugcccgccaucgucagggaagcaauaaaacgggggcuucgaacguuaauucuggcuccaacaagagugguugccgcugagauggaagaggcacuccgcggauugccuaucagguaccagacucccgccauccgugccgagcauaccggucgggaaauuguggaccugaugugucacgcuacauuuaccaugagacuccugaguccagucagggugccuaacuauaaucuuaucauuauggaugaggcgcauuucacugaccccgcaucuaccgccgcucgcggcuacauaagcacacgaguagaaaugggggaggccgcaggaaucuuuaugacggccacuccaccgggcuccagagauccuuucccccaaucaaacgcuccaauuauggacgaggaacgggagauccccgaaaggucuuggaauagcggucacgagugggugaccgauuuuaaggggaagacaguuugguucgucccuaguaucaaagcgggaaacgacauugccgcaugccugcgcaagaauggcaaaaaggugauacaguugucccguaaaaccuuugauagcgaauaugugaagacuagagcuaacgacugggauuucgucguaacaaccgacaucucugagaugggcgccaauuuucgggcagagagggugauugauccacgccgauguaugaagcccguuauccuaacggacggggaagagagagugauucuggccggaccuaugccggucacucacucauccgcugcccagcggaggggucgcaucggcagaaacccaaaaaaugaaaacgaccaauacauauacaugggggagccccucgaaaaugaugaggacugcgcgcauuggaaggaggcaaaaauguuacuggauaacaucaauacaccugaaggaauuauccccaguauguucgagccagaaagggagaagguggacgccauugauggcgaauaucggcuucguggugaggcucgcaaaaccuuuguugaccugaugcgaagaggggaucucccugugugguuggccuacagggucgcugcagagggcaucaacuaugccgaccggcgcugguguuucgauggaauaaagaauaaccagauucuggaagagaacguggaaguagagaucuggaccaaagagggcgaaagaaagaagcucaaacccagguggcuggacgcucggauuuacagcgauccacuugcccuaaaggaguucaaagaauuugcagcggggcgaaagucgcugacuuugaauuuaaucacagagaugggaagacugccuaccuucaugacacagaaagcccgcgacgcucucgauaaccuggccgugcuucacacugcagaaguugguggcagggcuuauaaucaugcccugucugagcucccggagacguuggaaacccugcuacugcucacacuucuggcaacugucaccgggggaauauuuuuauucuugauguccggcaaggguaucgggaagaugacacugggcaugugcugcauuaucaccgccagcauucuccugugguacgcucagauccaaccccacuggauagcggccucaauuauccuugaguuuuuccugaucgugcucuugauuccagaaccugagaaacagcggacuccccaggacaaccagcugacguauguggucaucgcaauauuaaccguuguggcugccacaauggccaaugaaaugggauuucuagagaagacuaaaaaggaccugggccucgggaguauuaccacacaagagucugaauccaacauccuugauauugaccugcguccagcaagcgcuuggaccuuguacgccguagcgacuacauucgugacgccuaugcugagacacucaaucgagaauaguagcgucaacgugucccucaccgcuauagccaaucaggcaacuguucugaugggacuugguaggggcuggccccucucuaaaauggauaucggggugccgcuguuggccauuggauguuacagccaggucaacccaaucacacugaccgcugcauuacuacugcucguagcccauuaugcgauuaucggcccuggucuucaggcuaaggccacccgcgaagcacaaaagcgggccgcugccgggauuaugaaaaaucccacaguggacggcaucacuguuauagaucuggagccaauucccuacgacccuaaguuugaaaaacaguugggacaggugaugcugcucguccugugcgugacgcagguccuuaugaugcgaaccacaugggcauuaugugaggcucugacucucgccaccggcccgaucuccacauugugggaggggaaccccggaagauucuggaauaccacuaucgcggugucaauggccaacauuuuuaggggcucuuaucuggcaggugcugggcuacuguucaguauaaugaagaauacgacaaacacccgccggggaacuggcaauaucggugaaacccucggcgagaaauggaagucgagacuuaacgcccuggggaagagcgaauuucaaauuuacaaaaaguccggaauccaggagguugaucguacauuggcaaaagagggcauuaagaggggggaaacugaccaccaugcugugucucggggaucagccaaacugcgcugguucguagagcgaaacauggugaccccagaaggcaaggucguugaucucgguugcgggagaggaggcuggagcuauuacugugguggccugaaaaaugugagggaggucaagggguuaacaaagggaggcccugggcacgaagagcccaucccuauguccacguauggauggaaccuugugcggcugcagaguggcguagacguguucuuuaccccacccgagaaaugcgauacucuccuaugugacauaggugaaucuagcccuaauccaacaaucgaggccgggcgcacccugagaguuuugaaccugguggaaaauuggcucaacaauaacacucaauucugcauuaagguccuuaaucccuacaugccgucagugaucgagaaaauggaaacacugcagaggaaguacggaggcgcguugguccgaaacccucugucccggaauaguacccaugagauguauugggugagcaacgcuacgggcaauauuguuucuuccguaaacaugaucucacguaugcucauaaauagauuuaccaugaaacacaagaaggcaacauacgagccagauguggacuuagggagcggaacucgcaacauugguaucgaaaacgagauccccaaucuggacauuauaggcaaaaggaucgaaaagauuaaacaggagcacgaaaccucguggcauuaugaucaggaccacccuuacaagacaugggccuaucaugggucuuacgagacuaaacaaaccggaagugcuuccagcauggucaacggcgugguucggcuucugacaaagccaugggaugugguccccauggugacccagauggccaugacugacacgacaccguucggucagcagagaguauuuaaggagaaaguggauacccgcacucaagaaccuaaggaggggaccaaaaagcuaaugaggaucacagcagaauggcucuggaaagagcugggaaagaagaaaacgccccgaauguguacccgggaggaauucacuagaaagguuaggucaaaugccgcuuugggcgcgauuuuuacagacgagaacaaauggaaguccgcccgcgaagcagucgaggauucucguuucugggaacugguggaccgggagagaaaucuccaccuugagggcaaaugcgaaaccuguguguauaacaugauggggaagagggagaaaaagcugggagaauuugguaaggcuaaaggcagccgcgccaucugguacaugugguuaggggcacgauuccuggaguuugaagccuugggauuccucaaugaggaucacugguuuagucggggcaacucccugagcggugucgagggggaaggacuacauaagcuuggcuacauacugagagacguuucuaaaaaggagggcggggcuauguaugccgaugacacugcgggaugggacacaaggaucacccucgaagaucugaaaaaugaggaaauggugacaaaccacaugaagggugagcauaagaaauuggcagaggccauuuucaagcugacuuaccagaauaaaguagugcgcguccagagaccaaccccucggggcacggugauggacaucauuucaaggaaggaucagcgugggaguggacaaguuggcaccuauggucucaacacauucacuaauauggaagcucagcuuauccgacagauggagggggaaggaauuuuuaaauccauacaacgccugaccgugacagaggagaucgccguccagaacugguuagcaagagugggccgggaaaggcugagccgcauggcuauuucuggcgacgauugcguaguuaagcccuuggacgauagauucgccucggcucucacugcccugaaugacauggggaaggugcggaaagauauccagcagugggagccaucaaggggauggaacgacuggacccaaguccccuuuugcagccaccauuuccacgaacuagugaugaaggauggucgagugcuugucguuccuugucguaaccaggacgagcugaucggcagagcacgcauuucccagggggcgggauggagucucaaagaaacggccugccugggcaagucuuacgcucagauguggacauugauguauuuucaccggagggauuuaagacuggccgcaaaugcuauauguagcgccgugccaucccauuggguaccgaccucacgcacuacauggaguauccacgcaaaacaugaguggaugaccacugaggacaugcucgccguguggaaccgggucuggauucaagaaaaucccuggauggaggacaagaccccuguggaaucuugggaggaaguuccauaccuugguaagagggaggaucaguggugcgggagccugaucggacuaacaucccgagcgacgugggcuaaaaacauucagaccgccaucaaucaggugagaucacugauaggcaacgaggaauauacugacuacaugcccagcaugaagcgguucaggaaagaggaagaggaagcaggcguccucugguga

SEQ ID NO: 14589 - RNA, 9876 nt, Artificial Sequence
  derived and/or modified CDS sequence (opt3) from DENV-2__KF955373__SS-prME
accgccggcgugaucauuaugcugauacccacagcuauggcauuccaccucacuacgaggaacggggagccucauaugaucgucgggaggcaggaaaaggguaaaagccuucuguuuaagaccgaggacggcguuaauaugugcacauugauggccauugauuuaggggaacugugugaggacacuaucaccuacaaaugcccauuacuccggcaaaacgaaccggaggauauugacuguuggugcaauuccacaucuaccugggugacuuauggaacauguaccacgacuggcgagcaccgccgagaaaagcguucaguagcgcuggugccccaugucgguauggggcuugagaccagaacagaaacuuggaugaguagcgagggagcuuggaaacacgugcagaggaucgagaccuggauucugcggcauccuggcuucacaaucauggccgcaauuuuggccuacaccaucggcacgacucacuuucagcgcgcucucauuuucauccugcugacagcaguugccccauccaugaccaugagaugcauagggauuucuaacagggauuuuguggaaggagucucggguggcucauggguggacaucguacucgagcacgggagcuguguuacuacaauggcuaagaauaagcccaccuuagauuucgaacugauuaaaacggaggccaagcagccugcgacccuucggaaauauugcaucgaagcaaaguugacaaacacuaccacagagagucgcuguccaacucaaggagagcccucccugaaugaagaacaggacaaacgauuuaucugcaagcauucuaugguggauagaggcugggguaacggguguggacuguucggcaagggcgggauuguaacaugcgccauguuuacaugcaaaaagaauauggaaggaaaaguggugcucccugagaaccuggaauacaccauagucaucacuccacacagcggugaggagcaugcuguuggcaaugacacggggaagcacggaaaagaaauuaagaucacaccgcaguccucaauaaccgaggccgaacuuacuggcuaugguaccgugacaauggaguguagucccaggaccgggcuggauuucaacgaaaugguauugcuccagauggaggacaaagcauggcuggugcaccggcaaugguuuuuagaucugccucucccauggcuucccggcgcugacacucagggaagcaauuggauucagaaggagacacuggucacguucaagaacccucaugccaaaaagcaggacgugguuguguugggcucucaagaaggggcgaugcacaccgcccuaacuggagcaacagagauccagauguccucagguaaucugcucuuuaccggccaucugaaaugccgucuucgcauggauaagcugcaguugaaagggaugagcuacaguauguguacaggaaaguucaagaucgucaaagaaauugcugagacucaacacggcaccaucgugauuagaguacaguaugagggugacgggucuccaugcaagauacccuucgaaaucauggaucucgagaaaaggcauguucugggccgguuaauuacggugaacccgaucgucaccgaaaaggacuccccugugaacaucgaggccgaacccccauuuggagauagcuacauuauaaucggcgucgagccugggcagcugaaacuaaauugguucaagaagggaucgucuauuggucagauguuugagacaacuaugcgaggcgcuaaacgcauggccauccucggggacaccgcaugggauuucggaucccugggcgguguguuuacaucaauugggaaggcccuucaccaaguuuucggcgcuaucuacggagcggcauuuaguggcgugagcuggacuaugaaaauauugaucgggguaauuaucaccuggauuggaaugaacuccagaucuacgagccugucagucagucucgugcugguuggcguggucacacuuuaucugggugugaugguacaggccgacuccgggugugugguuagcuggaagaauaaagaauugaagugcggaucuggcaucuucauaaccgauaacguccacacuuggacagagcaguacaaguuucagcccgaaucaccaaguaaacucgcuagcgccauucaaaaggcacaugaggaagguaucuguggcauuagguccgugacccggcuggagaauuuaauguggaaacagaucacucccgagcugaaccacauacuaucugaaaaugaggugaagcucaccaucaugacaggggacauuaaaggaaucaugcaggccggcaagcgcucgcugagaccucagccaacggaacuuaaauauagcuggaagaccugggggaaggcuaaaauguuguccacugagucacauaaccaaacauuccugauugauggaccggaaaccgccgagugccccaauacaaacagggcauggaauagucucgaggucgaagacuacggcuuugguguuuucucuacuaacaucuggcugaaguuacgugagaaacaggacguguuuugugauagcaagcugauguccgcggcuauaaaagacaaucgggccgugcacgcagauaugggguauuggauugaaucagcccuuaacgacaccuggaagauggagaaggcuagcuucaucgagguaaaaucuugccacuggccuaagucccauacguuguggaguaauggaguccucgaaagcgagaugaucauucccaaaaacuucgccggccccgugucucagcacaacuaccgaccugguuaucauacacagaccgcaggcccauggcaccuggggaagcuagaaauggauuuugacuucugugagggaacuaccguuguggucacagaagauugcggcaauagagggcccucccugaggacuaccacagcuucaggaaaacucaucacggaguggugcugucgcaguugcacccugccgccucuucgguacagaggcgaggacgguuguugguacgggauggaaauuaggccauugaaggagaaggaagagaaccuggugaauagcuuaguuacugccggacauggccaaauagauaacuuuucgcucggugugcugggcauggcgcuuuuccuggaagagauguugcgcacacgaguagggaccaaacacgccauccuccuggucgcuguguccuuugugacucuaauuacaggaaauaugucuuuccgggaccugggccgugucaugguuauggugggggcaaccaugacggaugacaucggaaugggcguaacuuaucucgcccugcuugcugccuuuaaggugagacccaccuucgcagcggguuugcuguuaaggaaacucacaagcaaggagcugaugauggccaccauugggaucgcacuucugucacagaguacuauaccugaaacaauccuagagcucaccgaugcccuggcauugggaaugaugguccugaaaauugugcgcaacauggaaaaguaccaguuagcuguuacaaucauggccauuuccugcgugcccaaugcagucauccuccaaaacgccuggaaggugucuuguacuauacuggcugcgguuagcguguccccacuucuguugaccucaagccagcagaaagccgacuggauuccucucgcacugacgaucaagggccuaaaucccacagcuaucuuucugaccacucuuagucggaccucuaaaaagagauccuggccacucaacgaggccgucauggccguaggcauggugagcauucuggcuucgucauugcugaaaaaugacauaccgaugacagggccuuuaguugcaggaggucuccugacugugugcuauguccuuaccggcaggucugccgaucuggaauuggagcgagcggcugacgugaagugggaggaucaggccgaaaucaguggguccagccccauucucucuaucacgauuagcgaggacggauccaugucaaucaaaaacgaagaggaggaacacacacugaccauacuaauccgcacuggccugcuuguaauuagugguguguucccacucagcauccccauuacagcagccgcuugguaccugugggaggucaagaagcaacgggcagggguuuugugggaugugccuucuccacccccugugggaaaagccgaauuagaggacggcgcguauagaaucaagcagaggggcauauuuggguacucccagauuggagcuggugucuauaaagaaggcaccuuccauacuauguggcacgugacacguggggccguucugaugcaucgcggaaagcggaucgagccgucaugggcagaugucaaaaaggaccucaucaguuacggcgguggguggaagcuggagggagaauggaaagagggcgaagaggugcagguccuugcccuggaaccaggcaagaaucccagagcugugcaaaccaaaccuggguuguuuaagacgaacacuggaaccauuggugccguuagccuagauuucuccccaggcacaucugggucgcccaucguggacaggaaaggaaaggucgugggccuguacgguaaugggguagucacccgaagcggagcauaugugucagcuauagcccagacagagaaguccauugaggauaacccugaaaucgaggacgauauuuuccggaaaaagcgccucacuaucauggaccugcacccgggcgcgggcaaaaccaagagauaccuucccgccauaguuagggaagcaauuaaacggggguuacgaacgcugauccucgcuccaacaagaguggucgccgcugagauggaagaggcauugcgcggacugccuaucagguaucagacucccgccauucgugccgagcauaccggucgggaaaucguggaccucaugugucacgcuacauuuaccaugagacugcuuaguccaguuagggugccuaacuacaaucugauuauaauggaugaggcgcacuucacugaccccgcaucuaucgccgcucgcggcuauauuagcacccgagucgaaaugggggaggccgcaggaaucuuuaugacagccacgccaccgggcuccagagauccuuucccccagucaaacgcuccaaucauggacgaggaacgggagauucccgaaaggucuuggaauagcggucaugagugggugacugauuuuaaggggaagaccguaugguucgugccuaguauaaaagcgggaaacgacaucgccgcaugcuugcgcaagaauggcaaaaagguuauucaacuaucccguaaaacauuugauagcgaauacgucaagaccagagcuaacgacugggauuucguggugacuacagacaucucugagaugggcgccaauuuucgggcagagagggucauugauccacgccgauguaugaagcccguaauccugaccgacggggaagagagagugauacucgccggaccuaugccgguuacgcacucauccgcugcccagcggaggggucgcaucggcagaaaccccaaaaaugaaaacgaccaguauauuuacaugggggagcccuuagaaaaugaugaggacugcgcgcauuggaaggaggcaaaaaugcugcuugauaacaucaauacuccugaaggaauuauccccaguauguucgagccagaaagggagaagguggacgccauagauggcgaauaccggcugcguggugaggcucgcaaaacauuugucgaccucaugcgaagaggggauuugccuguguggcuggccuauaggguugcugcagagggcauuaacuacgccgaccggcgcugguguuucgauggaaucaagaauaaccaaauucucgaagagaacguggaagucgagaucuggaccaaagagggcgaaagaaagaagcugaaacccagguggcuugacgcucggauauauagcgauccacuagcccugaaggaguucaaagaauuugcagcggggcgaaagucguugaccuuaaaucugaucacugagaugggaagacucccuacauucaugacccagaaagcccgcgacgcucuggauaaccuugccgugcugcacacagcagaaguagguggcagggcuuacaaucacgcccucucugaguugccggagacucuggaaacgcuacugcuccuuacccuguuagcaacagugacugggggaauauuuuuguuccugauguccggcaaggguaucgggaagaugacccucggcaugugcugcauuaucacagccagcauacugcuuugguaugcucagauucagccccauuggaucgcggccucaaucauucuggaguuuuuccucaucguuuugcugauaccagaaccugagaaacaacggaccccacaggacaaccaguuaacuuacgucgugauugcaauccuaacgguggucgcugccaccauggccaaugaaaugggauuucuggagaagaccaaaaaggaccucggccuugggaguauuacuacccaggagucugaauccaacauccuggauauagacuugcguccagcaagcgcuuggacacuguaugccguugcgaccacuuucgugacaccuaugcucagacacucaaucgagaauaguagcguaaacgugucccugacggcuauugccaaucaagcaaccguccuuaugggacucgguaggggcuggccccugucuaaaauggauaucggggugccguugcuggccauuggauguuacagccagguuaacccaaucacuuuaacagcugcacuacugcuccuuguggcccauuacgcgauuaucggcccuggucugcaggcuaaggccacccgcgaagcacagaagcgggccgcugccgggauaaugaaaaaucccaccgucgacggcauuacaguaaucgauuuggagccaauccccuaugacccuaaguuugaaaaacaacugggacaggugaugcuccugguucuuugcgugacucaggucuuaaugaugcgaacgaccugggcacugugugaggcucucacauuggccacuggcccgauuuccacccugugggaggggaaccccggaagauucuggaauacaaccauagcggugucaauggccaacaucuuuaggggcucuuaccuagcuggugcugggcuacucuucaguauuaugaagaauacuacgaacacacgccggggaaccggcaauaucggugaaacucuuggcgagaaauggaagucgagacugaacgccuugggaaagagcgaauuucagauuuauaaaaaguccggaauccaagaggucgaucguacccuggcaaaagagggcauaaagagaggggaaacagaccaccaugcugugucucggggaucagccaaacuccgcugguucguugagcgaaacauggugacuccagaaggcaagguaguggaucuggguugcgggagaggaggcuggagcuacuauugugguggccuuaaaaaugucagggagguuaaggggcuaaccaagggaggcccugggcacgaggaaccaaucccuauguccacauacggauggaaccuggugcggcuccagaguggcgucgacguguucuuuacgccacccgagaaaugcgauacccuacugugugacauuggugaaucuagcccuaauccaacuaucgaggccgggcgcacauugagaguacugaaccucguggaaaauuggcuuaacaauaacacccaguucugcauuaagguucugaaucccuauaugccgucagugaucgagaaaauggaaacuuugcaaaggaaguacggaggcgcgcugguccgaaacccucucucccggaauaguacacacgagauguacugggugagcaacgcuaccggcaauauagucucuuccgugaacaugauuucacguauguuaaucaauagauuuacgaugaaacauaagaaggcaaccuaugagccagauguugaccuggggagcggaacacgcaacaucgguauugaaaacgagauacccaaucuugacaucauuggcaaaaggaucgaaaagauuaaacaggagcacgaaacuucguggcauuacgaucaggaccacccuuauaagaccugggccuaccacgggucuuaugagacaaaacagacuggaagugcuuccagcaugguaaacggcguggucaagcugcuaaccaagccaugggaugugguucccauggugacacaaauggccaugaccgacacuacgccguucggucagcagcgggucuuuaaagagaagguggauacaagaacccaggaaccuaaagaggggacuaagaaacucaugcgcaucaccgcagaauggcuguggaaggaguugggaaagaaaaagacacccaggauguguacgcgagaggaguucacccggaaaguaagaucaaaugccgcucugggcgcgauauuuacugacgagaacaaguggaaauccgccagggaagcaguggaggauucucgcuucugggaacucguugaccgugagcggaaucuucaucuggagggcaagugcgaaacaugugucuacaacaugauggggaaaagagagaagaaguuaggagaauuugguaaagcuaagggcagcagggccaucugguauauguggcugggggcacgcuucuuggaguuugaagcccucggauuccugaaugaggaucacugguuuagucgaggcaacucccuaagcgguguggagggggaaggacuucauaaacugggcuacauucuccgggacgugucuaagaaagagggcggggcuauguacgccgaugacaccgcgggaugggacacuagaaucacacuggaagauuugaagaaugaggaaauggucaccaaccacaugaagggugagcauaaaaagcuggcagaggccauuuucaaacucacauaucaaaauaagguugugaggguacagcgcccaacuccuagaggcaccgugauggacaucauuucacggaaagaucagagggggaguggacaggucggcacguacggucuuaacaccuucacaaauauggaagcucaacugauacgucagauggagggggaaggaaucuuuaaguccauucagcgauuaacugugaccgaggagaucgccguucaaaacuggcuggcacgcgugggcagagaacgguugagcaggauggcuaucucuggcgacgauugcgucgugaagccccucgacgaucgcuucgccucggcucugacagcccuaaaugacauggggaaaguaagaaaggauauucagcagugggagccaucacggggauggaacgacuggacucagguucccuuuugcagccaccacuuccaugaacuugugaugaaagaugguaggguccugguggugccuugucgaaaccaagacgagcucauaggccgugcaagaaucucccagggggcgggauggagucugaaggaaaccgccugcuugggcaaaucuuaugcucagauguggacguuaauguacuuucaccgccgggaucugaggcucgccgcaaaugcuauuuguagcgccgucccaucccauuggguuccgacaucaagaaccacuuggaguauccacgcaaagcacgaguggaugacaaccgaggacaugcuugccguguggaaccgcguauggauucaggaaaaucccuggauggaggacaagacuccuguggaaucuugggaggaagucccauaucuggguaaacgggaggaucaauggugcgggagccuaaucggacugaccuccagggcgacaugggcuaagaacauacagacggccaucaaucaggugcgaucacucauuggcaacgaggaauacaccgacuauaugcccagcaugaaaagauuccggaaggaggaagaggaagcaggcguuuugugguga

SEQ ID NO: 14590 - RNA, 9876 nt, Artificial Sequence
  derived and/or modified CDS sequence (opt3) from DENV-2__GQ868600__SS-prME
accgccggcaugaucauuaugcugauacccacagugauggcuuuccaccucacuacgagaaacggggagccucauaugaucgucagcaggcaggaaaagggaaaaucccuucuguuuaagaccaaagacgguacaaauaugugcacuuugauggcaauggauuuaggcgagcugugugaagacaccauuacauacaagugcccauuccuaaaacaaaacgagccggaagauaucgacuguuggugcaauucuaccucaacuuggguuacauaugggaccuguacgacuaccggagagcaccggcgcgagaagcgaaguguggcccucguaccccaugugggcaugggucuggaaacacguacugagaccuggaugagcuccgaaggggcguggaagcacgcucagagaauugagacauggauccuuaggcauccuggauuuaccauaauggccgcaauccuggccuacacgauuggcacuacacacuuccagcgggucuugaucuuuauucuccugaccgcuaucgcaccaucuaugacuaugcgcugcauaggcauuucgaacagagauuucguggaggggguuucaggagguagcuggguggacaucguccuggaacacggcaguugugugacaaccauggccaaaaauaagcccacgcucgauuuugaguuaauuaaaaccgaagcuaagcagccugccacacugaggaaauauugcaucgaggcgaagcuuacuaacaccacaacugacucccgguguccaacccaaggggaacccacauugaaugaggagcaggauaagcgcuucguaugcaaacauucuaugguugaccgaggauggggcaacgguugugggcuguuuggaaagggcggcaucgugaccugcgcaauguucacuugcaaaaagaauauggaagggaaaauuguccagccugagaaccuagaauacacgguggugauaacaccacacagcggagaggaacaugccgucgguaaugauaccggcaagcacgggaaagagguuaagaucacuccgcaguccucaauuaccgaggcugaacucacaggauauggcaccgugacuauggaguguagucccagaacaggucuggacuuuaacgaaaugguacuucugcaaauggaggauaaggccugguuggugcacaggcagugguuccucgaccugccuuuaccauggcugcccggggcagacacgcagggcagcaauuggauccagaaagaaacccucgucacuuuuaagaacccucaugcuaaaaagcaagaugugguugugcuuggaucucaggagggcgccaugcacacagcgcugaccggggccacagagauacagauguccucaggaaauuugcuauucacuggucaucugaaaugccggcuccguauggacaagcugcaacuuaagggcaugagcuacaguauguguaccgggaaauucaagauugucaaagaaaucgcagagacgcagcacggaaccaucgugauucgcguacaguaugaaggcgaugguucuccaugcaagauccccuuugagauuauggaccuggagaaaagacauguuuuggggaggcucauaacagugaacccgaucgucacugaaaaggauuccccugugaacauugaggcugaacccccauucggcgacagcuacaucaucauuggagucgagccuggccagcugaaguuagauugguuuaaaaaggggucgucuauaggacaaauguucgaaaccacaaugcggggugccaaacgaauggcuauccugggcgacacugccugggauuuugggucccuaggaggcguguucaccucaauugguaaggcacuccaccagguuuuuggggccaucuacggcgcugcguucaguggagugagcuggacgaugaaaauucugaucggcguaauaaucacauggauugggaugaauucccgcucuaccagccuuucagucaguuuggugcugguuggaaucgugacucucuaucugggcgucauggugcaggcagacuccgguuguguagugagcuggaagaacaaggagcuuaaaugcgggucuggaauuuuuguuacagauaauguccacaccuggacugagcaguacaaguuccaacccgaaucaccaaguaaacuggccagcgcuauccagaaggcccaugaggaaggcauaugugguauuagauccgugaccagguuggagaaccucauguggaaacagaucacaucugaacugaaucacauuuuaucggagaacgaggugaagcugacgaucaugaccggcgacauaaaagggaucaugcaggucggaaagcggagccuacgcccccaaccuacugaacucagauauuccuggaagacauggggcaaagcaaagaugcugucaaccgagcuucauaaucagacauuuuugauugacgggccagaaacugccgagugcccgaacaccaauagggcuuggaacagucuggaaguugaggauuacggauucggcguguuuacgacaaauaucuggcuccgucugcgggagaaacaggacgccuucugugauucuaaguuaaugagcgcagcgauuaaagacaaccgagcugugcacgccgauauggguuauuggaucgaauccgcacugaaugacaccuggaagauagagaaggccucauucauugaaguaaaaagcugccacuggcccaagucucauacucuuugguccaacggggucuuggagagugagauggugaucccuaaaaauuuugcuggaccaguuagccagcacaacaacagacccggcuaccauacccaaacagccgguccuuggcaccucggcaagcuggaaauggauuucgacuuuugugaggggacuaccguggucgugacagaagauugcggaaauaggggcccaucucuacgcacgaccacugcauccgggaaacugaucacagaguggugcugucggucaugcacccuccccccgcugagauauaggggagaagacggcuguugguacgguauggagauucgcccucuuaaggagaaggaagagaacuugguuaguagccuggugacugcugggcauggacagaucgauaauuucucguuaggcauucucgguauggcccuguuucuugaagagaugcugcgaacacggguaggcaccaaacacgcgauauugcucgucgccguguccuucgugacgcugaucacugggaacaugucuuuucgugaccuaggaagagucaugguuauggugggcgcuaccaugacagaugacauugggaugggaguaaccuaccuggcacuccuggccgcuuucaaggugaggccaacuuuugccgcaggccuuuugcugcgcaaauuaacaagcaaggaacucaugaugaccacaaucgguauuguccugcuuucacagaguuccauccccgagacuauacuggagcuaaccgacgcgcucgcccuggggaugaugguguugaaaaugguucggaauauggaaaaguaucaacuggcugugacgaucauggccauuuuaugcgucccuaacgcagugauccuccagaaugcuuggaagguuucuuguacaauucuggccguggucagcguauccccccuucuguugaccucaagccagcagaaagcagauuggaucccacucgcccugacuauaaagggacuaaacccuaccgcuauuuuccugacaacucuuaguagaaccucuaaaaagagguccuggccccucaaugaggcgaucauggccgugggcaugguuagcauccuggcaucgucauugcugaaaaacgacauuccaaugacgggcccguuaguggcugggggacuccugacagucugcuacgugcuuaccggucgaucugccgaucuggaauuggagcgcgccacugacguaaagugggaugaccaagcugaaauaaguggcuccagcccuauccucucuauuacaaucagcgaggauggguccaugucaauuaaaaaugaggaagaggaacagacccugacuauccuaauacggacaggacugcuugugaucaguggccucuuucccgucagcauuccaaucaccgcagccgcgugguaucugugggagguuaagaagcagagagcugguguguugugggacgugcccucuccuccacccgucgggaaagccgaguuagaagauggagcauacaggauuaagcagaaaggcauccugggcuauucccaaauaggggccggaguguacaaggaggguacguuccacacuauguggcauguuacccguggcgcuguacucaugcacaaagggaagcgcauugaaccuucaugggcagacgugaagaaagaucugaucaguuauggaggcgguuggaagcuugagggggaauggaaagagggagaggaaguccaggugcuggccuuggagccgggcaagaacccacgggcgguucagacaaaacccggccuauuuagaaccaauacagggacuaucggagcugugagccuggacuucuccccugguaccucuggcucgccaauugucgauaagaaggggaaagugguaggacucuacggcaacggugucgugacgaggagcggggccuacguuucagcaaucgcccagacagaaaaguccauagaggacaaucccgaaauugaggacgauaucuuccgaaaacggcgccugacuauuauggaccuucauccuggagcuggcaagaccaaaagauauuuaccggccaucgugagggaggcaauaaagcggggccugcgaacacucauuuuggcucccaccagagucguggccgcggaaauggaggaagcccugcgcgggcucccaaucagguaccaaacuccugcaauccgugcugagcacaccggacgggaaauuguugaucugaugugucaugccacauuuacgaugagacuucugagucccaucagggugccaaacuauaacuugauuauaauggacgaggcucacuucacugauccugcaucuaucgccgcccgcgguuacauuagcacccgagucgagaugggcgaagcugcggggaucuuuaugacagcaacccccccaggauccagagacccguucccucagucaaaugcccccaucauggaugaggaacgggagauuccagagaggucuuggaacagcggccacgaaugggugacugacuuuaaggguaaaacaguaugguucgugcccaguauaaagaccgggaaugauaucgcugccugccuacgcaaaaacggaaagcguguuauucagcuguccagaaaaacguuugacagcgaguaugucaagacucggacaaaugauugggacuucguggugaccaccgacaucucugaaaugggcgcaaacuuuaaggccgagagggucauugauccucgccgauguaugaaaccaguaauccucacugacggcgaagagagagugauauuagcugggcccaugccuguuacacauucauccgcggcccaacggaggggacgcaucgguagaaauccgaggaacgagaaugaucaguacauuuauaugggcgaaccacuggagaacgacgaagauugcgcacacuggaaggaggcuaaaaugcuucuggacaauaucaacacccccgaagggauuaucccuaguauguucgagcccgagcgggaaaagguggaugccauagacggagaguaccgucuccgcggcgaagcacgaaaaacauuugucgauuugaugagaaggggugaccugccaguguggcucgccuacaagguugcugccgaggggauuaauuaugcggaucggcgcugguguuucgacggcacuagaaacaaucagauccuggaagagaacguggaggucgaaauuuggacgaaagagggagaaaggaagaagcuuaaaccucgguggcuagaugcacgaaucuacagcgacccccuggccuugaaggaguucaaagaguuugcugccggcagaaagucguuaacccugaaccucauaacagaaauggggcgccugccaacuuucaugacccagaaagcuagggacgcacuugauaaucuggccgugcuccauacagcugaggccggagguaaggcauauaaccacgcguugucugaacugccugagacccuagaaacucugcuccuucugacguuauuggccaccguaacaggcgggaucuuucuguuccucauguccggacggggcauugguaagaugacucuggggaugugcugcaucauuaccgcuagcauccuucugugguacgcccaaauacagccgcacuggauugcagcuucaaucauccucgaguuuuucuugauugugcuguuaauccccgagccagaaaaacagcguacaccucaggacaaucaacuaaccuauguuauaauugccauccugacugucguggcagccacaauggcuaacgagaugggcuuucucgaaaagacgaaaaaggaucuuggacugggcaauauugcgacccagcagcccgagaguaacaucuuggacauagaucugagaccagccucugcauggacucucuacgcuguggccacaaccuucaucaccccuaugcugaggcauuccauugaaaauagcucagucaacguuagucuuacagccaucgcaaaucaggcuacugugcucauggggcugggaaaagguuggcccuugagcaagauggacauuggcguaccgcuguuagccaucggguguuauucccaagugaacccaauuacgcuaaccgcggcucugcuccuucuggucgcccacuacgcaaucauaggaccuggcuugcaggccaaggcuacacgcgaggcacagaaacgggccgcggcugguauuaugaagaaucccacuguggaugggaucaccguuaucgaccuggauccaauucccuacgacccuaaauuugagaagcagcucggccaagugaugcugcuugucuuaugcguaacacaggugcugaugaugcgaaccacuugggcccucugugaagcauugacgcuggccacaggaccgguuucuacccuaugggagggcaaccccgggagauucuggaauacuaccauagcugugagcauggccaacaucuuuaggggauccuaucuggcaggcgcuggucuccuuuucucaauuaugaaaaauacaacuucuacccgccgggggacaggaaacaucggcgaaacgcugggugagaaguggaagaguagauugaaugcccugggcaaaucggaauuucagauuuacaagaaaagcgggauccaagaggucgaucguacccucgcgaaggagggaauaaaaaggggcgaaacugaccaucacgccgugucccgggggucugcaaagcugcgcugguucgucgagcgaaacuuagugacaccagaaggaaaaguuguggaucuuggcugcgguagagggggauggucauauuacuguggcggucugaagaacguaagggaggugaagggccucaccaaagggggaccuggccaugaggaacccaucccuaugagcacuuauggguggaaucuaguccggcugcaguccggaguugacguguucuuugucccacccgagaagugcgacacauugcugugugauauuggcgaaaguucuccuaacccaaccguggaggcuggucgcacgcucagaguacuuaaucugguggaaaacugguugaauaacaauacccaguucugcguuaaagugcugaaccccuacaugccgagcgucaucgagaggauggagacacuccagcgaaaguaugggggagccuuagugcggaauccucugucacguaacuccacucacgaaauguacugggucaguaaugcaagcggcaacauugugucuuccguuaauaugaucucaagaaugcuuauaaaccgcuuuaccaugaggcacaaaaaggcuacauacgagccagacguagaucugggcagcgggacucggaauauuggaaucgaaucggagacccccaaccuagacaucauugguaagagaauagaaaaaaucaagcaagagcaugagacaucuuggcacuaugaucaggaccauccuuacaaaaccugggccuaucacggcaguuacgaaacuaagcagacgggguccgccagcucaauggugaacggagucgugcgccuccugacaaaaccaugggauguugugcccauggucacccagauggcgaugacugacaccacaccguucggccaacagaggguguuuaaggagaagguagauacgcgaacccaggaaccuaaagaggguacuaagaaauugaugaagauuacagcugaauggcuguggaaagagcucgggaagaagaaaaccccccggauguguacuagagaggaauucacaaagaaagugagguccaaugcagcccuuggagcuaucuuuaccgacgagaacaaguggaaaucugcccgcgaagcaguugaggauagccguuucugggagcuggucgacaaggaacggaauuuacaccuggagggcaaaugcgaaacauguguguauaacaugaugggcaagagagagaagaaauugggggaauuuggaaaggccaaagguaguagggcuauuugguacauguggcucggcgcgcgcuuccuggaguuugaggcccuaggguuccuuaaugaagaccauugguuuucccgagagaacagccugucuggaguggaaggcgagggucuccacaagcugggguauaucuugcgggaagucucaaaaaaggagggaggcgcaauguacgcugaugacacugccggcugggauaccagaauaacgaucgaggaccugaagaaugaagagaugauuaccaaccauauggcaggggaacacaaaaagcucgccgaggcuaucuucaaacuuacauaccagaauaagguugugaggguacaacgcccaacuccuagaggaaccgugauggauauuaucagucggagggaccagcgugguuccggccaggucgggacauauggacugaacacuuucaccaauauggaagcccaauuaauucgacagauggagggcgaggguauauuuaaaagcauccagcaucugacggcgucugaagagauugcagugcaggauugguugguucgcguggggagagaacggcucucgaggauggccaucucaggagacgauugcgucgugaagccccuggacgaucgcuucgcuagagcccuaacagcacuuaacgacaugggcaagguacggaaagauauccaacagugggagccaagcaggggcuggaaugacuggacccagguucccuuuugcucccaccacuuccaugagcugauuaugaaggacgggcgaacucucguggucccuugucguaaccaggaugaacugauaggaagagcucgcaucagucaaggugccggcuggucuuugcgggagacagcuugcuuagggaaaagcuacgcccagauguggucccugauguauuuucacaggagagaccuccgccuugcagcgaaugccauuuguucagcugugccaagucauugggugccgaccucucggacuaccuggagcauccacgccucccacgaauggaugacaacggaggauaugcugaccgucuggaacaagguuuggauucuagaaaaccccuggauggaggacaaaacuccuguggagucaugggaagagaucccauaccugggaaagagggaagaucaguggugcggcagccucauagguuugacaucucgagcaaccugggcuaagaauauccagacugccauuaaccaaguaagaucccugaucgggaaugaggaauauacagacuacaugcccaguaugaaacgguucaggcgcgaggaggaagaggcaggagugcuuugguga

SEQ ID NO: 14591 - RNA, 9876 nt, Artificial Sequence
  derived and/or modified CDS sequence (opt3) from DENV-2__KF955359__SS-prME
accgcaggagugaucauuaugcugauacccaccgcuauggcauuccaccucacuacgaggaauggggagccucauaugaucgucggaaggcaggaaaaggguaaaagccuucuguuuaagaccgaggacggcguuaauaugugcacauugauggccauugauuuaggggaacugugugaggacacuaucaccuacaaaugcccacuacuccggcaaaacgaaccggaggauauugacuguuggugcaauuccacaucuaccugggugacuuauggaacauguaccacgacuggcgagcaccgccgagaaaagcguucagucgcgcuggugccccaugucgguauggggcuugagaccagaacagaaacuuggaugaguagcgagggagcuuggaaacacgugcagaggaucgagaccuggauucugcggcauccuggcuucacaaccauggccgcaaucuuggccuacacgauuggcacuacacacuuucagcgcgcucucaucuucauucugcugaccgcaguugccccauccaugacuaugagaugcaucgggauaucuaacagggauuuuguggaaggagucucggguggcucauggguggacauuguacucgagcacgggagcuguguuacaaccauggcuaagaauaagcccacguuagauuucgaacugaucaaaaccgaggccaagcagccugcgauucuucggaaauauugcaucgaagcaaaguugacaaacacuaccacagagagucgcuguccaacucaaggagagcccucccugaaugaggaacaggacaaacgauuuaucugcaagcauucuaugguggauagaggcugggguaacggguguggacuauucggcaagggcgggauuguaaccugcgccauguuuacaugcaaaaagaauauggaaggaaaaguggugcucccugagaaccuggaauacaccauagucaucacuccacacagcggugaggagcaugcuguuggcaaugacacggggaagcacggaaaagaaauuaagaucacaccgcaguccucaauaaccgaggccgaacuuacuggcuaugguaccgugacaauggaguguagucccaggaccgggcuggauuucaacgaaaugguauugcuccagauggaggacaaagcauggcuggugcaccggcaaugguuuuuagaucugccucucccauggcuucccggcgcugacacucagggaagcaauuggauucagaaggagacacuggucacguucaagaacccucaugccaaaaagcaggacgugguuguguugggcucucaagaaggggcgaugcacaccgcccuaacuggagcaacagagauccagauguccucagguaaucugcucuuuaccggccaucugaaaugccgucuucgcauggauaagcugcaguugaaagggaugagcuacaguauguguacaggaaaguucaagaucgucaaagaaauugcugagacucaacacggcaccaucgugauuagaguacaguaugagggugacgggucuccaugcaagauacccuucgaaaucauggaucucgagaaaaggcauguucugggccgguuaauuacggugaacccgaucgucaccgaaaaggacuccccugugaacaucgaggccgaacccccauuuggagauagcuacauuauaaucggcgucgagccugggcagcugaaacuaaauugguucaagaagggaucgucuauuggucagauguuugagacaacuaugcgaggcgcuaaacgcauggccauccucggggacaccgcaugggauuucggaucccugggcgguguguuuacaucaauugggaaggcccuucaccaaguuuucggcgcuaucuacggagcggcauuuaguggcgugagcuggacuaugaaaauauugaucgggguaauuaucaccuggauuggaaugaacuccagaucuacgagccugucagccagucucguccuggugggcaucguuacacuuuaucugggugugaugguccaggcugacaccgggugugugguauccuggaagaauaaagaauugaagugcggaagcggcauauucauuacugauaacgugcacacauggaccgagcaguacaaguuucagcccgaaucuccaucaaaacucgccagugcaauccaaaaggcccaugaggaagguauuuguggcaucaggagcguuacucggcuggagaauuuaauguggaaacagauaacccccgagcugaaccacauccuauccgaaaaugaggucaagcucacaauuaugacgggggacaucaaaggaauuaugcaggcuggcaagcgcucucugagaccucagccaaccgaacuuaaauauucguggaagacuugggggaaggccaaaauguugagcacagagucccauaaccaaaccuuccugaucgauggaccggaaacagcagagugccccaauacuaacagggcguggaacucacucgagguggaagacuacggcuuugguguguucaguaccaacauauggcugaaguuacgugagaaacaggacgucuuuugugauucuaagcugaugagcgcugccauuaaagacaaucgggcaguucacgccgauaugggguauuggaucgaauccgcucuuaacgacacguggaagauggagaaggccucauucaucgagauuaaaagcugccacuggccuaagucucauacauugugguccaauggagugcucgaaagugagaugaucauucccaagaauuucgcaggccccgugagccagcacaacuaccgaccugguuaucauacccagacugcuggcccauggcaccuggggaagcuagaaauggauuuugacuucugugagggaaccacaguagucgugacugaagauugcggcaauagagggcccucucugaggaccacaacggccuccggaaaacucauaaccgaguggugcugucgcucaugcacucugccgccucuucgguacagaggcgaggacgguuguugguacgggauggaaaucaggccauugaaggagaaggaagagaaccugguuaauaguuuagugacagcgggacauggccaaauugauaacuuuagccucgguguccugggcauggcccuuuuccuggaagagauguugcgcacccgaguggggacuaaacacgcuauccuccugguugcagugucguuuguaacacuaauuaccggaaauauguccuuccgggaccugggccgugucauggugauggugggggccacgaugacugaugacaucggaaugggcgucaccuaucucgcucugcuugccgcauuuaagguuagacccacauucgcggccgguuugcuguuaaggaaacucaccucuaaggagcugaugauggcuacuauagggaucgcccuucugagccagucaacaauuccugaaaccauccuagagcucacagaugcacuggcuuugggaaugauggugcugaaaauuguacgcaacauggaaaaguaccaguuagccgugacuaucauggcaauaaguugcguccccaaugccgugauucuccaaaacgcuuggaagguuuccuguaccauccuggcggccgugucugucagcccacuucuguugacguccucacagcagaaagcagacuggaucccucucgcucugacaauuaagggccuaaaucccaccgccauauuucugacuacccuuagccggacaaguaaaaagagaucuuggccacucaacgaggccgugauggcuguuggcaugguguccauccuggcaagcucguugcugaaaaaugacauuccgaugacugggccuuuagucgccggaggucuccugaccguaugcuaugugcuuacgggcaggucagcggaucuggaauuggagaaggcugccgacguuaaaugggaggaucaggcagaaaucucugggaguucccccauucucagcaucacaauaucugaggacggaagcauguccaucaagaacgaagaggaggaacacacccugacuauucuaauccgaacaggccugcuugugauuucaggugucuucccagugaguauccccauaaccgccgcugcaugguaccucugggagguaaagaaacaacgcgccggggugcugugggaugucccuagcccacccccuguuggaaaggcggaauuggaggacggcgcuuaucggauuaaacagagaggcaucuuuggguacucucagaucggagccgguguguauaaggaaggcacuuuccauacaauguggcacgugaccagaggggcagucuuaaugcaucguggaaaacgcauugagccguccugggccgaugugaagaaggaccugaucucauacggcgguggguggaaacucgagggagaauggaaggagggcgaagagguucagguacuggcucuugaaccaggcaaaaauccccgggccgugcaaacgaagccugggcuguuuaaaacuaacaccggaacaauaggugcagucaguuuggauuucagcccaggcaccuccgggucucccauuguggacagaaagggaaagguugugggccuauacgguaauggggucgugacaaggucgggagcuuauguaagcgccaucgcgcagacugagaaaucaauugaggauaacccugaaaucgaggacgauauauuccgaaagaaacggcugaccauuauggaccuccacccgggcgccggcaagacgaaacgcuaccugcccgcaaucgucagagaagcuaucaagagggggcuucggacauuaauucuggccccaacucgagugguugcugcagagauggaagaggcccucagaggauugccuauccgcuaucagacccccgccauuagggcugagcauacaggucgugaaauaguggaccugaugugucacgcgaccuuuacuaugcggcuccuguccccagucagagugccuaacuacaaucuuaucauuauggaugaggcacacuucaccgaccccgccaguaucgcugccaggggcuauaucucuacacgcguugaaaugggggaggcagccggaauuuuuaugacggcuacuccaccgggcagccgagauccuuucccccaguccaacgcgccaauaauggacgaggaaagagagauccccgaacggucauggaacucuggucaugagugggugaccgauuuuaaggggaaaacagucugguucgugccuagcauuaaggccggaaacgacaucgcagcuugccugaggaaaaauggcaagaaaguaauucaauugagucgcaagaccuuugauuccgaauacgugaagacucgugccaacgacugggauuucguugucacaaccgacaucagcgagaugggcgcaaauuuuagagccgagcgggugauagauccaaggcgcuguaugaaacccgugauccuaacggacggggaagaacgagucauucuggcuggaccuaugccgguaacucacucuucagccgcgcagagacgggguaggaucggccgcaacccaaagaaugaaaacgaccaguauauuuacaugggggagccccucgaaaaugaugaggacugcgcacauuggaaagaggccaagauguuacuggauaacaucaauacaccugaaggaauaauucccuccauguucgagccagaaagagagaaaguggacgcuaucgauggcgaauacaggcuucggggugaggcccguaagaccuuuguugaccugaugcgccgaggggaucucccugugugguuggcuuauagagucgcagccgagggcauuaacuacgcugacaggcggugguguuucgauggaaucaaaaauaaccaaauacuggaagagaacguggaaguugagaucuggaccaaggagggcgaacgcaagaaacucaagcccagauggcuggacgccaggauuuauagugauccacuugcacuaaaagaguucaaggaauuugcggccgggcggaaaagccugacuuugaauuuaaucacagagaugggacgacugccuaccuucaugacacagaaggcuagagacgcccucgauaaccuggcagugcuucacacugcugaagucgguggccgcgccuacaaucacgcacugucggagcucccggagacguuggaaacccugcuacugcucacacuucuggccacugugaccgggggaauauuuuuauucuugaugucuggcaaggguaucgggaaaaugacacugggcaugugcugcauaauuaccgcuuccauccuccugugguaugcgcagauccagccccauuggauugccgcaagcaucauacuugaguuuuuccugauuguacucuugaucccagaaccugagaagcaaaggacuccccaggacaaccagcugacguacgugguuauugcuaucuuaaccgucguggccgccacaauggcaaaugaaaugggauuucuagagaaaacuaagaaagaccugggccucgggucaauaaccacacaggagagugaaucuaacauccuugauauugaccugcggccagcuuccgccuggaccuuguaugcgguggcuacuacauucgucacgccuaugcugcgucacagcaucgaaaauucaaguguuaacgugagccucaccgccauugcaaaucaagccacuguacugaugggacuugguagaggcuggccccucuccaagauggauaucggggugccgcuguuggcuauuggauguuacucucaggucaacccaaucacacugaccgcagccuuacuacugcucguggcgcauuacgcuauaauuggcccuggucuucaggccaaggcaaccagggaagcccagaaacgcacagcugccgggaucaugaagaaucccacuguugacggcaucacggugauugaucuggagccaauacccuaugacccuaaauuugaaaagcaauugggacaggucaugcugcucguacugugcgugacccagguucuuaugaugcggacaacuugggcauuaugugaggcucugacccucgccacaggcccgaucagcaccuugugggaggggaaccccggacgauucuggaauacuacgauugcgguguccauggccaacaucuuuagaggcucauaccuggccggugcugggcuacuguucucuauuaugaaaaauacaaccaacacuaggcgcggaaccggcaauaucggugaaacacucggcgagaaguggaagagucggcuuaacgcccuggggaaaucggaauuucagauauauaagaaaagcggaauccaagaggucgauagaacuuuggcaaaggagggcauuaaacguggggaaaccgaccaccaugcuguguccaggggaucugccaagcugcggugguucgucgagcgcaacauggugacaccagaaggcaaaguuguggaucucgguugcgggcgaggaggcuggucauacuauugugguggccugaagaauguaagagaggugaagggguuaacgaaaggaggcccugggcacgaagaaccaaucccuaugagcaccuacggauggaaccuugucaggcugcaguccggcguugacguguucuuuacuccacccgagaagugcgauacacuccuaugugacauuggugaaaguucuccuaauccaaccaucgaggccgggcggacucugcgcgucuugaaccugguggaaaauuggcucaacaauaacacacaguucugcguaaaagugcuuaaucccuauaugccgagcguuauagagaagauggaaacccugcaaagaaaauacggaggcgcguuggugaggaacccucugucacgaaauuccacgcacgagauguacugggucaguaacgcuaccggcaauauugugagcucugucaacaugaucucccggaugcucaucaaucguuuuacaaugaagcauaagaaagcaacuuaugagccagauguggacuuagggucaggaaccagaaacauugguauagaaaacgagauccccaaucuggacauuaucggcaagcgcauugagaagaucaagcaggagcacgaaacaagcuggcauuacgaucaggaccacccuuauaaaacuugggccuaccacgggucguaugagaccaagcagacaggaucugcuaguuccaugguuaacggcguagugaaacuucugaccaaaccaugggaugucgugcccaugguuacucaaauggccaugacggacacaaccccguucggucagcagaggguguuuaaggagaaagucgauacucggacccaggaaccuaaggaggggacgaaaaagcuaaugagaauaacagcagaauggcucuggaaggagcugggcaaaaagaaaacaccccgcauguguacuagggaggaguucacacgaaaggugcggagcaaugccgcuuugggcgcgaucuuuaccgacgagaacaaauggaagucagccagagaagcaguagaggauuccagguucugggaacugguggaccgcgagcguaaucuccaucuugagggcaaaugcgaaacuuguguuuacaacaugauggggaagcgggagaagaaacugggagaauuugguaaggcuaaaggcucuagagccauuugguauaugugguuaggggcaagguuccuggaguuugaagccuugggauuccucaaugaggaucacugguuuagccgcggcaacagucuguccggugucgagggggaaggacuacauaaacuuggcuacauccugcgagacgugagcaaaaaggagggcggggcuauguacgccgaugacacagcgggaugggacacccggauuacacucgaagaucugaagaaugaggaaauggugacuaaccacaugaaaggugagcauaagaaauuggcagaggccaucuucaagcugaccuaucaaaauaaagucguuagagugcagaggccaacgccucgcggcaccguaauggacauuauaucuagaaaggaucagcgggggucaggacaggugggcacauacggucucaacacuuucaccaauauggaagcucaacuuaucaggcagauggagggggaaggaauuuuuaagaguauccagcgucugacagucacugaggagaucgccgugcaaaacugguuagcacgaguuggccgcgaaagacugucccggauggcuauuagcggcgacgauugcguggucaaacccuuggacgauagguucgccucugcucucaccgcccugaaugacauggggaaggugcgcaaagauauacagcagugggagccaucgagaggauggaacgacuggacgcagguacccuuuugcucacaccacuuccaugagcuaguuaugaaggauggucggaugcuuguggucccuuguaggaaccaagacgagcugaucggccgagcacguauuagccagggggcgggauggucccucaaagaaacagccugccugggcaagaguuaugcucagauguggaccuugauguacuuucacagacgcgauuuacggcuggccgcaaaugcuaucuguucugccgugccaagccauugggugccgacuuccaggacaaccuggucaauucacgcaaagcacgaguggaugacuaccgaggacaugcucgccgucuggaacagaguuuggauccaggaaaaucccuggauggaggacaaaacaccuguggaaaguugggaggaaguaccauaucuugguaagcgcgaggaucaauggugcgggucucugauaggacuaacgagccgggcgaccugggcuaaaaacauccagacugccauuaaucaggugaggucccugaucggcaacgaggaauacacagacuauaugcccucaaugaagcgauucagaaaagaggaagaggaagcaggcguccucugguga

SEQ ID NO: 14592 - RNA, 9876 nt, Artificial Sequence
  derived and/or modified CDS sequence (opt3) from DENV-2__KF955360__SS-prME
accgccggcgugauaauuaugcugauacccacagcuauggcauuccaccucacuacgaggaacggggagccucauaugaucguagggaggcaggaaaaggguaaaagccuucuguuuaagaccgaggacggcguuaauaugugcacauugauggccauugauuuaggggaacugugugaggacacuaucaccuacaaaugcccacuacuccggcaaaacgaaccggaggauauugacuguuggugcaauuccacaucuaccugggugacuuauggaacaugugcgaccacgggcgagcaccgccgagaaaagcguucaguagcucuggugccccaugucgguauggggcuugagacuagaaccgaaacauggaugaguagcgagggagccuggaaacacgugcagaggaucgagacuuggauacugcggcauccuggcuucaccaucauggcagccauuuuggcuuacacaaucggcaccacgcacuuucagcgcgcacucauuuucauccugcugacugccguugcuccauccaugacaaugagaugcauagggauuucuaacagggauuuuguggaaggagucucggguggcucauggguggacaucguacucgagcacgggagcuguguuaccacuauggccaagaauaagcccacauuagauuucgaacugauuaaaaccgaggcgaagcagccugcaacgcuucggaaauauugcaucgaagccaaguugaccaacacaacuaccgagagucgcuguccaacacaaggagagcccucccugaaugaagaacaggacaaacgauuuaucugcaagcauucuaugguggauagaggcugggguaacggguguggacuauucggcaagggcgggauugucacuugcgcuauguuuaccugcaaaaagaauauggaaggaaaaguggugcucccugagaaccuggaauacacaauagucaucaccccacacagcggugaggagcaugccguuggcaaugacacugggaagcacggaaaagaaauuaagaucacgccgcaguccucaauaacagaggcagaacuuaccggcuaugguacugugaccauggaguguagucccaggacagggcuggauuucaacgaaaugguauugcuccagauggaggacaaggcuuggcuggugcaccggcaaugguuuuuagaucugccucucccauggcuucccggcgccgacacccagggaagcaauuggauucagaaggagacucuggucacauucaagaacccucaugcgaaaaagcaggacgugguuguguugggcucucaagaaggggccaugcacacggcacuaaccggagcuacugagauccagauguccucagguaaucugcucuuuacaggccaucugaaaugccgucuucgcauggauaagcugcaguugaaagggaugagcuacaguauguguaccggaaaguucaagaucgucaaagaaauugccgagacacaacacggcacuaucgugauuagaguacaguaugagggugacgggucuccaugcaagauacccuucgaaaucauggaucucgagaaaaggcauguucugggccgguuaauuaccgugaacccgaucgucacggaaaaggacuccccugugaacaucgaggcugaacccccauuuggagauagcuacauuauaaucggcgucgagccugggcagcugaaacuaaauugguucaagaagggaucgucuauuggucagauguuugagaccacaaugcgaggcgccaaacgcauggcaauccucggggacacugccugggauuucggaucccugggcgguguguuuaccucaauugggaaggcacuucaccaaguuuucggcgcgaucuacggagcagccuuuaguggcgugagcuggacaaugaaaauauugaucgggguaauuaucacuuggauuggaaugaacuccagaucuaccagccugucagucagucucgugcugguuggcguggucacgcuuuaucugggugugaugguacaggcugacuccgggugugugguuagcuggaagaauaaagaauugaagugcggaucuggcaucuucauaacagauaacguccacaccuggacugagcaguacaaguuucagcccgaaucaccaaguaaacucgccagcgcaauucaaaaggcccaugaggaagguaucuguggcauuagguccgugacacggcuggagaauuuaauguggaaacagaucacccccgagcugaaccacauacuaucugaaaaugaggugaagcucacuaucaugaccggggacauuaaaggaaucaugcaggcuggcaagcgcucgcugagaccucagccaacagaacuuaaauauagcuggaagacgugggggaaggccaaaauguuguccaccgagucacauaaccaaacuuuccugauugauggaccggaaacagcagagugccccaauaccaacagggcguggaauagucucgaggucgaagacuacggcuuugguguuuucucuacaaacaucuggcugaaguuacgugagaaacaggacguguuuugugauagcaagcugauguccgcugccauaaaagacaaucgggcagugcacgccgauaugggguauuggauugaaucagcucuuaacgacacuuggaagauggagaaggccagcuucaucgagaucaaaucuugccacuggccuaagucccauaccuuguggaguaauggaguacucgaaagcgagaugauuauccccaagaacuucgcaggccccgucucucagcacaacuaccgaccugguuaucauacgcagacagcuggcccauggcaccuggggaagcuagaaauggauuuugacuucugugagggaaccacugugguugugaccgaagauugcggcaauagagggcccucccugaggacaacuaccgccucaggaaaacucauuacagaguggugcugucgcaguugcacgcugccgccucuucgguacagaggcgaggacgguuguugguacgggauggaaauaaggccauugaaggagaaggaagagaaccuggucaauagcuuagugaccgcgggacauggccaaaucgauaacuuuucgcucgguguucugggcauggcccuuuuccuggaagagauguugcgcacucgaguggggacaaaacacgcuauucuccugguagcagucuccuuugugacccuaaucacuggaaauaugucuuuccgggaccugggccgugugauggucaugguuggggccacaaugaccgaugacauuggaaugggcgugacguaucucgcucugcuugccgcauuuaagguaagacccacuuucgcggccgguuugcuguuaaggaaacucaccagcaaggagcugaugauggcuacaaucgggauagcccuucugucacagaguaccaucccugaaacuauucuagagcucacagaugcacuggcuuugggaaugauggugcugaaaaucguccgcaacauggaaaaguaccaguuagccgugaccauuauggcaaucuccugcguucccaaugccgugauacuccaaaacgcuuggaaggucucuuguacaauucuggcggccgugagcguuuccccacuucuguugacuucaagccagcagaaagcagacuggaucccucucgcucugaccaucaagggccuaaaucccacggccauuuuucugacaacccuuagucggacuucuaaaaagagauccuggccacucaacgaggccgugauggcugucggcaugguaagcauacuggcaucgucauugcugaaaaaugacaucccgaugaccgggccuuuaguggccggaggucuccugacaguuugcuaugugcuuacuggcaggucugcggaucuggaauuggagcgagcugccgacgucaagugggaggaucaggcagaaauuaguggguccagccccauccucucuauuaccaucagcgaggacggauccaugucaaucaaaaacgaagaggaggaacacacgcugacaauccuaauucgcaccggccugcuugugaucagugguguauucccagugagcauucccaucacugccgcugcaugguaccucugggaggucaagaagcaacgggccgggguucugugggaugugccuucuccacccccugugggaaaagcggaauuggaggacggcgcuuauagaauaaagcagaggggcauuuuuggguacucccagaucggagccggugucuauaaagaaggcacauuccauaccauguggcacgugacucguggggcaguuuuaaugcaucgcggaaagcggaucgagccgucaugggccgaugucaagaaagaccugauuaguuacggcgguggguggaaacucgagggagaauggaaagagggcgaagaggugcagguccuggcucuugaaccaggcaagaaucccagagccgugcaaacaaaaccugggcuguuuaagaccaacacgggaacuaucggugcaguuagcuuggauuucuccccaggcaccucugggucgcccauaguggacaggaaaggaaaggucgugggccuauacgguaaugggguagucacacgaagcggagcuuaugugucagccauugcgcagaccgagaaguccaucgaggauaacccugaaauugaggacgauaucuuccggaaaaagcgccugacaauaauggaccuccacccgggcgccggcaaaacuaagagauaccugcccgcaauuguuagggaagcuaucaaacgggggcuucgaaccuuaauccuggccccaacgagaguggucgcugcagagauggaagaggcccuccgcggauugccuauuagguaucagacacccgccauccgugcugagcauacuggucgggaaauuguggaccugaugugucacgcgaccuuuacaaugagacuccugaguccaguuagggugccuaacuacaaucuuauaaucauggaugaggcacacuucaccgaccccgccucuauugcugcccgcggcuauaucagcacucgagucgaaaugggggaggcagccggaaucuuuaugaccgcuacaccaccgggcuccagagauccuuucccccagucaaacgcgccaauuauggacgaggaacgggagauacccgaaaggucuuggaauagcggucaugagugggugacggauuuuaaggggaagacuguaugguucgugccuaguaucaaagccggaaacgacauugcagcuugccugcgcaagaauggcaaaaagguuauccaauugucccguaaaaccuuugauagcgaauacgucaagacaagagccaacgacugggauuucguggugaccacugacauuucugagaugggcgcaaauuuucgggccgagagggucaucgauccacgccgauguaugaagcccguaauacuaacagacggggaagagagagugauccuggcuggaccuaugccgguuacccacucauccgccgcgcagcggaggggucgcauuggcagaaaccccaaaaaugaaaacgaccaguauaucuacaugggggagccacucgaaaaugaugaggacugcgcacauuggaaggaggccaaaauguuacuggauaacauuaauacgccugaaggaaucauacccaguauguucgagccagaaagggagaagguggacgcuauugauggcgaauaccggcuucguggugaggcccgcaaaacuuuugucgaccugaugcgaagaggggaucucccugugugguuggcuuauaggguugcagccgagggcaucaacuacgcugaccggcgcugguguuucgauggaauuaagaauaaccaaauccuggaagagaacguggaagucgagauauggacaaaagagggcgaaagaaagaagcucaaacccagguggcuggacgcccggaucuauagcgauccacuugcacuaaaggaguucaaagaauuugcggccgggcgaaagucgcugaccuugaauuuaauuaccgagaugggaagacugccuacuuucaugacacagaaagcucgcgacgcccucgauaaccuggcagugcuucacaccgcugaaguagguggcagggccuacaaucacgcacugucugagcucccggagacauuggaaacucugcuacugcucacgcuucuggccaccgugacagggggaaucuuuuuauucuugauguccggcaaggguauugggaagaugacucugggcaugugcugcaucauaaccgcuagcauucuccugugguaugcgcagauccagccccauuggaucgccgcaucaauuauccuugaguuuuuccugauaguucucuugauuccagaaccugagaaacaacggacaccccaggacaaccagcugaccuacgucgugaucgcuauuuuaacuguggucgccgccacgauggcaaaugaaaugggauuucuagagaagaccaaaaaggaccugggccucgggaguaucacaacucaggagucugaauccaacauacuugauaucgaccugcguccagcuagcgccuggaccuuguaugcgguugcuacaaccuucgugacuccuaugcugagacacucaauugagaauaguagcguaaacgugucccucacagccaucgcaaaucaagccacgguccugaugggacuugguaggggcuggccccucucuaaaauggauauuggggugccgcuguuggcuaucggauguuacagccagguuaacccaauuacccugacugcagccuuacuacugcucguggcgcauuacgcuaucauaggcccuggucuucaggccaaggcaacacgcgaagcccagaagcggaccgcugccgggauuaugaaaaaucccaccgucgacggcaucacaguaaucgaucuggagccaauucccuaugacccuaaguuugaaaaacaauugggacaggugaugcugcucguucugugcgugacucagguccuuaugaugcgaacgaccugggcauuaugugaggcucugacacucgccacuggcccgauauccaccuugugggaggggaaccccggaagauucuggaauacaaccaucgcggugucaauggccaacauuuuuaggggcucuuaccuggcuggugcugggcuacuguucaguaucaugaagaauacuacgaacacacgccggggaaccggcaauauuggugaaacucucggcgagaaauggaagucgagacuuaacgcccugggaaagagcgaauuucagaucuauaaaaaguccggaauacaagaggucgaucguaccuuggcaaaagagggcaucaagagaggggaaacagaccaccaugcugugucucggggaucagccaaacugcgcugguucguugagcgaaacauggugacuccagaaggcaagguaguggaucucgguugcgggagaggaggcuggagcuacuauugugguggccugaaaaaugucagggagguuaagggguuaaccaagggaggcccugggcacgaagaaccaauuccuauguccacauacggauggaaccuugugcggcugcagaguggcgucgacguguucuuuacgccacccgagaaaugcgauacccuccuaugugacaucggugaaucuagcccuaauccaacuauugaggccgggcgcacacugagaguauugaaccugguggaaaauuggcucaacaauaacacccaguucugcaucaagguucuuaaucccuauaugccgucagugauagagaaaauggaaacucugcaaaggaaguacggaggcgcguugguccgaaacccucugucccggaauaguacacacgagauguacugggugagcaacgcuaccggcaauauugucucuuccgugaacaugaucucacguaugcucaucaauagauuuacgaugaaacauaagaaggcaaccuaugagccagauguugacuuagggagcggaacacgcaacauugguauagaaaacgagauccccaaucuggacauuaucggcaaaaggauugaaaagaucaaacaggagcacgaaacuucguggcauuacgaucaggaccacccuuauaagaccugggccuaccacgggucuuaugagacaaaacagacuggaagugcuuccagcaugguaaacggcguggucaaacuucugaccaagccaugggaugugguucccauggugacacaaauggccaugaccgacacuacgccguucggucagcagcgggucuuuaaagagaagguggauacaagaacccaggaaccuaaagaggggacuaagaaacuaaugcgcauaaccgcagaauggcucuggaaggagcugggaaagaaaaagacacccaggauguguacgcgagaggaguucacccggaaaguaagaucaaaugccgcuuugggcgcgaucuuuacugacgagaacaaguggaaauccgccagggaagcaguggaggauucucgcuucugggaacugguugaccgugagcggaaucuccaucuugagggcaagugcgaaacaugugucuacaacaugauggggaaaagagagaagaagcugggagaauuugguaaagcuaagggcagcagggccauuugguauaugugguuaggggcacgcuuccuggaguuugaagccuugggauuccucaaugaggaucacugguuuagucgaggcaacucccugagcgguguggagggggaaggacuacauaaacuuggcuacauccugcgggacgugucuaagaaagagggcggggcuauguacgccgaugacaccgcgggaugggacacuagaauuacacucgaagaucugaagaaugaggaaauggucaccaaccacaugaagggugagcauaaaaaguuggcagaggccaucuucaaacugacauaucaaaauaagguugugaggguacagcgcccaacuccuagaggcaccgugauggacauuauaucacggaaagaucagagggggaguggacaggucggcacguacggucucaacaccuucacaaauauggaagcucaacuuauccgucagauggagggggaaggaauuuuuaaguccauccagcgacugacugugaccgaggagaucgccguucaaaacugguuagcacgcgugggcagagaacggcugagcaggauggcuauuucuggcgacgauugcgucgugaagcccuuggacgaucgcuucgccucggcucucacagcccugaaugacauggggaaaguaagaaaggauauacagcagugggagccaucacggggauggaacgacuggacucagguucccuuuugcagccaccacuuccaugagcuagugaugaaagaugguaggguccuuguggugccuugucgaaaccaagacgagcugaucggccgugcaagaauuucccagggggcgggauggagucucaaggaaaccgccugccugggcaaaucuuaugcucagauguggacguugauguacuuucaccgccgggauuuaaggcuggccgcaaaugcuaucuguagcgccgucccaucccauuggguuccgacaucaagaaccacuuggaguauucacgcaaagcacgaguggaugacaaccgaggacaugcucgccguguggaaccgcguauggauccaggaaaaucccuggauggaggacaagacuccuguggaaucuugggaggaagucccauaucuugguaaacgggaggaucaauggugcgggagccugauaggacuaaccuccagggcgacaugggcuaagaacauccagacggccauuaaucaggugcgaucacugaucggcaacgaggaauacaccgacuauaugcccagcaugaaaagauuccggaaggaggaagaggaagcaggcguucucugguga

SEQ ID NO: 14593 - RNA, 9876 nt, Artificial Sequence
  derived and/or modified CDS sequence (opt3) from DENV-2__KF955363__SS-prME
accgccggagugaucauuaugcugauacccacagcuauggcauuccaccucacuacgcggaacggggaaccucauaugaucgucggaaggcaggaaaaggguaaaagccuucuguuuaagaccgaggacggcguuaauaugugcacauugauggccauugauuuaggggaacugugugaggacacuaucaccuacaaaugcccauuacuccggcaaaacgaaccggaggauauugacuguuggugcaauuccacaucuaccugggugacuuauggaacauguaccacgacuggcgagcaccgccgagaaaagcguucaguagcgcuggugccccaugucgguauggggcuugagaccagaacagaaacuuggaugaguagcgagggagcuuggaaacacgugcagaggaucgagaccuggauacugcggcauccuggcuucacaaucauggccgcaauuuuggccuacaccaucggcacgacucacuuucagcgcgcucucauuuucauccugcugacagcaguugccccauccaugaccaugagaugcauagggauuucuaacagggauuuuguggaaggagucucggguggcucauggguggacaucguacucgagcacgggagcuguguuacuacaauggcuaagaauaagcccaccuuagauuucgaacugauuaaaacggaggccaagcagccugcgacccuucggaaauauugcaucgaagcaaaguugacaaacacuaccacagagagucgcuguccaacucaaggagagcccucccugaaugaggaacaggacaaacgauuucuaugcaagcauucuaugguggauagaggcugggguaacggguguggacucuucggcaagggcgggaucguaaccugcgccauguuuacaugcaaaaagaauauggaaggaaaaguggugcagccugagaaccuggaauacaccauugucauaacuccacacagcggugaggagcaugcuguuggcaaugacacggggaagcacggaaaagaaaucaagauuacaccgcaguccucaaucaccgaggccgaacuuacuggcuaugguaccgugacaauggaguguagucccaggaccgggcuggauuucaacgaaaugguauugcuccaaauggaggacaaagcauggcuggugcaccggcagugguuuuuagaucugccucucccauggcuucccggcgcugacacucagggaagcaauuggauacagaaggagacacuggucacguucaagaacccucaugccaaaaagcaagacgugguuguguugggcucucaggaaggggcgaugcacaccgcccuaacuggagcaacagagauucagauguccucagguaaucugcucuuuaccggccaucugaaaugccgucuucgcauggauaagcugcaauugaaagggaugagcuacaguauguguacaggaaaguucaagaucgucaaagaaaucgcugagacucagcacggcaccauugugaucagaguacaguaugagggugacgggucuccaugcaagauucccuucgaaauaauggaucucgagaaaaggcauguucugggccgguuaaucacggugaacccgauugucaccgaaaaggacuccccugugaacaucgaggccgaacccccauuuggagauagcuacaucauuauaggcgucgagccugggcagcugaaacuaaauugguucaagaagggaucgucuaucggucaaauguuugagacaacuaugcgaggcgcuaaacgcauggccauucucggggacaccgcaugggauuucggaucccugggcgguguguuuacaucaaucgggaaggcccuucaccagguuuucggcgcuauuuacggagcggcauuuaguggcgugagcuggacuaugaaaaucuugauagggguaaucauuaccuggaucggaaugaacuccagaucuacgagccugucagucagucucgugcugguuggcguggucacacuuuaucugggugccauggugcaggcugacuccggguguguagugagcuggaagaauaaagaauugaagugcggaucuggcauuuucaucaccgauaacguucacacuuggacagagcaguacaaguuucaacccgaaucaccaaguaaacucgccagcgcaauacagaaggcccaugaggaagguauuuguggcaucagguccgucacccggcuggagaauuuaauguggaaacaggugacucccgagcugaaccacauucuaucugaaaaugaggugaagcucaccaucaugacaggggacauaaaaggaaucaugcaggcuggcaagcgcucgcugagaccucaaccaacggaacuuaaauauagcuggaagaccugggggaaggccaaaauguuguccacugagucacauaaccagacauuccugauugauggaccggaaaccgcagagugccccaauacaaacagggcguggaauagucucgaggucgaagacuacggcuuugguguuuucacuaccaacaucuggcugaaguuacgugagaaacaggacguguuuugugauucuaagcugaugagcgcugccauuaaagacaaucgggcagugcacgccgauaugggguauuggaucgaauccgcucuuaacgacacguggaagauggagaaggccucauucauagagguaaaaagcugccacuggccuaagucucauacauugugguccaauggaguccucgaaagugagaugauuauccccaaaaauuucgcaggccccgugagccagcacaacuaccgaccugguuaucauacccaaacugcuggcccauggcaccuggggaagcuagaaauggauuuugacuucugugagggaaccacaguuguggucacugaagauugcggcaauagagggcccucucugaggaccacaacggccuccggaaaacucaucaccgaguggugcugucgcucaugcacucugccgccucuucgguacagaggcgaggacgguuguugguacgggauggaaauuaggccauugaaggagaaggaagagaaccuggugaauaguuuaguuacagcgggacauggccagaucgauaacuuuagccucggugugcugggcauggcccuuuuccuggaagagauguugcgcacccgaguagggacuaaacacgcuauucuccuggucgcagugucguuugugacacuaauaaccggaaauauguccuuccgggaccugggccgugucaugguuauggugggggccacgaugacugaugacaucggaaugggcguaaccuaucucgcucugcuugccgcauuuaaggugagacccacauucgcggccgguuugcuguuaaggaaacucaccucuaaggagcugaugauggcuacuauugggaucgcccuucugagccagucaacaauuccugaaaccauccuagagcucacagaugcacuggcuuugggaaugaugguccugaaaauagugcgcaacauggaaaaguaccaauuagccguuacuaucauggcaauuaguugcgugcccaaugccgucauccuccagaacgcuuggaagguguccuguaccauucuggcggccguuucugugagcccacuucuguugacguccucacagcagaaagcagacuggaucccucucgcucugacaauaaagggccuaaaucccaccgccauuuuucugacuacccuuagccggacaaguaaaaagagaucuuggccacucaacgaggccaucauggcugucggcaugguauccauccuggcaagcucguugcugaaaaaugacauuccgaugacugggccuuuaguggccggaggucuccugaccguuugcuaugugcuuacgggcaggucagcggaucuggaauuggagcgagcugccgacgucaagugggaggaucaagcagaaauaucugggaguucccccauccucagcauuacaaucucugaggacggaagcauguccauuaaaaacgaagaggaggaacagacccugacuauccuaauacgcacaggccugcuugugaucucagguguauucccagugaguauucccaucaccgccgcugcaugguaccucugggaggucaagaagcagcgggccgggguucugugggaugugccuagcccacccccugugggaaaagcggaauuggaggacggcgcuuauagaauuaagcagaggggcaucuuaggguacucucaaauaggagccggugucuauaaagaaggcacuuuucacacaauguggcaugugacccguggggcaguucugaugcaccgcggaaagcggauugagccguccugggccgaugucaagaaagaccucaucucauacggcgguggguggaaacuggagggagaauggaaagagggcgaagaggugcagguccuugcucuggaaccaggcaagaaucccagagccgugcagacgaaaccuggguuguucaagacuaacaccggaacaaucggugcaguuagucuagauuuuagcccaggcaccuccgggucucccauuguggacaggaaaggaaaggucgugggccuguacgguaaugggguagucacacgaucgggagcuuaugugagcgccaucgcgcagacugagaagucaauagaggauaacccugaaauugaggacgauaucuuccggaaaaagcgccucaccauuauggaccugcauccgggcgccggcaaaacgaagagauaccuucccgcaaucguuagggaagcuauaaaacggggguuacgaacacugauucucgccccaacuagaguggucgcugcagagauggaagaggccuugcgcggacugccuaucagguaucaaacccccgccauccgugcugagcacacaggucgggaaauuguggaccucaugugucaugcgaccuucacuaugagacugcuuuccccaguuagggugccuaacuacaaucugaucauuauggaugaggcacacuuuaccgaccccgccaguauagcugcccgcggcuauaucucuacacgagucgaaaugggggaggcagccggaauuuucaugacggcuacuccaccgggcagcagagauccuuuuccccaguccaacgcgccaaucauggacgaggaacgggagauccccgaaaggucauggaacucuggucacgagugggugaccgauuucaaggggaagacaguaugguuugugccuagcauuaaagccggaaacgacauagcagcuugcuugcgcaagaauggcaaaaagguuauccagcuaagucguaaaaccuucgauuccgaauacgucaagacuagagccaacgacugggauuuuguggugacaaccgacauuagcgagaugggcgcaaauuucaaggccgagcgggucaucgauccaaggcgcuguaugaaacccguaauucugacggacggggaagaacgagugauccucgcuggaccuaugccgguuacucauucuucagccgcgcaaagacgggguaggauaggccgcaacccaaagaaugaaaacgaccaguauaucuacaugggggagcccuuagaaaaugaugaggacugcgcacacuggaaagaggccaagaugcugcuugauaacauuaauacaccugaaggaaucauucccuccauguuugagccagaaagagagaaaguggacgcuaucgauggcgaauacaggcugcggggugaggcccguaagaccuucgucgaccucaugcgccgaggggauuugccuguguggcuggcuuauagaguugcagccgagggcauaaacuacgcugacaggcggugguguuuugauggaauuaaaaauaaccagauccucgaagagaacguggaagucgagauuuggaccaaggagggcgaacgcaagaaacugaagcccagauggcuugacgccaggaucuauagugauccacuagcacugaaagaguucaaggaguucgcggccgggcgaaagagcuugacuuuaaaucugauaacagagaugggacggcucccuaccuuuaugacacagaaggcuagagacgcccuggauaaccuugcagugcugcauacugcugaagccgguggcaaggcauacaaucacgcccucucggaguugccggagacgcuggaaacccuacugcuccuuacacuguuagcuacuguaaccgggggaaucuucuuguuucugaugucuggcaaagguauugggaagaugacacucggcaugugcugcaucauuaccgcguccauccugcuuugguaugcccaaauacagccccacuggauugcagcuagcaucauccuggaguucuuucucauuguguugcugaucccagaaccugagaaacagcgcacuccccaggacaaccaauuaacguacguugucauagccauucuaaccgugguggccgcaacaauggcuaaugaaaugggauuccuggagaagacuaaaaaggaccucggccuugggucaaucaccacacaggagagugaaucuaacauucuggauaucgacuugaggccagccuccgcguggacccuguaugcugucgccacuacauuuguuacgccuaugcuccggcauagcauagaaaauucaagugugaacguaagccugaccgcaaucgccaaucaggcuacugugcuuaugggacucgguaagggcuggccccuguccaaaauggauauuggggucccguugcuggcaaucggauguuacucucaggugaacccaauuacauuaaccgccgcgcuacugcuccuuguugcucacuacgccaucauuggcccuggucugcaagcaaaggccacccgugaagcucagaaaagagccgcagcugggaucaugaagaaucccacaguggacggcauaacugucauugauuuggagccaauccccuaugacccuaaauucgaaaagcagcugggacagguaaugcuccugauccuuugcgugacgcaaguuuuaaugaugaggaccacaugggcccugugugaggcgcucacuuuggccaccggcccgauuagcacacugugggaggggaaccccggacgcuuuuggaauaccacuauagcaguguccauggcuaacaucuuccggggcucauaccuagccggugcagggcugcucuuuucuauuaugaagaauacgacaaacacccgaagaggaacuggcaauaucggugaaacccuuggcgagaaauggaagaguaggcugaacgcuuuggggaaaucggaguuccagauuuauaagaaaagcggaauccaggaggucgaucgcacacuggccaaggagggcauaaaaagaggggaaacugaccaucacgccguguccagaggaucugcgaagcuccguugguuugucgagaggaacauggugaccccagaaggcaagguuguggaucuggguugcgggcggggaggcuggucauacuauugugguggccuuaaaaauguacgcgaggugaaggggcuaacaaaaggaggcccugggcaugaagaaccaaucccuaugagcacguacggauggaaccugguccgacuccaauccggcguugacguguucuucaccccacccgagaagugcgauacucuacugugugacauuggugaaaguucuccuaauccaacaaucgaggcugggagaaccuugaggguccugaaccucguggaaaauuggcuuaacaauaacacucaguuuugcauuaaaguacugaaucccuauaugccgagcgugaucgagaagauggaaacauugcagcggaaguacggaggcgcacugguucgcaacccucucucaagaaauuccacccacgagauguacugggugaguaacgccacgggcaauauagucagcucugugaacaugauuuccaggauguuaaucaaucgauucaccaugaaacacaagaaagcuacauaugagccagaugucgaccuggggucaggaacucggaacaucgguauugaaagcgagauacccaaccuugacaucauuggcaagcguaucgagaaaauuaagcaggagcaugaaaccucguggcacuacgaucaagaccauccuuauaagacaugggccuaccacgggucuuaugagacuaaacagaccggaagugcauccagcauggugaauggcguuguaagacugcuaacaaagccaugggaugugguccccauggugacccagauggccaugacugacacgacaccguuuggucagcaacgcguuuucaaagagaagguggauaccaggacucaggaaccuaaagaggggaccaagaagcucaugaaaaucacagcugaauggcuguggaaggaguugggcaaaaagaaaacgccccggauguguaccagagaggaauuuacucgcaaggucaggucaaacgcggcccugggcgcaauauucacagacgagaauaaauggaaguccgcucgagaagccguggaggauucucgguuuugggaacucguagacagagagaggaaccuucaccuggagggcaagugcgaaaccuguguguacaauaugauggggaaacgcgagaagaaauuaggagaguucgguaaggcaaaaggcagccgugccaucugguauauguggcugggggcucgguuuuuggaguucgaagcccucggauuucugaacgaggaucauugguucaguagaggcaauucccuaagcgguguugagggggaaggacuucacaggcugggcuacauucuccgcgacgucucuaagaaggagggcggggcgauguacgcagaugacacugccggaugggacacacgaaucacccuggaagauuugaaaaacgaggaaauggugacaaaucauaugaagggugagcacaaaaagcuggcugaggccauuuuuaaacucacuuaucagaacaaggugguccggguucagagaccaaccccuaggggcacggugauggacaucauuucacgcagagaucaacgggggaguggacagguaggcaccuacggucuuaauacauucacuaacauggaagcacagcugauaaggcaaauggagggggaaggaaucuucaaguccauucagcauuuaaccgugacagaggagaucgcuguccagaauuggcuggcccgugugggccgagaacgcuugagcagaaugguuaucucuggcgacgauugcguggucaaaccccucgacgaucgguuugcuucggcccugacugcacuaaacgacauggggaaggugaggaaagauauucagcaaugggagccaucacgcggauggaaugacuggacccagguacccuucugcagccaccacuuucaugaacuuguuaugaaggaugguagagugcuggucgugccuugucggaaccaggacgagcucauaggcagggcgcgaaucucccagggggccggauggagucugaaagaaacggcuugcuugggcaagucuuaugcccaaauguggacauuaauguacuuccaccguagagaucugcgccucgcagcuaacgccauuuguagcgcagugccaucccauugggucccgaccucacggacuacauggaguauccacgccaagcacgaguggaugaccacugaggacaugcuugcgguuuggaauaggguguggauucaggaaaaccccuggauggaggacaaaaccccuguagaaucuugggaggaagugccauaucuggguaagagagaggaucaguggugcgggagccuaaucggacugacaucccgcgcuacgugggccaaaaauauacagaccgcaaucaaccaaguccggucacucauuggcaaugaggaauacacugacuauaugcccagcaugaagagguuucgaagagaggaagaggaagccggcguguugugguga

SEQ ID NO: 14594 - RNA, 9876 nt, Artificial Sequence
  derived and/or modified CDS sequence (opt3) from DENV-2__EU726767__SS-prME
agcgccggaaugaucauuaugcugauacccaccgugauggcuuuccaccucacaacuagaaacggggagccucauaugaucgucuccaggcaggaaaagggaaaaucucuucuguuuaagacggaggacgguguuaauaugugcaccuugauggcaauggauuuaggcgaacugugugaggacacaauuacuuacaaaugcccacuacuccggcaaaacgaaccggaggauaucgacuguuggugcaauucaaccaguacaugggugaccuaugggacuugugccacaaccggagagcaccgccgagaaaagcguagcguagcgcuggugccccaugucggcaugggucuugagacgagaacugaaaccuggauguccucugagggggcuuggaaacacgcccagaggauugagacauggauccugcggcauccuggauucacuauaauggcagccaucuuggcuuacaccauuggcacaacccacuuucagcgcgcacucaucuucauucugcugacggccguggcuccaucgaugacuaugagaugcaucggcauaucaaacagggauuuuguugaaggggugagcggagguaguugggucgacauugugcucgagcacggcuccuguguaacaaccauggccaagaauaagcccacuuuagauuucgaacugaucaaaacagaggcgaagcagccugcaacccuucggaaauauugcauugaagccaaguugacgaacaccacaacugagucucgcuguccaacccaaggggagcccagccugaaagaagaacaggacaagcgauuuguuugcaagcauuccaugguggauagaggauggggcaaugguugugggcuauucggaaaaggcggcaucgucacaugcgcuauguuuacuugcaagaaaaacauggaagggaagaucgugcagccugagaaucucgaauacaccauuguggucacaccacacucaggagaggagcaugccguugguaacgacaccggcaaacacgggaaggaaauaaaagugacuccgcagaguagcaucacggaggcagaacugacaggauauggcaccguaacuauggaguguucucccaggaccggucuugauuucaaugaaauggugcuguugcaaauggagaacaaggcuuggcucguccaccggcagugguuucuggacuuaccucugccauggcuccccggggccgauacacagggcuccaauuggauucagaaggagacccuugugacuuucaaaaacccucaugcgaagaaacaagacguugugguccugggaucacaggaaggcgccaugcacacagcauugacgggggcuaccgagauccagaugagcaguggaaaucuacuguuuacuggucaucucaagugccgucugcgcauggacaaacuucaacugaagggcaugucuuacuccauguguacagggaaguucaaagugguaaaggaaauagccgagacccagcacggaacaauuguuaucagagugcaguaugagggcgaugguagcccaugcaaaauccccuucgaaauuauggacuuggagaagagguacguccucgggcggcugaucacugugaacccgauugucaccgaaaaagauucgccugugaacauagaggcugaacccccauuuggcgacucuuacaucauuaucggaguugagccuggccaguuaaagcugaauugguucaagaaaggguccucaaucggacaaauguuugagacgaccaugcgaggugccaagcgcauggcaauucuaggcgauacagccugggacuucgggagucucggaggcguguuuacuagcauagguaaagcucugcaucagguauucggggcgaucuauggcgcagccuuuuccggagucucuuggaccaugaagauucuuaucggcgugauuaucacauggauagggaugaacagcagaucaacaaguuuguccguuagccuggugcucgucggaaucgugacccuguaccuuggcguaauggugcaggcugauucugguuguguugucucauggaaaaauaaggaacugaagugcgggaguggaauuuucaucacggacaacgugcacacauggaccgagcaguauaaauuucaacccgaaagcccauccaaguuggccucugcaauucagaaagcccaggaggaaggcaucugugguauaaggucggugacucggcucgagaaucugauguggaagcagauuacacccgaguuaaaccacauccuggcugaaaaugaggucaaacuaaccauuaugacuggcgauguuaaggggaucaugcaagccggaaaacgcagccucagaccucagccaaccgaacugaaguacuccuggaagacauggggcaaagcaaagaugcuuucaacggagagucauaaccagaccuucuugauagacgggccggaaacugcggagugccccaauacaaacagggcuuggaacucucuggagguggaagauuauggauuuggcguguucaccacaaacaucuggcucaaacugaaggagaaacaggacgccuuuugugacagcaaguuaauguccgcagccauuaaggauaaucgugcuguacacgccgacauggguuacuggaucgaaucagcacugaacgauacuuggaaaauugagaaggcuagcuucaucgaggucaaaaauugccauuggccuaagucucacacccuuugguccaacgggguguuggaaagugagaugauaauucccaagaaucucgccggacccguuagccaacacaauuaucggccuggcuaccauacgcagaucgcggguccauggcaccugggcaagcuagaaauggacuucgauuuuugugaggggacaaccguggucgugacugaagacugcggaaaccgaggccccucucugagaaccacaacugccuccgggaagcucaucaccgaguggugcuguaggucaugcacacugccgccucuucgcuaccggggagaggauggcuguugguaugguauggaaauuagaccauugaaagagaaggaagagaaucugguuaacaguuuagugacggcugggcauggacagguagacaauuucagccucggcguccuggguauggcacuuuuucuggaagagauguugaggacccgcgugggcacuaaacacgccauccuccugguggcugucucguucaugacacuaauuaccgggaacauguccuuuaaggaucugggacgaguugugguaauggugggcgccgcaaugacugacgauauagggaugggagucacauaccucgcgcugcuugccgcuuucaaagugcggcccaccuuugccgcaggcuugcuguuacguaagcucacgucuaaggagcugaugaugacuaccaucgguauugcacuucugagccaaucaacaaucccugaaaccauucuagagcucacugacgcccuggcauuggggaugaugguucugaaaauggugagaaauauggaaaaguaucaguuagccgucacaaucauggcuauacucugcgugcccaacgcgguuauccugcagaaugccuggaaagugaguuguaccauucuugcagucguauccgugucuccacuguugcucacaagcucccagcaaaagacugauuggaucccucuggcucuaaccauuaaaggacugaaccccacggccaucuuccuuacaacccucucaaggacuagcaagaaacgcaguuggccacugaaugaggccauaauggcuguuggcauggugucuauuuuggcauccagccuguuaaagaacgacaucccgaugaccggcccucucgucgccgggggacugcuuacagugugcuacguacugacuggucggucggcggacuuggaacucgagagagcuaccgaugugaagugggaggaccaggccgaaaucucaggcucuagucccauucuguccauaacgaucagcgaggaugggucuaugagcauuaaaaaugaagaggaggaacagacacuaaccauccugauuaggacuggacuucucgucaucuccggccuguuuccaguuucaauacccaucacagcagccgcuugguauuugugggaggugaagaaacagcgagcugguguguuaugggacgucccuaguccacccccuauggggaaggccgaacuggaggauggagcguaccgcauuaaacaaaagggcauccucggcuauagccagauuggggcuggaguguacaaggaagguaccuuccauacuauguggcacguuacacggggcgccguacugaugcacaaagggaagagaaucgagccgucuugggcagacgugaaaaaggaucuuauauccuacggaggcgguuggaaacuggagggggaauggaaggagggagaagagguccagguguuggcccuagaaccaggcaagaaccccagggcuguucagaccaaaccuggccuguuuaagacgaaugccgggacuauuggagcagugucacucgacuucaguccagguaccagcggcucccccaucaucgauaaaaaggggaaagucgugggacuguauggcaacgguguagucacacguucuggggcuuacgugucggccauugcgcaaaccgaaaagagcaucgaggacaacccugaaauagaggaugacauuuuucgcaagcggagacuuacaaucauggauuuacauccgggagccggcaaaacuaagagguaucugcccgcaauuguucgagaagcuaucaaacggggccuccgcaccuugauacuggccccaacgagaguggucgcugcagagauggaagaggcccucagggggcugccuauucgguaccagacacccgccauccgagcugagcacacuggaagagaaaucguggaccuuaugugucaugcgaccuucacaaugcgccuguugucaccaguuagggugccuaauuauaaccuaauuaucauggacgaggcacacuucaccgaucccgccuccauugcugcccgugguuacauaaguacucgggucgaaaugggcgaggcagccgggaucuuuaugaccgcuacaccaccgggaucuagagacccuuucccccagagcaaugcgccaauuaucgaugaggaaagggagauccccgaacgcuccuggaacucaggccaugagugggugacggacuuuaaggguaaaacuguaugguucgugccuucuauuaaggccgggaaugauauagcagcuugccugcgaaagaacggcaaaaagguuauccaacucagcagaaaaaccuuugacagugaauaugucaagacacggaccaaugauugggacuucguggugacuacagauauuuccgagaugggcgccaacuuuaaagcagagagggucaucgacccacgccguuguaugaagcccguaauuuuaaccgauggcgaagagagagugauccuggccgggccuaugccgguuacgcacagcucugcugcccagcggaggggacgcauaggucgaaaucccaaaaacgaaaaugaccaguacaucuacaugggcgagccccuugaaaacgacgaggauugcgcgcacuggaaggaggcaaagaugcugcucgacaauauuaacacuccugaagggaucauucccucaauguucgagccagaaagagagaaaguggaugccaucgacggagaauaucgguugaggggcgaggcucgcaagacauuugucgaucugaugagaaggggugaccucccuguguggcuggccuacaaaguugcugcagaggggauaaauuaugccgaucggcguugguguuucgacggcauuaagaacaaccagauccuugaagagaauguggaagucgagauuuggaccaaagagggagaacgcaagaagcuaaaaccccgauggcuggaugcuagaaucuacuccgacccauuggccuuaaaggaguuuaaagaguucgcagcgggcaggaagagucugacccucaaccugauaacugagauggggcggcuuccuacauucaugacccagaaaacucgcgaugcccuggacaaucucgcuguguugcauacugccgaagcaggagguagagcuuauaaccacgcccugagcgagcuaccggagacgcuggaaacccuccuucuguuaacauugcuggcaacuguaaccggcgggaucuuucucuuccugaugucgggaaggggcauugguaagaugacacuugggaugugcugcaucauuaccgccucuauccugcucugguacgcucaaauacagccccauuggauugcggccuccaucaucuuggaguuuuuccugauuguguuacuaaucccagaaccugagaagcagcggacuccccaagauaaucagcugacguauguugucauagcaauucucaccgugguggcugccacaauggccaacgaaaugggcuuucuugagaaaacuaagaaagaccugggauugggcagcaucgucacccagcagccagagucaaauauucuggacaucgaucuccgaccugcaagugcuuggacacuguacgccguugcgaccacuuucgugacacccaugcuuagacacucuauagaaaacuccagcguaaaugugucacucacggcuaucgccaaccaagcaaccguccugaugggguugggaaaggguuggccgcugaguaaaauggacauuggcgugccauuacuagccaucggguguuacagccagguuaauccuauuacucugacagcugcacuccuucuguugguggcccacuaugcgaucauuggacccggccugcaggcuaaggccacccgcgaggcacagaagagggccgcugccgguaucaugaaaaacccaaccgucgaugggauaacaguaauugaccucgaucccaucccuuacgacccgaaguuugaaaaacaacugggccaggugaugcuuuuaguucugugcgugacucagguccucaugaugcggacgaccugggcauugugugaggcucugacacuagccacuggacccaucuccacccugugggaaggcaauccagggcguuucuggaacacaaccauugcggugucuauggccaauauauuuagaggaagcuaucucgcaggcgcuggucuucuguucuccaucaugaagaacacuacgaauacaaggcgcgggaccggaaacauuggcgagacuuugggugagaaauggaagucacggcugaacgcccucggcaaaucugaauuucaaaucuacaagaagagugggauucaggaggucgaucgaacccuggcaaaagaaggaaucaagagaggcgagacagaccaucacgcugugucgagggggagcgccaaauuacgcugguucguugagcggaauauggugacuccugaaggaaagguaguggaucuuggcugcgguagagggggaugguccuauuacuguggcggucugaaaaacguccgugagguuaagggccucaccaaagggggacccggccaugaggaaccuauaccaaugucuacauauggguggaaucuagugaggcugcagucaggagucgacguguuuuucaucccaccugaaaaaugcgauacguugcugugugacauuggcgagagcuccccaaaccccaccguagaggccggucggacucuccgcgugcuuaaucugguugaaaacugguugaauaacaauacacaguucugcaucaaggugcugaacccguacaugccuagugucauugagaaaauggaagcgcuccaacgaaaguacgggggagcuuuagugagaaauccacugucuaggaacagcacccacgagauguauugggucucaaaugcauccggcaacaucgugaguagcguuaauaugauaucucggaugcuuauuaaccgcuuuacuaugagacauaaaaaggccacauacgaacccgauguagaccugggcuccgggaccaggaacaucggaaucgagucagagauuccuaaucuagacauaaucgguaagcgaauugagaaaaucaagcaggagcacgaaacgagcuggcacuaugaucaggaccauccauacaaaaccugggcuuaucacggcucguacgagacaaagcagacugggucugccaguuccauggugaacggagucgugcggcuccugaccaaacccugggauguuuugccgacagugacucaaauggcaaugaccgacacaaccccuuucggccagcagcgugucuuuaaggaaaagguggauacuagaacgcaggagcccaaagaggguacaaagaaacugaugaagauuaccgccgaauggcucuggaaagagcuugggaagaaaaagacuccacgcauguguaccagggaagaguucacacggaagguaagaagcaaugcugcgcugggagccguguuuacggacgagaacaaauggaagucagcacgcgaagcuguugaggauuccagguucugggaauuagucgacaaagagcgaucucugcauuuggaaggcaagugcgagaccuguguguauaauaugaugggcaaacgggagaagaagcucggggaauuuggaaaagccaaggguagcagagcaaucugguacauguggcugggcgccagguuccuagaguuugaagcucuuggguuccugaacgaggaucacugguuuagucgcgaaaauucccucagcggaguggagggcgagggucugcacaaauugggguacauacugcgugacgucucuaagaaagaaggaggcgccauguaugcggaugacacugcaggcugggacacacggaucacccucgaggaucuuaagaacgaagagaugguuacuaaucauauggaaggggagcacaagaaacuggccgaggcuauuuucaaguuaacauaccaaaacaaagugguaagagugcagaggccuaccccacgcggaacagucauggacaucauuucacgacgggaucagagagguaguggccaaguggggacuuauggacugaauaccuuuacgaacauggaagcccaguugaucaggcagauggagggcgaagguguuuucaagaauauucagcaucucaccgugacagaggagauagcaguccaaaacuggcuggcucgcguggggagagaacggcuauccaggauggccaucagcggagacgauugcguaguuaaaccacuugacgaucguuucgcuucugcccugacugcacucaaugacaugggcaagauucgaaaggauauccagcagugggagcccucgcgcggcuggaacgacuggacccaggugccuuuuugcucacaccauuuccacgaacugaucaugaaagaugggagagucuugguggugccaugucggaaccaagacgaguuaauuggaagggcgcgcauaagccagggugccggcuggucccugagagaaacagcuugccucgggaagaguuacgcccagauguggucucuuauguauuuucaccggagggaucugcgacuagcagcuaaugccaucuguagcgcagucccgucccauuggguucccacuucacguaccacguggaguauucacgccaaacaugaguggaugacaaccgaggacaugcugacuguguggaacagaguauggauccaggaaaauccuuggauggaggacaagacaccaguggaaucuugggaggaaauucccuaccucggaaaacgcgaggaucaauggugcggcagcuugaucggucugaccucccgggcgacuugggcuaagaacauacaggccgcaaucaaucaggucaggucacuuauugggaacgaggaauauaccgacuacaugccuagcaugaagagauuccgccgggaggaagaggaagccggagugcugugguga

SEQ ID NO: 14595 - RNA, 9876 nt, Artificial Sequence
  derived and/or modified CDS sequence (opt3) from DENV-2__EU687246__SS-prME
agcgcaggaaugaucauuaugcugauaccaaccgugauggcuuuccaccucacaacuagaaauggggagccucauaugaucguauccauucaggaaaagggaaaaucucuucuguuuaagacggaggacgguguuaauaugugcaccuugauggcaauggauuuaggcgaacugugugaggacacaaucacuuacaaaugcccacuacucaggcaaaacgaaccggaggauauugacuguuggugcaauucaaccaguacaugggugaccuaugggacuuguacaaccacgggagagcaccggcgcgaaaagcgaagcguagcacuggugccccaugucggcaugggucuugagacucguaccgaaacauggauguccucugagggggcguggaaacacgcucagagaaucgagacuuggauacugaggcauccuggauucaccaucauggccgcaauuuuggccuacacaaucggcaccacgcacuuucagcgggcucucauuuucauccugcugacugcaguggccccaucgaugacaaugcgcugcauaggcauuucaaacagagauuuuguugaaggggugagcggagguaguugggucgacaucgugcucgagcacggcuccuguguaaccacuauggcuaagaauaagcccacauuagauuucgaacugauuaaaaccgaggccaagcagccugcgacgcuuaggaaauauugcaucgaagcaaaguugaccaacacaacuaccgagucucgguguccaacacaaggggagcccagccugaaagaggaacaagacaagcgcuuuguuugcaagcauuccaugguggaucgaggauggggcaaugguugugggcuauucggaaaaggcggcaucgucacuugcgccauguuuaccugcaagaaaaacauggaagggaagauugugcagccugagaaucucgaauacacaauaguggucaccccacacucaggagaggagcaugcuguugguaacgacacuggcaaacacgggaaggaaaucaaagugacgccgcagaguagcauuacagaggccgaacugaccggauauggcacuguaaccauggaguguucucccagaacaggucuugauuucaaugaaauggugcuguugcaaauggagaacaaggcauggcucguccacaggcagugguuucuggacuuaccucugccauggcuccccggggcugauacccagggcuccaauuggauccagaaggagacucuugugacauucaaaaacccucaugccaagaaacaagacguugugguccugggaucacaggaaggcgcgaugcacacggccuugaccggggcaacugagauacagaugagcaguggaaaucuacuguuuacaggucaucucaagugccggcugcguauggacaaacuucaacugaagggcaugucuuacuccauguguaccgggaaguucaaagugguaaaggaaauugcugagacacagcacggaacuaucguuauccgcgugcaguaugagggcgaugguagcccaugcaaaauucccuucgaaaucauggacuuggagaagagauacguccucgggaggcugauuaccgugaacccgauagucacggaaaaagauucgccugugaacaucgaggccgaacccccauuuggcgacucuuacauuaucaucggaguugagccuggccaguuaaagcugaauugguucaagaaaggguccucaauuggacaaauguuugagaccacaaugcggggugcuaagcgaauggccauacuaggcgauacugcaugggacuucgggagucucggaggcguguuuaccagcaucgguaaagcccugcaucagguauucggggcuauuuauggcgcggcauuuuccggagucucuuggacaaugaagauccuuauuggcgugaucauaacuuggaucgggaugaacagccgcucaaccaguuuguccguuagccuggugcucgucggaauugugacgcuguaccuuggcguaauggugcaggccgauucugguuguguugucucauggaaaaauaaggaacugaagugcgggaguggaaucuucauuacagacaacgugcacaccuggacugagcaguauaaauuucaacccgaaagcccauccaaguuggcuucugccauccagaaagcacaggaggaaggcauaugugguauuagaucggugacaaggcucgagaaucugauguggaagcagaucacccccgaguuaaaccacauucuggccgaaaaugaggucaaacuaacuaucaugaccggcgauauaaaggggaucaugcaagcuggaaaacggagccuccgcccucagccaacagaacugaaguacuccuggaagacguggggcaaagccaagaugcuuucaaccgagagucauaaccagacuuucuugauugacgggccggaaacagcagagugccccaauaccaacagagcguggaacucucuggagguugaagauuauggauuuggcguguucacaacuaacaucuggcucaaacugaaggagaaacaggacgcuuuuugugacagcaaguuaauguccgccgcaauuaaggauaauagggccgugcacgcugacauggguuacuggaucgaaucagcccugaacgauaccuggaaaauagagaaggccagcuucauugaggucaagaauugccauuggccuaagucucacacgcuuugguccaacggggucuuggaaagugagaugaucauccccaagaaucucgcuggacccgugagccaacacaauuaucguccuggcuaccauacacagauugccgguccauggcaccugggcaagcuagaaauggacuucgauuuuugugacgggaccacuguuguggucaccgaggauugcggaaaccggggccccucucugcgaacaacuaccgcguccgggaagcucaucacagaauggugcuguagaucaugcacgcugccgccucuuagguaccgcggagaggacggcuguugguaugguauggagauucggccauugaaagaaaaggaggaaaaucuggugaacaguuuaguuaccgccgggcauggacagguggauaauuucagccucggcguacuggguauggcucuuuuucuggaggaaauguugagaacuagggucggcacaaaacacgcaauacuccugguggcccuaucguucgugacccugaucacugggaacauguccuuuaaggaccucggacgcgucguugugaugguaggcgcuacaaugaccgaugacauugggaugggagugacguaccuggcccuuuuggcagcguucaaaguccgacccacuuuugccgcuggccuguuacuccggaagcugaccucuaaggagcuuaugaugacaaccaucgguauugugcugcuaagccaaucaaauaucccugagacuauacucgaacugacagaugccuuggcacuggggaugaugguuuuaaaaaucgugcgugacauggagaaguaucagcucgcugucaccauuauggccauccugugcgugcccaacgcaguuauucuucagaaugccuggaaagugaguuguacaauccuggcugucguauccgugucuccauugcuccugacuagcucccagcaaaagaccgacuggauaccucuagcgcugacgauuaaaggacuuaaccccacagccaucuuccucaccacucugucaagaaccaauaagaaaaggagcuggccauugaacgaagcaaucauggcuguuggcauggugaguauucuggccucuuccuuacucaagaaugauauaccgaugacaggcccucuggucgccgggggacuucugacugugugcuacguauugaccggucgcagcgcugaccucgagcuggaacgggcaacggaugugaagugggaggaccaggccgagaucucgggcucaucucccauucuaaguaucacaauuuccgaagaugggagcaugucuaucaaaaacgaggaagaggagcagacccugacuauacuuaucagaacaggacuccuggucauuagcggcuuguuuccaguuuccauccccauuaccgcggcugccugguauuuaugggaagugaagaaacagagggccggugugcugugggacgucccuucaccacccccuauggggaaggccgagcucgaagauggagcuuaccgaaucaaacaaaagggcauacugggcuauagucagauuggggcaggaguguacaaggaggguacuuuccauacaauguggcacguuacccgcggcgccguacuuaugcacaaagggaagcggaucgaaccgagcugggcggacgugaaaaaggaucugaucucuuacggaggcgguuggaaauuggagggggaguggaaggaaggagaggaaguccaggugcuagcucuggagccaggcaagaaucccagagccguucagacgaaaccuggccucuuuaagacuaacaccgggacaauuggagcagugucccuggacuucucaccagguaccaguggcagccccaucauagauaaaaaggggaaagucgugggacuuuauggcaacgguguagucacaagguccggggccuacgugucugcuauugcccaaacugaaaagucgaucgaggacaauccugauauugaggacgacaucuuucguaagcgccgguuaaccauaauggaucugcauccgggagcaggcaaaacgaagagauaucuccccgcuauuguuagggaagccaucaaacgaggcuugcggacacugauccucgcgccaacucgcguggucgccgcagagauggaagaggcucugagagggcuuccuauuagguaccagacccccgccauccgggcugaacacacaggacgagagauuguggaccugaugugucaugcaaccuucacuaugagauugcuaagcccaguucgcgugccuaacuauaaucugauaaucauggaugaggcccacuucaccgaccccgccucaauugcugcgagggguuacaucuccacacgugucgaaaugggcgaggcagccgggaucuuuaugacggcuacuccaccgggaagucgggauccuuucccccagucuaacgccccaauuauagacgaagagagagagauccccgaaaggagcuggaacuccggccaugagugggugaccgauuuuaaggguaaaacaguaugguucgugccuucaauuaaggcagggaacgacaucgccgcuugccuccgcaagaauggcaaaaagguuauucaauuaucucgaaaaaccuuugauagcgaauauaucaagacuagaacaaacgacugggauuucgucgugaccacggacauaagugagaugggcgcgaauuuuaaagccgaacgggugaucgacccaaggcgcuguaugaagcccgucauucugacugauggcgaggagcguguaauccuugcagggccuaugccggugacacacuccagcgcugcccagagacggggaaggauuggucgcaaccccaaaaaugaaaacgaccaguacaucuacaugggcgagccccuggaaaaugaugaggacugcgcacacuggaaggaagccaagaugcucuuggauaacauaaauaccccugaggggauuauccccucuauguucgagccagaacgagagaaaguugacgcuauugauggagaauauagacugcggggcgaggccaggaagaccuuuguggaccucaugcgcagaggugaucugccugucuggcuugcguacaaaguggcagccgaagggaucaacuaugcugacaggcggugguguuucgauggcauaaagaacaaucagauccuagaggagaacguugaaguggagauuuggacuaaagaaggagagcguaagaagcugaaaccccgcugguuggacgcccgaaucuacucagauccauuagcucugaaggaguuuaaagaguucgcagccggcagaaagucccucacacugaaucuuauuaccgagauggggaggcugccuacauucaugacucagaaaacgcgggacgcucucgacaacuuggccguccugcauaccgcagaagcgggaggucgcgccuauaaucacgcucuaagugagcugccggaaacacucgagacucuucuguuauugacccugcucgccacagugaccggcgggaucuuucuguuccuuaugagcggaagaggcauagguaagaugacucuggggaugugcugcauuaucacggcaucgauccucuugugguacgcucagauucagccccauuggaucgccgcaucuauaauucuggaguuuuucuuaaucguacuacugauuccagaaccugagaagcagaggaccccacaagauaaccagcucacauaugugguuaucgccauacuuacugucguggcugcgaccauggccaaugaaaugggcuuucuggagaaaacaaagaaagacuugggacugggcuccaucgcaacccagcagccagaaagcaacauucucgauaucgaccugcggccugcuucagccuggacucuuuacgccguggcaacaacguucauuacccccaugcuccgacacaguaucgaaaauucuuccgucaacguuagccugacugcuauugccaaucaagcgacaguguugauggggcugggaaaggguuggccguuaucaaaaauggauaucggcguaccacuacuggcuauaggguguuacagucaggugaacccuauuacccucaccgccgcacuucuguugcugaucgcccacuaugcuaucauuggacccggccuccaggcaaaggccacaagagaggcgcagaagcgcgcugccgcagguauaaugaaaaauccaacugucgacgggaucacggugauugaucuggaccccaucccuuacgauccgaaguuugaaaaacaacuuggccagguuauguuacuggugcucugcgucacccagguauugaugaugaggacaacuugggcccugugugaggcucuaacccuggccacaggacccauuagcacccucugggaaggcaacccagggcgguucuggaauacuacgaucgcaguguccauggcuaacauauuucguggaucuuaucuugccggcgcgggucuguuguucagcaucaugaagaauacaaccaacacuagaagggggaccggaaacauuggcgagacacugggugaaaaauggaagucccgccucaaugcccugggcaaaucagaguuucaaaucuacaagaagucugggauucaggagguugaccggacuuuagcaaaagaaggaaucaagcgaggcgagaccgaucaucacgcugugaguagagggucggccaaacuuaggugguucgucgaacgcaacauggugacaccugagggaaaggucguggaccugggcugcgguagagggggauggagcuauuacuguggcggucucaaaaauguucgggaggugaagggccuaacgaaaggcgggcccgggcaugaggaaccuauaccaauguccaccuauggguggaaccugguacguuugcagucuggaguggaugucuuuuucauucccccugaaaaaugcgacacucugcucugugacaucggcgagucaagcccaaaucccacaguugaagcagguaggacccuucgggugcugaacuuggucgagaauuggcugaacaauaacacucaguucugcaucaaggugcucaauccguacaugccuuccguaauugagaaaauggaaacauuacaacgcaaguacgggggagcucuggugcgaaacccacuuaguagaaauucuacccacgagauguauuggguuagcaacgccucaggcaauauaguguccagugucaacaugaucagcaggaugcugauuaaccgguuuacgaugcgccauaaaaaggccaccuacgaacccgauguggaccuaggcucugggacaagaaauaucggaauugaguccgaaaucccuaaccucgauauaaucgguaagaggauugagaaaaucaagcaggagcacgaaacuucauggcacuaugaccaggaucauccauacaaaaccugggcguaucacggcagcuacgagacaaagcagacugggucggcuucuaguauggucaauggagugguucgacuguugaccaaacccugggacguacugccgacagugacccaaauggcaaugacugauacgacaccuuucggccagcagcgggucuuuaaggaaaagguggacacccguacucaggagcccaaagaagguaccaagaaacucaugaagauuacagccgaguggcuuuggaaagagcuggggaagaaaaagacgccaagaauguguacccgcgaagaguucacuaggaagguucgguccaacgcugccuuaggagcaaucuuuacagaugaaaauaaauggaaaagcgccagagaggcuguggaggacucacgcuucugggaacuggucgauaaagagaggaacuugcaucucgaaggcaagugcgagaccuguguguauaauaugaugggcaaacgagaaaagaagcugggggaguuuggaaaagcgaaggguucccgggccauuugguacauguggcuaggcgcaagauuccuugaguuugaagcucugggguuccucaacgaggaccacugguuuucuagggaaaauagccugaguggaguagagggcgaagguuugcacaaacugggguacauacuccgcgacguguccaagaaagagggaggcgccauguaugcagaugacacugccggcugggauacacguaucacccuugaggaccugaagaacgaagagaugguuacaaaucauauggaaggggagcacaagaaauuagcugaagccauuuucaagcugacuuaccaaaacaaagucgugcgggugcagagaccuacccccaggggaacggucauggauaucaucagccgccgagaccagcgggguucuggccaaguugggaccuauggauugaauacauuuacuaacauggaggcgcagcucauuagacagauggagggcgaagguguguucaagaauauacagcaucugaccguaacagaggaaaucgcagugcaaaacuggcuagccagggucgggcgcgagagacuuucacggauggcuauuaguggagaugacugcgugguuaaaccacuggaugacagguucgccuccgcacucacugcucugaacgauaugggcaagauccguaaggacauucagcagugggagcccagccgaggcuggaaugauuggacccaggugccuuuuugcucucaccauuuccacgaauugaucaugaaagacgggcgcgucuuagugguaccauguagaaaccaagacgagcugauaggacgggccaggaucucgcagggugcuggcuggucacuccgcgaaacggccugccuuggaaagagcuacgcacagauguggucccugauguauuuucacagacgggaucuaaggcuggcggccaaugcuauuuguagugccguuccgucucauugggugcccacaagccgaaccacuugguccauccacgcaaaacaugaguggaugacaaccgaagacaugcucacugucuggaaccguguguggauucaggagaauccuuggauggaggauaagaccccaguggaaucaugggaggaaauccccuacuugggaaaaagagaggaccaauggugcggcagucugauaggucuuacaucucgcgcuacgugggccaagaacauucaggcagccaucaaucagguccggagccugauuggguccgaagaguauaccgauuacaugccuucaaugaagagguucagacgcgaggaagaggaagcgggaguucucugguga

SEQ ID NO: 14596 - RNA, 9876 nt, Artificial Sequence
  derived and/or modified CDS sequence (opt3) from DENV-2__FJ639828__SS-prME
agcgugggcaugaucauuaugcugauacccaccgucauggccuuccaccucacaacuagaaacggggagccucauaugaucguuuccauucaggaaaagggaaaaucucuucuguuuaagacggaggacggugugaauaugugcaccuugauggcuauggauuuaggcgaacugugugaggacacaaucacuuacaaaugcccacuacucaggcaaaacgaaccggaggauauugacuguuggugcaauucaaccaguacauggguaaccuaugggacuuguacaaccacgggagagcaccggcgcgaaaagcgaagcguggcacuggucccccaugugggcaugggucuugagacucguaccgaaacauggauguccucugagggggccuggaaacacgcgcagagaaucgagacuuggauacugaggcauccuggauucaccaucauggcugccauuuuggcauacacaaucggcaccacgcacuuucagcggacucucauuuucauccugcugacagccguugcuccaucgaugaccaugcgcugcauaggcauuucaaacagagauuuuguggaaggggucagcggagguaguuggguggacaucguacucgagcacggcuccuguguuacuacaauggcaaagaauaagcccaccuuagauuucgaacugauuaaaacggaggccaagcagccugcuacccuuaggaaauauugcaucgaagccaaguugacaaacacuaccacagagucucgguguccaacucaaggggagcccagccugaaagaagagcaggacaagcgcuuugugugcaagcauuccauggucgaucgaggauggggcaaugguugugggcuauucggaaaaggcggcaucgugaccugcgcgauguuuacaugcaagaaaaacauggaagggaagauugugcagccugagaaucucgaauacaccauagucguuacuccacacucaggagaggagcaugcaguggguaacgacacgggcaaacacgggaaggaaaucaaaguaacaccgcagaguagcauuaccgaggccgaacugacuggauauggcaccgugacaauggaguguucucccagaaccggucuugauuucaaugaaaugguccuguugcaaauggagaacaaggcuuggcucgugcacaggcagugguuucuggacuuaccucugccauggcuccccggggccgauacucagggcuccaauuggauccagaaggagacacuuguuacguucaaaaacccucaugcaaagaaacaagacguggucgugcugggaucacaggaaggcgcuaugcacaccgccuugacuggggcgacagagauacagaugagcaguggaaaucuacuguuuaccggucaucucaagugccggcugcguauggacaaacuucaacugaagggcaugucuuacuccauguguacagggaaguucaaaguaguuaaggaaauugccgagacucagcacggaaccaucgugauccgcguccaguaugagggcgaugguagcccaugcaaaauucccuucgaaaucauggacuuggagaagagauacgugcucgggaggcugauuacggucaacccgauagcaaccgaaaaagauucgccugugaacaucgaggcugaacccccauuuggcgacucuuacauuaucaucggaguugagccuggccaguuaaagcugaauugguucaagaaaggguccucaauuggacaaauguuugagacaacuaugcggggugccaagcgaauggcuauacuaggcgauaccgccugggacuucgggagucucggaggcguguuuacaagcaucgguaaagcacugcaucagguauucggggccauuuauggcgcugcguuuuccggagucucuuggacuaugaagauccuuauuggcgugaucauaaccuggaucgggaugaacagccgcucaacgaguuuguccguuagccuggugcucgucggagugguaacacuguaccuuggcgugaugguucaggcagauucugguugugucgugucauggaaaaauaaggaacugaagugcgggaguggaauuuucaucaccgacaacgugcacacuuggacagagcaguauaaauuucaacccgaaagcccauccaaguuggccucugcuauucagaaagcccaggaggaaggcaucugugguauaagaucggucaccaggcucgagaaucugauguggaagcagauuacucccgaguuaaaccacauccuggcagaaaaugagguuaaacuaaccauuaugacaggcgauaucaaggggauaaugcaagccggaaaacggagccuccgcccucagccaacggaacugaaguacuccuggaagaccuggggcaaagcuaagaugcuuucaacugagagucauaaccagacauucuugaucgacgggccggaaaccgccgagugccccaauacaaacagagcauggaauucucuggagguggaagauuauggauuuggcguguucacuaccaacauuuggcucaaacugaaggagaaacaggacgcguuuugugacagcaaguuaauguccgcugccaucaaggauaauagggcaguacacgccgacauggguuacuggauugaaucagcucugaacgauacguggaaaaucgagaaggccagcuucauagaggucaaaaauugccauuggccuaagucucacacacuuugguccaacgggguguuggaaagugagaugauuaucccaaaaaaccucgcaggacccguuagccaacacaauuaucguccuggcuaccauacccagaucgcugguccauggcaccugggcaagcuagaaauggacuucgauuuuugugacgggacuaccguggucgugacagaggauugcggaaaccggggccccucucugcgaacuaccacagccuccgggaagcucauuacggaauggugcuguagaucaugcacccugccgccucuuagguaccgcggagaggacggcuguugguaugguauggagauccggccauugaaagaaaaggaggaaaaucugguuaacaguuuagugacugcggggcauggacagguagauaauuucagccucggcguccuggguauggcccuuuuucuggaggaaauguugagaacaagggugggcaccaaacacgcuauucuccugguggcagucucguucguuacucuaauaacagggaacauguccuuuaaggaccugggacgcgugguagugauggucggcgccaccaugacggaugacaucgggaugggagugacuuaccucgcucugcuugccgcauucaaaguucgacccaccuuugcggccggcuuguuccugcggaaguuaacaucuaaggagcucaugaugaccacuauugguaucgugcugcuuagccaaucaacacugccugagaccauucuagaacucacagaugcucuggccuuggggaugaugguccugaaaauggugcgugacauggagaaguaucaguuagcaguuacuaucauggcuauacucugcgugcccaaugccgucauccugcagaacgcauggaaaguaaguuguaccauucuugccgugguuuccgugucuccacuguugcucacgagcucccagcaaaagacagacuggaucccucuggcucuaaccauuaaaggacugaaucccacugcgaucuuucuuaccacacucucaagaacuaacaagaaaaggagcuggccacugaaugaagccauaauggcagucggcauggugaguauuuuggcuucuucccuguuaaagaacgauaucccgaugaccggcccucucguagccgggggacugcuuacggugugcuacguccugacaggucgcagcgccgacuuggagcucgaacgggcuaccgauguuaagugggaggaccaggcagagaucucgggcucaucucccauucugaguauaacuaucuccgaagaugggagcaugucuauuaaaaaugaggaagaggagcagacacuaaccauccugauuagaacuggacuucucgugaucagcggccuguucccaguguccauacccaucacagccgcggcuugguauuugugggaagucaagaaacagagggccgguguguuaugggacguuccuucaccacccccuauggggaaggcagagcuggaagauggagccuaccgaauuaaacaacgcggcauccucggcuauagucagauuggggcuggaguauacaaggaggguaccuuucauacgauguggcacgugacucggggcgcaguccugacccacaaggggaaaagaaucgaaccgagcugggccgacgugaagaaagaucuuauaucuuacggaggcgguuggaagcuggagggggaguggaaagaaggagaggaaguucagguguuggcgcuagagccaggcaagaaccccagggcuguccagacaaagccuggccuguucaaaaccaauacagggacuauuggagccgugucccucgacuuuucaccagguaccaguggcagccccaucaucgauaagaaagggaagguagucggacuguauggcaacggugugguuacgcguuccggggcauacgugucugccauugcucaaacagaaaaaucgaucgaggacaacccugauauagaggacgacauuuuccgcaagcggagacuuacuaucauggauuuacauccgggagccggcaagaccaaaagguaucugcccgcaauuguccgagaagcuaucaagcggggccuccgcacauugauacuggccccaaccagagugguugcggccgagauggaagaggcacucagggggcugccuauucgguaccagacucccgcuauccgagccgaacacaccggaagagagaucguggaccuuaugugucaugcuacauucacgaugcgccuguugagcccagucagggugccuaauuauaaccuaauuaucauggaugaggcacacuuuacugaccccgccucaauugccgcucgugguuacauauccacccggguagaaaugggcgaggcggcagggaucuucaugacagccaccccaccgggaaguagagauccuuuuccccagucuaaugcuccaauuaucgacgaagagagggagauccccgaacgcagcuggaacuccggccaugagugggugacugauuucaaagguaagacaguuugguuugucccuucaauuaaagccgggaaugacauagcagccugccugcgaaagaacggaaagaaagugauccaacucucuagaaagaccuucgauagcgaauaugugaaaacgcggacuaaugacugggauuuugucguaacaaccgacauuagugagaugggcgcuaacuucaaggcggaaagggugaucgacccacgccguuguaugaaacccguuauuuuaaccgauggcgaggagagagugauccuggccgggccuaugccggucacucacuccagcgcagcucagcggaggggacgcauaggucgaaauccaaagaacgaaaaugaccaguacaucuacaugggcgagccccuugaaaacgaugaggacugcgcccacuggaaagaagcaaagaugcugcucgauaauauuaacacaccugaggggaucauucccucuauguuugagccagaaagagagaagguggacgccaucgauggagaauaucgguugaggggcgaggcucgcaaaaccuucguugaccugaugagaaggggugaucucccuguguggcuggccuacaaggucgcggcagaagggauaaauuaugccgaccggcguugguguuuugauggcauuaaaaacaaccagauccuugaggagaauguggaaguagagauuuggacaaaggaaggagagcgcaaaaagcuaaagccccgauggcuggacgcuagaaucuacucagauccauuggccuuaaaagaguucaaggaauucgcugcaggcaggaaaucccugacucucaaccugauaacggagauggggcggcuuccuaccuuuaugacacaaaagacucgcgacgcccuggacaaucucgcuguguugcauaccgccgaagcaggagguagagcguauaaccacgcccugagugagcuaccggaaacacuggagacccuccuucuguuaacuuugcuggcuacgguuaccggcgggaucuuccucuuucugaugagcggaaggggcauugguaaaaugacacuugggaugugcugcaucgucacugccucgauucugcucugguacgcacagauccagccccauuggauagcugccucuauuaucuuggaguucuuucugaucguguuacuaauuccagaaccugagaagcagcggaccccccaagauaaucagcugacauauguggucaucgcaauacucaccguuguggccgcuacuauggcgaacgaaaugggcuuccuugagaagacaaaaaaggaccugggauugggcuccauugccacgcagcagccagaaagcaauauccuggauauugaccuccgaccugcaucagcuuggacccuguacgccguagccacuacauuugugacccccaugcuuagacacaguaucgagaacucuuccgucaaugugagccucaccgcaauagcuaaccaagccacaguucugaugggguugggaaaagguuggccgcugucaaagauggauaucggcgcgccauuacuagcuauuggguguuacagucaggugaauccuaucacucugacggccgcacuccuucuguuggucgcccacuaugcuauuaucggacccggccugcaggcaaaagccacccgcgaggcgcagaagagggcugccgcagguauuaugaagaacccaacaguagacgggaucacugugauagaucucgaccccauuccuuacgauccgaaauucgaaaagcaacugggccagguuaugcuuuuagugcugugcgucacccaggugcucaugaugcggacaaccugggccuugugugaggcucugacucuagccacgggacccaucagcacacugugggaaggcaauccagggcguuuuuggaacaccacuaucgcagucuccauggcuaauauuuucagaggaucuuaucucgccggcgcgggucuucuguuuagcauaaugaaaaacaccacaaauuccaggcgcgggacuggaaacaucggcgagaccuugggugaaaaguggaaaucacggcugaacgcccucggcaagucugaguuccaaauuuacaaaaagagugggauccaggagguggaccgaacacuggcaaaggaaggaauuaaaagaggcgagacggaucaucacgcuguuucgagggggagcgccaaguuacgcugguuuguggaacggaauaugguaaccccugagggaaaaguggucgaccuuggcugcgguagagggggaugguccuauuacuguggcggucugaagaacguucgugaggugaaaggccucacuaaggggggacccggccaugaagagccuaucccaaugucuacauauggguggaaucuagucaggcugcagucaggaguggauguauucuucauacccccugaaaagugcgacaccuugcugugugacaucggcgagagcuccccaaaccccacuguggaagcaggucggacacuccgcguucuuaaucugguggagaacugguugaauaacaauacccaguuuugcauuaaaguccugaacccguacaugccuagugugaucgagaagauggaaacgcuccaacgaaaauacgggggagcuuuagucagaaauccacugucuaggaacagcacccacgagauguauugggugucaaaugccuccggcaacauuguuaguagcguaaauaugaucucucggaugcuuauaaaccgcuucacaaugagacauaagaaagccacuuacgaacccgauguggaccugggcuccgggaccaggaacauuggaaucgagucagaaaucccuaaucuagauauuauagguaagcgaaucgagaagauuaaacaggagcacgaaacaagcuggcacuaugaccaggaucauccauacaagacuugggcguaucacggcucguacgagaccaaacagacagggucugcuaguuccauggucaacggagugguucggcuccugaccaagcccugggacguguugccgacugucacgcaaauggcaaugacagauaccacuccuuuuggccagcagcguguguucaaagaaaagguagacaccagaacacaggagcccaaggaagguacgaaaaagcugaugaaaaucaccgccgaguggcucuggaaggagcuugggaaaaagaaaacuccacgcauguguacaagggaagaguuuacccggaaggugagaagcaaugcugcccugggagcaauuuucacugaugaaaacaaguggaaaucagcccgcgaggcuguugaggacuccagguuuugggaauuagucgauaaggagcgaaaucugcauuuggaaggcaaaugcgagacauguguguauaacaugaugggcaagcgggaaaaaaagcucggggaguucggaaaggcgaaagguucuagagccaucugguacauguggcugggcgcaagguuucuagaguucgaagcucuuggguuucugaaugaggaccacugguucagccgcgaaaacagucucuccggaguggagggcgaaggucugcaccguuugggguacauacugcgggacgucagcaagaaagagggaggcgccauguaugcagaugacaccgccggcugggauacaagaaucacucucgaggaccuuaagaaugaagagaugguuaccaaccauauggaaggggagcacaaaaagcuggcugaagccauuuuuaaguuaacguaccaaaauaaagugguaagggugcagcgcccuaccccccgaggaacagucauggauaucauuucucggagagaccagagggguucaggccaaguggggacuuauggacugaacaccuucacaaauauggaggcgcaguugauccgccagauggagggcgaagguguuuucaagaacauucagcaucucacugugaccgaggaaauagcaguccaaaauuggcuggccagaguggggcgggagaggcuaagucguauggcuaucuccggagaugacugcguaguuaaaccacuugaugaccgauuugccagcgcacugacggcucucaacgauaugggcaagauucgcaaagacauccagcagugggagcccucuagaggcuggaacgauuggacacaggugccuuucugcucgcaccauuuucacgaacugaucaugaaggacgggcgggucuugguggugccauguaggaaucaagacgaguuaauuggacgcgccagaauaucacagggugcuggcuggagccugcgggaaaccgccugccucgggaaguccuacgcacagauguggagucuuauguauuuccacaggcgagaucugcgucuagcggccaacgcuaucuguucugccgucccgagccauuggguucccacuuccagaacaaccuggucaauucacgcaaaacaugaguggaugacuaccgaagacaugcugacaguguggaaucgcguauggauccaggagaacccuuggauggaggauaagacgccaguggaaaguugggaggaaauucccuaccucggaaaacgggaggaccaauggugcggcucuuugaucggucugaccagcagggcuacuugggccaagaauauacaggcagccaucaaccaggucagaucccuuauugggaaugaagaguauacagauuacaugccuucaaugaaacgcuuucggagggaggaagaggaagcgggagugcugugguga

SEQ ID NO: 14597 - RNA, 9876 nt, Artificial Sequence
  derived and/or modified CDS sequence (opt3) from DENV-2__FJ639829__SS-prME
agcgugggcaugaucauuaugcugauccccaccgucauggccuuccaccucaccacuagaaacggggagccucauaugaucguuuccauucaggaaaagggaaagucucuucuguuuaagacggaggacggugugaauaugugcaccuugauggcuauggauuuaggcgaacugugugaggacacaaucacuuacaaaugcccacuacucaggcaaaacgaaccggaggauauugacuguuggugcaauucaaccaguacauggguaaccuaugggacuuguacaaccacgggagagcaccggcgcgaaaagcgaagcguggcacuggucccccaugugggcaugggucuugagacucguaccgaaacauggauguccucugagggggccuggaaacacgcgcagagaaucgagacuuggauacugaggcauccuggauucaccaucauggcugccauuuuggcauacacaaucggcaccacgcacuuucagcggacucucauuuucauccugcugacagccguugcuccaucgaugaccaugcgcugcauaggcauuucaaacagagauuuuguggaaggggucagcggagguaguuggguggacaucguacucgagcacggcuccuguguuacuacaauggcaaagaauaagcccaccuuagauuucgaacugauuaaaacggaggccaagcagccugcuacccuuaggaaauauugcaucgaagccaaguugacaaacacuaccacagagucucgguguccaacucaaggggagcccagccugaaagaagaacaggacaagcgcuuugugugcaagcauuccauggucgaucgaggauggggcaaugguugugggcuauucggaaaaggcggcaucgugaccugcgcgauguuuacaugcaagaaaaacauggaagggaagauugugcagccugagaaucucgaauacaccauagucguuacuccacacucaggagaggagcaugcaguggguaacgacacgggcaaacacgggaaggaaaucaaaguaacaccgcagaguagcauuaccgaggccgaacugacuggauauggcaccgugacaauggaguguucucccagaaccggucuugauuucaaugaaaugguccuguugcaaauggagaacaaggcuuggcucgugcacaggcagugguuucuggacuuaccucugccauggcuccccggggccgauacucagggcuccaauuggauccagaaggagacacuuguuacguucaaaaacccucaugcaaagaaacaagacguggucgugcugggaucacaggaaggcgcuaugcacaccgccuugacuggggcgacagagauacagaugagcaguggaaaucuacuguuuaccggucaucucaagugccggcugcguauggacaaacuucaacugaagggcaugucuuacuccauguguacagggaaguucaaaguaguuaaggaaauugccgagacucagcacggaaccaucgugauccgcguccaguaugagggcgaugguagcccaugcaaaauucccuucgaaaucauggacuuggagaagagauacgugcucgggaggcugauuacggucaacccgauagugaccgaaaaagauucgccuguuaacaucgaggcagaacccccauuuggcgacucuuacauuaucaucggaguggagccuggccaguuaaagcugaauugguucaagaaaggguccucaauuggacaaauguuugagacaacuaugcggggugcuaagcgaauggccauacuaggcgauaccgcuugggacuucgggagucucggaggcguauuuacaagcaucgguaaagcccugcaucaggucuucggggcaauuuauggcgccgcuuuuuccggagugucuuggacuaugaagauccuuauuggcguuaucauaaccuggaucgggaugaacagccgcucaacgaguuuguccgugagccugguccucgugggaguagugacacuguaccuuggcguuaugguccaggcggauucugguuguguggugucauggaaaaauaaggaacugaagugcgggaguggaauuuucaucaccgacaacguccacacuuggacagagcaguauaaauuucaacccgaaagcccauccaaguuggcaucugccauucagaaagcucaggaggaaggcaucugugguauaagaucgguuaccaggcucgagaaucugauguggaagcagauuacucccgaguuaaaccacauccuggccgaaaaugaggugaaacuaaccauuaugacaggcgauaucaaggggauaaugcaagcaggaaaacggagccuccgcccucagccaacggaacugaaguacuccuggaagaccuggggcaaagccaagaugcuuucaacugagagucauaaccagacauucuugaucgacgggccggaaaccgcugagugccccaauacaaacagagccuggaacucucuggagguggaagauuauggauuuggcguauucacuaccaacauuuggcucaaacugaaggagaaacaggacgcauuuugugacagcaaguuaauguccgcggcuaucaaggauaauagggccguccacgcagacauggguuacuggauugaaucagcccugaacgauacguggaaaaucgagaaggcuagcuucauagaggugaaaaauugccauuggccuaagucucacacacuuugguccaacgggguuuuggaaagugagaugauuauccccaagaaucucgccggacccgugagccaacacaauuaucguccuggcuaccauacccagaucgcagguccauggcaccugggcaagcuagaaauggacuucgauuuuugugacgggacuaccgucgugguuacagaggauugcggaaaccggggccccucucugcgaacuaccacagcuuccgggaagcucauuacggaauggugcuguagaucaugcacccugccgccucuuagguaccgcggagaggacggcuguugguaugguauggagauccggccauugaaagaaaaggaggaaaaucuggugaacaguuuaguaacugccgggcauggacaggucgauaauuucagccucggcgugcuggguauggcgcuuuuucuggaggaaauguugagaacaagggugggcaccaaacacgccauucuccuggucgcuguuucguucgugacucuaauaacagggaacauguccuuuaaggaccugggacgcguaguggucauggugggcgcaaccaugacggaugacaucgggaugggaguuacuuaccucgcccugcuugcugccuucaaagugcgacccaccuuugcagcgggcuuguuccugcggaaguuaacaucuaaggagcucaugaugaccacuauugguaucguccugcuuagccaaucaacaauuccugagaccauccuggaacuaacagaugcccucgcucuggggaugaugguguugaaaaugguucgugacauggagaaguaucagcuggccgugacuauaauggcaaucuuaugcguccccaaugcuguaauucuccagaacgccuggaaagugaguuguaccauccuggcaguuguguccgucucuccacuucuguugacgagcucccagcaaaagacagacuggauuccucucgcccugaccaucaaaggacuaaaucccacugcuauauuucugaccacacuuucaagaacuaacaagaaaaggagcuggccacucaaugaagcgauuauggccgugggcaugguaaguauccuggcaucuuccuugcugaagaacgauaucccgaugaccggcccuuuaguggcugggggacuccugacggucugcuacguucuuacaggucgcagcgccgaccuggaguuggaacgggccaccgaugugaagugggaggaccaggcugagauuucgggcucaucucccauacucaguaucacuauuuccgaagaugggagcaugucuaucaaaaaugaggaagaggagcagacacugaccauucuaaucagaacuggacugcuugugauaagcggccucuucccagucuccauccccauuacagcagccgcgugguaucugugggaagugaagaaacagagggcugguguuuugugggacguaccuucaccacccccuauggggaaggccgaguuagaagauggagcauaccgaaucaaacaacgcggcauucugggcuauagucagaucggggccggaguguacaaggaggguaccuuucauacgauguggcacgucacucggggcgcugugcucacccacaaggggaaaagaauagaaccgagcugggcagacguuaagaaagaucugauuucuuacggaggcgguuggaaacuugagggggaguggaaagaaggagaggaagugcagguccuggccuuggagccaggcaagaaccccagggcggugcagacaaagccuggccuauucaaaaccaauacagggacuaucggagcuguaucccuggacuuuucaccagguaccaguggcagccccaucauugauaagaaagggaaggucgugggacucuauggcaacgguguugugacgcguuccggggccuacgucucugcaaucgcccaaacagaaaaaucgauagaggacaacccugauauugaggacgacaucuuccgcaagcggagacugacuauuauggaucuucauccgggagcuggcaagaccaaaagguauuuacccgccaucgugcgagaagcaauaaagcggggccugcgcacacucauuuuggcuccaaccagaguuguggccgcggagauggaagaggcccugagggggcucccuauccgguaccagacucccgcaauccgagcugaacacaccggaagagagauugucgaccugaugugucaugccacauucacgaugcgccuucugagcccagugaggguaccuaauuauaacuugaucauuauggaugaggcucacuuuacugaccccgcaucaauagccgcccgugguuacaucuccacccggguggaaaugggcgaggcugcggggauuuucaugacagcaaccccaccgggaaguagagauccuuuuccccagucuaaugccccaaucaucgacgaagagagggagauucccgaacgcagcuggaacuccggccaugaguggguuacugauuucaaagguaagacagucugguuugugccuucaauaaaagcugggaaugacaucgccgcaugccuacgaaagaacggaaagaaagugauucaacugucuagaaagaccuucgauagcgaauaugucaaaacgcggacuaaugacugggauuuuguagugacaaccgacaucagugagaugggcgccaacuucaaggcugaaaggguuauugacccacgccguuguaugaaacccgugauccucaccgauggcgaggagagagucauauuagcggggccuaugccggugacucacuccagcgccgcacagcggaggggacgcaucggucgaaauccaaagaacgaaaaugaccaguacauuuacaugggcgagccccuggaaaacgaugaggacugcgcucacuggaaagaagccaagaugcuucuggauaauaucaacacaccugaggggauuauccccucuauguuugagccagaaagagagaagguugacgcaauagauggagaauaucggcucaggggcgaggcccgcaaaaccuucguggacuugaugagaaggggugaucugccugucuggcucgcuuacaagguggccgcggaagggauuaauuaugcagaccggcguugguguuuugauggcaucaaaaacaaccagauucuggaggagaauguagaaguggagaucuggacaaaggaaggagagcgcaagaaacuuaaaccccgauggcuagacgccagaauauacucagauccacuggcuuugaaagaguucaaggaguucgccgcuggcaggaaauccuuaacucugaaccucaucacggagauggggcggcugccuaccuuuaugacacaaaagacucgcgacgcacuugacaaucuggccguucuccauaccgcugaagccggagguagagcauauaaccacgcguugagugagcugccggaaacacuagagacccugcuccuucugacuuuauuggccacggucaccggcgggauuuuccuguuucucaugagcggaaggggcaucgguaaaaugacacuggggaugugcugcauugugacugcuucgauccuucugugguacgcccagauacagccccauuggauugcagcuucuaucauccucgaguucuuuuugauugugcuguuaaucccagaaccugagaagcagcggacaccacaagauaaucagcuaacauaugucguuauagccauucugaccgugguagcagccacuauggcuaacgaaaugggcuuccucgagaagaccaagaaggaccuuggacugggcuccaucgcgacgcagcagccagaaagcaauauuuuggauaucgaccugcgaccugccucagcauggacccucuacgcuguggccacuacauuugucacccccaugcugagacacaguauagagaacucuuccgugaauguuagccuuaccgccaucgcaaaccaagcuacagugcucauggggcugggaaaagguuggccguugucaaagauggauauuggcgccccacuguuagcgaucggguguuacagucaggucaauccuauuacucuaacggcugcccugcuccuucugguagcacacuaugccaucauuggacccggcuugcaggcuaaagcaacccgcgaggcccagaagagggcggcugccgguaucaugaagaacccaacaguggacgggauaacuguuauugaucuggaccccaucccuuacgauccgaaauucgaaaagcaacucggccaggugaugcugcuugucuuaugcgugacccagguccugaugaugcggacaaccugggcacucugugaggccuugacucuggcuacgggacccaucagcacacuaugggaaggcaauccagggcguuuuuggaacaccacuauugccguguccauggcaaauauauucagaggaucuuaucuggcuggcgccggucuccuuuuuagcaucaugaaaaacaccacaaauuccaggcgcgggacuggaaacauuggcgagacccugggugaaaaguggaaaucacgguugaacgcgcugggcaagucugaguuccaaaucuacaaaaagagugggauucaggagguugaccgaacacucgccaaggaaggaaucaaaagaggcgagacggaucaucacgcagugucgagggggagcgcuaagcugcgcugguuuguagaacggaauauggugaccccugagggaaaagucguugacuuaggcugcgguagagggggaugguccuauuacuguggcggucuuaagaacgugcgugaggucaaaggccugacuaaagggggacccggccaugaagaaccuauaccaaugucuacauauggguggaaucucgugaggcuacagucaggaguagauguguucuucauacccccugaaaagugcgacacccuguugugugacauuggcgagagcuccccaaaccccacuguugaagccggucggacacugcgcgugcucaaucuugucgagaacuggcugaauaacaauacccaguuuugcaucaaaguguugaacccguacaugccuagugucauugagaagauggaaacgcugcaacgaaaauacgggggagcacucgugagaaauccauuaucuaggaacagcacccacgagauguauuggguuucaaaugcuuccggcaacaucguaaguagcgugaauaugauaucucggaugcugauuaaccgcuucacaaugagacauaagaaagccacuuacgaacccgaugucgaccuuggcuccgggaccaggaacaucggaaucgagucagaaauuccuaaucuggauauaaucgguaagcgaauugagaagaucaaacaggagcacgaaacaagcuggcacuaugaccaggaucauccauacaagacuugggccuaucacggcucguacgagaccaaacagacagggucugcgaguuccauggugaacggaguugugcggcuacucaccaagcccugggacguccugccgacugugacgcaaauggcuaugacagauaccacuccuuuuggccagcagcguguauucaaagaaaagguggacaccagaacacaggagcccaaggaagguacgaaaaaguugaugaaaauuaccgcagaguggcuguggaaggagcucgggaaaaagaaaacuccacgcauguguacaagggaagaguuuacccggaagguuagaagcaaugccgcucuuggagccaucuucacugaugaaaacaaguggaaaucagcacgcgaggccgucgaggacuccagguuuugggaacugguggauaaggagcgaaauuuacaucuggaaggcaaaugcgagacauguguguauaacaugaugggcaagcgggagaagaaguugggggaguucggaaaggcuaaagguucuagagcgauaugguacauguggcucggcgccagguuucuggaguucgaagcacuaggguuucuuaaugaggaccacugguucagccgcgaaaacagucuguccggagucgagggcgaaggucuccaccgucugggguacaucuugcgggacguuagcaagaaagagggaggcgcuauguaugccgaugacaccgcaggcugggauacaagaauuacucuggaggaccucaagaaugaagagauggugaccaaccauauggaaggggagcacaagaaacuugccgaagcuaucuuuaaacugacguaccaaaauaaaguagugaggguccagcgcccuacaccccgaggaacagugauggauauuaucucucggagagaccagagggguucaggccaaguugggacuuauggauuaaacaccuucacaaauauggaggcccagcugauucgccagauggagggcgaagguguguucaagaacauacagcauuugacugucaccgaggaaaucgcggugcaaaauuggcucgcaagaguagggcgggagaggcugagucguauggccauuuccggagaugacugcguugugaaaccacuagaugaccgauuugcuagcgcccuuacggcacugaacgauaugggcaagauccgcaaagacauccagcagugggagcccucuagaggcuggaacgauuggacacaggucccuuucugcucgcaccauuuucacgaacucauuaugaaggacgggcgggugcugguggucccauguaggaaucaagacgaguugauaggacgcgcuagaaucucacagggugccggcuggagcuuacgggaaaccgcuugccuggggaaguccuacgcccagauguggagucucauguauuuccacaggcgagaucuucgucuggcagcgaacgccauuuguucugcuguuccgagccauugggugcccacuuccagaacaaccuggucaauccacgccaaacaugaguggaugacuaccgaagacaugcuaacaguauggaaucgcguguggauucaggagaacccuuggauggaggauaagacgccagucgaaaguugggaggaaauccccuaccugggaaaacgggaggaccaauggugcggcucucucauagguuugaccagcagggcaacuugggcuaagaauauccagguggccauuaaccagguuagaucccugaucgggaaugaagaguauacagauuacaugccuucaaugaaacgcuuucggagggaggaagaggaagcaggagugcuuugguga

SEQ ID NO: 14598 - RNA, 9876 nt, Artificial Sequence
  derived and/or modified CDS sequence (opt3) from DENV-2__FJ639831__SS-prME
agcgcaggaaugauaauuaugcugauaccaaccgugauggcuuuccaccucacaacuagaaacggggagccucauaugaucgucuccauucaggaaaagggaaaaucucuucuguuuaagacggaggacgguguuaauaugugcaccuugauggcaauggauuuaggcgaacugugugaggacacaaucacuuacaaaugcccacuacucaggcaaaacgaaccggaggauauugacuguuggugcaauucaaccaguacaugggugaccuaugggacuuguacaaccacgggagagcaccggcgcgaaaagcgaagcguagcccuggugccacaugucggcaugggucuugagacucguaccgaaacauggauguccucugagggggcguggaaacacgcucagagaaucgagacuuggauacugaggcauccuggauucaccaucauggccgcaauuuuggccuacacaaucggcaccacgcacuuucagcgggcucucauuuucauccugcugacugcaguggccccaucgaugacaaugcgcugcauaggcauuucaaacagagauuuuguugaaggggugagcggagguaguugggucgacaucgugcucgagcacggcuccuguguaaccacuauggcuaagaauaagcccacauuagauuucgaacugauuaaaaccgaggccaagcagccugcgacgcuuaggaaauauugcaucgaagcaaaguugaccaacacaacuaccgagucucgguguccaacacaaggggagcccagccugaaagaagaacaagacaagcgcuuuguuugcaagcauuccaucguggaucgaggauggggcaaugguugugggcuauucggaaaaggcggcauugucacuugcgccauguuuaccugcaagaaaaacauggaagggaagauagugcagccugagaaucucgaauacacaaucguggucaccccacacucaggagaggagcaugcuguugguaacgacacuggcaaacacgggaaggaaauuaaagugacgccgcagaguagcguaacagaggccgaacugaccggauauggcacugugaccauggaguguucucccagaacaggucuugauuucaaugaaaugguccuguugcaaauggagaacaaggcauggcucgugcacaggcagugguuucuggacuuaccucugccauggcuccccggggcugauacccagggcuccaauuggauccagaaggagacucuuguuacauucaaaaacccucaugccaagaaacaagacguggucgugcugggaucacaggaaggcgcgaugcacacggccuugaccggggcaacugagauacagaugagcaguggaaaucuacuguuuacaggucaucucaagugccggcugcguauggacaaacuucaacugaagggcaugucuuacuccauguguaccgggaaguucaaaguaguuaaggaaauugcugagacacagcacggaacuaucgugauccgcguccaguaugagggcgaugguagcccaugcaaaauucccuucgaaaucauggacuuggagaagagauacgugcucgggaggcugauuaccgucaacccgauagugacggaaaaagauucgccuguuaacaucgaggccgaacccccauuuggcgacucuuacauuaucaucggaguggagccuggccaguuaaagcugaauugguucaagaaaggguccucaauuggacaaauguuugagaccacaaugcggggugcuaagcgaauggccauacuaggcgauacugcaugggacuucgggagucucggaggcguauuuaccagcaucgguaaagcccugcaucaggucuucggggcuauuuauggcgcggcauuuuccggagugucuuggacaaugaagauccuuauuggcguuaucauaacuuggaucgggaugaacagccgcucaaccaguuuguccgugagccugguccucgugggaauuguaacgcuguaccuuggcgugaugguucaggccgauucugguugugucgugucauggaaaaauaaggaacugaagugcgggaguggaaucuucauuacagacaacgugcacaccuggacugagcaguauaaauuucaacccgaaagcccauccaaguuggcuucugccauccagaaagcacaggaggaaggcauaugugguauuagaucggucacaaggcucgagaaucugauguggaagcagaucacccccgaguuaaaccacauucuggccgaaaaugagguuaaacuaacuaucaugaccggcgauauaaaggggaucaugcaagcuggaaaacggagccuccgcccucagccaacagaacugaaguacuccuggaagacguggggcaaagccaagaugcuuucaaccgagagucauaaccagacuuucuugauugacgggccggaaacagcagagugccccaauaccaacagagcguggaacucucuggagguggaagauuauggauuuggcguguucacaacuaacaucuggcucaaacugaaggagaaacaggacgcuuuuugugacagcaaguuaauguccgccgcaauuaaggauaauagggccguacacgcugacauggguuacuggaucgaaucagcccugaacgauaccuggaaaauagagaaggccagcuucauugaggucaaaaauugccauuggccuaagucucacacgcuuugguccaacgggguguuggaaagugagaugaucauccccaagaaucucgcuggacccguuagccaacacaauuaucguccuggcuaccauacacagauugccgguccauggcaccugggcaagcuagaaauggacuucgauuuuugugacgggaccacuguggucgugaccgaggauugcggaaaccggggccccucucugcgaacaacuaccgcguccgggaagcucaucacagaauggugcuguagaucaugcacgcugccgccucuuagguaccgcggagaggacggcuguugguaugguauggagauucggccauugaaagaaaaggaggaaaaucugguuaacaguuuagugaccgccgggcauggacagauagauaauuucagccucggcguacuggguauggcucuuuuucuggaggaaauguugagaacuagggucggcacaaaacacgcaauccuccugguggccgugucguucgucacccuaauuacugggaacauguccuuuaaggaccugggacgcguugugguaauggugggcgcuacaaugaccgaugacaucgggaugggagucacguaccucgcccugcuugcagcguucaaagugcgacccacuuuuguugccggcuugcuguuacggaagcucaccucuaaggagcugaugaugacaaccauugguaucgugcuucugagccaaucaacuauaccugagacaauccuagaacucaccgaugcucuggccuuggggaugaugguccugaaaauugugcgugacauggagaaguaucaguuagcaguuacaaucauggcuauucucugcgugcccaaugccgucauccugcagaacgcauggaaaguaaguuguacuauacuugccgugguuuccgugucuccacuguugcucaccagcucccagcaaaagacggacuggauuccucuggcucuaacaaucaaaggacugaaucccaccgcgaucuuccuuacuacccucucaagaacaaacaagaaaaggagcuggccacugaaugaagccauuauggcagucggcauggugaguauauuggcuucuucccuguuaaagaacgauaucccgaugacuggcccucucguagccgggggacugcuuaccgugugcuacguccugacgggucgcagcgccgacuuggagcucgaacgggcuacagauguuaagugggaggaccaggcagagauuucgggcucaucucccauccugaguauuaccaucuccgaagaugggagcaugucuaucaagaaugaggaagaggagcagacucuaacaauccugauuagaaccggacuucucgugaucagcggccuguuuccaguguccauucccaucacugccgcggcuugguauuugugggaagucaagaaacagagggccgguguguuaugggacguuccuucaccacccccuauggggaaggcagagcuggaagauggagccuaccgaauaaaacaaaagggcguacucggcuauagucagauuggggcuggaguguacaaggaggguacauuccauaccauguggcacgucacgcgcggcgcagugcugaugcacaaagggaagcggaucgaaccgagcugggccgacguuaaaaaggaucuuaucucuuacggaggcgguuggaaacuggagggggaguggaaggaaggagaggaagugcaggucuuggcgcuagagccaggcaagaaccccagagcugugcagacuaaaccuggccuguuuaagaccaauacagggaccauuggagccguaucccucgacuucucaccagguacaaguggcagccccaucauagauaaaaaggggaaagucgugggacuguauggcaacgguguugugacuagguccggggcauacgucucugccauugcucaaaccgaaaagucgaucgaggacaacccugauauugaggacgacaucuuucguaagcgccggcuuacgauaauggauuuacauccgggagccggcaaaacaaagagauaucugcccgcaauugugagggaagcuaucaaacgaggccuccggacuuugauccuggccccaacccgcguuguggcggccgagauggaagaggcacucagagggcugccuauuagguaccagacacccgcuauccgggccgaacacaccggacgagagauugucgaccuuaugugucaugcuacuuucaccaugagacuguugagcccagugcgcguaccuaauuauaaccuaauaaucauggaugaggcacacuucacagaccccgccucaauugccgcuagggguuacaucuccacgcguguggaaaugggcgaggcggcagggaucuuuaugacugccaccccaccgggaagucgggauccuuucccccagucuaaugcuccaauuauagacgaagagagagagauccccgaaaggagcuggaacuccggccaugaguggguuacagauuuuaaggguaaaaccgucugguucgugccuucaauuaaggccgggaaugacaucgcagccugccugcgcaagaacggcaagaaggugauucaacucucucgaaaaacuuuugauagcgaauaugucaagacaagaaccaaugacugggauuucguagugacgacugacaucagugagaugggcgcuaacuuuaaagcggaacggguuauagacccaaggcgcuguaugaagcccgugaucuuaacagauggcgaggagcgugucauucuggccgggccuaugccggugacccacuccagcgcagcucagagacggggaaggaucggucgcaaucccaaaaacgaaaaugaccaguacauuuacaugggcgagccccuugaaaacgaugaggacugcgcccacuggaaggaagcaaagaugcugcucgauaauaucaacaccccugaggggauaauucccucuauguucgagccagaacgagagaaaguugacgccaucgauggagaauauagauugcggggcgaggcuaggaagacuuuuguggaccugaugcgcagaggugaucucccugucuggcuggccuacaaaguggcggcagaagggauuaauuaugccgacaggcggugguguuucgauggcaucaagaacaaccagauacuugaggagaauguagaaguggagaucuggacaaaagaaggagagcguaagaagcuaaaaccccgcuggcuggacgcucgaauuuacucagauccauuggccuuaaaggaguuuaaagaguucgcugcaggcagaaagucccugacccucaaccugaucacagagauggggaggcuuccuacuuucaugacgcagaaaacccgggacgcccuggacaaucucgcuguuuugcauacagccgaagcaggaggucgcgcguauaaccacgcccugagugagcuaccggaaacucuggagacccuccuucuguuaacauugcuggcuaccgucacuggcgggauuuuucucuuccugaugagcggaagaggcaucgguaagaugacgcuugggaugugcugcauaauuaccgccucgauccugcucugguacgcacagauccagccccauuggauugcugccucuaucauauuggaguuuuuccugauuguguuacuaaucccagaaccugagaagcagaggacaccccaagauaaucagcugacuuauguggucauugcaauccucaccguuguggccgcuacaauggcgaacgaaaugggcuuucuugagaaaaccaagaaagaccugggauugggcuccauaacuacacagcagccagaaagcaauauccuggauauugaccuccggccugccucagcauggacgcuguacgcuguagccaccacuuucgugacacccaugcuucgacacaguaucgagaacucuuccgucaaugugagccucaccgccauugcaaaccaagcuaccguucugaugggguugggaaaggguuggccgcugucaaaaauggauaucggcgugccauuacuagccauuggguguuacagucaggucaauccuaucacacugacugcggcucuccuucuguugguagcccacuaugcaauaauuggacccggccugcaggccaaggcuacgagagaggcacagaagcgcgccgcggcugguaucaugaaaaacccaaccguggacgggaucacaguuauugaucucgaccccauaccuuacgauccgaaguuugaaaaacaacugggccaggugaugcuuuuaguccugugcgugacucagguccucaugaugaggaccacaugggccaugugugaggcauugacccuggccacuggacccaucagcacgcuaugggaaggcaauccagggcgguucuggaacacaaccauugcuguguccauggccaauaucuuucguggaucuuaucuggcaggcgcuggucuccuuuucagcauuaugaagaacacuaccaauacaagaagggggacuggaaacaucggcgagacccugggugaaaaauggaagucccgcuugaacgcccugggcaaaucagaguuucaaauauacaagaagucugggauccaggagguugaccggacacucgcgaaagaaggaauuaagcgaggcgagacggaucaucacgccgugaguagagggucggcaaaacugaggugguucguagaacgcaauauggugaccccugagggaaaggucguugacuuaggcugcgguagagggggauggagcuauuacuguggcggucuuaaaaacgugcgggaggucaagggccugacuaaagggggacccggccaugaggaaccuaucccaauguccacauauggguggaaucucgugcgucuacagucuggaguagauguguuuuucauucccccugaaaaaugcgacacccuguugugugacaucggcgagucaagcccaaaccccacuguugaagcugguaggacacugcgggugcucaaucuugucgagaacuggcugaauaacaauacccaguucugcauaaagguguugaacccguacaugccuuccgucauugagaaaauggaaacgcugcaacgcaaguacgggggagcccucgugcgaaauccauuaaguagaaacucuacccacgagauguauuggguuagcaaugcaucaggcaacaucguauccagugugaauaugaucagcaggaugcugauuaaccgguuuacaaugcgccauaaaaagacuaccuacgaacccgaugucgaccuuggcucugggacaagaaacauaggaaucgaguccgaaauuccuaaucuggauaucauugguaagaggaucgagaaaauaaagcaggagcacgaaacuucauggcacuaugaccaggaucauccauacaaaaccugggcuuaucacggcagcuacgagacaaagcagaccgggucggccucuaguauggugaacggaguugugcgacuacucacuaaacccugggacguccugccgacggugacacaaauggccaugaccgauacuaccccuuucggccagcagcggguauuuaaggaaaagguggacacacguacgcaggagcccaaagaagguaccaagaaauugaugaagaucacugcggaguggcuguggaaagagcucgggaagaaaaagacaccaagaauguguacccgcgaagaguucacuaggaagguucgguccaaugcugcacuuggagccauuuuuacagaugaaaacaaauggaaaagcgcuagagaggccgucgaggacucacgcuucugggaacugguggauaaagagaggaaguuacaucuggaaggcaaaugcgagaccuguguguauaauaugaugggcaagcgagaaaagaaauugggggaguuuggaaaggcaaaagguucccgggccaucugguacauguggcucggcgcuagauuccuggaguuugaagcgcuaggguuccuuaacgaggaccacugguuuucuagggaaaauagccugaguggagucgagggcgaaggucuccacaagcugggguacauuuugcgcgacguuuccaaaaaggagggaggcgccauguaugcagaugacacagcuggcugggauacucguaucacccuggaggaccucaagaacgaagagauggugacgaaucauauggaaggggagcacaagaaacuugccgaagcaauuuucaaacugaccuaccaaaacaaaguagugcggguccagagaccuacacccaggggaacugugauggauauaaucagccgccgagaccagcgggguucuggccaaguugggaccuauggauuaaauacauuuacuaacauggaggcccagcugauuagacagauggagggcgaagguguguucaaaaauauccagcauuugaccgucacggaggaaaucgcugugcaaaacuggcucgccaggguagggcgcgagagacugucacggauggcgauuaguggagaugacugcguugugaagccacuagaugacagguucgcauccgcccuuacagcucugaaugauaugggcaagauacguaaagacauccagcagugggagcccagccgaggcuggaacgauuggacccaggucccuuuuugcucucaccauuuccacgaacucauuaugaaggacgggcgcgugcugguggucccauguagaaaccaagacgaguugaucggacgggccaggauuucgcagggugcaggcuggucauuacgcgaaacugcuugccuggggaaaagcuacgcccagauguggucccucaucuauuuucacagacgggaucuuaggcuggcugccaaugcaauauguagugcgguuccgucucauugggugcccacaagccgaaccacuugguccauccacgccaagcaugaguggaugaccacagaagacaugcuaacgguauggaaccguguguggauucaggagaauccuuggauggaggauaaaaccccagucgaaucaugggaggaaauccccuaccugggaaagagagaggaccaauggugcggcagucucauugguuugacuucucgcgcuacaugggccaagaacauccagaccgcaauaaaucaggugcggagccugauugggaacgaagaguauacugauuacaugccuuccaugaaaagguucagacgcgaggaagaggaagcuggaguucuuugguga

SEQ ID NO: 14599 - RNA, 9876 nt, Artificial Sequence
  derived and/or modified CDS sequence (opt3) from DENV-2__FJ639832__SS-prME
agcgcaggcaugauaauuaugcugauacccaccgugauggcuuuccaccucacuacuagaaacggggagccucauaugaucgucgguauucaagaaaagggaaaaucccuucuguuuaagacggaggacggcguuaauaugugcaccuugauggcaauggauuuaggggaacugugugaggacacgaucacuuacaaaugcccacuacucaggcaaaacgaaccggaggauauugacuguuggugcaauucuaccucaacaugggugaccuauggaacuuguacaaccacgggcgagcaccggcgcgaaaagcgaaguguagcacuggugccccaugucgguauggggcuugagacucguaccgaaacauggaugagcuccgagggagcguggaaacacgcucagagaaucgagacuuggauacugaggcauccuggcuucaccaucauggccgcaauuuuggccuacacaaucggcaccacgcacuuucagcgggugcucauuuucauccugcugacugcuguugcaccaucuaugacaaugcgcugcauagggauuucgaacagagauuuuguggaaggagucucagguggcagcuggguggacaucguacucgagcacgggaguuguguuaccacuauggccaagaauaagcccacauuagauuucgaacugauuaaaaccgaggcuaagcagccugccacgcuuaggaaauauugcaucgaagcgaaguugaccaacacaacuaccgagucccgguguccaacacaaggagagcccucucugaaagaagaacaggacaagcgcuuugugugcaagcauagcauggucgaucgaggcugggguaauggguguggacuauucggcaaaggcgggaucgugacuugcgcaauguuuaccugcaagaaaaacauggaaggaaagauugugcagccugagaaucucgaauacacaauagucguuaccccacacuccggugaggagcaugccgugggcaacgacacugggaaacacggaaaggaaaucaaaguaacgccgcagucaaguauuacagaggcugaacugaccggcuaugguacugugaccauggaguguagccccagaacagggcuugauuucaaugaaaugguccuguugcaaauggagaacaaggccuggcucgugcacaggcagugguuucuggacuuaccucugccauggcuccccggcgcagauaagcaggagucuaauuggauccagaaagaaacccuuguuacuuucaagaacccucaugcuaaaaagcaagacguggucgugcugggaucccaggagggcgccaugcacacagcguugacgggggccaccgaaauacagaugucaagcggaaaucuacuguuuacuggucaucucaaaugccggcugcguauggacaaacuucaacugaagggcaugaguuacucuauguguacagggaaauucaagguaguuaaagagauugcagagacccagcacggaacaaucgugauccgcguccaguaugaaggcgaugguuccccaugcaagauucccuucgagaucauggacuuggagaagagauacgugcucgggaggcugauuacugucaacccgauagugaccgagaaggauagcccuguuaacaucgaagcugagcccccauuuggcgacucguacauuaucaucggaguggagccuggccaguuaaagcugaauugguucaaaaaggggucuuccauuggacaaauguuugaaacgaccaugcggggugccaaacgaauggcuauacuaggcgauacagccugggacuucgggucacucggaggcguauuuacaaguaucgguaaggcacugcaucaggucuucggggccauuuauggcgcugcguuuagcggaguguccuggaccaugaaaauccuuauuggcguuaucauaacauggaucgggaugaacucucgcagcacuucauugagugugucccugguccucgugggaauuguaacccuguaccuuggcgugaugguucaggcagauagcgguugugucgugucuuggaagaauaaggagcugaaaugcgggucaggaaucuucauuacggacaacgugcacacauggaccgaacaguauaaguuucaacccgagaguccaagcaaauuggccuccgcuauccagaaggcccaggaagagggcauaugugguauuagaucugucacuaggcucgagaaucugauguggaaacagaucacacccgaauuaaaccacauucuggcagagaaugaaguuaagcuaaccaucaugacuggcgauauaaaagggaucaugcaagccggaaagcggucgcuccgcccucagccaaccgagcugaaguacagcuggaaaacauggggcaaggcuaaaaugcuuuccacggaaucauauaaccagaccuucuugauugacgggccggagacugccgagugccccaauacaaacagagcauggaauagucuggaaguggaggauuacggauuuggcguguucaccacaaacaucuggcucaagcugaaagaaaagcaggacgcguuuugugacucuaaguuaaugagcgcugccauuaaagauaauagggcaguacaugccgacauggguuauuggaucgaguccgcucugaacgauacuuggaagauagagaaagccucauucauugaagucaagaauugccacuggccuaaaagccauacccuuuggucuaacgggguguuggaguccgaaaugaucaucccaaagaaccucgcaggacccguuagucaacacaauuaccguccuggcuaccacacgcagauugcugguccauggcaucugggcaagcuagagauggacuucgauuuuugugacgggacaaccgugaucgucacugaagauugcggaaaccggggccccagccugcgaaccacaacugccucugggaaacucauuaccgaguggugcuguagauccugcacacugccgccucuuagguaucgcggagaggacggcuguugguacgguauggaaauacggccauugaaggagaaagaagagaaucuggugaacucauuaguuacggcggggcacggacagguggauaauuucagucucggcguacuggguauggcccuuuuucuggaagagauguugagaaccagggucggcacuaagcaugcuauccuccugguggcagugagcuucgucacacuaauuaccgggaacaugucguuuaaagaccugggacgcguugugguaauggugggcgccacuauggcugaugacaucgggaugggagucacauaucucgcccugcuugcagcguucaaggugcgacccaccuuugccgcuggcuugcuguuacggaagcucacguccaaagagcugaugaugacuaccauugguaucguucuucugucucaaagcacaauaccugaaaccgugcuagagcucacugaugcccuggcauuggggaugaugguccugaagaucgugcguaauauggaaaaauaccaguuagcuguuacaauuauggccauccucugcgugcccaacgcagucauucugcagaaugccuggaagguaucauguaccauccuugcugugguuaguguguccccacuguugcucacaucuagccagcagaaaacugacuggauaccucuggcgcuaaccauuaagggacugaaccccacggccaucuuccuuacaacccucuccagaacuaauaaaaagaggucauggccacugaacgaggcaaucauggcugucggcauggugagcauuuuggccaguucucuguuaaagaaugacauaccgaugaccggcccucucguagccgggggacugcuuacagugugcuauguccugacuggucgcuccgcugauuuggaacucgagcgggcaaccgacguuaaaugggaggaucaggccgaaaucagcggcucgucacccauucugucuaucacgauuagugaggacggguccaugagcaucaagaacgaagaggaggaacagacacuaaccauacugaucagaacuggacuucucgugauuucuggccuguuuccaaucagcauucccaucacagcggcugccugguacuugugggaggugaaaaagcagagggccggugucuuaugggaugugccuuccccacccccuauggggaaagccgaacuggaggacggagcuuaucgaauaaagcaaaagggcauucucggcuacucacagaucggggcaggaguuuacaaagaagguaccuuccacacuauguggcauguaacacgcggcgccgugcugaugcacaaggggaaacggaucgagccgaguugggcggaugucaagaaagaccuuauuagcuauggaggcgguuggaagcuggagggggaauggaaggagggagaagaggugcagguuuuggcucuagaaccaggcaaaaaucccagagccgugcagaccaagccuggccuguuuaaaacgaacacugggaccaucggagcagucucucucgauuucuccccagguacaucaggcagucccauaauugacaagaaagggaaggugguaggacuguacggcaacggugucgugaccaggagcggggccuauguuuccgcuaucgcccaaacagagaagucuauugaggauaauccugaaaucgaggacgauauauuucguaaacgccggcuuacuauuauggacuuacacccgggagcaggcaagaccaaaagauaccugcccgcuaucgugagggaagccaucaagcgaggccuccggacguugauucuggcgccaacacgcgucguggccgcagagauggaagaggcucucagagggcugccuaucagguaucagacucccgccauucgggcugagcauaccggacgagaaauaguugaccuuaugugucacgcaacauucaccaugagacuguugucgccagugcgcgucccuaacuacaaucuaaucauuauggaugaggcccauuucacugaccccgccagcaucgcugcgagggguuauaucucaacccguguggaaaugggcgaggcagccgggauuuuuaugacagcuacgccaccgggaucccgggauccuuucccccagaguaacgccccaauaaucgacgaggaaagagagauucccgaaaggucuuggaauagcggccacgaguggguaacugauuuuaaagguaagaccgugugguucguuccuuccaucaaggcagggaacgacauugccgcuugccugcgcaaaaauggaaagaaagucauccaacucucacgaaagacauuugauucugaauacgugaaaaccagaacuaacgacugggauuucguggucacaaccgacauaagcgagaugggcgcgaauuuuaaggccgagcggguaaucgauccaaggcgcuguaugaaacccgugauuuuaacggacggcgaagaacguguuauccuggcagggccuaugccggugacucauaguuccgcugcccagagacggggaaggauuggucgcaacccaaagaaugaaaacgaccaguacaucuauaugggcgagccccuugaaaaugaugaggacugcgcacacuggaaggaggccaaaaugcugcucgauaacauaaauacaccugaagggauuauccccagcauguucgagccagaacgagagaaggucgacgcuauugauggagaauacagauugcggggcgaggccaggaaaaccuuuguggaccugaugcgcagaggugaucucccuguuuggcuggcguauaagguggcagccgaggggaucaacuacgcugacaggcggugguguuucgauggcaucaaaaacaaucagauccuugaagagaacgucgaaguggagauuuggaccaaggagggagaacguaagaaacuaaagccccgcuggcuggacgcccgaaucuauucugauccauuggcuuuaaaagaguuuaaggaguucgcagccggcagaaaaucacugacucucaaucugauuacagagauggggaggcuuccuaccuucaugacacaaaagacucgggacgcucuggauaaccucgccguauugcacacggcagaagcgggaggucgcgccuacaaucaugcucuguccgagcuaccggagacccuggaaacacuccuucuguuaacuuugcuggccaccgugacaggcgggaucuuucucuuccugaugaguggaagaggcauagguaagaugacccuugggaugugcugcauuaucacugcaagcauccugcucugguaugcucagauucagccccacuggaucgccgcaucgauaauuuuggaguuuuuccugaucguuuuacuaauuccagaaccugagaaacagaggacgccccaagacaaccagcugaccuacgucgugaucgccauacucacaguggucgcugcgacuauggccaaugaaaugggcuuucuugagaagaccaaaaaggaccugggauugggcucuaucgcaacacagcagccagaguccaacauucuggauaucgaccuccggccugcuagcgccuggacccuguacgccguugcaacuacauucgugacgcccaugcuucgacauucaauugaaaauaguucuguaaacgugucccucaccgcuaucgccaaucaagcgacuguccugaugggguugggaaaagguuggccgcugagcaagauggauauuggcgugccauuacuagcuaucggguguuauucacagguuaacccuauaacacugaccgccgcacuccuucuguugguggcccacuacgcuauuaucggacccggccugcaggcaaaggccaccagagaggcgcagaaacgcgcugccgcagguaucaugaagaauccaacagucgacgggauuacuguaauagaucucgaccccaucccuuaugauccgaaauuugaaaagcaacugggccaggugaugcuuuuaauucugugcguuacacaggugcucaugaugaggaccacaugggccuugugugaggcucugacucuagccaccggacccaucaguacacugugggaaggcaacccagggcgguucuggaauaccacuauugcagucagcauggcuaacaucuuucguggauccuaccucgccggcgcgggucuucuguucucuauaaugaaaaauacgacaaacaccagaagggggacuggaaacaucggcgagaccuugggugagaaguggaaaagccgccugaaugcccucggcaaguccgaauuucaaauuuauaagaaaucagggauccaggagguggaccggacacuggcaaaggaaggaauuaaacgaggcgagacugaucaccaugcugucucuagagggagugccaaguuaaggugguucguggagcgcaacaugguuaccccugaaggaaaagugguagaccuuggcugcgguagagggggauggucguacuauuguggcggucugaagaaugugagagaggucaagggccucacaaaagggggacccggccacgaggaaccuaucccaaugagcacguacggguggaaccuaguucgucugcaguccggaguggaugucuuuuucauacccccugaaaagugcgacaccuugcugugugauauuggcgagucuucaccaaaucccacuguggaggcagguaggacacuccggguacuuaaccugguggaaaauugguugaacaauaacacccaguucugcaucaaaguucugaauccguacaugccuagcgugaucgagaagauggaagcucuccaacgcaaauaugggggagccuuaguccgaaacccacuguccagaaauaguacucaugagauguacugggugucuaacgccagcggcaauauugucucauccgugaacaugauaaguaggaugcuuaucaaccgguuuacaaugcgccacaagaaggcgaccuaugaacccgacguugaccugggcagcgggacgagaaauauuggaaucgagucugagguaccuaaccuagauauuaucgguaaaaggauagaaaagaucaaacaggagcaugaaaccuccuggcacuacgaccaggaucacccauauaagacaugggcuuaccauggcucauaugagacuaaacagaccgggagcgcaucgucuauggugaauggagucgugcgacuccugacaaagcccugggacguuuugccgacugugacccaaauggccaugacagauaccacuccuuucggccagcagcgggucuuuaaggaaaaaguggacacgcguacacaggagcccaaggaggguaccaaaaagcugaugaaaauuacugcugaauggcucuggaaggagcuugggaaaaagaagaccccaagaauguguacacgcgaagaguucacgaggaaaguacggaguaacgccgcacugggagccaucuuuaccgaugagaauaaguggaaauccgcuagagaagcgguggaggacagccgcuucugggaauuaguugauaaggagaggaaccugcacuuggaaggcaaaugcgagacuugugucuacaauaugaugggcaagcgagagaagaaacucggggaauuuggaaaggccaaagguucacgggcaauuugguacauguggcugggcgcuagauuccuagaguuugaagcccuuggguuccugaacgaggaccauugguuuuccagggaaaauucucucagcggaguggagggcgagggucugcacaaguugggguauauccugcgcgaugugaguaaaaaggaaggaggcgcaauguacgccgacgacacagcuggcugggauacccguauuacucucgaggaccuuaagaacgaagagauggucacaaaucacauggaaggggagcauaaaaagcuggccgaggcgauauucaaauuaaccuaucaaaacaagguugugcggguacagagaccuacacccaggggaacugugauggauaucauuucccgccgagaccagcgggguagcggccaagucgggaccuacggacugaauacguuuaccaacauggaagcacaguugaucagacagauggagggcgaagguguguucaaaaauauccagcaccucacaguuacugaggagguggccguccaaaacuggcuggcuaggguggggcgcgaaagacuaucucggauggccauuucaggagaugacugcguaguuaagccacuugaugacagguucgcaaacgcucugaccgcccucaaugauaugggcaagauacguaaagacauccagcagugggagcccaguaagggcuggaacgauuggacacaggugccuuuuugcucccaucacuuccaugaacugauuaugaaagacgggcgagucuugguggugccaugucgcaaucaagaugaguuaaucggacgggcucggauuagccagggugccggcuggucucugagggaaacugcaugccucgggaagucguaugcgcagauguggucacuuauguacuuucaccgcagagaccugcggcuagccgcuaacgccaucuguagcgcagucccgucccacuggguucccaccaguaggacgacauggucuauacaugcuaaacacgaguggaugaccacugaggacaugcugacaguguggaaucgaguauggauccgugaaaacccuuggauggaggauaagaccccaguggaaagcugggaggaaauucccuaucucggaaagagagaggaccaguggugcggcuccuugaucggucugacuucacgcgccaccugggccaaaaauauucaagccgcgaucaaccagguccggagucuuauagggaaugaggaauacacagauuacaugccuucuaugaagagguucagacgcgaggaagaggaagcuggagugcugugguga

SEQ ID NO: 14600 - RNA, 9876 nt, Artificial Sequence
  derived and/or modified CDS sequence (opt3) from DENV-2__FJ687434__SS-prME
agcgugggaaugaucauuaugcugauacccaccgucauggcauuccaccucacaacucggaacggggagccucauaugaucguuuccauucaggaaaaaggaaaaucucuucuguuuaagacggaggacggugugaauaugugcaccuugauggcuauggauuuaggagaacugugugaggacacaaucacuuacaaaugcccacuacucagacaaaacgaaccggaggauauugacuguuggugcaauucaaccaguacauggguaaccuaugggacuuguacaaccacgggagagcaccggcgcgaaaagcgaagcguggcacuggucccccaugugggcaugggucuugagacucguaccgaaacauggauguccucugagggggccuggaaacacgcgcagagaaucgagacuuggauacugaggcauccuggauucaccaucauggcugccauuuuggcauacacaaucggcaccacgcacuuucagcggacucucauuuucauccugcugacagccguugcuccaucgaugaccaugcgcugcauaggcauuucaaacagagauuuuguggaaggggucagcggagguaguuggguggacaucguacucgagcacggcuccuguguuacuacaauggcaaagaauaagcccaccuuagauuucgaacugauuaaaacggaggccaagcagccugcuacccuuaggaaauauugcaucgaagcccgguugacaaacacuaccacagagucucgcuguccaacucaaggggagcccagccugaaggaggaacaagacaaacgauuugugugcaagcauuccauggucgauagaggauggggcaaugguugugggcuauucggaaagggcggcaucgugaccugcgcgauguuuacaugcaaaaagaacauggaagggaaaauugugcagccugagaaucucgaauacaccauagucguuacuccacacucaggagaggagcaugcaguggguaacgacacgggcaagcacgggaaagaaaucaagguaacaccgcagaguagcauuaccgaggccgaacugacuggauauggcaccgugacaauggaguguucucccaggaccucccuugauuucaaugaaaugguccuguugcaaauggagaacaaggcuuggcucgugcaccggcagugguuucuggacuuaccucugccauggcuccccggugccgauacucaggggucaaauuggauccagaaggagacacuuguuacguucaagaacccucaugccaagaaacaagacguggucgugcugggcagccaggaaggagcuaugcacaccgccuugacuggcgcgacagagauacagaugaguucugggaaucuacuguuuaccggacaucucaaaugccgucugcgcauggacaaacuucaacugaaagguauguccuacagcauguguacaggcaaguucaagguaguuaaagaaauugccgagacucagcacgggaccaucgugaucagaguccaguaugagggagauggcucgccaugcaagauucccuucgaaaucauggacuuggagaaaagguacgugcucggucggcugauuacggucaacccgauagugaccgaaaaggauucuccuguuaacaucgaggcagaacccccauuuggggacuccuacauuaucaucggcguggagccuggacaguuaaaacugaauugguucaagaagggcucaaguauugggcaaauguuugagacaacuaugcgaggagcuaaacgcauggccauacuaggugauaccgcuugggacuucggcagccucgggggaguauuuacauccaucggcaaggcccugcaucaggucuucggugcaauuuauggggccgcuuuuucuggcgugagcuggacuaugaaaauccuuauuggaguuaucauaaccuggaucggcaugaacucaagaaguacguccuugagcgugucucugguccucguggggguagugacacuguaccuuggaguuaugguccaggcggauucaggcuguguggugaguuggaagaauaaagaacugaagugcgguagcgggauuuucaucaccgacaacguccacacuuggacagagcaguauaaguuucaacccgaauccccaucuaaauuggcaucggccauucagaaggcucaggaggaaggaaucuguggcauaaggagcguuacccggcucgagaaucugauguggaaacagauuacucccgaguuaaaccacauccuggccgaaaaugaggugaagcuaaccauuaugacaggugauaucaaaggcauaaugcaagcagggaagcgcucccucagaccucagccaacggaacugaaauacucauggaagaccuggggaaaggccaaaaugcuuaguacugagucucauaaccagacauucuugaucgacggcccggaaaccgcugagugccccaauacaaacagggccuggaauagccuggagguggaagauuauggguuuggaguauucacuaccaacauuuggcucaagcugaaagagaagcaggacgcauuuugugacuccaaauuaaugucagcggcuaucaaggauaaucgugccguccacgcagacaugggcuacuggauugaaagcgcccugaacgauacguggaagaucgagaaggcuucuuucauagaggugaagaauugccauuggccuaaaucccacacacuuuggaguaacgguguuuuggaaagcgagaugauuaucccaaagaaccucgccgggcccgugucucaacacaauuaucggccuggauaccauacccagaucgcaggcccauggcaccuggguaaacuagaaauggacuucgauuuuugugacggcacuaccgucgugguuacagaggauugcgggaaccgaggacccucccugagaacuaccacagcuucaggcaagcucauuacggaauggugcuguaggaguugcacccugccgccucuucgcuacagaggggaagacggauguugguauggcauggagaucagaccauugaaggaaaaagaggaaaaucuggugaacagcuuaguaacugccggucaugggcaggucgauaauuucucgcucggagugcugggcauggcgcuuuuucuggaggaaauguugaggacacgcguggguaccaagcacgccauucuccuggucgcuguuuccuucgugacucuaauaacaggcaacaugucuuuuaaagaccuggggcgaguaguggucauggugggagcaaccaugacggaugacaucggcauggggguuacuuaccucgcccugcuugcugccuucaaggugcggcccaccuuugcagcgggauugcuguuacguaaacucacaagcaaggagcugaugaugaccacuauuggcaucguccuucugucacaaaguacaauuccugagaccauccuagaacucacagaugcccuggcuuuggguaugauggugcugaagaugguuagagacauggagaaauaucaguuagccgugacuauaauggcaauccucugcguccccaaugcuguaauucugcagaacgccuggaagguguccuguaccauccuugcaguugugucugucagcccacuguugcucacguccucacagcagaaaacagacuggauuccucuggcccuaaccaucaaggggcugaaucccacugcuauauuccuuaccacacucagcaggacuaacaaaaagcgcaguuggccacugaaugaagcgauuauggccgugggaaugguaucuaucuuggcauccagccugcucaaaaacgauaucccgaugaccggcccucucguggcuggcgggcugcuuacggucugcuacguucugacaggacggucggccgacuuggagcucgaaagagccaccgaugugaagugggaggaccaggcugagauuucagguucuagucccauacuguccaucacuauuagcgaagauggcucuaugagcaucaagaaugaggaagaggagcagacacuaaccauucugaucaggacugggcuucucgugauauccggacuguuuccagucucaauccccauuacagcagccgcgugguauuugugggaagugaaaaagcagcgagcuggcguuuuaugggacguaccuaguccacccccuauggguaaagccgagcuggaagauggggcauaccgcaucaagcaacggggaauuuuaggcuauagccagaucggcgccgggguguacaaagagggaaccuuccauacgauguggcacgucacuagaggugcugugcugaugcacaagggcaagaggauagaaccgucuugggcagacguuaaaaaggaucuuauuuccuacgggggaggcuggaaacuggagggugaguggaaggaaggggaggaagugcaggucuuggcccuagagccaggcaaaaacccccgugcggugcagaccaagccuggccuguuuaagacaaauaccggcacaaucggggcuguaucacucgacuucaguccaggaacuagcgguucccccaucauugauaaaaagggcaaagucguggggcuguauggaaacggcguugugacccgcucuggugccuacgucucggcaaucgcccaaacggaaaagagcauagaggacaacccugauauugaggacgacaucuuucggaaaagaaggcuuacaauuauggauuuacauccgggggcuggaaagacuaagcgauaucugcccgccaucgugcgggaagcaauaaaacgcggccucagaaccuugauucuggcuccaacaaggguuguggccgcggagauggaagaggcccuccggggccugccuauccgauaccagacccccgcaaucagagcugaacacacugggcgcgagauugucgaccuuaugugucaugccaccuucacaaugaggcuguugucaccagugcguguaccuaauuauaaccuaaucauuauggaugaggcucacuucacggaccccgcauccauagccgcccggggauacaucaguacuagaguggaaaugggugaggcugcgggcauuuuuaugaccgcaacaccaccggggucuagggauccuuucccccagagcaaugccccaaucaucgacgaggaacgcgagauucccgaacgauccuggaacucaggacaugaguggguuaccgauuuuaagggcaaaacugucugguucgugccuucuauaaaggcugguaaugacaucgccgcaugccugaggaaaaacgggaagaaggugauucaacucagccggaaaacauuugauagugaauaugucaagaccaggacgaaugacugggauuucguagugacuacagacaucuccgagaugggagccaacuuuaaagcugaacgcguuauugacccacguagauguaugaagcccgugaucuuaaccgauggcgaggagcgggucauacuggcgggcccuaugccggugacccacagcucugccgcacagaggcgcgggcgaaucggaagaaaucccaaaaacgaaaaugaccaguacauuuacaugggugagccccuugaaaacgaugaggacugcgcucacuggaaggaagccaaaaugcugcucgauaauaucaacacuccugagggcauuauccccucaauguucgagccagaacgggagaagguugacgcaauagauggggaauauagguugcgcggagaggccagaaagacauuuguggaccugaugaggcggggcgaucucccugucuggcuggcuuacaaaguggccgcggaagguauuaauuaugcagaccgucgcugguguuucgaugggaucaagaacaaccagauucuugaggagaauguagaaguggagaucuggaccaaagaaggcgagcgaaagaaacuaaagcccagauggcuggacgccaggauauacuccgauccauuggcuuuaaaggaguuuaaagaguucgccgcuggacggaagagucugacacucaaccugaucacugagaugggccgccuuccuacguucaugacccagaaaacaagagacgcacuggacaaucucgccguuuugcauacugcugaagccgggggaagggcauauaaccacgcgcugagcgagcuaccggaaacccuggagacacuccuucuguuaaccuugcuggccacugucacggguggcauuuuucucuuccugaugucggggcggggaaucggcaagaugacccuugguaugugcugcauugugacagcuucuauccugcucugguacgcccagauacagccccauuggauugcagcuuccaucaucuuggaguuuuuccugauuguguuacuaaucccagaaccugagaaacagcgaacuccccaagauaaucagcugaccuaugucguuauagccauucucacagugguagcagccaccauggcuaacgaaaugggguuucuugagaagacuaagaaagaccugggcuugggaagcaucgcgacacagcagccagaaucaaauauucuggauaucgaccucagaccugccagugcauggacgcuguacgcuguggccaccacuuucgucacacccaugcuucgccacucuauagagaacuccagcgugaauguuucacucaccgccaucgcaaaccaagcuaccgugcugaugggcuuggggaagggauggccgcugaguaaaauggauauuggugccccauuacuagcgaucggcuguuacagccaggucaauccuauuacacugacugcugcccuccuucuguugguagcacacuaugccaucauugggcccggacugcaggcuaaggcaacgagggaggcccagaaacgggcggcugccggcaucaugaagaacccaaccguggacgguauaacaguuauugaucucgaccccaucccuuacgauccgaaguuugaaaaacaacuggggcaggcaaugcuuuuagugcugugcgucacucaggugcucaugaugcguaccacaugggccuugugugaggcucugacccuagccacuggccccaucuccacgcugugggaaggaaauccaggcagauucuggaacacaaccauugcagucucuauggcuaauauauuuagggggagcuaucucgccggagcgggccuucuguucuccaucaugaagaacacuaccaauucacgccgggguacagggaacauuggagagacuuugggcgaaaaauggaagucucgacugaacgcccucgguaaaagugaguuucaaaucuacaagaaaucgggcauucaggagguggacagaacccuggcaaaggaagggaucaagaggggagagacagaucaucacgcuguuagccgcggcuccgccaaauuacggugguucguggaaagaaauaugguaacgccugaggggaagguggucgaccuuggaugcggccgugguggguggucuuauuacuguggaggccugaaaaacguuagggaggugaagggucucaccaaaggcgggcccggacaugaggagccuauaccaaugucaacuuauggcuggaaucuaguccggcugcagagcgggguggauguauuuuucaucccaccugaaaagugcgacacauugcugugugacauuggagaguccaguccaaaccccaccguggaagcaggccgcacucuccgaguucuuaaucugguggagaacugguugaauaacaauacacaguucugcaucaagguccugaacccguacaugccuucugugauugagaaaauggaaacccuccaaagaaaguacgguggggcuuuagucaggaauccacugagccggaacucaacgcacgagauguauuggguguccaaugccaguggaaacaucguuagcucuguaaauaugauaucccgcaugcuuauuaacagauuuaccaugaggcauaaaaaggccacauacgaacccgauguggaccugggcucaggcacucgaaacaucgggaucgagagcgaaauuccuaaucuagauauaaucggaaaacggauugagaagaucaagcaggagcacgaaaccucguggcacuaugaccaggaucauccauacaaaacaugggcguaucacgguucuuacgagacuaagcagaccggcagugcuuccagcauggucaacggggugguucgucuccugacaaaacccugggacguguugccgaccgucacucaaauggcaaugacggauacaaccccuuucggacagcagagaguguuuaaggaaaaaguagacacucgcacccaggagcccaaggaaggcacaaagaaacugaugaagauuacggccgaguggcucuggaaagagcuugguaagaaaaagaccccaaggauguguacucgggaagaguucacaagaaaagugcgcucaaaugcugcccugggggcaaucuuuaccgaugaaaacaaguggaaguccgccagggaggcuguugaggacucucgauucugggaauuagucgauaaagagcggaaucugcauuuggaaggaaagugcgagacuuguguguauaacaugaugggcaaaagagaaaagaaacucggcgaguuugggaaggcgaagggaagcagggccauaugguacauguggcugggugcacgcuuccuagaguuugaagcucuuggcuuccugaaugaggaccacugguuuagucgugaaaacucccucagcgggguggagggagaaggccugcacaaauuggguuacauccugcgggacgucucuaagaaagaagggggagccauguaugcagaugacacagccggcugggauaccagaauuacacucgaggaccuuaagaaugaagagaugguuacuaaccauauggaaggcgagcacaaaaagcuggcugaagccaucuucaaguuaaccuaccaaaauaaagugguaagggugcagcgcccuacgccccgagggaccgucauggauauuaucucacggagagaccagaggggaaguggucaagugggcacauaugggcugaacacuuuuaccaauauggaggcgcaguugauucgccagauggagggagaaggcguuuucaagaacauacagcaucucacagugacugaggaaaucgcaguccaaaauuggcuggccagagugggucgggagaggcuaucccguauggcuauuagcggggaugacugcguaguuaaaccacuugaugaccgauucgccucugcacugaccgcucucaacgauaugggaaagauccgcaaagacauccagcagugggagcccucgagaggcuggaacgauuggacgcaagugccuuuuugcucacaccauuuccacgaacugauuaugaaggacggccgggucuugguggugccauguaggaaucaagacgaguuaauagggcgcgccagaaucagccagggagcugguuggucccugcgggaaacagccugccucggcaagaguuacgcacagauguggucucuuauguauuuucacaggcgagaucugcgucuagcggccaacgcuauuuguagcgccgucccgucccauuggguucccaccucaagaacuacauggaguauccacgcaaaacaugaguggaugaccacugaagacaugcugaccguguggaaucgcguauggauucaggagaacccuuggauggaggauaagacaccaguggaaucuugggaggaaauccccuaccucgggaaacgggaggaccaauggugcggcagcuugauaggccugacguccagggcuaccugggccaagaauauccaggcagccauuaaccaggucagaucacuuaucgguaaugaagaguauacugauuacaugccuagcaugaaacgcuuccggagggaggaagaggaagcgggggugcugugguga

SEQ ID NO: 14601 - RNA, 9876 nt, Artificial Sequence
  derived and/or modified CDS sequence (opt3) from DENV-2__FJ687439__SS-prME
agcgccggcaugauaauuaugcugauacccaccgugauggcuuuccaccucacuacuagaaacggggagccucauaugaucgucgguauucaagaaaaaggaaaaucccuucuguuuaagacggaggacggcguuaauaugugcaccuugauggcaauggauuuaggggaacugugugaggacacaaucacuuacaaaugcccacuacucaggcaaaacgaaccggaggauauugacuguuggugcaauucuaccucaacaugggugaccuauggaacuuguacaaccacgggcgagcaccggcgcgaaaagcgaaguguagcccuggugccccaugucgguauggggcuugagacucguaccgaaacauggaugagcuccgagggagcguggaaacacgcucagagaaucgagacuuggauacugaggcauccuggcuucaccaucauggccgcaauuuuggccuacacaaucggcaccacgcacuuucagcgggcucucauuuucauccugcugacugcaguggccccaucuaugacaaugcgcugcauagggauuucgaacagagauuuuguugaaggagugucagguggcagcugggucgacaucgugcucgagcacgggaguuguguaaccacuauggcuaagaauaagcccacauuagauuucgaacugauuaaaaccgaggccaagcagccugcgacgcuuaggaaauauugcaucgaagcaaaguugaccaacacaacuaccgagucccgguguccaacacaaggagagcccucucugaaagaagaacaggacaagcgcuuuguuugcaagcauagcaugguggaucgaggcugggguaauggguguggacuauucggcaaaggcgggaucgucacuugcgccauguuuaccugcaagaaaaacauggaaggaaagauugugcagccugagaaucucgaauacacaauaguggucaccccacacuccggugaggagcaugcuguuggcaacgacacugggaaacacggaaaggaaaucaaagugacgccgcagucaaguauuacagaggccgaacugaccggcuaugguacuguaaccauggaguguagccccagaacagggcuugauuucaaugaaauggugcuguugcaaauggagaacaaggcauggcucguccacaggcagugguuucuggacuuaccucugccauggcuccccggcgcugauaagcaggagucuaauuggauccagaaagaaacccuugugacuuucaagaacccucaugccaaaaagcaagacguugugguccugggaucccaggagggcgcgaugcacacagccuugacgggggcaaccgaaauacagaugucaagcggaaaucuacuguuuacuggucaucucaaaugccggcugcguauggacaaacuucaacugaagggcaugaguuacucuauguguacagggaaauucaaggugguaaaagagauugcugagacccagcacggaacaaucguuauccgcgugcaguaugaaggcgaugguuccccaugcaagauucccuucgagaucauggacuuggagaagagauacguccucgggaggcugauuacugugaacccgauagccaccgagaaggauagcccugucaacaucgaagcugagcccccauuuggcgacucguacauuaucaucggaguggagccuggccaguuaaagcugaauugguucaaaaaggggucuuccauuggacaaauguuugaaacgaccaugcggggugccaaacgaauggcaauacuaggcgauacagccugggacuucgggucacucggaggcguuuuuacaaguaucgguaaggcucugcaucagguguucggggcgauuuauggcgcagccuuuagcggaguauccuggaccaugaaaauccuuauuggcgucaucauaacauggaucgggaugaacucucgcagcacuucauugagugugucccugguucucgugggaauugucacccuguaccuuggcgugaugguacaggcugauagcgguugugugguuucuuggaagaauaaggagcugaaaugcgggucaggaaucuucauuacggacaacguccacacauggaccgaacaguauaaguuucaacccgagaguccaagcaaauuggccuccgcaauccagaaggcccaggaagagggcauaugugguauuagaucugugacuaggcucgagaaucugauguggaaacagaucacacccgaauuaaaccacauucuggcugagaaugaagugaagcuaaccaucaugacuggcgauauaaaagggaucaugcaagccggaaagcggucgcuccgcccucagccaaccgagcugaaguacagcuggaaaacauggggcaaggcaaaaaugcuuuccacggaaucauauaaccagaccuucuugauugacgggccggagacugcggagugccccaauacaaacagagcuuggaauagucuggaagucgaggauuacggauuuggcguuuucaccacaaacaucuggcucaagcugaaagaaaagcaggacgccuuuugugacucuaaguuaaugagcgcagccauuaaagauaauagggcugugcaugccgacauggguuauuggaucgaguccgcacugaacgauacuuggaagauagagaaggcuucauucauugaagugaagaauugccacuggccuaaaagccauacccuuuggucuaacgggguauuggaguccgaaaugaucaucccaaagaaccucgccggacccgucagucaacacaauuaccguccuggcuaccacacgcagauugcggguccauggcaucugggcaagcuagagauggacuucgauuuuugugacgggacaaccgugaucguuacugaagauugcggaaaccggggccccagccugcgaaccacaacugccucugggaaacucauuaccgaguggugcuguagauccugcacacugccgccucuuagguaucgcggagaggacggcuguugguacgguauggaaauacggccauugaaggagaaagaagagaaucuggugaacucauuagucacggcugggcacggacagguggauaauuucagucucggcguucuggguauggcacuuuuucuggaagagauguugagaaccagggugggcacuaagcaugccauccuccugguagcugucagcuucgugacacuaauuaccgggaacaugucguuuaaagaccugggacgcguggucguuauggugggcgccacuauggcagaugacaucgggaugggaguaacauaucucgcgcugcuugccgcuuucaaggugcgacccaccuuugccgcaggcuugcuguuacggaagcucacguccaaagagcugaugaugacuaccauugguaucguccuucugucucaaagcacaauaccugaaaccauccuagagcucacugaugcucuggccuuggggaugauggugcugaagauuguucguaauauggaaaaauaccaguuagcagugacaaucauggccauucucugcguccccaacgcugugauccugcagaaugcguggaagguuucauguaccauacuugccguggucaguguauccccacuguugcucacaucuagccagcagaaaacugacuggauuccucuggcacuaaccaucaagggacugaaccccacggcuaucuuccuuacaacccucuccagaacuaauaaaaagaggucauggccacugaacgaggccauuauggccgugggcaugguuagcauauuggcuaguucucuguuaaagaaugacaucccgaugaccggcccucucguggcagggggacugcuuacagucugcuaugugcugacuggucgcuccgccgauuuggaacucgagcgggcgaccgacguaaaaugggaggaucaggcugaaauuagcggcucgucacccauccugucuauuacgaucagugaggacggguccaugagcauaaagaacgaagaggaggaacagacacuaaccauccugauuagaacuggacuucucgugaucucuggccuguuuccaauuagcauccccauaacagccgcagccugguacuugugggaggucaaaaagcagagggcugguguuuuaugggaugugccuuccccacccccuauggggaaagcagaacuggaggacggagccuaucgaauuaagcaaaagggcauccucggcuacucacagaucggggcgggaguguacaaagaagguaccuuccacacuauguggcaugucacacgcggcgcugugcugaugcacaaggggaaacggauugagccgaguugggccgauguuaagaaagaccuuaucagcuauggaggcgguuggaagcuggagggggaauggaaggagggagaagagguacagguguuggcacuagaaccaggcaaaaaucccagagccguccagaccaagccuggccuguuuaaaacgaacacugggaccauaggagcugugucucucgauuucuccccagguacaucaggcagucccauuaucgacaagaaagggaagguugugggacuguacggcaacggugucgugaccaggagcggggccuauguauccgcaauugcucaaacagagaagucuaucgaggauaauccugaaauagaggacgauauuuuucguaaacgccggcuuacuaucauggacuuacacccgggagccggcaagaccaaaagauaccugcccgcgaucgucagggaagccauuaagcgaggccuccggacguugauccuggcaccaacacgcgugguugcugccgagauggaagaggcucucagagggcugccuauuagguaucagacucccgcaauacgggccgagcauaccggacgagaaaucguggaccuuaugugucacgccacauucaccaugagacuguugucgccaguccgcgugccuaacuacaaucuaauuguuauggaugaggcucauuucacugaccccgcgagcaucgcagccagggguuauaucucaacccguguggaaaugggcgaggcugccgggauuuuuaugacagcaacgccaccgggaucccgggauccuuucccccagaguaacgccccaauaaucgacgaggaaagagagauucccgaaaggucuuggaauagcggccacgagugggucacugauuuuaaagguaagaccgugugguucguaccuuccaucaaggcugggaacgacauugcggccugccugcgcaaaaauggaaagaaagugauccaacucucacgaaagacauuugauucugaauacguuaaaaccagaacuaacgacugggauuucgucgugacaaccgacauaagcgagaugggcgcaaauuuuaaggcugagcgggugaucgauccaaggcgcuguaugaaacccgucauuuuaacggacggcgaagaacguguaauccuggccgggccuaugccggugacucauaguuccgcagcccagagacggggaaggauuggucgcaacccaaagaaugaaaacgaccaguacaucuauaugggcgagccccuugaaaaugaugaggacugcgcucacuggaaggaggccaaaaugcugcucgauaacauaaauacaccugaagggauuauccccagcauguucgagccagaacgagagaagguugacgcgauugauggagaauacagauugcggggcgaggcaaggaaaaccuuuguggaccugaugcgcagaggugaucucccugucuggcuggccuauaagguggcugccgaggggaucaacuacgcugacaggcggugguguuucgauggcaucaaaaacaaucagauccuugaagagaacguugaaguggagauuuggaccaaggagggagaacguaagaaacuaaagccccgcuggcuggacgcacgaaucuauucugauccauuggccuuaaaagaguuuaaggaguucgcugccggcagaaaaucacugacucucaaucugauuacagagauggggaggcuuccuaccuucaugacacaaaagacucgggacgcacuggauaaccucgcggucuugcacacggccgaagcuggaggucgcgccuacaaucaugcacuguccgagcuaccggagacccuggaaacacuccuucuguuaacuuugcuggcuaccgugacaggcgggaucuuucucuuccugaugaguggaagaggcauagguaagaugacccuugggaugugcugcauuaucacugccagcauccugcucugguaugcacagauucagccccacuggaucgccgcuucgauaauuuuggaguuuuuccugaucguauuacuaauuccagaaccugagaaacagaggacgccccaagacaaccagcugaccuacgugguuaucgcgauacucacagucguggccgcaacuauggcuaaugaaaugggcuuucuugagaagaccaaaaaggaccugggauugggcucuaucgccacacagcagccagaguccaacauucuggauaucgaccuccggccugccagcgcauggacccuguacgcuguggccacuacauucgucacgcccaugcuucgacauucaauugaaaauaguucuguuaacaucucccucaccgcgauugcuaaucaagccacugugcugaugggguugggaaaagguuggccgcugagcaagauggauaucggcguaccauuacuagcaauaggguguuauucacaggugaacccuauuacacugaccgccgcucuccuucuguuggucgcacacuacgccaucaucggacccggccugcaggcgaaggcuaccagagaggcccagaaacgcgcagccgcugguauuaugaagaauccaacaguggacgggauaacuguuaucgaucucgaccccauuccuuaugauccgaaauuugaaaagcaacugggccaggugaugcuuuuaauccugugcgucacgcagguacucaugaugaggaccacaugggccuugugugaggcacugacucuagcuaccggacccauuaguacacugugggaaggcaacccagggcgguucuggaauaccacuaucgccgugagcauggcgaacauauuucguggauccuaccucgccggcgcaggucuucuguucucuaucaugaaaaauacgacaaacaccagaagggggacuggaaacauuggcgagaccuugggugagaaguggaaaagccgccugaaugcucucggcaaguccgaauuucaaaucuauaagaaaucagggauucaggagguugaccggacacuggccaaggaaggaaucaaacgaggcgagacugaucaccaugcagugucuagagggagugcuaaguuaaggugguucgucgagcgcaacauggugaccccugaaggaaaagucguggaccuuggcugcgguagagggggauggucguacuauuguggcggucugaagaauguuagagaggugaagggccucacaaaagggggacccggccacgaggaaccuauaccaaugagcacguacggguggaaccuaguacgucugcaguccggaguggaugucuuuuucauucccccugaaaagugcgacaccuugcugugugauaucggcgagucuucaccaaaucccacuguugaggccgguaggacacuccgggugcuuaaccuggucgaaaauugguugaacaauaacacccaguucugcaucaaagugcugaauccguacaugccuagcguaauugagaagauggaagcccuccaacgcaaauaugggggagcguuagugcgaaacccacuguccagaaauaguacucaugagauguacuggguuucuaacgcuagcggcaauauagugucauccgucaacaugaucaguaggaugcuuauuaaccgguuuacaaugcgccacaagaaggcaaccuaugaacccgacguggaccugggcagcgggacgagaaauaucggaauugagucugagaucccuaaccuagauauaaucgguaaaaggauugaaaagaucaaacaggagcaugaaaccuccuggcacuacgaccaggaucacccauauaagacaugggccuaccauggcucauaugagacuaaacagaccgggagcgcuucgucuauggucaauggagugguucgacuccugacaaagcccugggacguauugccgacugugacccaaauggccaugacagauaccacuccuuucggccagcagcgggucuuuaaggaaaaaguggacacgcguacacaggagcccaaggaggguaccaaaaagcugaugaaaauuacugcagaauggcucuggaaggagcuugggaaaaagaagaccccaagaauguguacacgcgaagaguucacgaggaaaguucggaguaacgccgcucugggagcgaucuuuaccgaugagaauaaguggaaauccgccagagaagcaguggaggacagccgcuucugggaauuagucgauaaggagaggaaccugcacuuggaaggcaaaugcgagacuuguguguacaauaugaugggcaagcgagagaagaaacucggggaauuuggaaaggcuaaagguucacgggccauuugguacauguggcugggcgcaagauuccuagaguuugaagcccuuggguuccugaacgaggaccauugguuuuccagggaaaauucucucagcggaguagagggcgagggucugcacaaguugggguauauacugcgcgaugugaguaaaaaggaaggaggcgcuauguacgccgacgacacagcgggcugggauacccguaucacucucgaggaccuuaagaacgaagagaugguuacaaaucacauggaaggggagcauaaaaagcuggcagaggccauuuucaaauuaaccuaucaaaacaaggucgugcgggugcagagaccuacacccaggggaacugucauggauaucaucucccgccgagaccagcgggguagcggccaaguugggaccuacggacugaauacguuuaccaacauggaagcucaguugauuagacagauggagggcgaagguguguucaaaaauauacagcaccucacaguaacugaggagguggccguccaaaacuggcuggcaaggguggggcgcgaaagacuaucucggauggcuaucucaggagaugacugcguugugaagccacuugaugacagguucgccaacgcucugaccgcccucaaugauaugggcaagauucguaaagacauccagcagugggagcccaguaagggcuggaacgauuggacacaggucccuuuuugcucccaucacuuccaugaacugauuaugaaagacgggcgaguguugguaguuccaugucgcaaucaagaugaguuaaucggacgggcacggauaagccagggugcgggcuggucucugagggaaacugccugccucgggaagucguaugcucagauguggucacuuauguacuuucaccgcagagaccugcggcuagccgcaaacgcuaucuguagcgccgugccgucccacuggguccccaccaguaggacgacauggucuauucaugcaaaacacgaguggaugaccacugaggacaugcugacaguguggaaucgaguguggauccgugaaaacccuuggauggaggauaagaccccagucgaaagcugggaggaaauucccuaucucggaaagagagaggaccaguggugcggcuccuugaucggucugacuucacgcgccaccugggcgaaaaauauacaagcugccauuaaccagguucggagucuuaucgggaaugaggaauacacagauuacaugccuucuaugaagagguucagacgcgaggaagaggaagcaggagugcugugguga

SEQ ID NO: 14602 - RNA, 9876 nt, Artificial Sequence
  derived and/or modified CDS sequence (opt3) from DENV-2__FJ687440__SS-prME
agcgccggaaugaucauuaugcugauaccaaccgugauggcuuuccaccucacuacuagaaacggggaaccucauaugaucgucgguauucaagaaaaggguaaaucccuucuguuuaagacggaggacggcguuaauaugugcaccuugauggcaauggauuuaggggaacugugugaggacacaaucacuuacaaaugcccacuacucaggcaaaacgaaccggaggauauugacuguuggugcaauucuaccucaacauggaucaccuauggaacuuguacaaccacgggcgagcaccggcgcgaaaagcgaaguguggcccugguaccccauguggguauggggcuugagacucguaccgaaacauggaugagcuccgagggagcguggaaacacgcucagagaauagagacuuggauccugaggcauccuggcuucaccauuauggccgcaaucuuggccuacacaauuggcaccacgcacuuucagcgggcucucaucuucauacugcugacugcagucgccccaucuaugacaaugcgcugcauugggaucucgaacagagauuuuguggaaggaguuucagguggcagcuggguggacauuguccucgagcacgggaguugugugaccacuauggcuaagaauaagcccacauuagauuucgaacugaucaaaaccgaggccaagcagccugcgacgcuuaggaaauauugcaucgaagcaaaguugaccaacacaacuaccgagucccgguguccaacacaaggagagcccucucugaaagaagaacaagacaagcgcuuuguuugcaagcauagcaugguugaucgaggcugggguaauggguguggacuauucggcaaaggcgggauugugacuugcgccauguuuaccugcaagaaaaacauggaaggaaagauaguccagccugagaaucucgaauacacaaucguggugaccccacacuccggugaggagcaugcugucggcaacgacacugggaaacacggaaaggaaauuaaaguuacgccgcagucaaguaucacagaggccgaacugaccggcuaugguacugugaccauggaguguagccccagaacagggcuugauuucaaugaaaugguacuguugcaaauggagaacaaggcauggcucgugcacaggcagugguuucuggacuuaccucugccauggcuccccggcgcugauaagcagggaucuaauuggauacagaaagagacccuugucacuuucaagaacccucaugccaaaaagcaagacgugguugugcugggcucccaggaaggggcgaugcacacagccuugacgggagcaaccgagauucagaugucaagcgguaaucuacuguuuacuggccaucucaaaugccggcugcguauggacaaacuucaacugaaggggaugaguuacucuauguguacaggaaaauucaaggucgugaaagaaaucgcugagacccagcacggcacaaucguaauucgcguucaguaugagggugauggguccccaugcaagauccccuucgaaauuauggacuuggagaaaagauacgugcucggcaggcugauaacugucaacccgaucgugaccgaaaaggauagcccugucaacauugaggccgaacccccauuuggagacucguacaucaucauuggcguggagccugggcaguuaaagcugaauugguucaaaaagggaucuuccauaggucaaauguuugagacgaccaugcggggcgcuaaacgaauggccauccuaggggauacagcaugggacuucggaucacucggcgguguuuuuacaaguauugggaaggcccugcaucagguguucggcgcuaucuauggagcggcauuuagcggcguauccuggaccaugaaaauucuuaucggggucauaaucacauggauuggaaugaacucucgcagcacuucauugagugugucccugguucucgugggcaucgucacccuguaccuuggugugaugguacaggccgauagcgggugugugguuucuuggaagaauaaggaacugaaaugcggaucaggcauuuucaucacggacaacguccacacauggaccgagcaguauaaguuucaacccgaaaguccaagcaaauuggcuuccgccauacagaaggcacaggaggaagguauuuguggcaucagaucugugacuaggcucgagaaucugauguggaaacagauuacacccgaguuaaaccacauccuggccgaaaaugaggugaagcuaaccauaaugacuggggauaucaaaggaauuaugcaagcuggcaagcggucgcuccgcccucagccaaccgaacugaaguacagcuggaaaacaugggggaaggccaaaaugcuuuccacggagucacauaaccagaccuucuugaucgacggaccggaaacugcagagugccccaauacaaacagagcguggaauagucuggaggucgaagauuauggcuuugguguuuucaccacaaacauuuggcucaagcugaaagagaagcaggacgcuuuuugugacucuaaguuaaugagcgccgcaaucaaagauaauagggccgugcacgcugacaugggguacuggauagaauccgcccugaacgauacuuggaagauugagaaagcaucauucaucgaggugaagaauugccauuggccuaaaagccacacccuuuggucuaacggaguauuggaauccgagaugaucauuccaaagaaccucgcuggccccgucagucaacacaauuaucguccugguuaccauacgcagaucgccggcccauggcaccuggggaagcuagaaauggacuucgauuuuugugacggaacaaccgugauuguuacugaggauugcggcaaccgggggcccagccugcgaaccacaacugcgucuggaaaacucauaaccgaauggugcuguagauccugcacacugccgccucuuagguaccgcggcgaggacgguuguugguaugggauggagauccggccauugaaggaaaaagaggaaaaucuggugaacucauuagucacggccggacauggccagguggauaauuucagucucgguguucugggcauggcucuuuuucuggaggaaauguugagaaccaggguggggacuaagcacgcaauucuccugguagccgucagcuucgugacacuaaucaccggaaacaugucguuuaaagaccugggccgcguggucguuauggugggggcuacuaugacagaugacauuggaaugggcguaaccuaccucgcccugcuugcagcguucaaggugcgacccacguuugccgcugguuugcuguuacggaagcucacuuccaaagagcugaugaugaccacaaucgggauaguccuucugucucaaagcaccaucccugagacuauucuagaacucacagaugcccuggcauugggaaugauggugcugaagaucguucguaauauggagaaauaucaguuagcugugaccauuauggccauccucugcguccccaacgcagugauacugcagaaugccuggaagguuucauguacaauucuugcuguggucaguguauccccacuguugcucacuucuagccagcagaagaccgacuggaucccucuggcgcuaacgaucaagggccugaaccccacagccauuuuccuuaccacucucuccagaaccaauaaaaagaggucauggccacugaacgaagcaauaauggcugugggcaugguuagcaucuuggccaguucucuguuaaagaaugacauuccgaugacagggccucucguggccggaggucugcuuacugucugcuacgugcugaccggccgcuccgcugauuuggagcucgaacgggcaacggacguaaaaugggaggaucaggccgagaucagcgggucgucacccauucugucuaucacaauaagugaagacggauccaugagcaucaagaacgaggaagaggagcagacccuaacuauucugaucagaacaggccuucucgugauuucuggucuguuuccagucagcauccccauaaccgcggcugccugguauuugugggaaguuaaaaagcagagggcagggguguuaugggaugugccuuccccacccccuaugggaaaagccgagcuggaagacggcgcuuaccgaauuaagcaaaagggcauccucggguauucacagaucggagcaggagucuacaaagagggcacuuuccauacaauguggcacgugacccgcggggccguucugaugcacaagggaaaacggauugaaccgaguugggcggauguaaagaaagaccuuaucagcuacggcgguggguggaagcuggagggagaguggaaggaaggcgaggaagugcaggucuuggcucuagagccaggcaaaaaucccagagccgugcagacgaagccugggcuguuuaaaacuaacaccggaacaauaggugcaguuucucucgauuucuccccaggcaccucagggagucccauuaucgacaagaaaggaaagguggucggccuguaugguaacggggugguaacaaggagcggagccuacgucuccgcuauugcccaaacugaaaagucuaucgaggauaauccugagauagaagacgauauuuuucguaaacgccggcuuaccaucauggacuuacauccgggcgcaggcaagacgaaaagauaucugcccgcuaucgugagggaggccauuaagcgagggcuccggacauugauccuggcgccaacucgcguuguggccgcagaaauggaggaagcucucagaggacugccuauuagguaccagacccccgccauacgggcugagcacacaggucgagagaucgucgaccuuaugugucaugcaaccuucacuaugagacuguugucgccagugcgcguuccuaacuauaaucuaauuaucauggaugaagcccacuucaccgaccccgccagcaucgcugcgaggggcuacauuucaacacguguggagaugggggaagcagccggaauauuuaugacggcuacuccaccgggcucccgggauccuuucccccagaguaacgccccaaucauugacgaggagagagaaauccccgagaggucuuggaauagcggucaugaaugggucaccgauuuuacagggaaaaccgugugguucguaccuuccauuaaggcaggaaacgacaucgccgcuugccugcgcaagaauggcaaaaaggugauacaacucucacgaaaaacuuuugauucugaguauguuaagacaagaaccaacgacugggauuucgucgugacgacugacaucagcgaaaugggcgcgaauuuuaaagccgagcgggugauugauccaaggcgcuguaugaagcccgucaucuuaacagacggggaggaacguguaauucuggcaggaccuaugccggugacccacaguuccgcugcccagagacgggguaggaucggccgcaaccccaagaaugagaacgaccaguacauauacaugggggaaccccuugagaaugaugaagacugcgcacacuggaaggaggccaagaugcugcucgauaacauuaauaccccugagggaaucauucccagcauguucgaaccagagcgagaaaaaguugacgcuaucgauggcgaguauagauugcggggugaagccaggaagacuuuuguggaccugaugcgcagaggggaucucccugucuggcuggcguacaaaguggcagccgagggcauaaacuaugcugacaggcggugguguuucgauggaaucaagaacaaucagauucuugaggaaaacguugagguggaaaucuggacaaaagagggcgagcguaagaagcuaaaaccccgcuggcuggacgcccgaauuuacucugauccauuggcuuuaaaggaauuuaaagaguucgcagccgggagaaagucacugacccucaaucugaucacagaaaugggaaggcuuccuacuuucaugacgcagaaaacccgggacgcucuggauaaccucgccgucuugcauacagcagaggcggguggccgcgccuauaaucacgcucuguccgaacuaccggagacucuggagacccuccuucuguuaacauugcuggccaccgugacugggggaauauuucucuuccugaugaguggcagagguauugggaagaugacgcuuggcaugugcugcaucaucaccgcaagcauucugcucugguacgcucagauccagccccauuggauagccgcaucgauuaucuuggaauuuuuccugauuguauuacuaaucccagagccugaaaagcagaggacaccccaagacaaccagcugacuuaugugguuauagccauccucaccgucguggcugcgacaauggccaaugagaugggauuucuugagaaaaccaagaaagaccugggcuuggggucuauugcaacucagcagccagaguccaacauccuggauauugaccuccggccugcuagcgccuggacacuguacgccguggcaacgaccuucgucacucccaugcuucgacacucaaucgagaauaguucuguuaacgugucccucacagcuauugccaaucaagcgaccguacugaugggauuggguaagggcuggccgcugagcaaaauggauaucggggugccauuacuagcuauaggauguuacucacaggucaacccuauuacccugacagccgcacuccuucuguugguggcccacuaugcuaucaucggccccggucugcaggcaaaggccacuagagaagcgcagaagcgcgcugccgcagggauuaugaaaaauccaacgguugacggcauaaccgugaucgaucucgaccccauuccuuacgauccgaaguuugagaaacaacugggacaggucaugcuuuuaauccugugcguaacacaggugcucaugaugaggacuaccugggccuugugugaagcucugacacuagccaccggccccauuaguacucugugggaggggaacccaggacgguucuggaauacgacaaucgcaguuagcauggcuaacauauuucguggcuccuaucucgccggugcggggcuucuguucucuaucaugaagaauaccacuaacaccagaaggggaacaggcaacauuggugaaacuuugggcgagaaauggaaaagccgccugaaugcccucgggaaauccgaguuucaaaucuacaagaagucaggcauucaggaaguggaccggacccuggcaaaagagggcaucaagcgaggggaaacagaucaucacgcugucucuagaggaagugccaaauuaaggugguucguggagcgcaacauggucacgccugagggcaaggugguugaccuugguugcgggcggggaggcuggucguauuacugugguggccugaaaaaugugagagaaguaaaggggcucaccaagggaggccccgggcaugaggaaccuauaccaaugagcacuuauggauggaaccuagugcgucugcaguccggcgucgauguauuuuucauucccccugagaaaugcgacacauugcugugugauaucggugaaucuucaccaaaucccaccguggaggcagggaggacucuccggguccuuaaccugguggagaauugguugaacaauaacacacaguucugcaucaagguacugaauccguacaugccuagcgugauugagaaaauggaggcucuccaacgcaaguacggaggcgccuuaguucgaaacccacuguccagaaauaguacccacgaaauguauugggugucuaacgccagcggcaauauagucucauccgugaacaugaucaguaggaugcuuauuaaccgguuuacgaugcgccauaaaaaggcgaccuacgagcccgacgucgaccuggggagcggaacaagaaauaucgguauugaaucugagaucccuaaccuagauauaaucggcaagaggauugagaaaaucaagcaggaacacgagacuuccuggcacuaugaccaggaucauccauacaaaaccugggcuuaucacgggucauacgaaacaaagcagacuggaagcgcaucgucuauggugaauggcguuguacgacuccugaccaaacccugggacguguugccgacagucacccaaauggccaugacugauacgacaccuuucggucagcagcggguguuuaaggagaagguugacacccguacucaggaacccaaagaggggaccaagaaacugaugaagauuacagcugaguggcucuggaaagaacuuggaaagaaaaagacgccaagaauguguacccgcgaggaguucacuaggaaggugcggaguaacgccgcacugggcgccaucuuuacagaugagaauaaauggaaguccgcuagagaggcggucgaagacagccgcuucugggaguuaguggauaaagaaaggaaccugcauuuggagggcaagugcgaaaccuguguauauaauaugauggggaaacgagagaagaagcucggagaguuugguaaagccaagggcucacgggcaauuugguacauguggcugggggcuagauuccuagaauuugaggcccuuggauuccugaacgaagaccacugguuuuccagggaaaauucucucagcggcguggaaggugaggggcugcacaaauugggauacauacugcgcgauguuaguaagaaagagggcggcgcaauguaugccgacgacacugcugggugggauacacguaucacccucgaagaccuuaagaacgaggaaauggucacaaaucauauggagggagaacacaagaaacuggccgaggcgauuuucaaguuaacuuaccaaaacaaaguggugcggguccagagaccuacccccagggguacgguuauggauaucaucucccgccgagaccagcggggcagcgggcaagugggaaccuauggccugaauacauuuacuaacauggaggcacaguugauuagacagauggaaggugaggggguauucaagaauauacagcaucucaccgccacagaagagaucgcugugcaaaacuggcuggccagggucggacgcgagagacuaucucggauggcaauuucaggcgaugacugcgugguuaaaccacuugaugacagguucgcuaacgcccugacugcucucaaugauaugggcaagauccguaaggacauucagcagugggaacccaguaaaggguggaacgauuggacccaggugccuuuuugcucccaccauuuccacgagcugaucaugaaggacggacgagucuuggugguaccaugucgcaaucaagaugaauuaauagguagagcccggaucagccagggcgcaggguggucucugagggagacggcgugccucggaaaaucguacgcccagauguggucacuuauguauuuucaccgcagagaccugcggcuagcugccaacgcaauuuguagcgcuguuccgucccauugggugcccacaaguaggaccacuuggucuauccacgccaagcaugaauggaugacaaccgaggacaugcugacugucuggaaucgaguguggauucgugagaacccuuggauggaagauaaaaccccaguggagagcugggaagagauccccuaccucggcaagagagaagaccaguggugcgguuccuugauagggcugacaucacgcgcaacgugggccaagaauauucaagcggcuaucaaccagguccggagucuuauuggaaaugaggaguauaccgauuacaugccuucuaugaaaagguucagacgcgaagaggaagaggccggcguucugugguga

SEQ ID NO: 14603 - RNA, 9876 nt, Artificial Sequence
  derived and/or modified CDS sequence (opt3) from DENV-2__FJ687441__SS-prME
agcgccggaaugaucauuaugcugauacccaccgugauggcuuuccaccucaccacuagaaacggggagccucauaugaucgucgguauucaagaaaaggguaaaucccuucuguuuaagacggaggacggaguuaauaugugcaccuugauggcaauggauuuaggggaacugugugaggacacaaucacuuacaaaugcccacuacucaggcaaaacgaaccggaggauauugacuguuggugcaauucuaccucaacauggaucaccuauggaacuuguacaaccacgggcgagcaccggcgcgaaaagcgaaguguggcccugguaccccauguggguauggggcuugagacucguaccgaaacauggaugagcuccgagggagcguggaaacacgcucagagaauagagacuuggauccugaggcauccuggcuucaccauuauggccgcaaucuuggccuacacaauuggcaccacgcacuuucagcgggcucucaucuucauacugcugacugcagucgccccaucuaugacaaugcgcugcauugggaucucgaacagagauuuuguggaaggaguuucagguggcagcuggguggacauuguccucgagcacgggaguugugugaccacuauggcuaagaauaagcccacauuagauuucgaacugaucaaaaccgaggccaagcagccugcgacgcuuaggaaauauugcaucgaagcaaaguugaccaacacaacuaccgagucccgguguccaacacaaggagagcccucucugaaagaggaacaggacaagcgcuuuguuugcaagcauagcaugguugaucgaggcugggguaauggguguggacuauucggcaaaggcgggauugugacuugcgccauguuuaccugcaagaaaaacauggaaggaaagauaguccagccugagaaucucgaauacacaaucguggugaccccacacuccggugaggagcaugcugucggcaacgacacugggaaacacggaaaggaaauuaaaguuacgccgcagucaaguaucacagaggccgaacugaccggcuaugguacugugaccauggaguguagccccagaacagggcuugauuucaaugaaaugguacuguugcaaauggagaacaaggcauggcucgugcacaggcagugguuucuggacuuaccucugccauggcuccccggcgcugauaagcagggaucuaauuggauacagaaagagacccuugucacuuucaagaacccucaugccaaaaagcaagacgugguugugcugggcucccaggaaggggcgaugcacacagccuugacgggagcaaccgagauucagaugucaagcgguaaucuacuguuuacuggccaucucaaaugccggcugcguauggacaaacuucaacugaaggggaugaguuacucuauguguacaggaaaauucaaggucgugaaagaaaucgcugagacccagcacggcacaaucguaauucgcguucaguaugagggugauggguccccaugcaagauccccuucgaaauuauggacuuggagaaaagauacgugcucggcaggcugauaacugucaacccgaucgugaccgaaaaggauagcccugucaacauugaggccgaacccccauuuggagacucguacaucaucauuggcguggagccugggcaguuaaagcugaauugguucaaaaagggaucuuccauaggucaaauguuugagacgaccaugcggggcgcuaaacgaauggccauccuaggggauacagcaugggacuucggaucacucggcgguguuuuuacaaguauugggaaggcccugcaucagguguucggcgcuaucuauggagcggcauuuagcggcguauccuggaccaugaaaauucuuaucggggucauaaucacauggauuggaaugaacucucgcagcacuucauugagugugucccugguucucgugggcaucgucacccuguaccuuggugugaugguacaggccgauagcgggugugugguuucuuggaagaauaaggaacugaaaugcggaucaggcauuuucaucacggacaacguccacacauggaccgagcaguauaaguuucaacccgaaaguccaagcaaauuggcuuccgccauacagaaggcacaggaggaagguauuuguggcaucagaucugugacuaggcucgagaaucugauguggaaacagauuacacccgaguuaaaccacauccuggccgaaaaugaggugaagcuaaccauaaugacuggggauaucaaaggaauuaugcaagcuggcaagcggucgcuccgcccucagccaaccgaacugaaguacagcuggaaaacaugggggaaggccaaaaugcuuuccacggagucacauaaccagaccuucuugaucgacggaccggaaacugcagagugccccaauacaaacagagcguggaauagucuggaggucgaagauuauggcuuugguguuuucaccacaaacauuuggcucaagcugaaagagaagcaggacgcuuuuugugacucuaaguuaaugagcgccgcaaucaaagauaauagggccgugcacgcugacaugggguacuggauagaauccgcccugaacgauacuuggaagauugagaaagcaucauucaucgaggugaagaauugccauuggccuaaaagccacacccuuuggucuaacggaguauuggaauccgagaugaucauuccaaagaaccucgcuggccccgucagucaacacaauuaucguccugguuaccauacgcagaucgccggcccauggcaccuggggaagcuagaaauggacuucgauuuuugugacggaacaaccgugauuguuacugaggauugcggcaaccgggggcccagccugcgaaccacaacugcgucuggaaaacucauaaccgaauggugcuguagauccugcacacugccgccucuuagguaccgcggcgaggacgguuguugguaugggauggagauccggccauugaaggaaaaagaggaaaaucuggugaacucauuagucacggccggacauggccagguggauaauuucagucucgguguucugggcauggcucuuuuucuggaggaaauguugagaaccaggguggggacuaagcacgcaauucuccugguagccgucagcuucgugacacuaaucaccggaaacaugucguuuaaagaccugggccgcguggucguuauggugggggcuacuaugacagaugacauuggaaugggcguaaccuaccucgcccugcuugcagcguucaaggugcgacccacguuugccgcugguuugcuguuacggaagcucacuuccaaagagcugaugaugaccacaaucgggauaguccuucugucucaaagcaccaucccugagacuauucuagaacucacagaugcccuggcauugggaaugauggugcugaagaucguucguaauauggagaaauaucaguuagcugugaccauuauggccauccucugcguccccaacgcagugauacugcagaaugccuggaagguuucauguacaauucuugcuguggucaguguauccccacuguugcucacuucuagccagcagaagaccgacuggaucccucuggcgcuaacgaucaagggccugaaccccacagccauuuuccuuaccacucucuccagaaccaauaaaaagaggucauggccacugaacgaagcaauaauggcugugggcaugguuagcaucuuggccaguucucuguuaaagaaugacauuccgaugacagggccucucguggccggaggucugcuuacugucugcuacgugcugaccggccgcuccgcugauuuggagcucgaacgggcaacggacguaaaaugggaggaucaggccgagaucagcgggucgucacccauucugucuaucacaauaagugaagacggauccaugagcaucaagaacgaggaagaggagcagacccuaacuauucugaucagaacaggccuucucgugauuucuggucuguuuccagucagcauccccauaaccgcggcugccugguauuugugggaaguuaaaaagcagagggcagggguguuaugggaugugccuuccccacccccuaugggaaaagccgagcuggaagacggcgcuuaccgaauuaagcaaaagggcauccucggguauucacagaucggagcaggagucuacaaagagggcacuuuccauacaauguggcacgugacccgcggggccguucugaugcacaagggaaaacggauugaaccgaguugggcggauguaaagaaagaccuuaucagcuacggcgguggguggaagcuggagggagaguggaaggaaggcgaggaagugcaggucuuggcucuagagccaggcaaaaaucccagagccgugcagacgaagccugggcuguuuaaaacuaacaccggaacaauaggugcaguuucucucgauuucuccccaggcaccucagggagucccauuaucgacaagaaaggaaagguggucggccuguaugguaacggggugguaacaaggagcggagccuacgucuccgcuauugcccaaacugaaaagucuaucgaggauaauccugagauagaagacgauauuuuucguaaacgccggcuuaccaucauggacuuacauccgggcgcaggcaagacgaaaagauaucugcccgcuaucgugagggaggccauuaagcgagggcuccggacauugauccuggcgccaacucgcguuguggccgcagaaauggaggaagcucucagaggacugccuauuagguaccagacccccgccauacgggcugagcacacaggucgagagaucgucgaccuuaugugucaugcaaccuucacuaugagacuguugucgccagugcgcguuccuaacuauaaucuaauuaucauggaugaagcccacuucaccgaccccgccagcaucgcugcgaggggcuacauuucaacacguguggagaugggggaagcagccggaauauuuaugacggcuacuccaccgggcucccgggauccuuucccccagaguaacgccccaaucauugacgaggagagagaaauccccgagaggucuuggaauagcggucaugaaugggucaccgauuuuaaagggaagacagugugguucguaccuuccauuaaggcaggaaacgacaucgccgcuugccugcgcaaaaauggcaagaaagugauacaacucucacgaaagaccuuugauucugaguauguuaaaacuagaacaaacgacugggauuucgucgugaccacggacaucagcgaaaugggcgcgaauuuuaaggccgagcgggugauugauccaaggcgcuguaugaaacccgucaucuuaacugacggggaggaacguguaauucuggcaggaccuaugccggugacacacaguuccgcugcccagagacgggguaggaucggccgcaacccaaagaaugagaacgaccaguacauauacaugggggaaccccuugagaaugaugaagacugcgcacacuggaaggaggccaaaaugcugcucgauaacauuaauaccccugagggaaucauucccagcauguucgaaccagagcgagaaaagguugacgcuaucgauggcgaguauagauugcggggugaagccaggaaaaccuuuguggaccugaugcgcagaggggaucucccugucuggcuggcguacaagguggcagccgagggcauaaacuaugcugacaggcggugguguuucgauggaaucaaaaacaaucagauucuugaggaaaacguugagguggaaaucuggacuaaggagggcgagcguaagaaacuaaagccccgcuggcuggacgcccgaauuuacucugauccauuggcuuuaaaagaauuuaaggaguucgcagccgggagaaaaucacugacacucaaucugaucaccgaaaugggaaggcuuccuacauucaugacucaaaagacgcgggacgcucuggauaaccucgccgucuugcauaccgcagaggcggguggccgcgccuauaaucacgcucuguccgaacuaccggagacacuggagacucuccuucuguuaaccuugcuggccacagugaccgggggaauauuucucuuccugaugaguggcagagguauugggaagaugacucuuggcaugugcugcaucaucacggcaagcauucugcucugguacgcucagauccagccccauuggauagccgcaucgauuaucuuggaauuuuuccugauuguauuacuaaucccagagccugaaaaacagaggacaccccaagacaaccagcugacauaugugguuauagccauccucacugucguggcugcgaccauggccaaugagaugggauuucuugaaaagacuaaaaaggaccugggcuuggggucuauugcaacccagcagccagaguccaacauccuggauauugaccuccggccugcuagcgccuggacucuguacgccguggcaacaacguucgucacccccaugcuucgacacucaaucgagaauaguucuguuaacgugucccucacugcuauugccaaucaagcgacaguacugaugggauuggguaaaggcuggccgcugagcaagauggauaucggggugccauuacuagcuauaggauguuacucacaggucaacccuauuacccugaccgccgcacuccuucuguugguggcccacuaugcuaucaucggccccggucugcaggcaaaggccacaagagaagcgcagaaacgcgcugccgcagggauuaugaagaauccaacuguugacggcauaacggugaucgaucucgaccccauuccuuacgauccgaaauuugagaagcaacugggacaggucaugcuuuuaauccugugcguaacccaggugcucaugaugaggacaacuugggccuugugugaagcucugacccuagccacaggccccauuaguacccugugggaggggaacccaggacgguucuggaauacuacgaucgcaguuagcauggcuaacauauuucguggcuccuaucucgccggugcggggcuucuguucucuaucaugaaaaauacaaccaacacuagaaggggaaccggcaacauuggugaaacauugggcgagaaguggaaaagccgccugaaugcccucgggaaguccgaguuucaaaucuacaagaaaucaggcauucaggaaguggaccggacucuggcaaaggagggcaucaaacgaggggaaaccgaucaucacgcugucucuagaggaagugccaaguuaaggugguucguggagcgcaacauggucacaccugagggcaaagugguugaccuugguugcgggcggggaggcuggucguauuacugugguggccugaagaaugugagagaaguaaaggggcucacgaaaggaggccccgggcaugaggaaccuauaccaaugagcaccuauggauggaaccuagugcgucugcaguccggcgucgauguauuuuucauucccccugagaagugcgacacuuugcugugugauaucggugaaucuucaccaaaucccacaguggaggcagggaggacccuccggguccuuaaccugguggagaauugguugaacaauaacacucaguucugcaucaaaguacugaauccguacaugccuagcgugauugaaaagauggaggcucuccaacgcaaauacggaggcgccuuaguucgaaacccacuguccagaaauaguacacacgaaauguauugggugucuaacgccagcggcaauauagucucauccgugaacaugaucaguaggaugcuuauuaaccgguuuaccaugcgccauaagaaggcgacguacgagcccgacgucgaccuggggagcggaaccagaaauaucgguauugaaucugagaucccuaaccuagauauaaucggcaaaaggauugagaagaucaaacaggaacacgagacauccuggcacuaugaccaggaucauccauacaagacuugggcuuaucacgggucauacgaaaccaaacagacaggaagcgcaucgucuauggugaauggcguuguacgacuccugacuaagcccugggacguguugccgaccgucacacaaauggccaugaccgauacuacgccuuucggucagcagcggguguuuaaggagaaaguugacacacguacccaggaacccaaggaggggacuaaaaagcugaugaaaauuaccgcugaguggcucuggaaggaacuuggcaaaaagaagacaccaagaauguguacgcgcgaggaguucaccaggaaagugcggaguaacgccgcacugggcgccaucuuuacugaugagaauaaguggaaauccgcuagagaggcggucgaagacagccgcuucugggaguuaguggauaaggaaaggaaccugcauuuggagggcaaaugcgaaacauguguauauaauaugauggggaagcgagagaagaaacucggagaguuugguaaggccaaaggcucacgggcaauuugguacauguggcugggggcuagauuccuagaauuugaggcccuuggauuccugaacgaagaccacugguuuuccagggaaaauucucucagcggcguggaaggugaggggcugcacaaguugggauacauacugcgcgauguuaguaaaaaggagggcggcgcaauguaugccgacgacaccgcugggugggauacucguaucacacucgaagaccuuaagaacgaggaaauggucaccaaucauauggagggagaacacaaaaagcuggccgaggcgauuuucaaauuaacauaccaaaacaagguggugcggguccagagaccuacucccagggguaccguuauggauaucaucucccgccgagaccagcggggcagcgggcaagugggaacguauggccugaauaccuuuacaaacauggaggcacaguugauuagacagauggaaggugaggggguauucaaaaauauacagcaucucacugccaccgaagagaucgcugugcaaaacuggcuggccagggucggacgcgagagacuaucucggauggcaauuucaggcgaugacugcgugguuaagccacuugaugacagguucgcuaacgcccugacagcucucaaugauaugggcaagauccguaaagacauucagcagugggaacccaguaagggguggaacgauuggacucaggugccuuuuugcucccaccauuuccacgagcugaucaugaaagacggacgagucuuggugguaccaugucgcaaucaagaugaauuaauagguagagcccggaucagccagggcgcaggguggucucugagggagaccgcgugccucggaaagucguacgcccagauguggucacuuauguauuuucaccgcagagaccugcggcuagcugccaacgcaauuuguagcgcuguuccgucccauugggugcccacgaguaggacaaccuggucuauccacgccaaacaugaauggaugacuacagaggacaugcugaccgucuggaaucgaguguggauucgugagaacccuuggauggaagauaagacuccaguggagagcugggaagagauccccuaccucggcaagagagaagaccaguggugcgguuccuugauagggcugaccucacgcgcaacaugggccaaaaauauucaagcggcuaucaaccagguccggagucuuauuggaaaugaggaguauacggauuacaugccuucuaugaagagguucagacgcgaagaggaagaggccggcguucugugguga

SEQ ID NO: 14604 - RNA, 9876 nt, Artificial Sequence
  derived and/or modified CDS sequence (opt3) from DENV-2__FJ687445__SS-prME
agcgugggcaugaucauuaugcugauccccaccgucauggccuuccaccucaccacuagaaacggggagccucauaugaucguuuccauucaggaaaagggaaagucucuucuguuuaagacggaggacggugugaauaugugcaccuugauggcuauggauuuaggcgaacugugugaggacacaaucacuuacaaaugcccacuacucaggcaaaacgaaccggaggauauugacuguuggugcaauucaaccaguacauggguaaccuaugggacuuguacaaccacgggagagcaccggcgcgaaaagcgaagcguggcacuggucccccaugugggcaugggucuugagacucguaccgaaacauggauguccucugagggggccuggaaacacgcgcagagaaucgagacuuggauacugaggcauccuggauucaccaucauggcugccauuuuggcauacacaaucggcaccacgcacuuucagcggacucucauuuucauccugcugacagccguugcuccaucgaugaccaugcgcugcauaggcauuucaaacagagauuuuguggaaggggucagcggagguaguuggguggacaucguacucgagcacggcuccuguguuacuacaauggcaaagaauaagcccaccuuagauuucgaacugauuaaaacggaggccaagcagccugcuacccuuaggaaauauugcaucgaagccaaguugacaaacacuaccacagagucucgguguccaacucaaggggagcccagccugaaagaagaacaggacaagcgcuuugugugcaagcauuccauggucgaucgaggauggggcaaugguugugggcuauucggaaaaggcggcaucgugaccugcgcgauguuuacaugcaagaaaaacauggaagggaagauugugcagccugagaaucucgaauacaccauagucguuacuccacacucaggagaggagcaugcaguggguaacgacacgggcaaacacgggaaggaaaucaaaguaacaccgcagaguagcauuaccgaggccgaacugacuggauauggcaccgugacaauggaguguucucccagaaccggucuugauuucaaugaaaugguccuguugcaaauggagaacaaggcuuggcucgugcacaggcagugguuucuggacuuaccucugccauggcuccccggggccgauacucagggcuccaauuggauccagaaggagacacuuguuacguucaaaaacccucaugcaaagaaacaagacguggucgugcugggaucacaggaaggcgcuaugcacaccgccuugacuggggcgacagagauacagaugagcaguggaaaucuacuguuuaccggucaucucaagugccggcugcguauggacaaacuucaacugaagggcaugucuuacuccauguguacagggaaguucaaaguaguuaaggaaauugccgagacucagcacggaaccaucgugauccgcguccaguaugagggcgaugguagcccaugcaaaauucccuucgaaaucauggacuuggagaagagauacgugcucgggaggcugauuacggucaacccgauagugaccgaaaaagauucgccuguuaacaucgaggcagaacccccauuuggcgacucuuacauuaucaucggaguggagccuggccaguuaaagcugaauugguucaagaaaggguccucaauuggacaaauguuugagacaacuaugcggggugcuaagcgaauggccauacuaggcgauaccgcuugggacuucgggagucucggaggcguauuuacaagcaucgguaaagcccugcaucaggucuucggggcaauuuauggcgccgcuuuuuccggagugucuuggacuaugaagauccuuauuggcguuaucauaaccuggaucgggaugaacagccgcucaacgaguuuguccgugagccugguccucgugggaguagugacacuguaccuuggcguuaugguccaggcggauucugguuguguggugucauggaaaaauaaggaacugaagugcgggaguggaauuuucaucaccgacaacguccacacuuggacagagcaguauaaauuucaacccgaaagcccauccaaguuggcaucugccauucagaaagcucaggaggaaggcaucugugguauaagaucgguuaccaggcucgagaaucugauguggaagcagauuacucccgaguuaaaccacauccuggccgaaaaugaggugaaacuaaccauuaugacaggcgauaucaaggggauaaugcaagcaggaaaacggagccuccgcccucagccaacggaacugaaguacuccuggaagaccuggggcaaagccaagaugcuuucaacugagagucauaaccagacauucuugaucgacgggccggaaaccgcugagugccccaauacaaacagagccuggaacucucuggagguggaagauuauggauuuggcguauucacuaccaacauuuggcucaaacugaaggagaaacaggacgcauuuugugacagcaaguuaauguccgcggcuaucaaggauaauagggccguccacgcagacauggguuacuggauugaaucagcccugaacgauacguggaaaaucgagaaggcuagcuucauagaggugaaaaauugccauuggccuaagucucacacacuuugguccaacgggguuuuggaaagugagaugauuauccccaagaaucucgccggacccgugagccaacacaauuaucguccuggcuaccauacccagaucgcagguccauggcaccugggcaagcuagaaauggacuucgauuuuugugacgggacuaccgucgugguuacagaggauugcggaaaccggggccccucucugcgaacuaccacagcuuccgggaagcucauuacggaauggugcuguagaucaugcacccugccgccucuuagguaccgcggagaggacggcuguugguaugguauggagauccggccauugaaagaaaaggaggaaaaucuggugaacaguuuaguaacugccgggcauggacaggucgauaauuucagccucggcgugcuggguauggcgcuuuuucuggaggaaauguugagaacaagggugggcaccaaacacgccauucuccuggucgcuguuucguucgugacucuaauaacagggaacauguccuuuaaggaccugggacgcguaguggucauggugggcgcaaccaugacggaugacaucgggaugggaguuacuuaccucgcccugcuugcugccuucaaagugcgacccaccuuugcagcgggcuuguuccugcggaaguuaacaucuaaggagcucaugaugaccacuauugguaucguccugcuuagccaaucaacaauuccugagaccauccuggaacuaacagaugcccucgcucuggggaugaugguguugaaaaugguucgugacauggagaaguaucagcuggccgugacuauaauggcaaucuuaugcguccccaaugcuguaauucuccagaacgccuggaaagugaguuguaccauccuggcaguuguguccgucucuccacuucuguugacgagcucccagcaaaagacagacuggauuccucucgcccugaccaucaaaggacuaaaucccacugcuauauuucugaccacacuuucaagaacuaacaagaaaaggagcuggccacucaaugaagcgauuauggccgugggcaugguaaguauccuggcaucuuccuugcugaagaacgauaucccgaugaccggcccuuuaguggcugggggacuccugacggucugcuacguucuuacaggucgcagcgccgaccuggaguuggaacgggccaccgaugugaagugggaggaccaggcugagauuucgggcucaucucccauacucaguaucacuauuuccgaagaugggagcaugucuaucaaaaaugaggaagaggagcagacacugaccauucuaaucagaacuggacugcuugugauaagcggccucuucccagucuccauccccauuacagcagccgcgugguaucugugggaagugaagaaacagagggcugguguuuugugggacguaccuucaccacccccuauggggaaggccgaguuagaagauggagcauaccgaaucaaacaacgcggcauucugggcuauagucagaucggggccggaguguacaaggaggguaccuuucauacgauguggcacgucacucggggcgcugugcucacccacaaggggaaaagaauagaaccgagcugggcagacguuaagaaagaucugauuucuuacggaggcgguuggaaacuugagggggaguggaaagaaggagaggaagugcagguccuggccuuggagccaggcaagaaccccagggcggugcagacaaagccuggccuauucaaaaccaauacagggacuaucggagcuguaucccuggacuuuucaccagguaccaguggcagccccaucauugauaagaaagggaaggucgugggacucuauggcaacgguguugugacgcguuccggggccuacgucucugcaaucgcccaaacagaaaaaucgauagaggacaacccugauauugaggacgacaucuuccgcaagcggagacugacuauuauggaucuucauccgggagcuggcaagaccaaaagguauuuacccgccaucgugcgagaagcaauaaagcggggccugcgcacacucauuuuggcuccaaccagaguuguggccgcggagauggaagaggcccugagggggcucccuauccgguaccagacucccgcaauccgagcugaacacaccggaagagagauugucgaccugaugugucaugccacauucacgaugcgccuucugagcccagugaggguaccuaauuauaacuugaucauuauggaugaggcucacuuuacugaccccgcaucaauagccgcccgugguuacaucuccacccggguggaaaugggcgaggcugcggggauuuucaugacagcaaccccaccgggaaguagagauccuuuuccccagucuaaugccccaaucaucgacgaagagagggagauucccgaacgcagcuggaacuccggccaugaguggguuacugauuucaaagguaagacagucugguuugugccuucaauaaaagcugggaaugacaucgccgcaugccuacgaaagaacggaaagaaagugauucaacugucuagaaagaccuucgauagcgaauaugucaaaacgcggacuaaugacugggauuuuguagugacaaccgacaucagugagaugggcgccaacuucaaggcugaaaggguuauugacccacgccguuguaugaaacccgugauccucaccgauggcgaggagagagucauauuagcggggccuaugccggugacucacuccagcgccgcacagcggaggggacgcaucggucgaaauccaaagaacgaaaaugaccaguacauuuacaugggcgagccccuggaaaacgaugaggacugcgcucacuggaaagaagccaagaugcuucuggauaauaucaacacaccugaggggauuauccccucuauguuugagccagaaagagagaagguugacgcaauagauggagaauaucggcucaggggcgaggcccgcaaaaccuucguggacuugaugagaaggggugaucugccugucuggcucgcuuacaagguggccgcggaagggauuaauuaugcagaccggcguugguguuuugauggcaucaaaaacaaccagauucuggaggagaauguagaaguggagaucuggacaaaggaaggagagcgcaagaaacuuaaaccccgauggcuagacgccagaauauacucagauccacuggcuuugaaagaguucaaggaguucgccgcuggcaggaaauccuuaacucugaaccucaucacggagauggggcggcugccuaccuuuaugacacaaaagacucgcgacgcacuugacaaucuggccguucuccauaccgcugaagccggagguagagcauauaaccacgcguugagugagcugccggaaacacuagagacccugcuccuucugacuuuauuggccacggucaccggcgggauuuuccuguuucucaugagcggaaggggcaucgguaaaaugacacuggggaugugcugcauugugacugcuucgauccuucugugguacgcccagauacagccccauuggauugcagcuucuaucauccucgaguucuuuuugauugugcuguuaaucccagaaccugagaagcagcggacaccacaagauaaucagcuaacauaugucguuauagccauucugaccgugguagcagccacuauggcuaacgaaaugggcuuccucgagaagaccaagaaggaccuuggacugggcuccaucgcgacgcagcagccagaaagcaauauuuuggauaucgaccugcgaccugccucagcauggacccucuacgcuguggccacuacauuugucacccccaugcugagacacaguauagagaacucuuccgugaauguuagccuuaccgccaucgcaaaccaagcuacagugcucauggggcugggaaaagguuggccguugucaaagauggauauuggcgccccacuguuagcgaucggguguuacagucaggucaauccuauuacucuaacggcugcccugcuccuucugguagcacacuaugccaucauuggacccggcuugcaggcuaaagcaacccgcgaggcccagaagagggcggcugccgguaucaugaagaacccaacaguggacgggauaacuguuauugaucuggaccccaucccucaugauccgaaauucgaaaagcaacucggccaggugaugcugcuugucuuaugcgugacccagguccugaugaugcggacaaccugggcacucugugaggccuugacucuggcuacgggacccaucagcacacuaugggaaggcaauccagggcguuuuuggaacaccacuauugccguguccauggcaaauauauucagaggaucuuaccuggcuggcgccggucuccuuuuuagcaucaugaaaaacaccacaaauuccaggcgcgggacuggaaacauuggcgagacccugggugaaaaguggaaaucacgguugaacgcgcugggcaagucugaguuccaaaucuauaaaaagagugggauucaggagguugaccgaacacucgccaaggaaggaaucaaaagaggcgagacggaucaccaugcagugucgagggggagcgcuaagcugcgcugguuuguagaacggaauauggugaccccugagggaaaagucguugacuuaggcugcgguagagggggaugguccuacuauuguggcggucuuaagaacgugcgugaggucaaaggccugacuaaagggggacccggccacgaagaaccuauaccaaugucuacauacggguggaaucucgugaggcuacagucaggaguagauguguucuucauacccccugaaaagugcgacacccuguugugugacauuggcgagagcuccccaaaccccacuguugaagccggucggacacugcgcgugcucaaucuugucgagaacuggcugaauaacaauacccaguuuugcaucaaaguguugaacccguauaugccuagugucauugagaagauggaaacgcugcaacgaaaauacgggggagcacucgugagaaauccauuaucuaggaacagcacccaugagauguacuggguuucaaaugcuuccggcaacaucguaaguagcgugaauaugauaucucggaugcugauuaaccgcuucacaaugagacacaagaaagccacuuaugaacccgaugucgaccuuggcuccgggaccaggaacaucggaaucgagucagaaauuccuaaucuggauauaaucgguaagcgaauugagaagaucaaacaggagcacgaaacaagcuggcauuacgaccaggaucacccauauaagacuugggccuaccauggcucguaugagaccaaacagacagggucugcgaguuccauggugaacggaguugugcggcuacucaccaagcccugggacguccugccgacugugacgcaaauggcuaugacagauaccacuccuuuuggccagcagcguguauucaaagaaaagguggacaccagaacacaggagcccaaggaagguacgaaaaaguugaugaaaauuaccgcagaguggcuguggaaggagcucgggaaaaagaaaacuccacgcauguguacaagggaagaguuuacccggaagguuagaagcaaugccgcucuuggagccaucuucacugaugaaaacaaguggaaaucagcacgcgaggccgucgaggacuccagguuuugggaacugguggauaaggagcgaaauuuacaccuggaaggcaaaugcgagacauguguguacaacaugaugggcaagcgggagaagaaguugggggaguucggaaaggcuaaagguucuagagcgauaugguauauguggcucggcgccagguuucuggaguucgaagcacuaggguuucuuaaugaggaccacugguucagccgcgaaaacagucuguccggagucgagggcgaaggucuccaucgucugggguacaucuugcgggacguuagcaagaaagagggaggcgcuauguacgccgaugacaccgcaggcugggauacaagaauuacucuggaggaccucaagaaugaagagauggugaccaaccacauggaaggggagcauaagaaacuugccgaagcuaucuuuaaacugacguaucaaaauaaaguagugaggguccagcgcccuacaccccgaggaacagugauggauauuaucucucggagagaccagagggguucaggccaaguugggacuuacggauuaaacaccuucacaaauauggaggcccagcugauucgccagauggagggcgaagguguguucaagaacauacagcacuugacugucaccgaggaaaucgcggugcaaaauuggcucgcaagaguagggcgggagaggcugagucguauggccauuuccggagaugacugcguugugaaaccacuagaugaccgauuugcuagcgcccuuacggcacugaacgauaugggcaagauccgcaaagacauccagcagugggagcccucuagaggcuggaacgauuggacacaggucccuuucugcucgcaucacuuucacgaacucauuaugaaggacgggcgggugcugguggucccauguaggaaucaagacgaguugauaggacgcgcuagaaucucacagggugccggcuggagcuuacgggaaaccgcuugccuggggaaguccuaugcccagauguggagucucauguacuuccauaggcgagaucuucgucuggcagcgaacgccauuuguucugcuguuccgagccacugggugcccacuuccagaacaaccuggucaauccaugccaaacacgaguggaugacuaccgaagacaugcuaacaguauggaaucgcguguggauucaggagaacccuuggauggaggauaagacgccagucgaaaguugggaggaaauccccuaucugggaaaacgggaggaccaauggugcggcucucucauagguuugaccagcagggcaacuugggcuaagaauauccagguggccauuaaccagguuagaucccugaucgggaaugaagaguacacagauuauaugccuucaaugaaacgcuuucggagggaggaagaggaagcaggagugcuuugguga

SEQ ID NO: 14605 - RNA, 9876 nt, Artificial Sequence
  derived and/or modified CDS sequence (opt3) from DENV-2__FJ687447__SS-prME
agcgcaggaaugaucauuaugcugauccccaccgugauggcuuuccaccucacuacuagaaauggggaaccucauaugaucgucgguauucaagaaaagggaaaaucccuucuguuuaagacggaggacggcguuaauaugugcaccuugauggcaauggauuuaggggaacugugugaggacacuaucacuuacaaaugcccacuacucaggcaaaaugaaccggaggauauugacuguuggugcaauucuaccucaacaugggugaccuauggaacuuguacgaccacgggcgagcaccggcgcgaaaagcgaaguguagcccuggugccccaugucgguauggggcuugagacucguaccgaaacauggaugagcuccgagggagcguggaaacacgcucagagaaucgagacuuggauacugaggcauccuggcuucaccaucauggccgcaauuuuggccuacacaaucggcaccacgcacuuucagcgggcucucauuuucauccugcugacugcaguggccccaucuaugacaaugcgcugcauagggauuucgaacagagauuuuguugaaggagugucagguggcagcugggucgacaucgugcucgagcacgggaguuguguaaccacuauggcuaagaauaagcccacauuagauuucgaacugauuaaaaccgaggccaagcagccugcgacgcuuaggaaauauugcaucgaagcaaaguugaccaacacaacuaccgagucccgguguccaacacaaggagagcccucucugaaagaagaacaggacaagcgcuuuguuugcaagcauagcaugguggaucgaggcugggguaauggguguggacuauucggcaaaggcgggaucgucacuugcgccauguuuaccugcaagaaaaacauggaaggaaagauugugcagccugagaaucucgaauacacaauaguggucaccccacacuccggugaggagcaugcuguuggcaacgacacugggaaacacggaaaggaaaucaaagugacgccgcagucaaguauuacagaggccgaacugaccggcuaugguacuguaaccauggaguguagccccagaacaucucuugauuucaaugaaauggugcuguugcaaauggagaacaaggcauggcucguccacaggcagugguuucuggacuuaccucugccauggcuccccggggcugauaagcaggaguccaauuggauccagaaagaaacccuugugacuuucaagaacccucaugccaaaaagcaagacguugugguccugggcucacaggagggagcgaugcacacagccuugacgggcgcaaccgaaauacagaugagcagugggaaucuacuguuuacuggacaucucaaaugccggcugcguauggacaaacuucaacugaaggguaugucuuacuccauguguacaggcaaauucaaggugguaaaagagauugcugagacccagcacgggacaaucguuauccgcgugcaguaugaaggagauggcagcccaugcaagauucccuucgagaucauggacuuggagaagagauacguccucgguaggcugauuacugugaacccgauagucaccgagaaggauucgccugugaacaucgaagccgagcccccauuuggggacucuuacauuaucaucggcguugagccuggacaguuaaagcugaauugguucaaaaagggcuccucaauugggcaaauguuugaaacgaccaugcggggagcuaaacgaauggccauacuaggugauacagcaugggacuucggcagucucgggggaguguuuacuagcaucggcaaggcccugcaucagguauucggugcuauuuauggggcggcauuuuccggcgucucuuggaccaugaaaauccuuauuggagugaucauaacauggaucggcaugaacagccgcucaacaaguuuguccguuagccuggugcucgucgggauugugacccuguaccuuggaguaauggugcaggccgauucuggcuguguugucucauggaagaauaaggagcugaaaugcgguagugggaucuucauuacggacaacgugcacacauggaccgaacaguauaaguuucaacccgagagcccauccaaauuggcuucugccauccagaaggcacaggaagagggaauauguggcauuagaucggugacuaggcucgagaaucugauguggaaacagaucacacccgaauuaaaccacauucuggccgagaaugaagucaagcuaaccaucaugacuggugauauaaaaggcaucaugcaagcugggaagcggagccuccgcccucagccaaccgagcugaaguacuccuggaaaacauggggaaaggccaaaaugcuuucaacggaaaguuauaaccagaccuucuugauugacggcccggagacugcagagugccccaauacaaacagagcguggaacucucuggaaguugaggauuacggguuuggaguguucaccacaaacaucuggcucaagcugaaagaaaagcaggacgcuuuuugugacagcaaguuaauguccgccgcaauuaaagauaauagggccgugcaugcugacaugggcuauuggaucgagucagcccugaacgauacuuggaagauagagaaagccagcuucauugaaguaaagaauugccacuggccuaaaucucauacccuuugguccaacggugucuuggagagugaaaugaucaucccaaagaaccucgcugggcccgugagccaacacaauuaccguccuggauaccacacgcagauugccggcccauggcaucuggguaagcuagagauggacuucgauuuuugugacggcacaaccguuaucgugacugaagauugcgggaaccggggacccucucugcgaaccacaacugcguccggcaaacucauuaccgaguggugcuguagaucaugcacacugccgccucuuagguaucgcggggaggacggauguugguacggcauggaaauacggccauugaaggagaaagaagagaaucuggucaacaguuuagugacggccggucacgggcagguugauaauuucagccucggagugcugggcauggcucuuuuucuggaagagauguugagaaccaggguagguacuaagcaugcaauccuccuggucgccgugucguucgugacacuaauuaccggcaacauguccuuuaaagaccuggggcgcgucguugugaugguaggagcuacuauggccgaugacaucggcaugggggugacauaucucgcacugcuugcggccuucaagguccgacccaccuuugcugccggauugcuguuacggaagcucacgucuaaagagcugaugaugacuaccauuggcaucgugcuucugagccaaucaacaauaccugaaaccauccuagagcucacugaugcacuggcuuuggguaugaugguucugaagauugugcguaauauggaaaaauaccaguuagccgucacaaucauggcaauucucugcgugcccaacgccguuauccugcagaaugcuuggaaggugaguuguaccauacuugcggucguauccgugucuccacuguugcucacaagcucccagcagaaaacugacuggauuccucuggcccuaaccaucaaggggcugaaccccacggcaaucuuccuuacaacccucucaagaacuaauaaaaagaggagcuggccacugaacgaggcuauuauggccguuggaauggugaguauauuggccucuucccuguuaaagaaugacaucccgaugaccggcccucucgucgcuggcgggcugcuuacagugugcuauguacugacuggacgcagcgcagauuuggaacucgagcgggccaccgacgugaaaugggaggaucaggcggaaauuucggguucaucucccauccugaguauuacgaucuccgaggacggcagcaugucuauaaagaacgaagaggaggaacagacacuaaccauccugauuagaacugggcuucucgucaucagcggacuguuuccaauuuccauccccauaacagcugccgcaugguacuugugggagguuaaaaagcagagggccggcguguuaugggaugugccuucaccacccccuauugguaaagcugaacuggaggacggggcauaucgaaucaagcaaaagggaauccucggcuacagucagauuggcgccggggucuacaaagaaggaaccuuccacacuauguggcaugugacacgcggugcgguucugaugcacaagggcaaacggaucgagccgagcugggcugauguaaagaaagaccuuauaucuuaugggggaggcuggaagcuggagggugaauggaaggagggggaagaggugcaggucuuggcccuagaaccaggcaaaaaucccagagcagugcagaccaagccuggccuguuuaaaacgaacacuggcaccauuggggccguuucccucgauuucucaccaggaacaagugguagccccaucauugacaagaaaggcaagguggucgggcuguacggaaacggcgugguaaccagguccggugcuuaugucucugccaucgcacaaacagagaagucgauagaggauaauccugaaauugaggacgauaucuuucguaaacgccggcuuacuaucauggacuuacacccgggggcuggaaagaccaaaagauaccugcccgccauugugagggaagcgaucaagcgaggccuccggacguugauucuggccccaacacgcguuguggcagcugagauggaagaggcccucagaggccugccuauaagguaucagacucccgcuauccgggcagagcauaccgggcgagaaauugucgaccuuaugugucacgccacauucaccaugagacuguugagcccagugcgcguuccuaacuacaaucuaaucaucauggaugaggcccauuucacugaccccgcuucaauugcggcaaggggauauauauccacccguguggaaaugggugaggccgcuggcaucuuuaugacagccacgccaccggggagucgggauccuuucccccagucuaacgcaccaauuaucgacgaggaaagagagauucccgaaaggagcuggaacuccggacacgagugggucacugauuuuaaaggcaagaccgugugguucguaccuucaaucaaggccgguaacgacauagcugcgugccugcgcaaaaaugggaagaaagugauccaacucucucgaaagacauuugauagcgaauacguuaaaaccagaacuaacgacugggauuucgucgugacaaccgacauuagugagaugggagccaauuuuaaggcagagcgggugaucgauccaaggcgcuguaugaaacccgucauuuuaacggacggcgaagaacguguaauccuggcuggcccuaugccggugacucauuccagcgccgcacagagacgggggaggauaggacgcaacccaaagaaugaaaacgaccaguacauuuauaugggugagccccuugaaaaugaugaggacugcgcccacuggaaggaggcuaaaaugcugcucgauaacaucaauacaccugaaggcauuauccccucuauguucgagccagaacgagagaagguugacgccauagauggggaauacagauugcggggagaggcgaggaaaaccuuuguggaccugaugcgcagaggcgaucucccugucuggcuggcauucaagguggccgcugaggguaucaacuaugccgacaggcggugguguuuugaugggauuaaaaacaaucagauccuugaagagaacguugaaguggagauuuggaccaaggagggcgaacguaagaaacuaaagccccgcuggcuggacgcucgaaucuacucagauccauuggcauuaaaagaguucaaggaguucgccgcuggaagaaaaucccugacucucaaucugauaacagagaugggcaggcuuccuaccuuuaugacacaaaagacucgggacgcccuggauaaccucgcagucuugcacacggcggaagccgggggacgcgcuuauaaucaugcccugagugagcuaccggagacccuggaaacacuccuucuguuaacuuugcuggcaaccgugacagguggcauuuuccucuuucugaugagcgggagaggaaucggcaagaugacccuugguaugugcugcaucauuacugcuucgauccugcucugguacgcccagauacagccccacuggauugcagccucuaucauuuuggaguucuuucugaucguauuacuaauaccagaaccugagaaacagaggacgccccaagacaaccagcugaccuaugugguuaucgcuauucucacagucguggcggccacuauggcaaaugaaaugggguuccuugagaagaccaaaaaggaccugggcuugggauccaucgcuacacagcagccagagagcaacauucuggauaucgaccuccggccugccucagccuggacccuguacgcaguggcuacuacauuugucacgcccaugcuucgacauaguauugaaaauucuuccguuaacgugagccucaccgccaucgcgaaucaagcuacuguacugaugggcuuggggaaaggauggccgcugucaaagauggauauaggugugccauuacuagccauuggcuguuacagucaggucaacccuaucacacugaccgcagcccuccuucuguugguggcucacuaugcaaucauugggcccggacugcaggccaaggcgaccagagaggcucagaaacgcgccgcagccggcauaaugaagaauccaacaguugacgguaucacugugauugaucucgaccccaucccuuacgauccgaaauucgaaaagcaacuggggcaggucaugcuuuuaauucugugcguaacacaggugcucaugaugaggaccacaugggcuuugugugaggcccugacucuagcaaccggccccaucagcacacugugggaaggaaacccaggccgguuuuggaauaccacuauagcuguuuccauggccaacaucuuccgugggucuuaucucgcgggagccggccuucuguuuagcauuaugaaaaauacgacaaacaccagaagggguacugggaacaucggagagaccuugggcgagaaguggaaaucccgccugaaugcacucgguaagucagaguuccaaauuuacaagaaaucuggcauccaggagguggaccggacacuggcuaaggaagggauaaaacgaggagagacugaucaccaugccgucaguagaggcucggcaaaguuaaggugguuuguggagcgcaacauggucaccccugaagggaaagugguugaccuuggaugcggccgggguggguggagcuauuacuguggaggccugaagaaugugagagagguaaagggucucacaaaaggcgggcccggacacgaagaaccuauuccaauguccacguauggcuggaaccuagugcgucugcagucuggggucgauguuuucuucauacccccugaaaagugcgacaccuugcugugugauaucggagagucaagcccaaaucccacuguggaggcuggcaggacacuccggguccuuaaccugguggaaaauugguugaacaauaacacccaguuuugcauuaaaguacugaauccguacaugccuuccgugauagagaagauggaagcccuccaacgcaaauacgguggggccuuaguucgaaacccacugaguagaaauucuacucaugagauguauugggugagcaacgcgucaggaaauaucgucuccagugugaacaugauuagcaggaugcuuaucaaccgguucacaaugcgccacaagaaggcuaccuacgaacccgacgucgaccugggcucuggcacgagaaauauugggaucgaguccgagauaccuaaccuagauaucauuggaaaaaggaucgaaaagauuaaacaggagcaugaaaccucauggcacuaugaccaggaucacccauacaagacaugggcauaucaugguagcuacgagacuaaacagaccggcucggccucuaguauggugaaugggguuguacgacuccugacaaagcccugggacguguugccgacugucacccaaauggcuaugacagauaccacuccuuuuggacagcagcggguguucaaggaaaaaguugacacgcguacacaggagcccaaggagggcaccaaaaagcugaugaaaaucacugccgaauggcucuggaaggagcuugguaaaaagaagaccccaagaauguguacacgcgaagaguuuacgaggaaagugcgguccaacgcagcccugggggcuauuuucaccgaugagaauaaguggaaaagcgcgagagaagccgucgaggacucacgcuuuugggaauuaguggauaaggagaggaaccugcacuuggaaggaaaaugcgagacuuguguauauaauaugaugggcaagcgagagaagaaacucggcgaguucgggaaggcaaaaggaucccgggcuauaugguacauguggcugggugccagauuucuagaguucgaagcacuuggcuuucugaacgaggaccauugguucucuagggaaaauagccucagugggguggagggagagggccugcacaaguuggguuacauccugcgcgauguuuccaaaaaggaagggggagccauguaugcugacgacacagccggcugggauacccguauuacucucgaggaccuuaagaacgaagagauggucacaaaucacauggaaggcgagcauaaaaagcuggcggaggcaaucuuuaaauuaaccuaccaaaacaagguggugcggguccagagaccuacacccagggggacuguuauggauaucauuagccgccgagaccagcggggaucuggucaagugggcaccuaugggcugaauacguucaccaacauggaagcccaguugauaagacagauggagggagaaggcguauucaaaaauauccagcaccucacagugacugaggaggucgcugugcaaaacuggcuggccaggguuggucgcgaaagacuaucacggauggcaauuaguggggaugacugcguggucaagccacuugaugacagguuugcuaacgcccugaccgcucucaaugauaugggaaagauccguaaagacauucagcagugggagcccuccaagggcuggaacgauuggacacaggugccuuucugcagccaucacuuucaugaacugaucaugaaagacggccgaguauugguugugccaugucgcaaucaagaugaguuaauagggagagcccggaucucucagggagcagguuggucgcugagggaaacugcgugccucggcaagucauacgcccagauguggagccuuauguauuuccaccgcagagaccugcggcuagcugccaacgcaauuuguuccgcugucccgagucacugggugcccaccucuaggacgacauggagcauccaugccaaacacgaguggaugaccacugaggacaugcugacaguguggaaucgagucuggauucgugaaaacccuuggauggaggauaagaccccaguugaauccugggaggaaauccccuaccucgggaagagagaggaccaguggugcggaucauugauaggccugacaagucgcgcaaccugggccaaaaauauucaagcggcuaucaaccaggugcggucucuuauugguaaugaggaauauacagauuacaugccuagcaugaagagguuuagacgcgaggaagaggaagccgggguacugugguga

SEQ ID NO: 14606 - RNA, 9876 nt, Artificial Sequence
  derived and/or modified CDS sequence (opt3) from DENV-2__FJ810411__SS-prME
agcgcaggaaugaucauuaugcugauccccaccgugauggcuuuccaccucacuacuagaaauggggaaccucauaugaucgucgguauucaagaaaagggaaaaucccuucuguuuaagacggaggacggcguuaauaugugcaccuugauggcaauggauuuaggggaacugugugaggacacuaucacuuacaaaugcccacuacucaggcaaaaugaaccggaggauauugacuguuggugcaauucuaccucaacaugggugaccuauggaacuuguacgaccacgggcgagcaccggcgcgaaaagcgaaguguagcccuggugccccaugucgguauggggcuugagacucguaccgaaacauggaugagcuccgagggagcguggaaacacgcucagagaaucgagacuuggauacugaggcauccuggcuucaccaucauggccgcaauuuuggccuacacaaucggcaccacgcacuuucagcgggcucucauuuucauccugcugacugcaguggccccaucuaugacaaugcgcugcauagggauuucgaacagagauuuuguugaaggagugucagguggcagcugggucgacaucgugcucgagcacgggaguuguguaaccacuauggcuaagaauaagcccacauuagauuucgaacugauuaaaaccgaggccaagcagccugcgacgcuuaggaaauauugcaucgaagcaaaguugaccaacacaacuaccgagucccgguguccaacacaaggagagcccucucugaaagaagaacaggacaagcgcuuuguuugcaagcauagcaugguggaucgaggcugggguaauggguguggacuauucggcaaaggcgggaucgucacuugcgccauguuuaccugcaagaaaaacauggaaggaaagauugugcagccugagaaucucgaauacacaauaguggucaccccacacuccggugaggagcaugcuguuggcaacgacacugggaaacacggaaaggaaaucaaagugacgccgcagucaaguauuacagaggccgaacugaccggcuaugguacuguaaccauggaguguagccccagaacaucucuugauuucaaugaaauggugcuguugcaaauggagaacaaggcauggcucguccacaggcagugguuucuggacuuaccucugccauggcuccccggggcugauaagcaggaguccaauuggauccagaaagaaacccuugugacuuucaagaacccucaugccaaaaagcaagacguugugguccugggcucacaggagggagcgaugcacacagccuugacgggcgcaaccgaaauacagaugagcagugggaaucuacuguuuacuggacaucucaaaugccggcugcguauggacaaacuucaacugaaggguaugucuuacuccauguguacaggcaaauucaaggugguaaaagagauugcugagacccagcacgggacaaucguuauccgcgugcaguaugaaggagauggcagcccaugcaagauucccuucgagaucauggacuuggagaagagauacguccucgguaggcugauuacugugaacccgauagucaccgagaaggauucgccugugaacaucgaagccgagcccccauuuggggacucuuacauuaucaucggcguugagccuggacaguuaaagcugaauugguucaaaaagggcuccucaauugggcaaauguuugaaacgaccaugcggggagcuaaacgaauggccauacuaggugauacagcaugggacuucggcagucucgggggaguguuuacuagcaucggcaaggcccugcaucagguauucggugcuauuuauggggcggcauuuuccggcgucucuuggaccaugaaaauccuuauuggagugaucauaacauggaucggcaugaacagccgcucaacaaguuuguccguuagccuggugcucgucgggauugugacccuguaccuuggaguaauggugcaggccgauucuggcuguguugucucauggaagaauaaggagcugaaaugcgguagugggaucuucauuacggacaacgugcacacauggaccgaacaguauaaguuucaacccgagagcccauccaaauuggcuucugccauccagaaggcacaggaagagggaauauguggcauuagaucggugacuaggcucgagaaucugauguggaaacagaucacacccgaauuaaaccacauucuggccgagaaugaagucaagcuaaccaucaugacuggugauauaaaaggcaucaugcaagcugggaagcggagccuccgcccucagccaaccgagcugaaguacuccuggaaaacauggggaaaggccaaaaugcuuucaacggaaaguuauaaccagaccuucuugauugacggcccggagacugcagagugccccaauacaaacagagcguggaacucucuggaaguugaggauuacggguuuggaguguucaccacaaacaucuggcucaagcugaaagaaaagcaggacgcuuuuugugacagcaaguuaauguccgccgcaauuaaagauaauagggccgugcaugcugacaugggcuauuggaucgagucagcccugaacgauacuuggaagauagagaaagccagcuucauugaaguaaagaauugccacuggccuaaaucucauacccuuugguccaacggugucuuggagagugaaaugaucaucccaaagaaccucgcugggcccgugagccaacacaauuaccguccuggauaccacacgcagauugccggcccauggcaucuggguaagcuagagauggacuucgauuuuugugacggcacaaccguuaucgugacugaagauugcgggaaccggggacccucucugcgaaccacaacugcguccggcaaacucauuaccgaguggugcuguagaucaugcacacugccgccucuuagguaucgcggggaggacggauguugguacggcauggaaauacggccauugaaggagaaagaagagaaucuggucaacaguuuagugacggccggucacgggcagguugauaauuucagccucggagugcugggcauggcucuuuuucuggaagagauguugagaaccaggguagguacuaagcaugcaauccuccuggucgccgugucguucgugacacuaauuaccggcaacauguccuuuaaagaccuggggcgcgucguugugaugguaggagcuacuauggccgaugacaucggcaugggggugacauaucucgcacugcuugcggccuucaagguccgacccaccuuugcugccggauugcuguuacggaagcucacgucuaaagagcugaugaugacuaccauuggcaucgugcuucugagccaaucaacaauaccugaaaccauccuagagcucacugaugcacuggcuuuggguaugaugguucugaagauugugcguaauauggaaaaauaccaguuagccgucacaaucauggcaauucucugcgugcccaacgccguuauccugcagaaugcuuggaaggugaguuguaccauacuugcggucguauccgugucuccacuguugcucacaagcucccagcagaagacugacuggauuccucuggcccuaaccaucaaggggcugaaccccacggcaaucuuccuuacaacccucucaagaacuaauaaaaagaggagcuggccacugaacgaggcuauuauggccguuggaauggugaguauauuggccucuucccuguuaaagaaugacaucccgaugaccggcccucucgucgcuggcgggcugcuuacagugugcuauguacugacuggacgcagcgcagauuuggaacucgagcgggccaccgacgugaaaugggaggaucaggcggaaauuucggguucaucucccauccugaguauuacgaucuccgaggacggcagcaugucuauaaagaacgaagaggaggaacagacacuaaccauccugauuagaacugggcuucucgucaucagcggacuguuuccaauuuccauccccauaacagcugccgcaugguacuugugggagguuaaaaagcagagggccggcguguuaugggaugugccuucaccacccccuauugguaaagcugaacuggaggacggggcauaucgaaucaagcaaaagggaauccucggcuacagucagauuggcgccggggucuacaaagaaggaaccuuccacacuauguggcaugugacacgcggugcgguucugaugcacaagggcaaacggaucgagccgagcugggcugauguaaagaaagaccuuauaucuuaugggggaggcuggaagcuggagggugaauggaaggagggggaagaggugcaggucuuggcccuagaaccaggcaaaaaucccagagcagugcagaccaagccuggccuguuuaaaacgaacacuggcaccauuggggccguuucccucgauuucucaccaggaacaagugguagccccaucauugacaagaaaggcaagguggucgggcuguacggaaacggcgugguaaccagguccggugcuuaugucucugccaucgcacaaacagagaagucgauagaggauaauccugaaauugaggacgauaucuuucguaaacgccggcuuacuaucauggacuuacacccgggggcuggaaagaccaaaagauaccugcccgccauugugagggaagcgaucaagcgaggccuccggacguugauucuggccccaacacgcguuguggcagcugagauggaagaggcccucagaggccugccuauaagguaucagacucccgcuauccgggcagagcauaccgggcgagaaauugucgaccuuaugugucacgccacauucaccaugagacuguugagcccagugcgcguuccuaacuacaaucuaaucaucauggaugaggcccauuucacugaccccgcuucaauugcggcaaggggauauauauccacccguguggaaaugggugaggccgcuggcaucuuuaugacagccacgccaccggggagucgggauccuuucccccagucuaacgcaccaauuaucgacgaggaaagagagauucccgaaaggagcuggaacuccggacacgagugggucacugauuuuaaaggcaagaccgugugguucguaccuucaaucaaggccgguaacgacauagcugcgugccugcgcaaaaaugggaagaaagugauccaacucucucgaaagacauuugauagcgaauacguuaaaaccagaacuaacgacugggauuucgucgugacaaccgacauuagugagaugggagccaauuuuaaggcagagcgggugaucgauccaaggcgcuguaugaaacccgucauuuuaacggacggcgaagaacguguaauccuggcuggcccuaugccggugacucauuccagcgccgcacagagacgggggaggauaggacgcaacccaaagaaugaaaacgaccaguacauuuauaugggugagccccuugaaaaugaugaggacugcgcccacuggaaggaggcuaaaaugcugcucgauaacaucaauacaccugaaggcauuauccccucuauguucgagccagaacgagagaagguugacgccauagauggggaauacagauugcggggagaggcgaggaaaaccuuuguggaccugaugcgcagaggcgaucucccugucuggcuggcauucaagguggccgcugaggguaucaacuaugccgacaggcggugguguuuugaugggauuaaaaacaaucagauccuugaagagaacguugaaguggagauuuggaccaaggagggcgaacguaagaaacuaaagccccgcuggcuggacgcucgaaucuacucagauccauuggcauuaaaagaguucaaggaguucgccgcuggaagaaaaucccugacucucaaucugauaacagagaugggcaggcuuccuaccuuuaugacacaaaagacucgggacgcccuggauaaccucgcagucuugcacacggcggaagccgggggacgcgcuuauaaucaugcccugagugagcuaccggagacccuggaaacacuccuucuguuaacuuugcuggcaaccgugacagguggcauuuuccucuuucugaugagcgggagaggaaucggcaagaugacccuugguaugugcugcaucauuacugcuucgauccugcucugguacgcccagauacagccccacuggauugcagccucuaucauuuuggaguucuuucugaucguauuacuaauaccagaaccugagaaacagaggacgccccaagacaaccagcugaccuaugugguuaucgcuauucucacagucguggcggccacuauggcaaaugaaaugggguuccuugagaagaccaaaaaggaccugggcuugggauccaucgcuacacagcagccagagagcaacauucuggauaucgaccuccggccugccucagccuggacccuguacgcaguggcuacuacauuugucacgcccaugcuucgacauaguauugaaaauucuuccguuaacgugagccucaccgccaucgcgaaucaagcuacuguacugaugggcuuggggaaaggauggccgcugucaaagauggauauaggugugccauuacuagccauuggcuguuacagucaggucaacccuaucacacugaccgcagcccuccuucuguugguggcucacuaugcaaucauugggcccggacugcaggccaaggcgaccagagaggcucagaaacgcgccgcagccggcauaaugaagaauccaacaguugacgguaucacugugauugaucucgaccccaucccuuacgauccgaaauucgaaaagcaacuggggcaggucaugcuuuuaauucugugcguaacacaggugcucaugaugaggaccacaugggcuuugugugaggcccugacucuagcaaccggccccaucagcacacugugggaaggaaacccaggccgguuuuggaauaccacuauagcuguuuccauggccaacaucuuccgugggucuuaucucgcgggagccggccuucuguuuagcauuaugaaaaauacgacaaacaccagaagggguacugggaacaucggagagaccuugggcgagaaguggaaaucccgccugaaugcacucgguaagucagaguuccaaauuuacaagaaaucuggcauccaggagguggaccggacacuggcuaaggaagggauaaaacgaggagagacugaucaccaugccgucaguagaggcucggcaaaguuaaggugguuuguggagcgcaacauggucaccccugaagggaaagugguugaccuuggaugcggccgggguggguggagcuauuacuguggaggccugaagaaugugagagagguaaagggucucacaaaaggcgggcccggacacgaagaaccuauuccaauguccacguauggcuggaaccuagugcgucugcagucuggggucgauguuuucuucauacccccugaaaagugcgacaccuugcugugugauaucggagagucaagcccaaaucccacuguggaggcuggcaggacacuccggguccuuaaccugguggaaaauugguugaacaauaacacccaguuuugcauuaaaguacugaauccguacaugccuuccgugauagagaagauggaagcccuccaacgcaaauacgguggggccuuaguucgaaacccacugaguagaaauucuacucaugagauguauugggugagcaacgcgucaggaaauaucgucuccagugugaacaugauuagcaggaugcuuaucaaccgguucacaaugcgccacaagaaggcuaccuacgaacccgacgucgaccugggcucuggcacgagaaauauugggaucgaguccgagauaccuaaccuagauaucauuggaaaaaggaucgaaaagauuaaacaggagcaugaaaccucauggcacuaugaccaggaucacccauacaagacaugggcauaucaugguagcuacgagacuaaacagaccggcucggccucuaguauggugaaugggguuguacgacuccugacaaagcccugggacguguugccgacugucacccaaauggcuaugacagauaccacuccuuuuggacagcagcggguguucaaggaaaaaguugacacgcguacacaggagcccaaggagggcaccaaaaagcugaugaaaaucacugccgaauggcucuggaaggagcuugguaaaaagaagaccccaagaauguguacacgcgaagaguuuacgaaaaaggugagguccaacgcagcccugggggcuauuuucaccgaugagaauaaauggaaaagcgcgcgggaagccgucgaggacucaagauuuugggaauuaguggauaaagagcgcaaccugcacuuggaaggaaagugcgagacuuguguauauaauaugaugggcaagagggagaaaaagcucggcgaguucgggaaagcaaagggaucccgagcuauaugguacauguggcugggugcccgguuucuagaguucgaagcacuuggcuuucugaacgaggaccauugguucucuagagaaaauagccucagugggguggagggagagggccugcacaaauuggguuacauccugagggauguuuccaagaaggaagggggagccauguaugcugacgacacagccggcugggauacccgcauuacucucgaggaccuuaaaaacgaagagauggucacaaaucacauggaaggcgagcauaagaaacuggcggaggcaaucuuuaaguuaaccuaccaaaacaaaguggugcguguccagcggccuacacccagagggacuguuauggauaucauuagcaggcgcgaccagcgaggaucuggucaagugggcaccuaugggcugaauacguucaccaacauggaagcccaguugauacggcagauggagggagaaggcguauucaagaauauccagcaccucacagugacugaggaggucgcugugcaaaacuggcuggccagaguugguagggaacgccuaucaagaauggcaauuaguggggaugacugcguggucaagccacuugaugaccgguuugcuaacgcccugaccgcucucaaugauaugggaaaaaucaggaaggacauucagcagugggagcccuccaaaggcuggaacgauuggacacaggugccuuucugcagccaucacuuucaugaacugaucaugaaggacggccguguauugguugugccaugucgaaaucaagaugaguuaauagggcgcgccagaaucucucagggagcagguuggucgcugcgggaaacugcgugccucggcaaaucauacgcccagauguggagccuuauguauuuccacaggcgcgaccugagacuagcugccaacgcaauuuguuccgcugucccgagucacugggugcccaccucucggacgacauggagcauccaugccaagcacgaguggaugaccacugaggacaugcugacaguguggaauagggucuggauucgagaaaacccuuggauggaggauaagaccccaguugaauccugggaggaaauccccuaccucgggaaacgugaggaccaguggugcggaucauugauaggccugacaaguagagcaaccugggccaagaauauucaagcggcuaucaaccaggugcgcucucuuauugguaaugaggaauauacagauuacaugccuagcaugaaacgguuuaggagagaggaagaggaagccgggguacugugguga

SEQ ID NO: 14607 - RNA, 9876 nt, Artificial Sequence
  derived and/or modified CDS sequence (opt3) from DENV-2__FJ744713__SS-prME
agcgcaggaaugaucauuaugcugauccccaccgugauggcuuuccaccucacaacuagaaauggggaaccucauaugaucgucgguauucaagaaaagggaaaaucccuucuguuuaagacggaggacggcguuaauaugugcaccuugauggcaauggauuuaggggaacugugugaggacacaaucacuuacaaaugcccacuacucaggcaaaaugaaccggaggauauugacuguuggugcaauucuaccucaacaugggugaccuauggaacuuguacaaccacgggcgagcaccggcgcgaaaagcgaaguguagcccuggugccccaugucgguauggggcuugagacucguaccgaaacauggaugagcuccgagggagcguggaaacacgcucagagaaucgagacuuggauacugaggcauccuggcuucaccaucauggccgcaauuuuggccuacacaaucggcaccacgcacuuucagcgggcucucauuuucauccugcugacugcaguggccccaucuaugacaaugcgcugcauagggauuucgaacagagauuuuguugaaggagugucagguggcagcugggucgacaucgugcucgagcacgggaguuguguaaccacuauggcuaagaauaagcccacauuagauuucgaacugauuaaaaccgaggccaagcagccugcgacgcuuaggaaauauugcaucgaagcaaaguugaccaacacaacuaccgagucccgguguccaacacaaggagagcccucucugaaagaagaacaggacaagcgcuuuguuugcaagcauagcaugguggaucgaggcugggguaauggguguggacuauucggcaaaggcgggaucgucacuugcgccauguuuaccugcaagaaaaacauggaaggaaagauugugcagccugagaaucucgaauacacaauaguggucaccccacacuccggugaggagcaugcuguuggcaacgacacugggaaacacggaaaggaaaucaaagugacgccgcagucaaguauuacagaggccgaacugaccggcuaugguacuguaaccauggaguguagccccagaacaucucuugauuucaaugaaauggugcuguugcaaauggagaacaaggcauggcucguccacaggcagugguuucuggacuuaccucugccauggcuccccggggcugauaagcaggaguccaauuggauccagaaagaaacccuugugacuuucaagaacccucaugccaaaaagcaagacguugugguccugggcucacaggagggagcgaugcacacagccuugacgggcgcaaccgaaauacagaugagcagugggaaucuacuguuuacuggacaucucaaaugccggcugcguauggacaaacuucaacugaaggguaugucuuacuccauguguacaggcaaauucaaggugguaaaagagauugcugagacccagcacgggacaaucguuauccgcgugcaguaugaaggagauggcagcccaugcaagauucccuucgagaucauggacuuggagaagagauacguccucgguaggcugauuacugugaacccgauagucaccgagaaggauucgccugugaacaucgaagccgagcccccauuuggggacucuuacauuaucaucggcguugagccuggacaguuaaagcugaauugguucaaaaagggcuccucaauugggcaaauguuugaaacgaccaugcggggagcuaaacgaauggccauacuaggugauacagcaugggacuucggcagucucgggggaguguuuacuagcaucggcaaggcccugcaucagguauucggugcuauuuauggggcggcauuuuccggcgucucuuggaccaugaaaauccuuauuggagugaucauaacauggaucggcaugaacagccgcucaacaaguuuguccguuagccuggugcucgucgggauugugacccuguaccuuggaguaauggugcaggccgauucuggcuguguugucucauggaagaauaaggagcugaaaugcgguagugggaucuucauuacggacaacgugcacacauggaccgaacaguauaaguuucaacccgagagcccauccaaauuggcuucugccauccagaaggcacaggaagagggaauauguggcauuagaucggugacuaggcucgagaaucugauguggaaacagaucacacccgaauuaaaccacauucuggccgagaaugaagucaagcuaaccaucaugacuggugauauaaaaggcaucaugcaagcugggaagcggagccuccgcccucagccaaccgagcugaaguacuccuggaaaacauggggaaaggccaaaaugcuuucaacggaaaguuauaaccagaccuucuugauugacggcccggagacugcagagugccccaauacaaacagagcguggaacucucuggaaguugaggauuacggguuuggaguguucaccacaaacaucuggcucaagcugaaagaaaagcaggacgcuuuuugugacagcaaguuaauguccgccgcaauuaaagauaauagggccgugcaugcugacaugggcuauuggaucgagucagcccugaacgauacuuggaagauagagaaagccagcuucauugaaguaaagaauugccacuggccuaaaucucauacccuuugguccaacggugucuuggagagugaaaugaucaucccaaagaaccucgcugggcccgugagccaacacaauuaccguccuggauaccacacgcagauugccggcccauggcaucuggguaagcuagagauggacuucgauuuuugugacggcacaaccguuaucgugacugaagauugcgggaaccggggacccucucugcgaaccacaacugcguccggcaaacucauuaccgaguggugcuguagaucaugcacacugccgccucuuagguaucgcggggaggacggauguugguacggcauggaaauacggccauugaaggagaaagaagagaaucuggucaacaguuuagugacggccggucacgggcagguugauaauuucagccucggagugcugggcauggcucuuuuucuggaagagauguugagaaccaggguagguacuaagcaugcaauccuccuggucgccgugucguucgugacacuaauuaccggcaacauguccuuuaaagaccuggggcgcgucguugugaugguaggagcuacuauggccgaugacaucggcaugggggugacauaucucgcacugcuugcggccuucaagguccgacccaccuuugcugccggauugcuguuacggaagcucacgucuaaagagcugaugaugacuaccauuggcaucgugcuucugagccaaucaacaauaccugaaaccauccuagagcucacugaugcacuggcuuuggguaugaugguucugaagauugugcguaauauggaaaaauaccaguuagccgucacaaucauggcaauucucugcgugcccaacgccguuauccugcagaaugcuuggaaggugaguuguaccauacuugcggucguauccgugucuccacuguugcucacaagcucccagcagaaaacugacuggauuccucuggcccuaaccaucaaggggcugaaccccacggcaaucuuccuuacaacccucucaagaacuaauaaaaagaggagcuggccacugaacgaggcuauuauggccguuggaauggugaguauauuggccucuucccuguuaaagaaugacaucccgaugaccggcccucucgucgcuggcgggcugcuuacagugugcuauguacugacuggacgcagcgcagauuuggaacucgagcgggccaccgacgugaaaugggaggaucaggcggaaauuucggguucaucucccauccugaguauuacgaucuccgaggacggcagcaugucuauaaagaacgaagaggaggaacagauccuaacaauucugaucagaaccgggcuucucgucauuagcggacuguuuccaaucuccauacccauuacugcugccgcaugguacuugugggagguuaaaaagcagagggccggcguguuaugggaugugccuucaccacccccuaucgguaaagcugaacuggaggacggggcauaucgaaucaagcaaaagggcauucucggauacagucagaucggcgccggggucuacaaagaaggaacauuccacaccauguggcaugugacucgcggugcgguucugaugcacaagggcaaacggauagagccgagcugggcugauguaaagaaagaccuuauuucuuaugggggaggcuggaagcuggagggugaauggaaggagggggaagaggugcaggucuuggcccuagaaccaggcaaaaaucccagagcagugcagacaaagccuggccuguuuaaaaccaacacgggcacuaucggggccguuucccucgauuucucaccaggaaccagugguagccccauuaucgacaagaaaggcaagguggucgggcuguacggaaacggcgugguaacaagguccggugcuuaugucucugccauagcacaaaccgagaagucgauugaggauaauccugaaaucgaggacgauaucuuucguaaacgccggcuuacaauuauggacuuacacccgggggcuggaaagacuaaaagauaccugcccgccaucgugagggaagcgauuaagcgaggccuccggaccuugauacuggccccaacgcgcguuguggcagcugagauggaagaggcccucagaggccugccuaucagguaucagacacccgcuauucgggcagagcauacugggcgagaaaucgucgaccuuaugugucacgccaccuucacaaugagacuguugagcccagugcgcguuccuaacuacaaucuaaucauuauggaugaggcccauuucaccgaccccgcuucaauagcggcaaggggauauaucuccacucguguggaaaugggugaggccgcuggcauuuuuaugaccgccacaccaccggggagucgggauccuuucccccagucuaacgcaccaaucauugacgaggaaagagagauccccgaaaggagcuggaacuccggacacgagugggucacggauuuuaaaggcaagacugugugguucguaccuucaauaaaggccgguaacgacaucgcugcgugccugcgcaaaaaugggaagaaagugauucaacucucucgaaagaccuuugauagcgaauacguuaaaacaagaaccaacgacugggauuucgucgugacuacagacaucagugagaugggagccaauuuuaaggcagagcgggugauugauccaaggcgcuguaugaaacccgucaucuuaaccgacggcgaagaacguguaauacuggcuggcccuaugccggugacgcauuccagcgccgcacagagacgggggaggauuggacgcaacccaaagaaugaaaacgaccaguacaucuauaugggugagccccuugaaaaugaugaggacugcgcccacuggaaggaggcuaaaaugcugcucgauaacauuaauacuccugaaggcaucauacccucuauguucgagccagaacgagagaagguugacgccaucgauggggaauacagauugcggggagaggcgaggaaaacauuuguggaccugaugcgcagaggcgaucucccugucuggcuggcauucaagguggccgcugaggguauuaacuaugccgacaggcggugguguuuugaugggaucaaaaacaaucagauucuugaagagaacguugaaguggagaucuggaccaaggagggcgaacguaagaaacuaaagccccgcuggcuggacgcucgaauauacucagauccauuggcauuaaaagaguucaaggaguucgccgcuggaagaaaaucccugacccucaaucugauuacugagaugggcaggcuuccuacauuuaugacccaaaagacacgggacgcccuggauaaccucgcagucuugcacacugcggaagccgggggacgcgcuuauaaucaugcccugagugagcuaccggagacgcuggaaacccuccuucuguuaacauugcuggcaacugugaccgguggcaucuuccucuuucugaugagcgggagaggaaucggcaagaugacacuugguaugugcugcauuaucaccgcuucgauacugcucugguacgcccagauucagccccacuggaucgcagccucuauuaucuuggaguucuuucugauaguauuacuaaucccagaaccugagaaacagaggacuccccaagacaaccagcugacguaugugguuauugcuauccucaccgucguggcggccacaauggcaaaugaaaugggguuccuugagaagacuaaaaaggaccugggcuugggauccauugcuacccagcagccagagagcaacauccuggauauugaccuccggccugccucagccuggacacuguacgcaguggcuaccacuuuugucacacccaugcuucgacauaguaucgaaaauucuuccguuaacgugagccucacggccauagcgaaucaagcuaccguacugaugggcuuggggaaaggauggccgcugucaaagauggauauuggugugccauuacuagccaucggcuguuacagucaggucaacccuaucacucugacagcagcccuccuucuguugguggcucacuaugcaauuauagggcccggacugcaggccaaggcgaccagagaggcucagaaacgcgccgcagccggcaucaugaagaauccaaccguugacgguauuacagugaucgaucucgaccccauuccuuacgauccgaaauucgaaaagcaacuggggcaggucaugcuuuuaauccugugcguaacucaggugcucaugaugaggacgaccugggcuuugugugaggcccugacacuagcaacuggccccauaagcacccugugggaaggaaacccaggccgguuuuggaauacaaccaucgcuguuuccauggccaacauuuuccgugggucuuaucucgcgggagccggccuucuguuuagcaucaugaaaaauacuacgaacacaagaagggguaccgggaacauuggagagacuuugggcgagaaguggaaaucccgccugaaugcacucgguaagucagaguuccaaaucuacaagaaaucuggcauacaggagguggaccggacccuggcuaaggaagggauuaaacgaggagagacagaucaccaugccgucaguagaggcucggcaaaguuaaggugguuuguggagcgcaacauggucacuccugaagggaaagugguugaccuuggaugcggccgggguggguggagcuauuacuguggaggccugaagaaugugagagagguaaagggucucaccaaaggcgggcccggacacgaagaaccuaucccaauguccacauauggcuggaaccuagugcgucugcagucuggggucgauguuuucuucauacccccugaaaagugcgacacguugcugugugauauuggagagucaagcccaaaucccaccguggaggcuggcaggacucuccggguccuuaaccugguggaaaauugguugaacaauaacacacaguuuugcauaaaaguacugaauccguacaugccuuccgugaucgagaagauggaagcccuccaacgcaaauacgguggggccuuaguucgaaacccacugaguagaaauucuacccaugagauguauugggugagcaacgcgucaggaaauauugucuccagugugaacaugaucagcaggaugcuuauuaaccgguucacuaugcgccacaagaaggcuacauacgaacccgacgucgaccugggcucuggcaccagaaauaucgggauagaguccgagaucccuaaccuagauauuaucggaaaaaggauugaaaagaucaaacaggagcaugaaacgucauggcacuaugaccaggaucacccauacaagaccugggcauaucaugguagcuacgagacaaaacagacuggcucggccucuaguauggugaaugggguuguacgacuccugaccaagcccugggacguguugccgacagucacucaaauggcuaugaccgauacaaccccuuuuggacagcagcggguguucaaggaaaaaguugacacucguacgcaggagcccaaggagggcacuaaaaagcugaugaaaauuaccgccgaauggcucuggaaggagcuugguaaaaagaagacuccaagaauguguacccgcgaagaguuuacaaggaaagugcgguccaacgcagcccugggggcuauauucacggaugagaauaaguggaaaagcgcgagagaagccgucgaggacucacgcuuuugggaauuaguggauaaggagaggaaccugcacuuggaaggaaaaugcgagaccuguguauauaauaugaugggcaagcgagagaagaaacucggcgaguucgggaaggcaaaaggaucccgggcuaucugguacauguggcugggugccagauuucuagaguucgaagcacuuggcuuucugaacgaggaccauugguucucuagggaaaauagccucagugggguggagggagagggccugcacaaguuggguuacauucugcgcgauguuuccaaaaaggaagggggagccauguaugcugacgacacugccggcugggauacacguaucacccucgaggaccuuaagaacgaagagauggucacuaaucacauggaaggcgagcauaaaaagcuggcggaggcaaucuuuaaauuaacauaccaaaacaagguggugcggguccagagaccuacccccagggggacaguuauggauauuauaagccgccgagaccagcggggaucuggucaagugggcacuuaugggcugaauaccuucacgaacauggaagcccaguugaucagacagauggagggagaaggcguauucaaaaauauucagcaccucaccgugacagaggaggucgcugugcaaaacuggcuggccaggguuggucgcgaaagacuaucacggauggcaaucaguggggaugacugcguggucaagccacuugaugacagguuugcuaacgcccugacugcucucaaugauaugggaaagauucguaaagacauccagcagugggagcccuccaagggcuggaacgauuggacccaggugccuuucugcagccaucacuuucaugaacugauaaugaaagacggccgaguauugguugugccaugucgcaaucaagaugaguuaaucgggagagcccggauuucucagggagcagguuggucgcugagggaaacagcgugccucggcaagucauacgcccagauguggagccuuauguauuuccaccgcagagaccugcggcuagcugccaacgcaaucuguuccgcugucccgagucacugggugcccacuucuaggaccacguggagcauucaugccaaacacgaguggaugacaaccgaggacaugcugacuguguggaaucgagucuggauccgugaaaacccuuggauggaggauaagacaccaguugaauccugggaggaaauacccuaccucgggaagagagaggaccaguggugcggaucauugauuggccugaccagucgcgcaacuugggccaaaaauauccaagcggcuauuaaccaggugcggucucuuaucgguaaugaggaauauaccgauuacaugccuagcaugaagagguuuagacgcgaggaagaggaagccgggguacugugguga

SEQ ID NO: 14608 - RNA, 9876 nt, Artificial Sequence
  derived and/or modified CDS sequence (opt3) from DENV-2__FJ744714__SS-prME
agcgccggaaugauaauuaugcugauacccaccgugauggcuuuccaccucacuacuagaaacggggagccucauaugaucgucgggauucaagaaaaggguaaaucccuucuguuuaagacggaggacggcguuaauaugugcaccuugauggcaauggauuuaggggaacugugugaggacacgaucacuuacaaaugcccacuacucaggcaaaacgaaccggaggauauugacuguuggugcaauucuaccucaacaugggugaccuauggaacuuguacaaccacgggcgagcaccggcgcgaaaagcgaaguguagcccuggugccccaugucgguauggggcuugagacucguaccgaaacauggaugagcuccgagggagcguggaaacacgcucagagaaucgagacuuggauacugaggcauccuggcuucaccaucauggccgcaauuuuggccuacacaaucggcaccacgcacuuucagcgggugcucauuuucauccugcugacugcuguugcaccaucuaugacaaugcgcugcauagggauuucgaacagagauuuuguggaaggagucucagguggcagcuggguggacaucguacucgagcacgggaguuguguuaccacuauggccaagaauaagcccacauuagauuucgaacugauuaaaaccgaggcuaagcagccugccacgcuuaggaaauauugcaucgaagcgaaguugaccaacacaacuaccgagucccgguguccaacacaaggagagcccucucugaaagaagaacaggacaagcgcuuugugugcaagcauagcauggucgaucgaggcugggguaauggguguggacuauucggcaaaggcgggaucgugacuugcgcaauguuuaccugcaagaaaaacauggaaggaaagauugugcagccugagaaucucgaauacacaauagucguuaccccacacuccggugaggagcaugccgugggcaacgacacugggaaacacggaaaggaaaucaaaguaacgccgcagucaaguauuacagaggcugaacugaccggcuaugguacugugaccauggaguguagccccagaacagggcuugauuucaaugaaaugguccuguugcaaauggagaacaaggccuggcucgugcacaggcagugguuucuggacuuaccucugccauggcuccccggcgcagauaagcaggagucuaauuggauccagaaagaaacccuuguuacuuucaagaacccucaugcuaaaaagcaagacguggucgugcugggaucccaggagggcgccaugcacacagcguugacgggggccaccgaaauacagaugucaagcggaaaucuacuguuuacuggucaucucaaaugccggcugcguauggacaaacuucaacugaagggcaugaguuacucuauguguacagggaaauucaagguaguuaaagagauugcagagacccagcacggaacaaucgugauccgcguccaguaugaaggcgaugguuccccaugcaagauucccuucgagaucauggacuuggagaagcgauacgugcucgggaggcugauuacugucaacccgauagugaccgagaaggauagcccuguuaacaucgaagcugagcccccauuuggcgacucguacauuaucaucggaguggagccuggccaguuaaagcugaauugguucaaaaaggggucuuccauuggacaaauguuugaaacgaccaugcggggugccaaacgaauggcuauacuaggcgauacagccugggacuucgggucacucggaggcguauuuacaaguaucgguaaggcacugcaucaggucuucggggccauuuauggcgcugcguuuagcggaguguccuggaccaugaaaauccuuauuggcguuaucauaacauggaucgggaugaacucucgcagcacuucauugagugugucccugguccucgugggaauuguaacccuguaccuuggcgugaugguucaggcagauagcgguugugucgugucuuggaagaauaaggagcugaaaugcgggucaggaaucuucauuacggacaacgugcacacauggaccgaacaguauaaguuucaacccgagaguccaagcaaauuggccuccgcuauccagaaggcccaggaagagggcauaugugguauuagaucugucacuaggcucgagaaucugauguggaaacagaucacacccgaauuaaaccacauucuggcagagaaugaaguuaagcuaaccaucaugacuggcgauauaaaagggaucaugcaagccggaaagcggucgcuccgcccucagccaaccgagcugaaguacagcuggaaaacauggggcaaggcuaaaaugcuuuccacggaaucauauaaccagaccuucuugauugacgggccggagacugccgagugccccaauacaaacagagcauggaauagucuggaaguggaggauuacggauuuggcguguucaccacaaacaucuggcucaagcugaaagaaaagcaggacgcguuuugugacucuaaguuaaugagcgcugccauuaaagauaauagggcaguacaugccgacauggguuauuggaucgaguccgcucugaacgauacuuggaagauagagaaagccucauucauugaagucaagaauugccacuggccuaaaagccauacccuuuggucuaacgggguguuggaguccgaaaugaucaucccaaagaaccucgcaggacccguuagucaacacaauuaccguccuggcuaccacacgcagauugcugguccauggcaucugggcaagcuagagauggacuucgauuuuugugacgggacaaccgugaucgucacugaagauugcggaaaccggggccccagccugcgaaccacaacugccucugggaaacucauuaccgaguggugcuguagauccugcacacugccgccucuuagguaucgcggagaggacggcuguugguacgguauggaaauacggccauugaaggagaaagaagagaaucuggugaacucauuaguuacggcggggcacggacagguggauaauuucagucucggcguacuggguauggcccuuuuucuggaagagauguugagaaccagggucggcacuaagcaugcuauccuccugguggcagugagcuucgucacacuaauuaccgggaacaugucguuuaaagaccugggacgcguugugguaauggugggcgccacuauggcugaugacaucgggaugggagucacauaucucgcccugcuugcagcguucaaggugcgacccaccuuugccgcuggcuugcuguuacggaagcucacguccaaagagcugaugaugacuaccauugguaucguucuucugucucaaagcacaauaccugaaaccgugcuagagcucacugaugcccuggcauuggggaugaugguccugaagaucgugcguaauauggaaaaauaccaguuagcuguuacaauuauggccauccucugcgugcccaacgcagucauucugcagaaugccuggaagguaucauguaccauccuugcugugguuaguguguccccacuguugcucacaucuagccagcagaaaacugacuggauaccucuggcgcuaaccauuaagggacugaaccccacggccaucuuccuuacaacccucuccagaacuaauaaaaagaggucauggccacugaacgaggcaaucauggcugucggcauggugagcauuuuggccaguucucuguuaaagaaugacauaccgaugaccggcccucucguagccgggggacugcuuacagugugcuauguccugacuggucgcuccgcugauuuggaacucgagcgggcaaccgacguuaaaugggaggaucaggccgaaaucagcggcucgucacccauucugucuaucacgauuagugaggacggguccaugagcaucaagaacgaagaggaggaacagacacuaaccauacugaucagaacuggacuucucgugauuucuggccuguuuccaaucagcauucccaucacagcggcugccugguacuugugggaggugaaaaagcagagggcgggugucuuaugggaugugccuuccccacccccuauggggaaagccgaacuggaggacggagcuuaucgaauaaagcaaaagcgcauucucggcuacucacagaucggcgcagggguuuacaaagaaggaaccuuccacacuauguggcauguaacacggggugccgugcugaugcacaagggcaaaagaaucgagccgaguugggcggaugucaagaaagaccuuauuagcuaugggggaggcuggaagcuggagggugaauggaaggagggggaagaggugcagguuuuggcucuagaaccaggcaaaaaucccagggccgugcagaccaagccuggccuguuuaaaacgaacacuggcaccaucggggcagucucucucgauuucuccccaggaacaucagguagucccauaauugacaagaaaggcaaggugguagggcuguacggaaacggcgucgugacccguagcggugccuauguuuccgcuaucgcccaaacagagaagucuauugaggauaauccugaaaucgaggacgauauauuucgcaaacggagacuuacuauuauggacuuacacccgggggcaggaaagaccaaaagguaccugcccgcuaucgugcgagaagccaucaagcggggccuccgcacguugauucuggcgccaacaagagucguggccgcagagauggaagaggcucucaggggccugccuauccgguaucagacucccgccauucgagcugagcauaccgggagagaaauaguugaccuuaugugucacgcaacauucaccaugcgccuguugucgccagugagggucccuaacuacaaucuaaucauuauggaugaggcccauuucacugaccccgccagcaucgcugcgcguggauauaucucaacccggguggaaaugggugaggcagccggcauuuuuaugacagcuacgccaccgggguccagagauccuuucccccagaguaacgccccaauaaucgacgaggaaagggagauucccgaacgcucuuggaauagcggacacgaguggguaacugauuuuaaaggcaagaccgugugguucguuccuuccaucaaggcagguaacgacauugccgcuugccugcggaaaaaugggaagaaagucauccaacucucaagaaagacauuugauucugaauacgugaaaaccagaacuaacgacugggauuucguggucacaaccgacauaagcgagaugggagcgaauuuuaaggccgagaggguaaucgauccacgccguuguaugaaacccgugauuuuaacggacggcgaagagagaguuauccuggcaggcccuaugccggugacucauaguuccgcugcccagcggagggggcgcauuggacgaaacccaaagaaugaaaacgaccaguacaucuauaugggugagccccuugaaaaugaugaggacugcgcacacuggaaggaggccaaaaugcugcucgauaacauaaauacaccugaaggcauuauccccagcauguucgagccagaaagagagaaggucgacgcuauugauggggaauaccgguugaggggagaggcccgcaaaaccuuuguggaccugaugagaaggggcgaucucccuguuuggcuggcguauaagguggcagccgaggguaucaacuacgcugaccggcguugguguuucgaugggaucaaaaacaaucagauccuugaagagaacgucgaaguggagauuuggaccaaggagggcgaacgcaagaaacuaaagccccgauggcuggacgccagaaucuauucugauccauuggcuuuaaaagaguuuaaggaguucgcagccggaaggaaaucacugacucucaaucugauuacagagaugggccggcuuccuaccuucaugacacaaaagacucgcgacgcucuggauaaccucgccguauugcacacggcagaagcaggggguagagcauacaaucaugcucuguccgagcuaccggagacccuggaaacacuccuucuguuaacuuugcuggccaccgugacaggaggcaucuuucucuuccugaugagugggaggggaauaggcaagaugacccuugguaugugcugcauuaucacugcaagcauccugcucugguaugcucagauucagccccacuggaucgccgcaucgauaauuuuggaguuuuuccugaucguuuuacuaauuccagaaccugagaaacagcggacgccccaagacaaccagcugaccuacgucgugaucgccauacucacaguggucgcugcgacuauggccaaugaaaugggguuucuugagaagaccaaaaaggaccugggcuugggaucuaucgcaacacagcagccagaguccaacauucuggauaucgaccuccgaccugcuagcgccuggacccuguacgccguugcaacuacauucgugacgcccaugcuuagacauucaauugaaaauaguucuguaaacgugucccucaccgcuaucgccaaucaagcgacuguccugaugggcuuggggaaaggauggccgcugagcaagauggauauuggugugccauuacuagcuaucggcuguuauucacagguuaacccuauaacacugaccgccgcacuccuucuguugguggcccacuacgcuauuaucgggcccggacugcaggcaaaggccacccgcgaggcgcagaaaagggcugccgcaggcaucaugaagaauccaacagucgacgguauuacuguaauagaucucgaccccaucccuuaugauccgaaauuugaaaagcaacugggacaggugaugcuuuuaauucugugcguuacacaggugcucaugaugcggaccacaugggccuugugugaggcucugacucuagccaccggccccaucaguacacugugggaaggaaacccaggccguuucuggaauaccacuauugcagucagcauggcuaacaucuuuagaggguccuaccucgccggagcgggccuucuguucucuauaaugaaaaauacgacaaacaccaggcgcgguacugggaacaucggagagaccuugggcgagaaguggaaaagccggcugaaugcccucgguaaguccgaauuucaaauuuauaagaaaucaggcauccaggagguggaccgaacacuggcaaaggaagggauuaaaagaggagagacugaucaccaugcugucucuaggggcagugccaaguuacgcugguucguggagcggaacaugguuaccccugaagggaaagugguagaccuuggaugcggcagagguggguggucguacuauuguggaggccugaagaaugugcgugaggucaagggucucacaaaaggcgggcccggacacgaagaaccuaucccaaugagcacguacggcuggaaccuaguuaggcugcaguccgggguggaugucuuuuucauacccccugaaaagugcgacaccuugcugugugauauuggagagucuucaccaaaucccacuguggaggcaggccggacacuccgcguacuuaaccugguggaaaauugguugaacaauaacacccaguucugcaucaaaguucugaauccguacaugccuagcgugaucgagaagauggaagcucuccaacgaaaauaugguggggccuuagucagaaacccacuguccaggaauaguacucaugagauguacugggugucuaacgccagcggaaauauugucucauccgugaacaugauaagucggaugcuuaucaaccgcuuuacaaugagacacaagaaggcgaccuaugaacccgacguugaccugggcagcggcacgaggaauauugggaucgagucugagguaccuaaccuagauauuaucggaaaacgaauagaaaagaucaaacaggagcaugaaaccuccuggcacuacgaccaggaucacccauauaagacaugggcuuaccaugguucauaugagacuaaacagaccggcagcgcaucgucuauggugaauggggucgugcggcuccugacaaagcccugggacguuuugccgacugugacccaaauggccaugacagauaccacuccuuucggacagcagcgugucuuuaaggaaaaaguggacacgagaacacaggagcccaaggagggcaccaaaaagcugaugaaaauuacugcugaauggcucuggaaggagcuugguaaaaagaagaccccacgcauguguacaagggaagaguucacgcggaaaguaagaaguaacgccgcacugggggccaucuuuaccgaugagaauaaguggaaauccgcucgcgaagcgguggaggacagcagguucugggaauuaguugauaaggagcgaaaccugcacuuggaaggaaaaugcgagacuugugucuacaauaugaugggcaagcgggagaagaaacucggcgaauuugggaaggccaaaggaucaagagcaauuugguacauguggcugggugcuagguuccuagaguuugaagcccuuggcuuccugaacgaggaccauugguuuucccgcgaaaauucucucagcgggguggagggagagggccugcacaaguuggguuauauccugcgugaugugaguaaaaaggaagggggagcaauguacgccgacgacacagcuggcugggauacccggauuacucucgaggaccuuaagaacgaagagauggucacaaaucacauggaaggcgagcauaaaaagcuggccgaggcgauauucaaauuaaccuaucaaaacaagguugugagaguacagaggccuacaccccgcgggacugugauggauaucauuucccgacgggaccagagaggaagcggucaagucggcaccuacgggcugaauacguuuaccaacauggaagcacaguugaucaggcagauggagggagaaggcguguucaaaaauauccagcaccucacaguuacugaggagguggccguccaaaacuggcuggcucgcguggguagagaacggcuaucuaggauggccauuucaggggaugacugcguaguuaagccacuugaugaccguuucgcaaacgcucugaccgcccucaaugauaugggaaagauacgaaaagacauccagcagugggagcccaguaagggcuggaacgauuggacacaggugccuuuuugcucccaucacuuccaugaacugauuaugaaagacggccgcgucuugguggugccauguagaaaucaagaugaguuaaucgggcgggcuaggauuagccagggagccgguuggucucugcgcgaaacugcaugccucggcaagucguaugcgcagauguggucacuuauguacuuucacagacgggaccugaggcuagccgcuaacgccaucuguagcgcagucccgucccacuggguucccaccagucgaacgacauggucuauacaugcuaaacacgaguggaugaccacugaggacaugcugacaguguggaaucguguauggaucagagaaaacccuuggauggaggauaagaccccaguggaaagcugggaggaaauucccuaucucgggaagcgcgaggaccaguggugcggauccuugaucggccugacuucacgggccaccugggccaaaaauauucaagccgcgaucaaccaggucaggagucuuauagguaaugaggaauacacagauuacaugccuucuaugaagagauuccgccgggaggaagaggaagcuggggugcugugguga

SEQ ID NO: 14609 - RNA, 9876 nt, Artificial Sequence
  derived and/or modified CDS sequence (opt3) from DENV-2__FJ744716__SS-prME
agcgcaggaaugauaauuaugcugauacccaccgugauggcuuuccaccucacuacuagaaacggggagccucauaugaucgucgggauucaagaaaaggguaaaucccuucuguuuaagacggaggacggcguuaauaugugcaccuugauggcaauggauuuaggggaacugugugaggacacgaucacuuacaaaugcccacuacucaggcaaaacgaaccggaggauauugacuguuggugcaauucuaccucaacaugggugaccuauggaacuuguacaaccacgggcgagcaccggcgcgaaaagcgaaguguagcccuggugccccaugucgguauggggcuugagacucguaccgaaacauggaugagcuccgagggagcguggaaacacgcucagagaaucgagacuuggauacugaggcauccuggcuucaccaucauggccgcaauuuuggccuacacaaucggcaccacgcacuuucagcgggugcucauuuucauccugcugacugcuguugcaccaucuaugacaaugcgcugcauagggauuucgaacagagauuuuguggaaggagucucagguggcagcuggguggacaucguacucgagcacgggaguuguguuaccacuauggccaagaauaagcccacauuagauuucgaacugauuaaaaccgaggcuaagcagccugccacgcuuaggaaauauugcaucgaagcgaaguugaccaacacaacuaccgagucccgguguccaacacaaggagagcccucucugaaagaagaacaggacaagcgcuuugugugcaagcauagcauggucgaucgaggcugggguaauggguguggacuauucggcaaaggcgggaucgugacuugcgcaauguuuaccugcaagaaaaacauggaaggaaagauugugcagccugagaaucucgaauacacaauagucguuaccccacacuccggugaggagcaugccgugggcaacgacacugggaaacacggaaaggaaaucaaaguaacgccgcagucaaguauuacagaggcugaacugaccggcuaugguacugugaccauggaguguagccccagaacagggcuugauuucaaugaaaugguccuguugcaaauggagaacaaggccuggcucgugcacaggcagugguuucuggacuuaccucugccauggcuccccggcgcagauaagcaggagucuaauuggauccagaaagaaacccuuguuacuuucaagaacccucaugcuaaaaagcaagacguggucgugcugggaucccaggagggcgccaugcacacagcguugacgggggccaccgaaauacagaugucaagcggaaaucuacuguuuacuggucaucucaaaugccggcugcguauggacaaacuucaacugaagggcaugaguuacucuauguguacagggaaauucaagguaguuaaagagauugcagagacccagcacggaacaaucgugauccgcguccaguaugaaggcgaugguuccccaugcaagauucccuucgagaucauggacuuggagaagcgauacgugcucgggaggcugauuacugucaacccgauagugaccgagaaggauagcccuguuaacaucgaagcugagcccccauuuggcgacucguacauuaucaucggaguggagccuggccaguuaaagcugaauugguucaaaaaggggucuuccauuggacaaauguuugaaacgaccaugcggggugccaaacgaauggcuauacuaggcgauacagccugggacuucgggucacucggaggcguauuuacaaguaucgguaaggcacugcaucaggucuucggggccauuuauggcgcugcguuuagcggaguguccuggaccaugaaaauccuuauuggcguuaucauaacauggaucgggaugaacucucgcagcacuucauugagugugucccugguccucgugggaauuguaacccuguaccuuggcgugaugguucaggcagauagcgguugugucgugucuuggaagaauaaggagcugaaaugcgggucaggaaucuucauuacggacaacgugcacacauggaccgaacaguauaaguuucaacccgagaguccaagcaaauuggccuccgcuauccagaaggcccaggaagagggcauaugugguauuagaucugucacuaggcucgagaaucugauguggaaacagaucacacccgaauuaaaccacauucuggcagagaaugaaguuaagcuaaccaucaugacuggcgauauaaaagggaucaugcaagccggaaagcggucgcuccgcccucagccaaccgagcugaaguacagcuggaaaacauggggcaaggcuaaaaugcuuuccacggaaucauauaaccagaccuucuugauugacgggccggagacugccgagugccccaauacaaacagagcauggaauagucuggaaguggaggauuacggauuuggcguguucaccacaaacaucuggcucaagcugaaagaaaagcaggacgcguuuugugacucuaaguuaaugagcgcugccauuaaagauaauagggcaguacaugccgacauggguuauuggaucgaguccgcucugaacgauacuuggaagauagagaaagccucauucauugaagucaagaauugccacuggccuaaaagccauacccuuuggucuaacgggguguuggaguccgaaaugaucaucccaaagaaccucgcaggacccguuagucaacacaauuaccguccuggcuaccacacgcagauugcugguccauggcaucugggcaagcuagagauggacuucgauuuuugugacgggacaaccgugaucgucacugaagauugcggaaaccggggccccagccugcgaaccacaacugccucugggaaacucauuaccgaguggugcuguagauccugcacacugccgccucuuagguaucgcggagaggacggcuguugguacgguauggaaauacggccauugaaggagaaagaagagaaucuggugaacucauuaguuacggcggggcacggacagguggauaauuucagucucggcguacuggguauggcccuuuuucuggaagagauguugagaaccagggucggcacuaagcaugcuauccuccugguggcagugagcuucgucacacuaauuaccgggaacaugucguuuaaagaccugggacgcguugugguaauggugggcgccacuauggcugaugacaucgggaugggagucacauaucucgcccugcuugcagcguucaaggugcgacccaccuuugccgcuggcuugcuguuacggaagcucacguccaaagagcugaugaugacuaccauugguaucguucuucugucucaaagcacaauaccugaaaccgugcuagagcucacugaugcccuggcauuggggaugaugguccugaagaucgugcguaauauggaaaaauaccaguuagcuguuacaauuauggccauccucugcgugcccaacgcagucauucugcagaaugccuggaagguaucauguaccauccuugcugugguuaguguguccccacuguugcucacaucuagccagcagaaaacugacuggauaccucuggcgcuaaccauuaagggacugaaccccacggccaucuuccuuacaacccucuccagaacuaauaaaaagaggucauggccacugaacgaggcaaucauggcugucggcauggugagcauuuuggccaguucucuguuaaagaaugacauaccgaugaccggcccucucguagccgggggacugcuuacagugugcuauguccugacuggucgcuccgcugauuuggaacucgagcgggcaaccgacguuaaaugggaggaucaggccgaaaucagcggcucgucacccauucugucuaucacgauuagugaggacggguccaugagcaucaagaacgaagaggaggaacagacacuaaccauacugaucagaacuggacuucucgugauuucuggccuguuuccaaucagcauucccaucacagcggcugccugguacuugugggaggugaaaaagcagagggcgggugucuuaugggaugugccuuccccacccccuauggggaaagccgaacuggaggacggagcuuaucgaauaaagcaaaagcgcauucucggcuacucacagaucggcgcagggguuuacaaagaaggaaccuuccacacuauguggcauguaacacggggugccgugcugaugcacaagggcaaaagaaucgagccgaguugggcggaugucaagaaagaccuuauuagcuaugggggaggcuggaagcuggagggugaauggaaggagggggaagaggugcagguuuuggcucuagaaccaggcaaaaaucccagggccgugcagaccaagccuggccuguuuaaaacgaacacuggcaccaucggggcagucucucucgauuucuccccaggaacaucagguagucccauaauugacaagaaaggcaaggugguagggcuguacggaaacggcgucgugacccguagcggugccuauguuuccgcuaucgcccaaacagagaagucuauugaggauaauccugaaaucgaggacgauauauuucgcaaacggagacuuacuauuauggacuuacacccgggggcaggaaagaccaaaagguaccugcccgcuaucgugcgagaagccaucaagcggggccuccgcacguugauucuggcgccaacaagagucguggccgcagagauggaagaggcucucaggggccugccuauccgguaucagacucccgccauucgagcugagcauaccgggagagaaauaguugaccuuaugugucacgcaacauucaccaugcgccuguugucgccagugagggucccuaacuacaaucuaaucauuauggaugaggcccauuucacugaccccgccagcaucgcugcgcguggauauaucucaacccggguggaaaugggugaggcagccggcauuuuuaugacagcuacgccaccgggguccagagauccuuucccccagaguaacgccccaauaaucgacgaggaaagggagauucccgaacgcucuuggaauagcggacacgaguggguaacugauuuuaaaggcaagaccgugugguucguuccuuccaucaaggcagguaacgacauugccgcuugccugcggaaaaaugggaagaaagucauccaacucucaagaaagacauuugauucugaauacgugaaaaccagaacuaacgacugggauuucguggucacaaccgacauaagcgagaugggagcgaauuuuaaggccgagaggguaaucgauccacgccguuguaugaaacccgugauuuuaacggacggcgaagagagaguuauccuggcaggcccuaugccggugacucauaguuccgcugcccagcggagggggcgcauuggacgaaacccaaagaaugaaaacgaccaguacaucuauaugggugagccccuugaaaaugaugaggacugcgcacacuggaaggaggccaaaaugcugcucgauaacauaaauacaccugaaggcauuauccccagcauguucgagccagaaagagagaaggucgacgcuauugauggggaauaccgguugaggggagaggcccgcaaaaccuuuguggaccugaugagaaggggcgaucucccuguuuggcuggcguauaagguggcagccgaggguaucaacuacgcugaccggcguugguguuucgaugggaucaaaaacaaucagauccuugaagagaacgucgaaguggagauuuggaccaaggagggcgaacgcaagaaacuaaagccccgauggcuggacgccagaaucuauucugauccauuggcuuuaaaagaguuuaaggaguucgcagccggaaggaaaucacugacucucaaucugauuacagagaugggccggcuuccuaccuucaugacacaaaagacucgcgacgcucuggauaaccucgccguauugagaacggcagaagcagggggaagggccuacaaucacgcucuguccgagcuaccggagacccuggaaacacuccuucuguuaacuuugcuggccaccgugacagguggcaucuuucucuuccugaugagugggcggggaauaggcaagaugacccuugguaugugcugcauuaucacugcaagcauccugcucugguaugcucagauucagccccauuggaucgccgcaucgauaauuuuggaguuuuuccugaucguuuuacuaauuccagaaccugagaaacagcgaacgccccaagacaaccagcugaccuacgucgugaucgccauacucacaguggucgcugcgacuauggccaaugaaaugggguuucuugagaagaccaaaaaggaccugggcuugggaucuaucgcaacacagcagccagaguccaacauucuggauaucgaccucagaccugcuagcgccuggacccuguacgccguugcaacuacauucgugacgcccaugcuucgccacucaauugaaaauaguucuguaaacgugucccucaccgcuaucgccaaucaagcgacuguccugaugggcuuggggaaaggauggccgcugagcaagauggauauuggugugccauuacuagcuaucggcuguuauucacagguuaacccuauaacacugaccgccgcacuccuucuguugguggcccauuacgcuauuaucgggcccggacugcaggcaaaggccaccagggaggcgcagaaacgggcugccgcaggcaucaugaagaauccaacagucgacgguauuacuguaauagaucucgaccccaucccuuaugauccgaaauuugaaaagcaacugggacaggugaugcuuuuaauucugugcguuacacaggugcucaugaugcguaccacaugggccuugugugaggcucugacucuagccaccggccccaucaguacacugugggaaggaaacccaggcagauucuggaauaccacuauugcagucagcauggcuaacaucuuuaggggguccuaccucgccggagcgggccuucuguucucuauaaugaaaaauacgacaaacacccgccgggguacugggaacaucggagagaccuugggcgagaaguggaaaagccgacugaaugcccucgguaaguccgaauuucaaauuuauaagaaaucaggcauccaggagguggacagaacacuggcaaaggaagggauuaaaaggggagagacugaucaccacgcugucucucgcggcagugccaaguuacggugguucguggagagaaacaugguuaccccugaagggaaagugguagaccuuggaugcggccgugguggguggucguacuauuguggaggccugaagaaugugagggaggucaagggucucacaaaaggcgggcccggacaugaagaaccuaucccaaugagcacguacggcuggaaccuaguucggcugcaguccgggguggaugucuuuuucauacccccugaaaagugcgacaccuugcugugugauauuggagagucuucaccaaaucccacuguggaggcaggccgcacacuccgaguacuuaaccugguggaaaauugguugaacaauaacacccaguucugcaucaaaguucugaauccguacaugccuagcgugaucgagaagauggaagcucuccaaagaaaauaugguggggccuuagucaggaacccacugucccggaauaguacucacgagauguacugggugucuaacgccagcggaaauauugucucauccgugaacaugauaagucgcaugcuuaucaacagauuuacaaugaggcauaagaaggcgaccuaugaacccgacguugaccugggcagcggcacgcgaaauauugggaucgagucugagguaccuaaccuagauauuaucggaaaacggauagaaaagaucaaacaggagcacgaaaccuccuggcauuacgaccaggaucacccauauaagacaugggcuuaccacgguucauaugagacuaaacagaccggcagcgcaucgucuauggugaauggggucgugcgucuccugacaaagcccugggacguuuugccgacugugacccaaauggccaugacagauaccacuccuuucggacagcagagagucuuuaaggaaaaaguggacacgcgcacacaggagcccaaggagggcaccaaaaagcugaugaaaauuacugcugaauggcucuggaaggagcuugguaaaaagaagaccccaaggauguguacacgggaagaguucacgagaaaaguacgcaguaacgccgcacugggggccaucuuuaccgaugagaauaaguggaaauccgcuagggaagcgguggaggacagccgauucugggaauuaguugauaaggagcggaaccugcauuuggaaggaaaaugcgagacuugugucuacaauaugaugggcaagagagagaagaaacucggcgaauuugggaaggccaaaggaucaagggcaauuugguacauguggcugggugcucgcuuccuagaguuugaagcccuuggcuuccugaacgaggaccacugguuuucccgugaaaauucucucagcgggguggagggagagggccugcauaaguuggguuauauccugcgggaugugaguaaaaaggaagggggagcaauguacgccgacgacacagcuggcugggauaccagaauuacucucgaggaccuuaagaacgaagagauggucacaaaucacauggaaggcgagcacaaaaagcuggccgaggcgauauucaaauuaaccuaucaaaacaagguugugaggguacagcgcccuacaccccgagggacugugauggauaucauuucccggagagaccagaggggaagcggucaagucggcaccuacgggcugaauacguuuaccaacauggaagcacaguugauccgccagauggagggagaaggcguguucaaaaauauccagcaucucacaguuacugaggagguggccguccaaaacuggcuggcuagagugggucgggaaaggcuaucucguauggccauuucaggggaugacugcguaguuaagccacuugaugaccgauucgcaaacgcucugaccgcccucaaugauaugggaaagauacgcaaagacauccagcagugggagcccaguaagggcuggaacgauuggacacaggugccuuuuugcucccaccauuuccacgaacugauuaugaaagacggcagagucuugguggugccaugucggaaucaagaugaguuaaucgggagggcucgcauuagccagggagccgguuggucucugagagaaacugcaugccucggcaagucguaugcgcagauguggucacuuauguacuuucaucggagggaccugcgacuagccgcuaacgccaucuguagcgcagucccgucccacuggguucccaccagucguacgacauggucuauacacgcuaaacaugaguggaugaccacugaggacaugcugacaguguggaauagaguauggauccgcgaaaacccuuggauggaggauaagaccccaguggaaagcugggaggaaauucccuaucucgggaagcgggaggaccaguggugcggauccuugaucggccugacuucaagggccaccugggccaaaaauauucaagccgcgaucaaccaggucagaagucuuauagguaaugaggaauacacagauuacaugccuucuaugaagcgcuuccggagggaggaagaggaagcuggggugcugugguga

SEQ ID NO: 14610 - RNA, 9876 nt, Artificial Sequence
  derived and/or modified CDS sequence (opt3) from DENV-2__FJ744718__SS-prME
agcgcaggcaugauaauuaugcugauacccaccgugauggcuuuccaccucacuacuagaaacggggagccucauaugaucgucgguauucaagaaaagggaaaaucccuucuguuuaagacggaggacggcguuaauaugugcaccuugauggcaauggauuuaggggaacugugugaggacacuaucacuuacaaaugcccacuacucaggcaaaacgaaccggaggauauugacuguuggugcaauucuaccucaacaugggugaccuauggaacuuguacgaccacgggcgagcaccggcgcgaaaagcgaaguguagcacuggugccccaugucgguauggggcuugagacucguaccgaaacauggaugagcuccgagggagcguggaaacacgcucagagaaucgagacuuggauacugaggcauccuggcuucaccaucauggccgcaauuuuggccuacacaaucggcaccacgcacuuucagcgggugcucauuuucauccugcugacugcuguugcaccaucuaugacaaugcgcugcauagggauuucgaacagagauuuuguggaaggagucucagguggcagcuggguggacaucguacucgagcacgggaguuguguuaccacuauggccaagaauaagcccacauuagauuucgaacugauuaaaaccgaggcuaagcagccugccacgcuuaggaaauauugcaucgaagcgaaguugaccaacacaacuaccgagucccgguguccaacacaaggagagcccucucugaaagaagaacaggacaagcgcuuugugugcaagcauagcauggucgaucgaggcugggguaauggguguggacuauucggcaaaggcgggaucgugacuugcgcaauguuuaccugcaagaaaaacauggaaggaaagauugugcagccugagaaucucgaauacacaauagucguuaccccacacuccggugaggagcaugccgugggcaacgacacugggaaacacggaaaggaaaucaaaguaacgccgcagucaaguauuacagaggcugaacugaccggcuaugguacugugaccauggaguguagccccagaacagggcuugauuucaaugaaaugguccuguugcaaauggagaacaaggccuggcucgugcacaggcagugguuucuggacuuaccucugccauggcuccccggcgcagauaagcaggagucuaauuggauccagaaagaaacccuuguuacuuucaagaacccucaugcuaaaaagcaagacguggucgugcugggaucccaggagggcgccaugcacacagcguugacgggggccaccgaaauacagaugucaagcggaaaucuacuguuuacuggucaucucaaaugccggcugcguauggacaaacuucaacugaagggcaugaguuacucuauguguacagggaaauucaagguaguuaaagagauugcagagacccagcacggaacaaucgugauccgcguccaguaugaaggcgaugguuccccaugcaagauucccuucgagaucauggacuuggagaagagauacgugcucgggaggcugauuacugucaacccgauagugaccgagaaggauagcccuguuaacaucgaagcugagcccccauuuggcgacucguacauuaucaucggaguggagccuggccaguuaaagcugaauugguucaaaaaggggucuuccauuggacaaauguuugaaacgaccaugcggggugccaaacgaauggcuauacuaggcgauacagccugggacuucgggucacucggaggcguauuuacaaguaucgguaaggcacugcaucaggucuucggggccauuuauggcgcugcguuuagcggaguguccuggaccaugaaaauccuuauuggcguuaucauaacauggaucgggaugaacucucgcagcacuucauugagugugucccugguccucgugggaauuguaacccuguaccuuggcgugaugguucaggcagauagcgguugugucgugucuuggaagaauaaggagcugaaaugcgggucaggaaucuucauuacggacaacgugcacacauggaccgaacaguauaaguuucaacccgagaguccaagcaaauuggccuccgcuauccagaaggcccaggaagagggcauaugugguauuagaucugucacuaggcucgagaaucugauguggaaacagaucacacccgaauuaaaccacauucuggcagagaaugaaguuaagcuaaccaucaugacuggcgauauaaaagggaucaugcaagccggaaagcggucgcuccgcccucagccaaccgagcugaaguacagcuggaaaacauggggcaaggcuaaaaugcuuuccacggaaucauauaaccagaccuucuugauugacgggccggagacugccgagugccccaauacaaacagagcauggaauagucuggaaguggaggauuacggauuuggcguguucaccacaaacaucuggcucaagcugaaagaaaagcaggacgcguuuugugacucuaaguuaaugagcgcugccauuaaagauaauagggcaguacaugccgacauggguuauuggaucgaguccgcucugaacgauacuuggaagauagagaaagccucauucauugaagucaagaauugccacuggccuaaaagccauacccuuuggucuaacgggguguuggaguccgaaaugaucaucccaaagaaccucgcaggacccguuagucaacacaauuaccguccuggcuaccacacgcagauugcugguccauggcaucugggcaagcuagagauggacuucgauuuuugugacgggacaaccgugaucgucacugaagauugcggaaaccggggccccagccugcgaaccacaacugccucugggaaacucauuaccgaguggugcuguagauccugcacacugccgccucuuagguaucgcggagaggacggcuguugguacgguauggaaauacggccauugaaggagaaagaagagaaucuggugaacucauuaguuacggcggggcacggacagguggauaauuucagucucggcguacuggguauggcccuuuuucuggaagagauguugagaaccagggucggcacuaagcaugcuauccuccugguggcagugagcuucgucacacuaauuaccgggaacaugucguuuaaagaccugggacgcguugugguaauggugggcgccacuauggcugaugacaucgggaugggagucacauaucucgcccugcuugcagcguucaaggugcgacccaccuuugccgcuggcuugcuguuacggaagcucacguccaaagagcugaugaugacuaccauugguaucguucuucugucucaaagcacaauaccugaaaccgugcuagagcucacugaugcccuggcauuggggaugaugguccugaagaucgugcguaauauggaaaaauaccaguuagcuguuacaauuauggccauccucugcgugcccaacgcagucauucugcagaaugccuggaagguaucauguaccauccuugcugugguuaguguguccccacuguugcucacaucuagccagcagaaaacugacuggauaccucuggcgcuaaccauuaagggacugaaccccacggccaucuuccuuacaacccucuccagaacuaauaaaaagaggucauggccacugaacgaggcaaucauggcugucggcauggugagcauuuuggccaguucucuguuaaagaaugacauaccgaugaccggcccucucguagccgggggacugcuuacagugugcuauguccugacuggucgcuccgcugauuuggaacucgagcgggcaaccgacguuaaaugggaggaucaggccgaaaucagcggcucgucacccauucugucuaucacgauuagugaggacggguccaugagcaucaagaacgaagaggaggaacagacacuaaccauacugaucagaacuggacuucucgugauuucuggccuguuuccaaucagcauucccaucacagcggcugccugguacuugugggaggugaaaaagcagagggccggugucuuaugggaugugccuuccccacccccuauggggaaagccgaacuggaggacggagcuuaucgaauaaagcaaaagggcauucucggcuacucacagaucggggcaggaguuuacaaagaagguaccuuccacacuauguggcauguaacacgcggcgccgugcugaugcacaaggggaaacggaucgagccgaguugggcggaugucaagaaagaccuuauuagcuauggaggcgguuggaagcuggagggggaauggaaggagggagaagaggugcagguuuuggcucuagaaccaggcaaaaaucccagagccgugcagaccaagccuggccuguuuaaaacgaacacugggaccaucggagcagucucucucgauuucuccccagguacaucaggcagucccauaauugacaagaaagggaaggugguaggacuguacggcaacggugucgugaccaggagcggggccuauguuuccgcuaucgcccaaacagagaagucuauugaggauaauccugaaaucgaggacgauauauuucguaaacgccggcuuacuauuauggacuuacacccgggagcaggcaagaccaaaagauaccugcccgcuaucgugagggaagccaucaagcgaggccuccggacguugauucuggcgccaacacgcgucguggccgcagagauggaagaggcucucagagggcugccuaucagguaucagacucccgccauucgggcugagcauaccggacgagaaauaguugaccuuaugugucacgcaacauucaccaugagacuguugucgccagugcgcgucccuaacuacaaucuaaucauuauggaugaggcccauuucacugaccccgccagcaucgcugcgagggguuauaucucaacccguguggaaaugggcgaggcagccgggauuuuuaugacagcuacgccaccgggaucccgggauccuuucccccagaguaacgccccaauaaucgacgaggaaagagagauucccgaaaggucuuggaauagcggccacgaguggguaacugauuuuaaagguaagaccgugugguucguuccuuccaucaaggcagggaacgacauugccgcuugccugcgcaaaaauggaaagaaagucauccaacucucacgaaagacauuugauucugaauacgugaaaaccagaacuaacgacugggauuucguggucacaaccgacauaagcgagaugggcgcgaauuuuaaggccgagcggguaaucgauccaaggcgcuguaugaaacccgugauuuuaacggacggcgaagaacguguuauccuggcagggccuaugccggugacucauaguuccgcugcccagagacggggaaggauuggucgcaacccaaagaaugaaaacgaccaguacaucuauaugggcgagccccuugaaaaugaugaggacugcgcacacuggaaggaggccaaaaugcugcucgauaacauaaauacaccugaagggauuauccccagcauguucgagccagaacgagagaaggucgacgcuauugauggagaauacagauugcggggcgaggccaggaaaaccuuuguggaccugaugcgcagaggugaucucccuguuuggcuggcguauaagguggcagccgaggggaucaacuacgcugacaggcggugguguuucgauggcaucaaaaacaaucagauccuugaagagaacgucgaaguggagauuuggaccaaggagggagaacguaagaaacuaaagccccgcuggcuggacgcccgaaucuauucugauccauuggcuuuaaaagaguuuaaggaguucgcagccggcagaaaaucacugacucucaaucugauuacagagauggggaggcuuccuaccuucaugacacaaaagacucgggacgcucuggauaaccucgccguauugcacacggcagaagcgggaggucgcgccuacaaucaugcucuguccgagcuaccggagacccuggaaacacuccuucuguuaacuuugcuggccaccgugacaggcgggaucuuucucuuccugaugaguggaagaggcauagguaagaugacccuugggaugugcugcauuaucacugcaagcauccugcucugguaugcucagauucagccccacuggaucgccgcaucgauaauuuuggaguuuuuccugaucguuuuacuaauuccagaaccugagaaacagaggacgccccaagacaaccagcugaccuacgucgugaucgccauacucacaguggucgcugcgacuauggccaaugaaaugggcuuucuugagaagaccaaaaaggaccugggauugggcucuaucgcaacacagcagccagaguccaacauucuggauaucgaccuccggccugcuagcgccuggacccuguacgccguugcaacuacauucgugacgcccaugcuucgacauucaauugaaaauaguucuguaaacgugucccucaccgcuaucgccaaucaagcgacuguccugaugggguugggaaaagguuggccgcugagcaagauggauauuggcgugccauuacuagcuaucggguguuauucacagguuaacccuauaacacugaccgccgcacuccuucuguugguggcccacuacgcuauuaucggacccggccugcaggcaaaggccaccagagaggcgcagaaacgcgcugccgcagguaucaugaagaauccaacagucgacgggauuacuguaauagaucucgaccccaucccuuaugauccgaaauuugaaaagcaacugggccaggugaugcuuuuaauucugugcguuacacaggugcucaugaugaggaccacaugggccuugugugaggcucugacucuagccaccggacccaucaguacacugugggaaggcagcccagggcgguucuggaacaccacuauugcagucuccauggcuaauaucuuucguggaucuuaccucgccggcgcgggucuucuguucagcauaaugaaaaacacgacaaauaccagaagggggacuggaaacaucggcgagaccuugggugagaaguggaaaucccgccugaacgcccucggcaagucagaauuucaaauuuauaagaaaucugggauccaggagguggaccggacacuggcaaaggaaggaauuaaacgaggcgagacugaucaccaugcugucaguagagggucggccaaguuaaggugguucguggagcgcaauaugguuaccccugaaggaaaagugguagaccuuggcugcgguagagggggauggagcuacuauuguggcggucugaagaacgugagagaggucaagggccucacaaaagggggacccggccacgaggaaccuaucccaauguccacguacggguggaaucuaguucgucugcagucuggaguggaugucuuuuucauacccccugaaaagugcgacaccuugcugugugauauuggcgagucaagcccaaaccccacuguggaggcagguaggacacuccggguacuuaaucugguggaaaacugguugaauaacaauacccaguucugcaucaaaguucugaacccguacaugccuuccgugaucgagaagauggaagcucuccaacgcaaauaugggggagccuuaguccgaaauccacugaguagaaacucuacucaugagauguacugggugagcaaugccucaggcaacauugucuccagugugaauaugauaagcaggaugcuuaucaaccgguuuacaaugcgccacaagaaggcgaccuaugaacccgacguugaccugggcucugggacgagaaacauuggaaucgaguccgagguaccuaaucuagauauuaucgguaaaaggauagaaaagaucaaacaggagcaugaaaccucauggcacuacgaccaggaucacccauauaagacaugggcuuaccauggcagcuaugagacuaaacagaccgggucggcaucuaguauggugaacggagucgugcgacuccugacaaagcccugggacguuuugccgacugugacccaaauggccaugacagauaccacuccuuucggccagcagcgggucuuuaaggaaaaaguggacacgcguacacaggagcccaaggaggguaccaaaaagcugaugaaaauuacugcugaauggcucuggaaggagcuugggaaaaagaagaccccaagaauguguacacgcgaagaguucacgaggaaaguacgguccaaugccgcacugggagccaucuuuaccgaugagaacaaguggaaaagcgcuagagaagcgguggaggacucacgcuucugggaauuaguugauaaggagaggaaucugcacuuggaaggcaaaugcgagacuugugucuacaacaugaugggcaagcgagagaagaaacucggggaauuuggaaaggccaaagguucccgggcaauuugguacauguggcugggcgcuagauuccuagaguuugaagcccuuggguuccugaaugaggaccauugguuuucuagggaaaacagccucaguggaguggagggcgagggucugcacaaguugggguauauccugcgcgauguguccaaaaaggaaggaggcgcaauguacgccgacgacacagcuggcugggauacccguauuacucucgaggaccuuaagaaugaagagauggucacaaaccacauggaaggggagcauaaaaagcuggccgaggcgauauucaaauuaaccuaucaaaauaagguugugcggguacagagaccuacacccaggggaacugugauggauaucauuagccgccgagaccagcgggguucuggccaagucgggaccuacggacugaacacguuuaccaauauggaagcacaguugaucagacagauggagggcgaagguguguucaaaaacauccagcaccucacaguuacugaggagguggccguccaaaauuggcuggcuaggguggggcgcgaaagacuaucacggauggccauuaguggagaugacugcguaguuaagccacuugaugacagguucgcaaacgcucugaccgcccucaacgauaugggcaagauacguaaagacauccagcagugggagcccuccaagggcuggaaugauuggacacaggugccuuuuugcagccaucacuuccaugaacugauuaugaaagacgggcgagucuugguggugccaugucgcaaccaagaugaguuaaucggacgggcucggauuucucagggugccggcuggucgcugagggaaacugcaugccucgggaagucauaugcgcagauguggagccuuauguacuuucaccgcagagaccugcggcuagccgcuaaugccaucuguuccgcagucccgagucacuggguucccaccucuaggacgacauggagcauacaugcuaaacacgaguggaugaccacugaggacaugcugacaguguggaaccgaguauggauccgugaaaauccuuggauggaggauaagaccccaguggaauccugggaggaaauucccuaucucggaaagagagaggaccaguggugcggcucauugaucggucugacaagucgcgccaccugggccaaaaacauucaagccgcgaucaaucagguccggucucuuauagggaacgaggaauacacagauuacaugccuagcaugaagagguucagacgcgaggaagaggaagcuggagugcugugguga

SEQ ID NO: 14611 - RNA, 9876 nt, Artificial Sequence
  derived and/or modified CDS sequence (opt3) from DENV-2__FJ744722__SS-prME
agcgugggcaugaucauuaugcugauccccaccgucauggccuuccaccucaccacuaggaauggggagccucauaugaucguuuccauucaggaaaagggaaagucucuucuguuuaagacggaggacggugugaauaugugcaccuugauggcuauggauuuaggcgaacugugugaggacacaaucacuuacaaaugcccacuucucaggcaaaacgaaccggaggauauugacuguuggugcaauucaaccaguacaugggugaccuaugggacuuguacaaccacgggagagcaccggcgcgaaaagcgaagcguggcacuggucccccaugugggcaugggucuugagacucguaccgaaacauggauguccucugagggggccuggaaacacgcgcagagaaucgagacuuggauacugaggcauccuggauucaccaucauggcugccauuuuggcauacacaaucggcaccacgcacuuucagcggacucucauuuucauccugcugacagccguugcuccaucgaugaccaugcgcugcauaggcauuucaaacagagauuuuguggaaggggucagcggagguaguuggguggacaucguacucgagcacggcuccuguguuacuacaauggcaaagaauaagcccaccuuagauuucgaacugauuaaaacggaggccaagcagccugcuacccuuaggaaauauugcaucgaagccaaguugacaaacacuaccacagagucucgguguccaacucaaggggagcccaaucugaaagaagaacaggacaagcgcuuugugugcaagcauagcauggucgaucgaggauggggcaacgguugugggcuauucggaaaaggcggcaucgugaccugcgcgauguuuacaugcaagaaaaauauggaagggaagauugugcagccugagaaccucgaauacaccauagucguuacuccacacuccggagaggagcaugcaguggguaaugacacgggcaaacacgggaaggaaaucaaaguaacaccgcagucaaguauuaccgaggccgaacugacuggauauggcaccgugacaauggaguguagccccagaaccggucuugauuucaacgaaaugguccuguugcaaauggagaauaaggcuuggcucgugcacaggcagugguuucuggacuuaccucugccauggcuccccggggccgauacucagggcucuaacuggauccagaaggagacacuuguuacguucaaaaauccucaugcaaagaaacaagacguggucgugcugggaucccaggaaggcgcuaugcacaccgccuugacuggggcgacagagauacagaugucaagcggaaaccuacuguuuaccggucaucucaagugccggcugcguauggacaaacuucaacugaagggcaugaguuacucuauguguacagggaaguucaaaguaguuaaggaaauugccgagacucagcacggaaccaucgugauccgcguccaguaugagggcgaugguuccccaugcaaaauucccuucgaaaucauggacuuggagaagagauacgugcucgggaggcugauuacggucaacccgauagugaccgaaaaagauagcccuguuaauaucgaggcagaacccccauuuggcgacucguacauuaucaucggaguggagccuggccaguuaaagcugaacugguucaagaaagggucuuccauuggacaaauguuugagacaacuaugcggggugcuaagcgaauggccauacuaggcgauaccgcuugggacuucgggucacucggaggcguauuuacaaguaucgguaaagcccugcaucaggucuucggggcaauuuauggcgccgcuuuuagcggaguguccuggacuaugaagauccuuauuggcguuaucauaaccuggaucgggaugaacucucgcagcacgucauugagugugucccugguccucgugggaguagugacacuguaccuuggcguuaugguccaggcggauagcgguuguguggugucuuggaaaaacaaggaacugaagugcgggucaggaauuuucaucaccgacaauguccacacuuggacagagcaguauaaauuucaacccgaaaguccaagcaaguuggcauccgccauucagaaagcucaggaggaaggcaucugugguauaagaucuguuaccaggcucgagaaccugauguggaagcagauuacucccgaguuaaaucacauccuggccgaaaacgaggugaaacuaaccauuaugacaggcgauaucaaggggauaaugcaagcaggaaaacggucgcuccgcccucagccaacggaacugaaguacagcuggaagaccuggggcaaagccaagaugcuuuccacugagucacauaaucagacauucuugaucgacgggccggaaaccgcugagugccccaacacaaauagagccuggaacagucuggagguggaagauuauggauuuggcguauucacuaccaauauuuggcucaaacugaaggagaaacaggacgcauuuugugacucuaaguuaaugagcgcggcuaucaaggauaacagggccguccacgcagacauggguuacuggauugaauccgcccugaaugauacguggaaaaucgagaaggcuucauucauagaggugaaaaacugccauuggccuaagagccacacacuuuggucuaacgggguuuuggaauccgagaugauuauccccaagaaucucgccggacccgugagucaacacaacuaucguccuggcuaccauacccagaucgcagguccauggcaccugggcaagcuagaaauggacuucgauuuuugugacgggacuaccgucgugguuacagaggauugcggaaaucggggccccagccugcgaacuaccacagcuucugggaagcucauuacggaauggugcuguagauccugcacccugccgccucuuagguaccgcggagaggacggcuguugguaugguauggagauccggccauugaaagaaaaggaggaaaaccugguaaauucauuaguaacugccgggcauggacaggucgauaacuucagucucggcgugcuggguauggcgcuuuuucuggaggaaauguugagaacaagggugggcaccaaacacgccauucuccuggucgcuguuagcuucgugacucuaauaacagggaauaugucguuuaaggaccugggacgcguaguggucauggugggcgcaaccaugacggaugacaucgggaugggaguuacuuaccucgcccugcuugcugccuucaaagugcgacccaccuuugcagcgggcuuguuccugcggaaguuaacauccaaggagcucaugaugaccacuauugguaucguccugcuuucucaaagcacaauuccugagaccauccuggaacuaacagaugcccucgcucuggggaugaugguguugaaaaugguucgugacauggagaaguaucagcuggccgugacuauaauggcaaucuuaugcguccccaacgcuguaauucuccagaaugccuggaaagugucauguaccauccuggcaguugugagugucuccccacuucuguugacgucuagccagcaaaagacagacuggauuccucucgcccugaccaucaaaggacuaaaccccacugcuauauuucugaccacacuuuccagaacuaauaagaaaaggucauggccacucaacgaagcgauuauggccgugggcaugguaagcauccuggcaaguucuuugcugaagaaugauaucccgaugaccggcccuuuaguggcugggggacuccugacggucugcuacguucuuacaggucgcuccgccgaccuggaguuggaacgggccaccgaugugaagugggaggaccaggcugagauuagcggcucgucacccauacucucuaucacuauuagugaagauggguccaugagcaucaaaaacgaggaagaggagcagacacugaccauucuaaucagaacuggacugcuugugauaucuggccucuucccagucagcauccccauuacagcagccgcgugguaucugugggaagugaagaaacagagggcugguguuuugugggacguaccuuccccacccccuauggggaaggccgaguuagaagauggagcauaccgaaucaaacaacgcggcauucugggcuauucacagaucggggccggaguguacaaggaggguaccuuucauacgauguggcacgucacucggggcgcugugcucacccacaaggggaaaagaauagaaccgaguugggcagacguuaagaaagaucugauuagcuacggaggcgguuggaaacuugagggggaguggaaagaaggagaggaagugcagguccuggccuuggagccaggcaagaaucccagggcggugcagacaaagccuggccuauucaaaaccaacacagggacuaucggagcuguaucucuggacuuuuccccagguaccucaggcagucccaucauugauaagaaagggaaggucgugggacucuauggcaacgguguugugacgcguagcggggccuacgucuccgcaaucgcccaaacagaaaaaucuauagaggacaauccugauauugaggacgacaucuuccgcaagcggagacugacuauuauggaucuucauccgggagcuggcaagaccaaaagguauuuacccgccaucgugcgagaagcaauaaagcggggccugcgcacacucauuuuggcuccaaccagaguuguggccgcggagauggaagaggcccugagggggcucccuauccgguaccagacucccgcaauccgagcugaacacaccggaagagagauugucgaccugaugugucaugccacauucacgaugcgccuucugucgccagugaggguaccuaacuauaauuugaucauuauggaugaggcucacuuuacugaccccgcaagcauagccgcccgugguuacaucucaacccggguggaaaugggcgaggcugcggggauuuucaugacagcaaccccaccgggauccagagauccuuuuccccagaguaacgccccaaucaucgacgaagagagggagauucccgaacgcucuuggaauagcggccaugaguggguuacugauuucaaagguaagacagucugguuugugccuuccauaaaagcugggaacgacaucgccgcaugccuacgaaagaauggaaagaaagugauucaacugucaagaaagaccuucgauucugaauaugucaaaacgcggacuaacgacugggauuuuguagugacaaccgacaucagcgagaugggcgccaauuucaaggcugaaaggguuauugacccacgccguuguaugaaacccgugauccucaccgauggcgaggagagagucauauuagcggggccuaugccggugacucacaguuccgccgcacagcggaggggacgcaucggucgaaacccaaagaaugaaaacgaccaguacauuuacaugggcgagccccuggaaaaugaugaggacugcgcucacuggaaagaagccaagaugcuucuggauaacaucaauacaccugaggggauuauccccagcauguuugagccagaaagagagaagguugacgcaauagauggagaauaucggcucaggggcgaggcccgcaaaaccuucguggacuugaugagaaggggugaucugccugucuggcucgcuuacaagguggccgcggaagggauuaacuaugcagaccggcguugguguuuugauggcaucaaaaacaaucagauucuggaggagaacguagaaguggagaucuggacaaaggaaggagagcgcaagaaacuuaaaccccgauggcuagacgccagaauauacucugauccacuggcuuugaaagaguucaaggaguucgccgcuggcaggaaaucauuaacucugaaucucaucacggagauggggcggcugccuaccuuuaugacacaaaagacucgcgacgcacuugacaaccuggccguucuccauaccgcugaagccggagguagagcauauaaucacgcguuguccgagcugccggaaacacuagagacccugcuccuucugacuuuauuggccacggucaccggcgggauuuuccuguuucucaugaguggaaggggcaucgguaaaaugacacuggggaugugcugcauugugacugcuagcauccuucugugguacgcccagauacagccccauuggauugcagcuucgaucauccucgaguucuuuuugauugugcuguuaaucccagaaccugagaagcagcggacaccacaagauaaccagcuaacauaugucguuauagccauucugaccgugguagcagccacuauggcuaaugaaaugggcuuccucgagaagaccaagaaggaccuuggacugggcucuaucgcgacgcagcagccagaauccaacauuuuggauaucgaccugcgaccugccagcgcauggacccucuacgcuguggccacuacauuugucacccccaugcugagacacucaauagagaauaguucugugaacguuucccuuaccgccaucgcaaaucaagcuacagugcucauggggcugggaaaagguuggccguugagcaagauggauauuggcgccccacuguuagcgaucggguguuacucacaggucaacccuauuacucuaacggcugcccugcuccuucugguagcacacuaugccaucauuggacccggcuugcaggcuaaagcaacccgcgaggcccagaagagggcggcugccgguaucaugaagaauccaacaguggacgggauaacuguuauugaucuggaccccaucccuuacgauccgaaauucgaaaagcaacucggccaggugaugcugcuugucuuaugcgugacccagguccugaugaugcggacaaccugggcacucugugaggccuugacucuggcuacgggacccaucaguacacuaugggaaggcaacccagggcguuuuuggaauaccacuauugccgugagcauggcaaacauauucagaggauccuaucuggcuggcgccggucuccuauuuucuaucaugaaaaauaccacaaacagcaggcgcgggacuggaaacauuggcgagacccugggugaaaaguggaaaucccgguugaaugcgcugggcaagucagaguuccaaaucuacaaaaagucugggauucaggagguugaccgaacacucgccaaggaaggaaucaaaagaggcgagacggaucaucacgcagugaguagggggucggcuaagcugcgcugguuuguagaacggaacauggugaccccugagggaaaagucguugacuuaggcugcgguagagggggauggagcuauuacuguggcggucuuaagaaugugcgugaggucaaaggccugacuaaaggcgggcccgggcaugaagaaccuauaccaauguccacauauggguggaaccucgugaggcuacagucuggaguagauguguucuucauacccccugaaaagugcgacacccuguugugugacauuggcgagucaagcccaaaucccacuguugaagccggucggacacugcgcgugcucaaccuugucgagaauuggcugaacaauaacacccaguuuugcaucaaaguguugaauccguacaugccuuccgucauugagaagauggaaacgcugcaacgaaaauacgggggagcacucgugagaaacccauuaaguagaaauucuacccacgagauguauuggguuagcaacgcuucaggcaauaucguauccagugugaacaugauaagccggaugcugauuaaccgcuucacaaugagacauaagaaagccacuuacgaacccgaugucgaccuuggcucugggaccaggaauaucggaaucgaguccgaaauuccuaaccuggauauaaucgguaagcgaauugagaagaucaaacaggagcacgaaacaucauggcacuaugaccaggaucauccauacaagacuugggccuaucacggcagcuacgagaccaaacagacagggucggcgucuaguauggugaauggaguugugcggcuacucaccaagcccugggacguccugccgacugugacgcaaauggcuaugacagauaccacuccuuuuggccagcagcguguauucaaagaaaagguggacaccagaacacaggagcccaaggaagguacgaaaaaguugaugaaaauuaccgcagaguggcuguggaaggagcucgggaaaaagaaaacuccacgcauguguacaagggaagaguuuacccggaagguuagauccaacgccgcucuuggagccaucuucacugaugaaaauaaguggaaaagcgcacgcgaggccgucgaggacucaagguuuugggaacugguggauaaggagcgaaacuuacaucuggaaggcaaaugcgagacauguguguauaauaugaugggcaagcgggagaagaaguugggggaguucggaaaggcuaaagguuccagagcgauaugguacauguggcucggcgccagguuucuggaguucgaagcacuaggguuucuuaacgaggaccacugguucucucgcgaaaauagccugaguggagucgagggcgaaggucuccaccgucugggguacaucuugcgggacguuuccaagaaagagggaggcgcuauguaugccgaugacaccgcaggcugggauacaagaauuacucuggaggaccucaagaacgaagagauggugaccaaucauauggaaggggagcacaagaaacuugccgaagcuaucuuuaaacugacguaccaaaacaaaguagugaggguccagcgcccuacaccccgaggaacagugauggauauuaucagccggagagaccagagggguucuggccaaguugggacuuauggauuaaauaccuucacaaacauggaggcccagcugauucgccagauggagggcgaagguguguucaagaauauacagcauuugacugucaccgaggaaaucgcggugcaaaacuggcucgcaagaguagggcgggagaggcugucacguauggccauuaguggagaugacugcguugugaaaccacuagaugaccgauuugcuuccgcccuuacggcacugaacgauaugggcaagauccgcaaagacauccagcagugggagcccagcagaggcuggaaugauuggacacaggucccuuucugcucucaccauuuucacgaacucauuaugaaggacgggcgggugcugguggucccauguaggaaccaagacgaguugauaggacgcgcuagaaucucgcagggugccggcuggucauuacgggaaaccgcuugccugggaaagagcuacgcccagauguggucccucauguauuuccacaggcgagaucuucgucuggcagcgaaugccauuuguagugcuguuccgucucauugggugcccacuagcagaacaaccugguccauccacgccaaacaugaguggaugacuaccgaagacaugcuaacaguauggaaccgcguguggauucaggagaauccuuggauggaggauaagacgccagucgaaucaugggaggaaauccccuaccugggaaaacgggaggaccaauggugcggcagucucauagguuugaccucuagggcaacuugggcuaagaacauccagguggccauuaaucagguuagaagccugaucgggaacgaagaguauacagauuacaugccuuccaugaaacgcuuucggagggaggaagaggaagcaggagugcuuugguga

SEQ ID NO: 14612 - RNA, 9876 nt, Artificial Sequence
  derived and/or modified CDS sequence (opt3) from DENV-2__FJ744723__SS-prME
agcgugggcaugaucauuaugcugauccccaccgucauggccuuccaccucaccacuagaaacggggagccucauaugaucguuuccauucaggaaaagggaaagucucuucuguuuaagacggaggacggugugaauaugugcaccuugauggcuauggauuuaggcgaacugugugaggacacaaucacuuacaaaugcccacuacucaggcaaaacgaaccggaggauauugacuguuggugcaauucaaccaguacauggguaaccuaugggacuuguacaaccacgggagagcaccggcgcgaaaagcgaagcguggcacuggucccccaugugggcaugggucuugagacucguaccgaaacauggauguccucugagggggccuggaaacacgcgcagagaaucgagacuuggauacugaggcauccuggauucaccaucauggcugccauuuuggcauacacaaucggcaccacgcacuuucagcggacucucauuuucauccugcugacagccguugcuccaucgaugaccaugcgcugcauaggcauuucaaacagagauuuuguggaaggggucagcggagguaguuggguggacaucguacucgagcacggcuccuguguuacuacaauggcaaagaauaagcccaccuuagauuucgaacugauuaaaacggaggccaagcagccugcuacccuuaggaaauauugcaucgaagccaaguugacaaacacuaccacagagucucgguguccaacucaaggggagcccagccugaaagaagaacaggacaagcgcuuugugugcaagcauuccauggucgaucgaggauggggcaaugguugugggcuauucggaaaaggcggcaucgugaccugcgcgauguuuacaugcaagaaaaacauggaagggaagauugugcagccugagaaucucgaauacaccauagucguuacuccacacucaggagaggagcaugcaguggguaacgacacgggcaaacacgggaaggaaaucaaaguaacaccgcagaguagcauuaccgaggccgaacugacuggauauggcaccgugacaauggaguguucucccagaaccggucuugauuucaaugaaaugguccuguugcaaauggagaacaaggcuuggcucgugcacaggcagugguuucuggacuuaccucugccauggcuccccggggccgauacucagggcuccaauuggauccagaaggagacacuuguuacguucaaaaacccucaugcaaagaaacaagacguggucgugcugggaucacaggaaggcgcuaugcacaccgccuugacuggggcgacagagauacagaugagcaguggaaaucuacuguuuaccggucaucucaagugccggcugcguauggacaaacuucaacugaagggcaugucuuacuccauguguacagggaaguucaaaguaguuaaggaaauugccgagacucagcacggaaccaucgugauccgcguccaguaugagggcgaugguagcccaugcaaaauucccuucgaaaucauggacuuggagaagagauacgugcucgggaggcugauuacggucaacccgauagugaccgaaaaagauucgccuguuaacaucgaggcagaacccccauuuggcgacucuuacauuaucaucggaguggagccuggccaguuaaagcugaauugguucaagaaaggguccucaauuggacaaauguuugagacaacuaugcggggugcuaagcgaauggccauacuaggcgauaccgcuugggacuucgggagucucggaggcguauuuacaagcaucgguaaagcccugcaucaggucuucggggcaauuuauggcgccgcuuuuuccggagugucuuggacuaugaagauccuuauuggcguuaucauaaccuggaucgggaugaacagccgcucaacgaguuuguccgugagccugguccucgugggaguagugacacuguaccuuggcguuaugguccaggcggauucugguuguguggugucauggaaaaauaaggaacugaagugcgggaguggaauuuucaucaccgacaacguccacacuuggacagagcaguauaaauuucaacccgaaagcccauccaaguuggcaucugccauucagaaagcucaggaggaaggcaucugugguauaagaucgguuaccaggcucgagaaucugauguggaagcagauuacucccgaguuaaaccacauccuggccgaaaaugaggugaaacuaaccauuaugacaggcgauaucaaggggauaaugcaagcaggaaaacggagccuccgcccucagccaacggaacugaaguacuccuggaagaccuggggcaaagccaagaugcuuucaacugagagucauaaccagacauucuugaucgacgggccggaaaccgcugagugccccaauacaaacagagccuggaacucucuggagguggaagauuauggauuuggcguauucacuaccaacauuuggcucaaacugaaggagaaacaggacgcauuuugugacagcaaguuaauguccgcggcuaucaaggauaauagggccguccacgcagacauggguuacuggauugaaucagcccugaacgauacguggaaaaucgagaaggcuagcuucauagaggugaaaaauugccauuggccuaagucucacacacuuugguccaacgggguuuuggaaagugagaugauuauccccaagaaucucgccggacccgugagccaacacaauuaucguccuggcuaccauacccagaucgcagguccauggcaccugggcaagcuagaaauggacuucgauuuuugugacgggacuaccgucgugguuacagaggauugcggaaaccggggccccucucugcgaacuaccacagcuuccgggaagcucauuacggaauggugcuguagaucaugcacccugccgccucuuagguaccgcggagaggacggcuguugguaugguauggagauccggccauugaaagaaaaggaggaaaaucuggugaacaguuuaguaacugccgggcauggacaggucgauaauuucagccucggcgugcuggguauggcgcuuuuucuggaggaaauguugagaacaagggugggcaccaaacacgccauucuccuggucgcuguuucguucgugacucuaauaacagggaacauguccuuuaaggaccugggacgcguaguggucauggugggcgcaaccaugacggaugacaucgggaugggaguuacuuaccucgcccugcuugcugccuucaaagugcgacccaccuuugcagcgggcuuguuccugcggaaguuaacaucuaaggagcucaugaugaccacuauugguaucguccugcuuagccaaucaacaauuccugagaccauccuggaacuaacagaugcccucgcucuggggaugaugguguugaaaaugguucgugacauggagaaguaucagcuggccgugacuauaauggcaaucuuaugcguccccaaugcuguaauucuccagaacgccuggaaagugaguuguaccauccuggcaguuguguccgucucuccacuucuguugacgagcucccagcaaaagacagacuggauuccucucgcccugaccaucaaaggacuaaaucccacugcuauauuucugaccacacuuucaagaacuaacaagaaaaggagcuggccacucaaugaagcgauuauggccgugggcaugguaaguauccuggcaucuuccuugcugaagaacgauaucccgaugaccggcccuuuaguggcugggggacuccugacggucugcuacguucuuacaggucgcagcgccgaccuggaguuggaacgggccaccgaugugaagugggaggaccaggcugagauuucgggcucaucucccauacucaguaucacuauuuccgaagaugggagcaugucuaucaaaaaugaggaagaggagcagacacugaccauucuaaucagaacuggacugcuugugauaagcggccucuucccagucuccauccccauuacagcagccgcgugguaucugugggaagugaagaaacagagggcugguguuuugugggacguaccuucaccacccccuauggggaaggccgaguuagaagauggagcauaccgaaucaaacaacgcggcauucugggcuauagucagaucggggccggaguguacaaggaggguaccuuucauacgauguggcacgucacucggggcgcugugcucacccacaaggggaaaagaauagaaccgagcugggcagacguuaagaaagaucugauuucuuacggaggcgguuggaaacuugagggggaguggaaagaaggagaggaagugcagguccuggccuuggagccaggcaagaaccccagggcggugcagacaaagccuggccuauucaaaaccaauacagggacuaucggagcuguaucccuggacuuuucaccagguaccaguggcagccccaucauugauaagaaagggaaggucgugggacucuauggcaacgguguugugacgcguuccggggccuacgucucugcaaucgcccaaacagaaaaaucgauagaggacaacccugauauugaggacgacaucuuccgcaagcggagacugacuauuauggaucuucauccgggagcuggcaagaccaaaagguauuuacccgccaucgugcgagaagcaauaaagcggggccugcgcacacucauuuuggcuccaaccagaguuguggccgcggagauggaagaggcccugagggggcucccuauccgguaccagacucccgcaauccgagcugaacacaccggaagagagauugucgaccugaugugucaugccacauucacgaugcgccuucugagcccagugaggguaccuaauuauaacuugaucauuauggaugaggcucacuuuacugaccccgcaucaauagccgcccgugguuacaucuccacccggguggaaaugggcgaggcugcggggauuuucaugacagcaaccccaccgggaaguagagauccuuuuccccagucuaaugccccaaucaucgacgaagagagggagauucccgaacgcagcuggaacuccggccaugaguggguuacugauuucaaagguaagacagucugguuugugccuucaauaaaagcugggaaugacaucgccgcaugccuacgaaagaacggaaagaaagugauucaacugucuagaaagaccuucgauagcgaauaugucaaaacgcggacuaaugacugggauuuuguagugacaaccgacaucagugagaugggcgccaacuucaaggcugaaaggguuauugacccacgccguuguaugaaacccgugauccucaccgauggcgaggagagagucauauuagcggggccuaugccggugacucacuccagcgccgcacagcggaggggacgcaucggucgaaauccaaagaacgaaaaugaccaguacauuuacaugggcgagccccuggaaaacgaugaggacugcgcucacuggaaagaagccaagaugcuucuggauaauaucaacacaccugaggggauuauccccucuauguuugagccagaaagagagaagguugacgcaauagauggagaauaucggcucaggggcgaggcccgcaaaaccuucguggacuugaugagaaggggugaucugccugucuggcucgcuuacaagguggccgcggaagggauuaauuaugcagaccggcguugguguuuugauggcaucaaaaacaaccagauucuggaggagaauguagaaguggagaucuggacaaaggaaggagagcgcaagaaacuuaaaccccgauggcuagacgccagaauauacucagauccacuggcuuugaaagaguucaaggaguucgccgcuggcaggaaauccuuaacucugaaccucaucacggagauggggcggcugccuaccuuuaugacacaaaagacucgcgacgcacuugacaaucuggccguucuccauaccgcugaagccggagguagagcauauaaccacgcguugagugagcugccggaaacacuagagacccugcuccuucugacuuuauuggccacggucaccggcgggauuuuccuguuucucaugagcggaaggggcaucgguaaaaugacacuggggaugugcugcauugugacugcuucgauccuucugugguacgcccagauacagccccauuggauugcagcuucuaucauccucgaguucuuuuugauugugcuguuaaucccagaaccugagaagcagcggacaccacaagauaaucagcuaacauaugucguuauagccauucugaccgugguagcagccacuauggcuaacgaaaugggcuuccucgagaagaccaagaaggaccuuggacugggcuccaucgcgacgcagcagccagaaagcaauauuuuggauaucgaccugcgaccugccucagcauggacccucuacgcuguggccacuacauuugucacccccaugcugagacacaguauagagaacucuuccgugaauguuagccuuaccgccaucgcaaaccaagcuacagugcucauggggcugggaaaagguuggccguugucaaagauggauauuggcgccccacuguuagcgaucggguguuacagucaggucaauccuauuacucuaacggcugcccugcuccuucugguagcacacuaugccaucauuggacccggcuugcaggcuaaagcaacccgcgaggcccagaagagggcggcugccgguaucaugaagaacccaacaguggacgggauaacuguuauugaucuggaccccaucccuuacgauccgaaauucgaaaagcaacucggccaggugaugcugcuugucuuaugcgugacccagguccugaugaugcggacaaccugggcacucugugaggccuugacucuggcuacgggacccaucagcacacuaugggaaggcaauccagggcguuuuuggaacaccacuauugccguguccauggcaaauauauucagaggaucuuaucuggcuggcgccggucuccuuuuuagcaucaugaaaaacaccacaaauuccaggcgcgggacuggaaacauuggcgagacccugggugaaaaguggaaaucacgguugaacgcgcugggcaagucugaguuccaaaucuacaaaaagagugggauucaggagguugaccgaacacucgccaaggaaggaaucaaaagaggcgagacggaucaucacgcagugucgagggggagcgcuaagcugcgcugguuuguagaacggaauauggugaccccugagggaaaagucguugacuuaggcugcgguagagggggaugguccuauuacuguggcggucuuaagaacgugcgugaggucaaaggccugacuaaagggggacccggccaugaagaaccuauaccaaugucuacauauggguggaaucucgugaggcuacagucaggaguagauguguucuucauacccccugaaaagugcgacacccuguugugugacauuggcgagagcuccccaaaccccacuguugaagccggucggacacugcgcgugcucaaucuugucgagaacuggcugaauaacaauacccaguuuugcaucaaaguguugaacccguacaugccuagugucauugagaagauggaaacgcugcaacgaaaauacgggggagcacucgugagaaauccauuaucuaggaacagcacccacgagauguauuggguuucaaaugcuuccggcaacaucguaaguagcgugaauaugauaucucggaugcugauuaaccgcuucacaaugagacauaagaaagccacuuacgaacccgaugucgaccuuggcuccgggaccaggaacaucggaaucgagucagaaauuccuaaucuggauauaaucgguaagcgaauugagaagaucaaacaggagcacgaaacaagcuggcacuaugaccaggaucauccauacaagacuugggccuaucacggcucguacgagaccaaacagacagggucugcgaguuccauggugaacggaguugugcggcuacucaccaagcccugggacguccugccgacugugacgcaaauggcuaugacagauaccacuccuuuuggccagcagcguguauucaaagaaaagguggacaccagaacacaggagcccaaggaagguacgaaaaaguugaugaaaauuaccgcagaguggcuguggaaggagcucgggaaaaagaaaacuccacgcauguguacaagggaagaguuuacccggaagguuagaagcaaugccgcucuuggagccaucuucacugaugaaaacaaguggaaaucagcacgcgaggccgucgaggacuccagguuuugggaacugguggauaaggagcgaaauuuacaucuggaaggcaaaugcgagacauguguguauaacaugaugggcaagcgggagaagaaguugggggaguucggaaaggcuaaagguucuagagcgauaugguacauguggcucggcgccagguuucuggaguucgaagcacuaggguuucuuaaugaggaccacugguucagccgcgaaaacagucuguccggagucgagggcgaaggucuccaccgucugggguacaucuugcgggacguuagcaagaaagagggaggcgcuauguaugccgaugacaccgcaggcugggauacaagaauuacucuggaggaccucaagaaugaagagauggugaccaaccauauggaaggggagcacaagaaacuugccgaagcuaucuuuaaacugacguaccaaaauaaaguagugaggguccagcgcccuacaccccgaggaacagugauggauauuaucucucggagagaccagagggguucaggccaaguugggacuuauggauuaaacaccuucacaaauauggaggcccagcugauucgccagauggagggcgaagguguguucaagaacauacagcauuugacugucaccgaggaaacggcggugcaaaauuggcucgcaagaguagggcgggagaggcugagucguauggccaucuccggagaugacugcguugugaaaccacuagaugaccgauuugcuagcgcccuuacagcacugaacgauaugggcaagauucgcaaagacauccagcagugggagcccucuagaggcuggaacgauuggacccaggucccuuucugcucgcaccauuuucacgaacucaucaugaaggacgggcgggugcugguggucccauguaggaaucaagacgaguugauuggacgcgcuagaauaucacagggugccggcuggagcuuacgggaaacugcuugccuggggaaguccuacgcccagauguggagucucauguauuuccacaggcgagaucuucgucuggcagcgaacgccaucuguucugcuguuccgagccauugggugcccacauccagaaccacuuggucaauucacgccaaacaugaguggaugaccacagaagacaugcuaacgguauggaaucgcguguggauccaggagaacccuuggauggaggauaagaccccagucgaaaguugggaggaaauucccuaccugggaaaacgggaggaccaauggugcggcucucucaucgguuugacuagcagggcaacaugggcuaagaauauacagguggccaucaaccagguuagaucccugauugggaaugaagaguauaccgauuacaugccuucaaugaaacgcuuucggagggaggaagaggaagcaggagugcuuugguga

SEQ ID NO: 14613 - RNA, 9876 nt, Artificial Sequence
  derived and/or modified CDS sequence (opt3) from DENV-2__FJ744724__SS-prME
agcgcaggcaugauaauuaugcugauacccaccgugauggcuuuccaccucacuacuagaaacggggagccucauaugaucgucgguauucaagaaaagggaaaaucccuucuguuuaagacggaggacggcguuaauaugugcaccuugauggcaauggauuuaggggaacugugugaggacacaaucacuuacaaaugcccacuacucaggcaaaacgaaccggaggauauugacuguuggugcaauucuaccucaacaugggugaccuauggaacuuguacaaccacgggcgagcaccggcgcgaaaagcgaaguguagcacuggugccccaugucgguauggggcuugagacucguaccgaaacauggaugagcuccgagggagcguggaaacacgcucagagaaucgagacuuggauacugaggcauccuggcuucaccaucauggccgcaauuuuggccuacacaaucggcaccacgcacuuucagcgggugcucauuuucauccugcugacugcuguugcaccaucuaugacaaugcgcugcauagggauuucgaacagagauuuuguggaaggagucucagguggcagcuggguggacaucguacucgagcacgggaguuguguuaccacuauggccaagaauaagcccacauuagauuucgaacugauuaaaaccgaggcuaagcagccugccacgcuuaggaaauauugcaucgaagcgaaguugaccaacacaacuaccgagucccgguguccaacacaaggagagcccucucugaaagaagaacaggacaagcgcuuugugugcaagcauagcaucgucgaucgaggcugggguaauggguguggacuauucggcaaaggcgggauugugacuugcgcaauguuuaccugcaagaaaaacauggaaggaaagauagugcagccugagaaucucgaauacacaaucgucguuaccccacacuccggugaggagcaugccgugggcaacgacacugggaaacacggaaaggaaauuaaaguaacgccgcagucaagugugacagaggcugaacugaccggcuaugguacugucaccauggaguguagccccagaacagggcuugauuucaaugaaauggugcuguugcaaauggagaacaaggccuggcucguucacaggcagugguuucuggacuuaccucugccauggcuccccggcgcagauaagcaggagucuaauuggauccagaaagaaacccuugugacuuucaagaacccucaugcuaaaaagcaagacgucgugguacugggaucccaggagggcgccaugcacacagcguugacgggggccaccgaaauacagaugucaagcggaaaucuacuguuuacuggucaucucaaaugccggcugcguauggacaaacuucaacugaagggcaugaguuacucuauguguacagggaaauucaagguugugaaagagauugcagagacccagcacggaacaaucgucauccgcgugcaguaugaaggcgaugguuccccaugcaagauucccuucgagaucauggacuuggagaagagauacguccucgggaggcugauuacugugaacccgauaguuaccgagaaggauagcccugugaacaucgaagcugagcccccauuuggcgacucguacauuaucaucggaguagagccuggccaguuaaagcugaauugguucaaaaaggggucuuccauuggacaaauguuugaaacgaccaugcggggugccaaacgaauggcuauacuaggcgauacagccugggacuucgggucacucggaggcgucuuuacaaguaucgguaaggcacugcaucagguguucggggccauuuauggcgcugcguuuagcggaguuuccuggaccaugaaaauccuuauuggcgugaucauaacauggaucgggaugaacucucgcagcacuucauugagugucucccuggugcucguaggaauugugacccuguaccuuggcguuaugguccaggcagauagcgguuguguggugucuuggaagaauaaggagcugaaaugcgggucaggaaucuucauuacggacaacguccacacauggaccgaacaguauaaguuucaacccgagaguccaagcaaauuggccuccgcuauccagaaggcccaggaagagggcauaugugguauuagaucuguuacuaggcucgagaaucugauguggaaacagaucacacccgaauuaaaccacauucuggcagagaaugaagugaagcuaaccaucaugacuggcgauauaaaagggaucaugcaagccggaaagcggucgcuccgcccucagccaaccgagcugaaguacagcuggaaaacauggggcaaggcuaaaaugcuuuccacggaaucauauaaccagaccuucuugauugacgggccggagacugccgagugccccaauacaaacagagcauggaauagucuggaaguggaggauuacggauuuggcguauucaccacaaacaucuggcucaagcugaaagaaaagcaggacgcguuuugugacucuaaguuaaugagcgcugccauuaaagauaauagggcaguccaugccgacauggguuauuggaucgaguccgcucugaacgauacuuggaagauagagaaagccucauucauugaagugaagaauugccacuggccuaaaagccauacccuuuggucuaacgggguuuuggaguccgaaaugaucaucccaaagaaccucgcaggacccgugagucaacacaauuaccguccuggcuaccacacgcagauugcugguccauggcaucugggcaagcuagagauggacuucgauuuuugugacgggacaaccgucgugguuacugaagauugcggaaaccggggccccagccugcgaaccacaacugccucugggaaacucaucaccgaguggugcuguagauccugcacacugccgccucuuagguaucgcggagaggacggcuguugguacgguauggaaauucggccauugaaggagaaagaagagaaucuggugaacucauuaguaacggcggggcacggacagauagauaauuucagucucggcguccuggguauggcccuuuuucuggaagagauguugagaaccagggugggcacuaagcaugcuauccuccugguggcagucagcuucguuacacuaauuaccgggaacaugucguuuaaagaccugggacgcgugguagugauggucggcgccacuauggcugaugacaucgggaugggagugacauaucucgcccugcuugcagcguucaagguucgacccaccuuugccgcuggcuugcuguuacggaagcucacguccaaagagcugaugaugacuaccauugguaucgugcuucugucucaaagcacaauaccugaaaccguccuagagcucacugaugcccuggcauuggggaugauggugcugaagaucguucgugacauggaaaaauaccaguuagcugugacaauuauggccauccucugcguccccaaugcaguaauucugcagaacgccuggaaggugucauguaccauccuugcuguugugagugucuccccacuguugcucacaucuagccagcagaaaacugacuggauaccucuggcgcuaaccauuaagggacugaaucccacggccaucuuccuuacaacccucuccagaacuaacaaaaagaggucauggccacugaaugaggcaaucauggcugugggcaugguaagcauuuuggccaguucucuguuaaagaacgauauaccgaugaccggcccucucguggccgggggacugcuuacagucugcuauguucugacuggucgcuccgcugacuuggaacucgagcgggcaaccgaugugaaaugggaggaccaggccgaaaucagcggcucgucacccauucugucuaucacgauuagugaggauggguccaugagcaucaagaaugaagaggaggaacagacacuaaccauacugaucagaacuggacuucucgugauuucuggccuguuuccaaucagcauucccaucacagcggcugccugguacuugugggaggucaaaaagcagagggccgguguguuaugggacguuccuuccccacccccuauggggaaagccgaacuggaggauggagcuuaucgaauaaagcaaaagggcauucucggcuacucacagaucggggcaggaguauacaaagaagguaccuuccacacuauguggcaugugacacgcggcgccguccugaugcacaaggggaaacggaucgagccgaguugggcggacgugaagaaagaucuuauuagcuauggaggcgguuggaagcuggagggggaauggaaggagggagaagagguucagguguuggcucuagaaccaggcaaaaaccccagagccguccagaccaagccuggccuguuuaaaacgaauacugggaccaucggagcagugucucucgacuucuccccagguacaucaggcagucccauaauugauaagaaagggaagguagucggacuguacggcaacggugugguuaccaggagcggggccuauguguccgcuaucgcccaaacagagaagucuauugaggacaacccugaaaucgaggaugacauauuucguaaacgccggcuuacuauuauggacuuacacccgggagcaggcaagaccaaaagauaccugcccgcuaucgucagggaagccaucaagcgaggccuccggacguugauucuggcgccaacacgcgugguugccgcagagauggaagaggcucucagagggcugccuaucagguaucagacucccgccauucgggcugagcauaccggacgagaaauaguggaucuuaugugucacgcaacauucaccaugagacuguugucgccaguccgcgugccuaauuacaaccuaaucauuauggacgaggcccauuucacugaucccgccagcaucgcugcgagggguuauaucucaacccguguagaaaugggcgaggcagccgggauuuuuaugacagcuacgccaccgggaucccgggacccuuucccccagaguaaugccccaauaaucgaugaggaaagagagauucccgaaaggucuuggaacagcggccacgagugggugacugacuuuaaagguaagaccguuugguucgucccuuccaucaaggcagggaaugauauugccgcuugccugcgcaaaaacggaaagaaagugauccaacucucacgaaagacauuugacucugaauacgugaaaaccagaacuaaugauugggacuucgucguaacaaccgauauaagcgagaugggcgcgaacuuuaaggccgagcgggugaucgacccaaggcgcuguaugaaacccguuauuuuaacggacggcgaagaacgugugauccuggcagggccuaugccggucacucauaguuccgcugcccagagacggggaaggauuggucgcaauccaaagaacgaaaaugaucaguacaucuauaugggcgagccccuugaaaacgacgaggauugcgcacacuggaaggaggccaaaaugcugcucgacaauauaaacacaccugaagggauuauccccagcauguucgagccagaacgagagaagguggaugcuauugacggagaauacagauugcggggcgaggccaggaaaaccuuuguugaucugaugcgcagaggugaccucccuguguggcuggcguauaaggucgcagccgaggggaucaauuacgcugauaggcggugguguuucgacggcaucaaaaacaaccagauccuugaagagaauguggaaguagagauuuggaccaaggagggagaacguaagaaacuaaagccccgcuggcuggaugcccgaaucuauucugacccauuggcuuuaaaagaguuuaaggaguucgcagccggcagaaaaucacugacucucaaccugauuacagagauggggaggcuuccuaccuucaugacacaaaagacucgggaugcucuggacaaucucgccguguugcacacggcagaagcgggaggucgcgccuacaaccaugcucuguccgagcuaccggagacccuggaaacacuccuucuguuaacuuugcuggccaccguuacaggcgggaucuuucucuuccugaugaguggaagaggcauagguaagaugacccuugggaugugcugcauuaucacugcaagcauccugcucugguaugcucagauucagccccacuggaucgccgcaucgauaauuuuggaguuuuuccugaucgucuuacuaauuccagaaccugagaaacagaggacgccccaagacaaucagcugaccuacguggugaucgccauacucacagucguugcugcgacuauggccaacgaaaugggcuuucuugagaagaccaaaaaggaucugggauugggcucuaucgcaacacagcagccagaguccaauauucuggacaucgaucuccggccugcuagcgccuggacccuguacgccguggcaacuacauucguaacgcccaugcuucgacauucaauugaaaacaguucugugaaugucucccucaccgcuaucgccaaccaagcgacugugcugaugggguugggaaaagguuggccgcugagcaagauggacauuggcguuccauuacuagcuaucggguguuauucacaggugaauccuauaacacugaccgccgcacuccuucuguuggucgcccacuacgcuauuaucggacccggccugcaggcaaaggccaccagagaggcgcagaaacgcgcugccgcagguaucaugaagaacccaacaguagaugggauuacugugauagaccucgaucccaucccuuaugacccgaaauuugaaaagcaacugggccagguuaugcuuuuaauucugugcgugacgcagguccucaugaugaggaccacaugggccuugugugaggcucugacucuagccaccggacccaucaguacacugugggaaggcaauccagggcgguucuggaacaccacuauugcagugagcauggcuaauaucuuucguggauccuaccucgccggcgcgggucuucuguucucuauaaugaaaaacacgacaaauaccagaagggggacuggaaacaucggcgagaccuugggugagaaguggaaaagccgccugaacgcccucggcaaguccgaauuucaaauuuauaagaaaucagggauccaggaggucgaucggacacuggcaaaggaaggaauuaaacgaggcgagacugaccaccaugcugugucuagagggagugccaaguuaaggugguucguugagcgcaauauggugaccccugaaggaaaaguaguggaucuuggcugcgguagagggggauggucguacuauuguggcggucugaagaacgucagagagguuaagggccucacaaaagggggacccggccacgaggaaccuaucccaaugagcacguacggguggaaucuagugcgucugcaguccggagucgacguguuuuucauacccccugaaaagugcgauaccuugcugugugacauuggcgagucuucaccaaaccccacuguagaggcagguaggacacuccgggugcuuaaucugguugaaaacugguugaauaacaauacccaguucugcaucaaagugcugaacccguacaugccuagcgucaucgagaagauggaagcucuccaacgcaaauaugggggagccuuagugcgaaauccacuguccagaaacaguacucaugagauguacugggucucuaaugccagcggcaacauugugucauccguuaauaugauaaguaggaugcuuaucaaccgguuuacaaugcgccacaagaaggcgaccuaugaacccgacguagaucugggcagcgggacgagaaacauuggaaucgagucugaggugccuaaucuagacauuaucgguaaaaggauagaaaagaucaaacaggagcaugaaaccuccuggcacuacgaucaggaccacccauauaagacaugggcuuaccauggcucauaugagacuaaacagaccgggagcgcaucgucuauggucaacggagugguucgacuccugacaaagcccugggauguguugccgacugucacccaaauggccaugacagacaccacuccuuucggccagcagcggguguuuaaggaaaaaguagauacgcguacacaggagcccaaggaggguaccaaaaagcugaugaaaauuacugcugaauggcucuggaaggagcuugggaaaaagaagaccccaagaauguguacacgcgaagaguucacgaggaaagugcggaguaaugccgcacugggagccaucuuuaccgacgagaacaaguggaaauccgcuagagaagcgguugaggauagccgcuucugggaauuagucgacaaggagaggaaucugcacuuggaaggcaaaugcgagacuuguguguacaacaugaugggcaagcgagagaagaaacucggggaauuuggaaaggccaaagguucacgggcaauuugguacauguggcugggcgcuagauuccuagaguuugaagcccuuggguuccugaaugaggaucauugguuuuccagggaaaacucucucagcggaguggagggcgagggucugcacaaguugggguauauccugcgcgacgucaguaaaaaggaaggaggcgcaauguacgccgacgauacagcuggcugggacacccguauuacucucgaggaucuuaagaaugaagagaugguuacaaaccacauggaaggggagcauaaaaagcuggccgaggcgauauucaaauuaaccuaucaaaauaaggugguacgggugcagagaccuacacccaggggaacugucauggacaucauuucccgccgagaucagcgggguagcggccaaguggggaccuacggacugaacacguuuaccaauauggaagcacaguugaucagacagauggagggcgaagguguuuucaaaaacauccagcaccucacagugacugaggaggucgccgugcaaaauuggcuggcuaggguagggcgcgaaagacuaucucggauggccauuucaggagacgauugcguugugaagccacuugacgauagguucgcaaacgcucugaccgcccucaacgacaugggcaagauacguaaagauauccagcagugggagcccaguaagggcuggaaugacuggacacaggucccuuuuugcucccaucacuuccaugaacugauuaugaaagaugggcgaguguugguggucccaugucgcaaccaagacgaguuaaucggacgggcucggauuagccagggugccggcuggucucugagggaaacugcaugccucgggaagucguaugcgcagauguggucacuuauguacuuucaccgcagagaccugcggcuagccgcuaaugccaucuguagcgcaguuccgucccacugggugcccaccaguaggacgacauggucuauacaugcuaaacacgaguggaugaccacugaggauaugcugacaguauggaaccgaguguggauccgugaaaauccuuggauggaggacaagaccccagucgaaagcugggaggaaauucccuaucucggaaagagagaggaucaguggugcggcuccuugaucggucugacuucacgcgccaccugggccaaaaacauucaaacagccaucaaucaggugcggagucuuauagggaacgaggaauacacggacuacaugccuucuaugaagagguucagacgcgaggaagaggaagcgggaguucugugguga

SEQ ID NO: 14614 - RNA, 9876 nt, Artificial Sequence
  derived and/or modified CDS sequence (opt3) from DENV-2__FJ906957__SS-prME
agcgccggcaugaucauuaugcugauccccaccgugauggcuuuccaccucaccacuagaaauggggagccucauaugaucgucuccauucaggaaaagggaaaaucucuucuguuuaagacggaggacgguguuaauaugugcaccuugauggcaauggauuuaggcgaacugugugaggacacaaucacuuacaaaugcccacuacucaggcaaaaugaaccggaggauauugacuguuggugcaauucaaccaguacaugggugaccuaugggacuuguacaaccacgggagagcaccggcgcgaaaagcgaagcguagcccuggugccccaugucggcaugggucuugagacucguaccgaaacauggauguccucugagggggcguggaaacacgcucagagaaucgagacuuggauacugaggcauccuggauucaccaucauggccgcaauuuuggccuacacaaucggcaccacgcacuuucagcgggcucucauuuucauccugcugacugcaguggccccaucgaugacaaugcgcugcauaggcauuucaaacagagauuuuguugaaggggugagcggagguaguugggucgacaucgugcucgagcacggcuccuguguaaccacuauggcuaagaauaagcccacauuagauuucgaacugauuaaaaccgaggccaagcagccugcgacgcuuaggaaauauugcaucgaagcaaaguugaccaacacaacuaccgagucucgguguccaacacaaggggagcccagccugaaagaggaacaagacaagcgcuuuguuugcaagcauuccaugguggaucgaggauggggcaaugguugugggcuauucggaaaaggcggcaucgucacuugcgccauguuuaccugcaagaaaaacauggaagggaagauugugcagccugagaaucucgaauacacaauaguggucaccccacacucaggagaggagcaugcuguugguaacgacacuggcaaacacgggaaggaaaucaaagugacgccgcagaguagcauuacagaggccgaacugaccggauauggcacuguaaccauggaguguucucccagaacaggucuugauuucaaugaaauggugcuguugcaaauggagaacaaggcauggcucguccacaggcagugguuucuggacuuaccucugccauggcuccccggggcugauaagcagggcuccaauuggauccagaaagagacccuugugacuuucaagaacccucaugccaaaaagcaagacguugugguccugggaucacaggaaggcgcgaugcacacagccuugacgggggcaaccgagauacagaugagcaguggaaaucuacuguuuacuggucaucucaaaugccggcugcguauggacaaacuucaacugaagggcaugucuuacuccauguguacagggaaauucaaggugguaaaagaaauugcugagacccagcacggaacaaucguuauccgcgugcaguaugagggcgaugguagcccaugcaagauucccuucgaaaucauggacuuggagaaaagauacguccucgggaggcugauuacugugaacccgauagucaccgaaaaggauucgccugugaacaucgaggccgaacccccauuuggcgacucuuacauuaucaucggaguugagccuggccaguuaaagcugaauugguucaaaaagggguccucaauuggacaaauguuugagacgaccaugcggggugcuaaacgaauggccauacuaggcgauacagcaugggacuucgggagucucggaggcguguuuacuagcaucgguaaggcccugcaucagguauucggggcuauuuauggcgcggcauuuuccggagucucuuggaccaugaaaauccuuauuggcgugaucauaacauggaucgggaugaacagccgcucaacaaguuuguccguuagccuggugcucgucggaauugugacccuguaccuuggcguaauggugcaggccgauucugguuguguugucucauggaagaauaaggaacugaaaugcgggaguggaaucuucauuacggacaacgugcacacauggaccgagcaguauaaguuucaacccgaaagcccauccaaauuggcuucugccauccagaaggcacaggaggaaggcauaugugguauuagaucggugacuaggcucgagaaucugauguggaaacagaucacacccgaguuaaaccacauucuggccgaaaaugaggucaagcuaaccaucaugacuggcgauauaaaagggaucaugcaagcuggaaagcggagccuccgcccucagccaaccgaacugaaguacuccuggaaaacauggggcaaggccaaaaugcuuucaacggagagucauaaccagaccuucuugauugacgggccggaaacugcagagugccccaauacaaacagagcguggaacucucuggagguugaagauuauggauuuggcguguucaccacaaacaucuggcucaagcugaaagagaagcaggacgcuuuuugugacagcaaguuaauguccgccgcaauuaaagauaauagggccgugcacgcugacauggguuacuggaucgaaucagcccugaacgauacuuggaagauagagaaagccagcuucauugagguaaagaauugccauuggccuaaaucucacacccuuugguccaacggggucuuggaaagugagaugaucaucccaaagaaccucgcuggacccgugagccaacacaauuaucguccuggcuaccauacgcagauugccgguccauggcaccugggcaagcuagaaauggacuucgauuuuugugacgggacaaccguuguggucacugaggauugcggaaaccggggccccucucugcgaaccacaacugcguccgggaaacucaucaccgaauggugcuguagaucaugcacacugccgccucuuagguaccgcggagaggacggcuguugguaugguauggagauucggccauugaaggaaaaagaggaaaaucuggugaacaguuuaguuacggccgggcauggacagguggauaauuucagccucggcguacuggguauggcucuuuuucuggaggaaauguugagaaccagggucggcacuaagcacgcaauacuccugguggccgcuucguucgugacacuaaucaccgggaacauguccuuuaaagaccugggacgcgucguugugaugguaggcgccacuaugacagaugacauugggaugggagugaccuaccucgcacugcuugcggccuucaagguccgacccacguuugcugccggcuugcuguuacggaagcucacuucuaaagagcugaugaugaccacaaucgguauugugcuucugagccaaucaaccaucccugagacuauacuagaacucacagaugcacuggcuuuggggaugaugguucugaagaucgugcguaauauggagaaauaucaguuagccgucaccauuauggcaauccucugcgugcccaacgccguuauucugcagaaugcuuggaaggugaguuguacaauccuugcggucguauccgugucuccacuguugcucacuagcucccagcagaagaccgacuggauaccucuggcccuaacgauuaagggacugaaccccacagcaaucuuccuuaccacucucucaagaaccaauaaaaagaggagcuggccacugaacgaagcuaucauggccguuggcauggugaguauuuuggccucuucccuguuaaagaaugacauaccgaugacaggcccucucgucgcugggggacugcuuacugugugcuacguacugaccggucgcagcgcagauuuggagcucgaacgggccacggacgugaaaugggaggaucaggcggagaucucgggcucaucucccauucugaguaucacaauuuccgaagacgggagcaugucuaucaagaacgaggaagaggagcagacccuaacuauacugaucagaacaggacuucucgucauuagcggccuguuuccaguuuccauccccauuaccgcugccgcaugguauuugugggaagugaaaaagcagagggccgguguguuaugggaugucccuucaccacccccuauggggaaagcugagcuggaagacggagcauaccgaaucaagcaaaagggcauacucggcuauagucagauuggggccggaguguacaaagaggguacuuuccauacaauguggcacguuacccgcggcgcgguacugaugcacaaggggaaacggaucgaaccgagcugggcugaugugaagaaagaccuuaucucuuacggaggcgguuggaagcuggagggggaguggaaggaaggagaggaaguccagguguuggcccuagagccaggcaaaaaucccagagcaguucagacgaagccuggccuguuuaaaacuaacaccgggacaauuggagccgugucccucgauuucucaccagguaccaguggcagccccaucauagacaagaaagggaaggucgugggacuguauggcaacgguguagucacaagguccggggcuuacgugucugccauugcacaaacugaaaagucgaucgaggauaauccugagauugaagacgauaucuuucguaaacgccggcuuaccauaauggacuuacauccgggagcuggcaagacgaaaagauaucugcccgccauuguuagggaggcgaucaagcgaggccuccggacauugauccuggccccaacucgcguggucgcagcugaaauggaggaagcccucagagggcugccuauuagguaccagacccccgcuauccgggcagagcacacaggacgagagauuguggaccuuaugugucaugccaccuucacuaugagacuguugagcccaguucgcgugccuaacuauaaucuaauaaucauggaugaagcccacuucaccgaccccgcuucaauugcggcaagggguuacaucuccacacgugucgagaugggcgaagccgcugggaucuuuaugacggccacuccaccgggaagucgggauccuuucccccagucuaacgcaccaauuauagacgaggagagagaaauccccgagaggagcuggaacuccggccaugaaugggugaccgauuuuaaagguaagacaguaugguucgugccuucaauuaaggccgggaacgacaucgcugcgugccugcgcaaaaauggaaagaaaguuauucaacucucucgaaagaccuuugauagcgaguaugucaaaacuagaacaaacgacugggauuucguggugaccacggacaucagugaaaugggcgccaauuuuaaggcagagcgggucauagauccaaggcgcuguaugaaacccguaaucuuaacugacggcgaggaacgugugauucuggcugggccuaugccgguuacacacuccagcgccgcacagagacggggaaggaucggucgcaacccaaagaaugagaacgaccaguacauuuacaugggcgaaccccuugagaaugaugaagacugcgcccacuggaaggaggcuaaaaugcugcucgauaacaucaauaccccugaggggauaauucccucuauguucgaaccagagcgagaaaagguggacgccaucgauggagaguauagauugcggggcgaagcgaggaaaaccuuugucgaccugaugcgcagaggugaucucccuguguggcuggcauacaagguugccgcugaggggauuaacuaugccgacaggcggugguguuucgauggcaucaaaaacaaucagauacuugaggaaaacguggaggucgaaaucuggacuaaggagggagagcguaagaaacuaaagccccgcuggcuggacgcucgaauuuacucagauccauuggcauuaaaagaauuuaaggaguucgccgcuggcagaaaaucccugacacucaaucugaucaccgaaauggggaggcuuccuacauucaugacucaaaagacgcgggacgcccuggauaaccucgcaguguugcauaccgcggaggccggaggucgcgcuuauaaucacgcccugagugaacuaccggagacacuggagacucuccuucuguuaaccuugcuggcaacaguaaccggcgggauuuuucucuuccugaugagcggaagaggcaucgguaagaugacucuugggaugugcugcauaauuacggcuucgauccugcucugguacgcccagauccagccccauuggauugcagccucuaucauauuggaauuuuuccugauuguguuacuaaucccagagccugaaaaacagaggacaccccaagacaaccagcugacauauguugucauugcuauccucacugugguggcggccaccauggcaaaugagaugggcuuucuugaaaagacuaaaaaggaccugggauugggcuccauagcuacccagcagccagagagcaacauccuggauauugaccuccggccugccucagccuggacucuguacgcagucgcuacaacguucguuacccccaugcuucgacacaguaucgaaaauucuuccgugaacguaagccucacugccauugcgaaucaagcuacagugcugaugggguugggaaaagguuggccgcugucaaagauggauaucggcgucccauuacuagccauuggguguuacagucaggugaacccuaucacccugaccgcagcccuccuucuguugguugcucacuaugcaauaauuggacccggccugcaggccaaggcgacaagagaagcucagaaacgcgccgcagccgguaucaugaagaauccaacuguggacgggaucacggucauugaucucgaccccauaccuuacgauccgaaauuugagaagcaacugggccagguaaugcuuuuaauccugugcgugacccagguucucaugaugaggacaacuugggcuuugugugaagcccugacccuagcaacaggacccauuagcacccugugggagggcaacccagggcgguucuggaauacuacgaucgcuguguccauggccaacauuuuucguggaucuuaucucgcgggcgccggucuucuguucagcaucaugaaaaauacaaccaacacuagaagggggaccggaaacauaggcgaaacauugggugagaaguggaaaucccgccugaaugcacucggcaagucagaguuucaaaucuacaagaaaucugggauucaggaagucgaccggacucuggcuaaggagggaaucaaacgaggcgaaaccgaucaucacgccgugaguagagggucggcaaaguuaaggugguucgucgagcgcaacauggugacaccugagggaaaaguuguggaccuuggcugcggucggggaggauggagcuauuacuguggcggucugaagaauguaagagaagugaagggccucacgaaagggggacccggccaugaggaaccuauuccaauguccaccuauggguggaaccuaguccgucugcagucuggaguugauguguuuuucauacccccugagaagugcgacacuuugcugugugauauaggcgaaucaagcccaaaucccacagucgaggcugguaggacccuccgggugcuuaaccugguagagaauugguugaacaauaacacucaguucugcauuaaagugcugaauccguacaugccuuccguuaucgaaaagauggaggcccuccaacgcaaauacgggggagccuuagugcgaaacccacugaguagaaauucuacacacgaaauguauugggucagcaacgcgucaggcaauaucguguccagugucaacaugauuagcaggaugcuuauaaaccgguuuaccaugcgccauaagaaggcuacguacgagcccgacguggaccugggcucugggaccagaaauaucggaauugaauccgagaucccuaaccuagauauuaucgguaaaaggauagagaagaucaaacaggaacacgagacaucauggcacuaugaccaggaucauccauacaagacuugggcauaucacggcagcuacgaaaccaaacagacagggucggccucuaguaugguuaauggaguagugcgacuccugacuaagcccugggacgucuugccgaccgugacacaaauggcuaugaccgauacuacgccuuucggccagcagcggguuuuuaaggagaaaguggacacacguacccaggaacccaaggaggguacuaaaaagcugaugaaaauuaccgccgaguggcucuggaaggaacuugggaaaaagaagacaccaagaauguguacgcgcgaggaguucaccaggaaaguccgguccaacgcagcccugggagcuaucuuuacugaugagaauaaguggaaaagcgcgagagaggccguggaagacucacgcuucugggaguuaguagauaaggaaaggaaccugcauuuggagggcaaaugcgaaacauguguguauaauaugaugggcaagcgagagaagaaacucggggaguuuggaaaggcaaaagguucccgggcuauuugguacauguggcugggcgccagauuccuagaauuugaggcacuuggguuccugaacgaagaccacugguuuucuagggagaauagccucaguggaguugaaggcgagggucugcacaaguugggguacauccugcgcgaugucuccaaaaaggagggaggcgccauguaugcugacgacaccgccggcugggauacucguauuacacucgaagaccuuaagaacgaggaaauggugaccaaucauauggagggggaacacaaaaagcuggcggaggcaauauucaaauuaacauaccaaaacaaggugguccggguucagagaccuacucccaggggaaccgugauggauaucauuagccgccgagaccagcgggguucuggccaaguagggacguauggacugaauaccuuuacaaacauggaggcccaguugaucagacagauggaaggcgaggguguguucaaaaauauccagcaucucacugucaccgaagagauugcugugcaaaacuggcuggccaggguugggcgcgagagacuaucacggauggcaauaaguggagaugacugcguggucaagccacuugaugacagguucgcuaacgcccugacagcucucaaugauaugggcaagauccguaaagacauucagcagugggaacccuccaagggcuggaacgauuggacucaggugccuuuuugcagccaccauuuccacgagcugaucaugaaagacgggcgaguauugguugugccaugucgcaaucaagaugaauuaauugggagagcacggaucucucagggugcaggcuggucgcugagggagaccgcgugccucgggaagucauacgcccagauguggagccuuauguauuuucaccgcagagaccugcggcuagcugccaacgcaauauguuccgcugucccgagucauugggugcccacgucuaggacaaccuggagcauccacgccaaacaugaauggaugacuacagaggacaugcugaccguguggaaucgagucuggauucaggagaacccuuggauggaagauaagacuccaguugaguccugggaagagauccccuaccucggaaagcgugaagaccaauggugcggcucauugauuggucugaccaguagagcaacaugggccaaaaauauccaggcggcuauaaaccaggugcgcucucuuauugggaaugaggaguauacggauuacaugccuagcaugaagcgguucaggagagaagaggaagaggccggaguacugugguga

SEQ ID NO: 14615 - RNA, 9876 nt, Artificial Sequence
  derived and/or modified CDS sequence (opt3) from DENV-2__FJ906958__SS-prME
agcgugggaaugaucauuaugcugauaccaaccgucauggccuuccaccucacaacuagaaacggggagccucauaugaucguuuccauucaggaaaagggaaaaucucuucuguuuaagacggaggacggugugaauaugugcaccuugauggcuauggauuuaggcgaacugugugaggacacaaucacuuacaaaugcccacuacucaggcaaaacgaaccggaggauauugacuguuggugcaauucaaccaguacauggguaaccuaugggacuuguacaaccacgggagagcaccggcgcgaaaagcgaagcguggcacuggucccacaugugggcaugggucuugagacucguaccgaaacauggauguccucugagggggccuggaaacacgcgcagagaaucgagacuuggauacugaggcauccuggauucaccaucauggcugccauuuuggcauacacaaucggcaccacgcacuuucagcgggcccucauuuucauccugcugacugcuguugcaccaucgaugacaaugcgcugcauaggcauuucaaacagagauuuuguggaaggggucagcggagguaguuggguggacaucguacucgagcacggcuccuguguuaccacuauggccaagaauaagcccacauuagauuucgaacugauuaaaaccgaggcuaagcagccugccacgcuuaggaaauauugcaucgaagcgaaguugaccaacacaacuaccgagucucgguguccaacacaaggggagcccagccugaaagaagaacaggacaagcgcuuugugugcaagcauuccauggucgaucgaggauggggcaaugguugugggcuauucggaaaaggcggcaucgugacuugcgcaauguuuaccugcaagaaaaacauggaagggaagauugugcagccugagaaucucgaauacacaauagucguuaccccacacucaggagaggagcaugccguggguaacgacacuggcaaacacgggaaggaaaucaaaguaacgccgcagaguagcauuacagaggcugaacugaccggauauggcacugugaccauggaguguucucccagaacaggucuugauuucaaugaaaugguccuguugcaaauggagaacaaggccuggcucgugcacaggcagugguuucuggacuuaccucugccauggcuccccggggcagauacccagggcuccaauuggauccagaaggagacucuuguuacauucaaaaacccucaugcuaagaaacaagacguggucgugcugggaucacaggaaggcgccaugcacacggcguugaccggggccacugagauacagaugagcaguggaaaucuacuguuuacaggucaucucaagugccggcugcguauggacaaacuucaacugaagggcaugucuuacuccauguguaccgggaaguucaaaguaguuaaggaaauugcagagacacagcacggaacuaucgugauccgcguccaguaugagggcgaugguagcccaugcaaagugcccuucgaaauuauggacuuggagaagagauacguccucgggaggcugaucaccgugaacccgguugugacggaaaaagauucgccuguaaacauugaggcugaacccccauuuggcgacucuuacauaaucauuggagucgagccuggccaguuaaagcugaauugguucaagaaaggguccucaaucggacaaauguuugagaccacaaugcggggugccaagcgaauggcuauccuaggcgauacugccugggacuucgggagucucggaggcguguuuaccagcauugguaaagcacugcaucagguuuucggggccauauauggcgcugcguuuuccggagugucuuggacaaugaagauccuuauuggcgucaucauuacuuggaucgggaugaacagccgcucaaccaguuuguccgugagccugguacucgugggaauaguuacgcuguaccuuggcgucauggugcaggcagauucugguuguguggucucauggaaaaauaaggaacugaagugcgggaguggaaucuucauuacagacaacguucacaccuggacugagcaguauaaauuucaacccgaaagcccauccaaguuggccucugcuauccagaaagcccaggaggaaggcauuugugguaucagaucggugacaaggcucgagaaucugauguggaagcagauaacccccgaguuaaaccacauucuggcagaaaaugaggugaaacuaacuaucaugaccggcgauauuaaggggaucaugcaagccggaaaacggagccuccgcccucagccaacagaacugaaguacuccuggaagacguggggcaaagcuaagaugcuuucaaccgagagucauaaccagacuuucuugauagacgggccggaaacagccgagugccccaauaccaacagagcauggaacucucuggagguagaagauuauggauuuggcgucuucacaacuaacaucuggcucaaacugaaggagaaacaggacgcguuuugugacagcaaguuaauguccgcugccgugaaggauaauagggcaguucacgccgacauggguuacuggauugaaucagcucugaacgauaccuggaaaaucgagaaggccagcuucauugaggugaaaaauugccauuggccuaagucucacacgcuuugguccaacggggucuuggaaagugagaugaucauacccaagaaucucgcaggacccgugagccaacacaauuaucguccuggcuaccauacacagauugcugguccauggcaccugggcaagcuagaaauggacuucgauuuuugugacgggaccacuguugugguaaccgaggauugcggaaaccggggccccucucugcgaacaacuaccgccuccgggaagcucaucacagaauggugcuguagaucaugcacgcugccgccucuuagguaccgcggagaggacggcuguugguaugguauggagauccggccauugaaagaaaaggaggaaaaucuggucaacaguuuagugaccgcggggcagggacaaguggauaauuucagccucggcguccuggguauggcccuuuuucuggaggaaauguugagaacuaggguuggcacaaaacaugcuauucuccugguggcaguaucguucgugacccuaaucacugggaacauguccuuuaaggaccugggacgcgucgugguuauggugggcgccacaaugaccgaugacauugggaugggagucacguaccucgcucugcuugccgcauucaaagugcgacccacuuuugcggccggcuugcuguuacggaagcucaccucuaaggagcugaugaugacaaccauagguaucguucuucugagccagucaacuauuccugagacaauccuagaacucaccgaugcucuggccuuggggaugauggugcugaaaauuguccgugacauggagaaguaucaguuagcaguaacaaucauggcuauacucugcgugcccaaugccguuauccugcagaacgcauggaaagugaguuguacuauucuugccgucguguccguaucuccacuguugcucaccagcucccaacagaagacggacuggaucccucuggcucuaacaauuaaaggacugaaucccaccgcgaucuuccuuacuacccucucaagaacaaacaagaaaaggagcuggccacugaaugaagccauaauggcagugggcauggucaguauuuuggcuucuucccuguuaaagaacgauaucccgaugacuggcccucucguugccgggggacugcuuaccgugugcuacgugcugacgggucgcagcgccgacuuggagcucgaacgggcuacagaugucaagugggaggaccaggcagagaucucgggcucaucucccauucugaguauaaccaucuccgaagaugggagcaugucuauuaaaaaugaggaagaggagcagacucuaacaauccugauuagaaccggacuucucgugaucagcggccuguuuccaguuuccauacccaucacugccgcggcuugguauuugugggaaguaaagaaacaaagggccgguguguuaugggacgucccuucaccacccccuauggggaaggcagagcuggaagauggagccuaccgaauuaaacagaagggcauccucggcuauagucagauuggggcuggaguguacaaggaggguacauuccacaccauguggcauguuacgcgcggcgcagugcugaugcacaaagggaagcggaucgaaccgagcugggccgacgucaaaaaggaucuuauaucuuacggaggcgguuggaaacuggagggggaguggaaggaaggagaggaagugcagguauuggcgcuagagccaggcaagaaccccagagcuguccaaacuaaaccuggccuguuuaagaccaauacagggaccauuggagccgugucccucgacuucucaccagguacaaguggcagccccaucaucgauaaaaaggggaaaguugugggacuguauggcaacggugucgugacuagguccggggcauacguuucugccauugcucagaccgaaaagucgaucgaggacaacccugauauagaggacgacauuuuucguaagcgccggcuuacgaucauggauuuacacccgggagccggcaaaacaaagagauaucugcccgcaauugugagggaagcuaucaaacgaggccuccggacuuugauacuggccccaacccgcgucguggcggccgagauggaagaggcacucagagggcugccuauuagguaccagacacccgcuauccgggccgaacauaccggacgagagaucguagaccuuaugugucacgcuacuuucaccaugagacuguugagcccagugcgcguuccuaauuauaaccuaauuaucauggaugaggcacauuucacagaccccgccucaauugccgcuagggguuacauauccacgcgugucgaaaugggcgaggcggcagggaucuuuaugacugccaccccaccgggaagucgggauccuuucccccaaucuaaugcuccaauuaucgacgaagagagagagauccccgaaaggagcuggaacuccggccacgagugggugacagauuuuaaggguaaaaccgugugguucgucccuucaauuaaggccgggaaugacauagcagccugccugcgcaagaacggcaagaagguaauccagcucucucgaaaaacuuuugauagcgaauaugcuaagacaagaaccaaugacugggauuucgugguuacgacugacauuagugagaugggcgcgaacuuuaaagccgaacgggugaucgacccaaggcgcuguaugaagcccgucauuuuaacagauggcgaggagcgugugauccuggcagggccuaugccgguuacccauuccagcgcugcccagagacggggaaggauaggucgcaaucccaaaaacgaaaaugaccaguacaucuacaugggcgagccccuugaaaacgaugaggacugcgcacacuggaaggaagccaagaugcugcucgauaauauuaacaccccugaggggaucauucccucuauguucgagccagaacgagagaaaguggacgcuaucgauggagaauauagauugcggggcgaggccaggaagacuuuugucgaccugaugcgcagaggugaucucccuguguggcuggcguacaaaguagcagccgaagggauaaauuaugcugacaggcggugguguuucgauggcauuaagaacaaccaaauccuugaggagaauguggaaguugagauuuggacaaaagaaggagagcguaagaagcuaaaaccccgcuggcuggacgcccgaaucuacucagauccauuggcuuuaaaggaguuuaaagaguucgcagccggcagaaagucccugacccucaaccugauaacagagauggggaggcuuccuacuuucaugacgcagaaaacccgggacgcucuggacaaucucgccgucuugcacacagcagaagcgggaggucgcgccuauaaccaugcucugagugagcuaccggaaacucuggagacccuccuucuguuaacauugcuggccaccgugacuggcgggaucuuucucuuccugaugagcggaagaggcauugguaagaugacgcuugggaugugcugcaucgugaccgcaucgauucugcucugguacgcucagauccagccccacuggauagccgcaucuauuaucuuggaguuuuuccugaucgucuuacuaauuccagaaccugagaagcaaaggacaccccaggauaaucagcugacuuauguugugaucgccauacucaccguaguggcugcgacaauggccaacgaaaugggcuuucuugagaaaaccaagaaagaccugggauugggcuccauugcaacucagcaaccagaaagcaauauccuggauauugaccuccggccugcuucagccuggacacuguacgccgucgcaacgaccuucgugacucccaugcuucgacauaguaucgagaacucuuccguuaaugugagccucacagcuauagccaaccaggcgaccguccugaugggguugggaaaggguuggccgcugucaaaaauggauaucggcguaccauuacuagcuauuggguguuacagucaggugaauccuaucacccugacagccgcacuccuucuguugguugcccacuaugcuauuaucggacccggccugcaggcaaaggccacuagagaggcgcaaaagcgcgcugccgcagguauuaugaaaaacccaacgguggacgggaucaccgucauagaucucgaccccauuccuuacgauccgaaguuugaaaaacagcugggccaggugaugcuuuuaguccugugcgugacacaaguucucaugaugaggacuaccugggccuugugugaggcucugacacuagccaccggacccaucagcacucugugggaaggcaauccagggcgguucuggaacacgacaaucgcaguguccauggcuaauauuuuucguggaucuuaucucgccggcgcgggucuucuguucagcauaaugaagaacaccacuaauaccagaagggggacaggaaacaucggcgagacuuugggugaaaaauggaagucccgccugaacgcccucggcaaaucagaguuucagauuuacaagaagucugggauccaggagguagaccggacccuggcaaaagaaggaauuaagcgaggcgagacagaucaccaugcugugaguagagggucggccaaauuaaggugguucgucgaacgcaauaugguuacgccugagggaaagguggucgaccuuggcugcgguagagggggauggagcuauuacuguggcggucugaaaaacgugcgggagguaaagggccucaccaaagggggacccggccacgaggaaccuaucccaauguccacuuauggguggaaucuagugcgucugcagucuggaguugauguguuuuucauacccccugaaaaaugcgacacauugcugugugacaucggcgagucaagcccaaaccccaccgucgaagcagguaggacucuccgggugcuuaaucuggucgagaacugguugaauaacaauacacaauucugcauuaaggugcugaacccguacaugccuuccguuaucgagaaaauggaaacccuccagcgcaaguacgggggagcuuuaguacgaaauccacugaguagaaacucuacgcaugagauguauugggugagcaaugccucaggcaacauugucuccagugugaauaugaucagcaggaugcuuauaaaccgguuuaccaugcgccacaaaaaggccacauacgaacccgauguugaccugggcucugggacuagaaacauuggaaucgaguccgaaaucccuaaucuagauauuauagguaagaggaucgagaaaauuaagcaggagcaugaaaccucauggcacuaugaccaggaucacccauacaaaacaugggcguaucauggcagcuacgagacuaagcaaaccgggucggcuucuaguauggugaacggagucgugcgacuccugacaaaacccugggacguauugccgaccgugacucagauggcaaugacggauacaaccccuuucggccagcagcggguuuuuaaggaaaaggucgacacucguacccaagagcccaaagaagguacaaagaaacugaugaagaucacggccgaguggcucuggaaagagcuugggaagaaaaagaccccaagaauguguacucgcgaagaguucacaaggaaggugcgguccaaugcugcccugggagcaauuuuuaccgaugaaaacaaauggaaaagcgccagagaggcuguggaggacucacgcuucugggaauuagucgauaaagagaggaaucugcacuuggaaggcaagugcgagacuuguguuuauaacaugaugggcaaacgagaaaagaagcucggggaguuuggaaaagcgaaggguucccgggccaucugguacauguggcugggcgcaagauuccuagaguuugaagcucuuggguuccugaaugaggaccauugguuuucuagggaaaacagccucaguggaguggagggcgaaggucugcacaaauugggguacauacugcgcgacguauccaagaaagagggaggcgccauguaugcagaugacacagccggcugggauacccguaucacacucgaggaccuuaagaaugaagagauggugacuaaccacauggaaggggagcauaagcggcuggcugaagccauuuucaaauuaaccuaccagaauaaggucgugagaguucagaggccuacgccccgcggaaccgugauggauaucauuagccgacgggaccaaagagguucuggccaggucgggacauauggacugaacacuuuuaccaauauggaggcgcaguugaucaggcagauggagggcgaagguguguucaaaaacauucaacaccucacaguaacugaggaaauagcaguucagaauuggcuggcccgcguggggagagagcggcuaucaaggauggcuaucaguggagaugacugcgucgugaagccacuugaugaccguuucgccuccgcacugaccgcucucaacgauaugggcaaaauucgaaaggacauccagcagugggagcccagccgcggcuggaacgauuggacgcaagugccuuuuugcucucaucacuuccaugaacugaucaugaaggacgggagagucuugguugugccaugucggaaucaggacgaguuaauuggaagggcccgcauaucgcagggugcuggcuggucacugagagaaacagccugccucgggaaaagcuacgcacagauguggucccuuauguauuuucaccggagggaucugcgacuagcggccaacgcuaucuguagugccguaccgucucacugggugcccaccagccguacuacaugguccauucaugcaaagcacgaguggaugaccacugaagacaugcugaccgucuggaauagaguguggauccaagagaacccuuggauggaggauaaaacaccaguugaaucaugggaggaaauucccuaccucggaaagcgcgaggaccaguggugcggcaguuugaucggucugacgucucgggcuaccugggccaaaaauauacaggcagccaucaaccaggugaggagccuuauugggaaugaagaguauacugauuacaugccuuccaugaagagauuccgccgggaggaagaggaagcgggaguccugugguga

SEQ ID NO: 14616 - RNA, 9876 nt, Artificial Sequence
  derived and/or modified CDS sequence (opt3) from DENV-2__FJ898452__SS-prME
agcgcaggcaugauaauuaugcugauacccaccgugauggcuuuccaccucacuacuagaaacggggagccucauaugaucgucgguauucaagaaaagggaaaaucccuucuguuuaagacggaggacggcguuaauaugugcaccuugauggcaauggauuuaggggaacugugugaggacacgaucacuuacaaaugcccacuacucaggcaaaacgaaccggaggauauugacuguuggugcaauucuaccucaacaugggugaccuauggaacuuguacaaccacgggcgagcaccggcgcgaaaagcgaaguguagcacuggugccccaugucgguauggggcuugagacucguaccgaaacauggaugagcuccgagggagcguggaaacacgcucagagaaucgagacuuggauacugaggcauccuggcuucaccaucauggccgcaauuuuggccuacacaaucggcaccacgcacuuucagcgggugcucauuuucauccugcugacugcuguugcaccaucuaugacaaugcgcugcauagggauuucgaacagagauuuuguggaaggagucucagguggcagcuggguggacaucguacucgagcacgggaguuguguuaccacuauggccaagaauaagcccacauuagauuucgaacugauuaaaaccgaggcuaagcagccugccacgcuuaggaaauauugcaucgaagcgaaguugaccaacacaacuaccgagucccgguguccaacacaaggagagcccucucugaaagaagaacaggacaagcgcuuugugugcaagcauagcauggucgaucgaggcugggguaauggguguggacuauucggcaaaggcgggaucgugacuugcgcaauguuuaccugcaagaaaaacauggaaggaaagauugugcagccugagaaucucgaauacacaauagucguuaccccacacuccggugaggagcaugccgugggcaacgacacugggaaacacggaaaggaaaucaaaguaacgccgcagucaaguauuacagaggcugaacugaccggcuaugguacugugaccauggaguguagccccagaacagggcuugauuucaaugaaaugguccuguugcaaauggagaacaaggccuggcucgugcacaggcagugguuucuggacuuaccucugccauggcuccccggcgcagauaagcaggagucuaauuggauccagaaagaaacccuuguuacuuucaagaacccucaugcuaaaaagcaagacguggucgugcugggaucccaggagggcgccaugcacacagcguugacgggggccaccgaaauacagaugucaagcggaaaucuacuguuuacuggucaucucaaaugccggcugcguauggacaaacuucaacugaagggcaugaguuacucuauguguacagggaaauucaagguaguuaaagagauugcagagacccagcacggaacaaucgugauccgcguccaguaugaaggcgaugguuccccaugcaagauucccuucgagaucauggacuuggagaagagauacgugcucgggaggcugauuacugucaacccgauagugaccgagaaggauagcccuguuaacaucgaagcugagcccccauuuggcgacucguacauuaucaucggaguggagccuggccaguuaaagcugaauugguucaaaaaggggucuuccauuggacaaauguuugaaacgaccaugcggggugccaaacgaauggcuauacuaggcgauacagccugggacuucgggucacucggaggcguauuuacaaguaucgguaaggcacugcaucaggucuucggggccauuuauggcgcugcguuuagcggaguguccuggaccaugaaaauccuuauuggcguuaucauaacauggaucgggaugaacucucgcagcacuucauugagugugucccugguccucgugggaauuguaacccuguaccuuggcgugaugguucaggcagauagcgguugugucgugucuuggaagaauaaggagcugaaaugcgggucaggaaucuucauuacggacaacgugcacacauggaccgaacaguauaaguuucaacccgagaguccaagcaaauuggccuccgcuauccagaaggcccaggaagagggcauaugugguauuagaucugucacuaggcucgagaaucugauguggaaacagaucacacccgaauuaaaccacauucuggcagagaaugaaguuaagcuaaccaucaugacuggcgauauaaaagggaucaugcaagccggaaagcggucgcuccgcccucagccaaccgagcugaaguacagcuggaaaacauggggcaaggcuaaaaugcuuuccacggaaucauauaaccagaccuucuugauugacgggccggagacugccgagugccccaauacaaacagagcauggaauagucuggaaguggaggauuacggauuuggcguguucaccacaaacaucuggcucaagcugaaagaaaagcaggacgcguuuugugacucuaaguuaaugagcgcugccauuaaagauaauagggcaguacaugccgacauggguuauuggaucgaguccgcucugaacgauacuuggaagauagagaaagccucauucauugaagucaagaauugccacuggccuaaaagccauacccuuuggucuaacgggguguuggaguccgaaaugaucaucccaaagaaccucgcaggacccguuagucaacacaauuaccguccuggcuaccacacgcagauugcugguccauggcaucugggcaagcuagagauggacuucgauuuuugugacgggacaaccgugaucgucacugaagauugcggaaaccggggccccagccugcgaaccacaacugccucugggaaacucauuaccgaguggugcuguagauccugcacacugccgccucuuagguaucgcggagaggacggcuguugguacgguauggaaauacggccauugaaggagaaagaagagaaucuggugaacucauuaguuacggcggggcacggacagguggauaauuucagucucggcguacuggguauggcccuuuuucuggaagagauguugagaaccagggucggcacuaagcaugcuauccuccugguggcagugagcuucgucacacuaauuaccgggaacaugucguuuaaagaccugggacgcguugugguaauggugggcgccacuauggcugaugacaucgggaugggagucacauaucucgcccugcuugcagcguucaaggugcgacccaccuuugccgcuggcuugcuguuacggaagcucacguccaaagagcugaugaugacuaccauugguaucguucuucugucucaaagcacaauaccugaaaccgugcuagagcucacugaugcccuggcauuggggaugaugguccugaagaucgugcguaauauggaaaaauaccaguuagcuguuacaauuauggccauccucugcgugcccaacgcagucauucugcagaaugccuggaagguaucauguaccauccuugcugugguuaguguguccccacuguugcucacaucuagccagcagaaaacugacuggauaccucuggcgcuaaccauuaagggacugaaccccacggccaucuuccuuacaacccucuccagaacuaauaaaaagaggucauggccacugaacgaggcaaucauggcugucggcauggugagcauuuuggccaguucucuguuaaagaaugacauaccgaugaccggcccucucguagccgggggacugcuuacagugugcuauguccugacuggucgcuccgcugauuuggaacucgagcgggcaaccgacguuaaaugggaggaucaggccgaaaucagcggcucgucacccauucugucuaucacgauuagugaggacggguccaugagcaucaagaacgaagaggaggaacagacacuaaccauacugaucagaacuggacuucucgugauuucuggccuguuuccaaucagcauucccaucacagcggcugccugguacuugugggaggugaaaaagcagagggccggugucuuaugggaugugccuuccccacccccuauggggaaagccgaacuggaggacggagcuuaucgaauaaagcaaaagggcauucucggcuacucacagaucggggcaggaguuuacaaagaagguaccuuccacacuauguggcauguaacacgcggcgccgugcugaugcacaaggggaaacggaucgagccgaguugggcggaugucaagaaagaccuuauuagcuauggaggcgguuggaagcuggagggggaauggaaggagggagaagaggugcagguuuuggcucuagaaccaggcaaaaaucccagagccgugcagaccaagccuggccuguuuaaaacgaacacugggaccaucggagcagucucucucgauuucuccccagguacaucaggcagucccauaauugacaagaaagggaaggugguaggacuguacggcaacggugucgugaccaggagcggggccuauguuuccgcuaucgcccaaacagagaagucuauugaggauaauccugaaaucgaggacgauauauuucguaaacgccggcuuacuauuauggacuuacacccgggagcaggcaagaccaaaagauaccugcccgcuaucgugagggaagccaucaagcgaggccuccggacguugauucuggcgccaacacgcgucguggccgcagagauggaagaggcucucagagggcugccuaucagguaucagacucccgccauucgggcugagcauaccggacgagaaauaguugaccuuaugugucacgcaacauucaccaugagacuguugucgccagugcgcgucccuaacuacaaucuaaucauuauggaugaggcccauuucacugaccccgccagcaucgcugcgagggguuauaucucaacccguguggaaaugggcgaggcagccgggauuuuuaugacagcuacgccaccgggaucccgggauccuuucccccagaguaacgccccaauaaucgacgaggaaagagagauucccgaaaggucuuggaauagcggccacgaguggguaacugauuuuaaagguaagaccgugugguucguuccuuccaucaaggcagggaacgacauugccgcuugccugcgcaaaaauggaaagaaagucauccaacucucacgaaagacauuugauucugaauacgugaaaaccagaacuaacgacugggauuucguggucacaaccgacauaagcgagaugggcgcgaauuuuaaggccgagcggguaaucgauccaaggcgcuguaugaaacccgugauuuuaacggacggcgaagaacguguuauccuggcagggccuaugccggugacucauaguuccgcugcccagagacggggaaggauuggucgcaacccaaagaaugaaaacgaccaguacaucuauaugggcgagccccuugaaaaugaugaggacugcgcacacuggaaggaggccaaaaugcugcucgauaacauaaauacaccugaagggauuauccccagcauguucgagccagaacgagagaaggucgacgcuauugauggagaauacagauugcggggcgaggccaggaaaaccuuuguggaccugaugcgcagaggugaucucccuguuuggcuggcguauaagguggcagccgaggggaucaacuacgcugacaggcggugguguuucgauggcaucaaaaacaaucagauccuugaagagaacgucgaaguggagauuuggaccaaggagggagaacguaagaaacuaaagccccgcuggcuggacgcccgaaucuauucugauccauuggcuuuaaaagaguuuaaggaguucgcagccggcagaaaaucacugacucucaaucugauuacagagauggggaggcuuccuaccuucaugacacaaaagacucgggacgcucuggauaaccucgccguauugcacacggcagaagcgggaggucgcgccuacaaucaugcucuguccgagcuaccggagacccuggaaacacuccuucuguuaacuuugcuggccaccgugacaggcgggaucuuucucuuccugaugaguggaagaggcauagguaagaugacccuugggaugugcugcauuaucacugcaagcauccugcucugguaugcucagauucagccccacuggaucgccgcaucgauaauuuuggaguuuuuccugaucguuuuacuaauuccagaaccugagaaacagaggacgccccaagacaaccagcugaccuacgucgugaucgccauacucacaguggucgcugcgacuauggccaaugaaaugggcuuucuugagaagaccaaaaaggaccugggauugggcucuaucgcaacacagcagccagaguccaacauucuggauaucgaccuccggccugcuagcgccuggacccuguacgccguugcaacuacauucgugacgcccaugcuucgacauucaauugaaaauaguucuguaaacgugucccucaccgcuaucgccaaucaagcgacuguccugaugggguugggaaaagguuggccgcugagcaagauggauauuggcgugccauuacuagcuaucggguguuauucacagguuaacccuauaacacugaccgccgcacuccuucuguugguggcccacuacgcuauuaucggacccggccugcaggcaaaggccaccagagaggcgcagaaacgcgcugccgcagguaucaugaagaauccaacagucgacgggauuacuguaauagaucucgaccccaucccuuaugauccgaaauuugaaaagcaacugggccaggugaugcuuuuaauucugugcguuacacaggugcucaugaugaggaccacaugggccuugugugaggcucugacucuagccaccggacccaucaguacacugugggaaggcaacccagggcgguucuggaauaccacuauugcagucagcauggcuaacaucuuucguggauccuaccucgccggcgcgggucuucuguucucuauaaugaaaaauacgacaaacaccagaagggggacuggaaacaucggcgagaccuugggugagaaguggaaaagccgccugaaugcccucggcaaguccgaauuucaaauuuauaagaaaucagggauccaggagguggaccggacacuggcaaaggaaggaauuaaacgaggcgagacugaucaccaugcugucucuagagggagugccaaguuaaggugguucguggagcgcaacaugguuaccccugaaggaaaagugguagaccuuggcugcgguagagggggauggucguacuauuguggcggucugaagaaugugagagaggucaagggccucacaaaagggggacccggccacgaggaaccuaucccaaugagcacguacggguggaaccuaguucgucugcaguccggaguggaugucuuuuucauacccccugaaaagugcgacaccuugcugugugauauuggcgagucuucaccaaaucccacuguggaggcagguaggacacuccggguacuuaaccugguggaaaauugguugaacaauaacacccaguucugcaucaaaguucugaauccguacaugccuagcgugaucgagaagauggaagcucuccaacgcaaauaugggggagccuuaguccgaaacccacuguccagaaauaguacucaugagauguacugggugucuaacgccagcggcaauauugucucauccgugaacaugauaaguaggaugcuuaucaaccgguuuacaaugcgccacaagaaggcgaccuaugaacccgacguugaccugggcagcgggacgagaaauauuggaaucgagucugagauuccuaaccuagauaucauagguaaaaggaucgaaaagauuaaacaggagcaugaaaccuccuggcacuacgaccaggaucacccauauaagacaugggcuuaccauggcucauaugagacuaaacagaccgggagcgcaucgucuaugguaaauggagugguccgacuccugacaaagcccugggacguguugccgacuguuacccaaauggccaugacagauaccacuccuuucggccagcagcggguguuuaaggaaaaagucgacacgcguacacaggagcccaaggaggguaccaaaaagcugaugaaaaucacugcugaauggcucuggaaggagcuugggaaaaagaagaccccaagaauguguacacgcgaagaguucacgaggaaagugcggaguaacgccgcacugggagccauuuuuaccgaugagaauaaguggaaauccgcuagagaagcgguagaggacagccgcuucugggaauuaguggauaaggagaggaaccugcacuuggaaggcaaaugcgagacuuguguuuacaauaugaugggcaagcgagagaagaaacucggggaauuuggaaaggccaaagguucacgggcaaucugguacauguggcugggcgcuagauuccuagaguuugaagcccuuggguuccugaacgaggaccauugguuuuccagggaaaauucucucagcggagucgagggcgagggucugcacaaguugggguauauucugcgcgaugugaguaaaaaggaaggaggcgcaauguacgccgacgacacagcuggcugggauacccguauaacucucgaggaccuuaagaacgaagagauggugacaaaucacauggaaggggagcauaaaaagcuggccgaggcgaucuucaaauuaaccuaucaaaacaaggucguucgggugcagagaccuacacccaggggaacuguaauggauauuaucucccgccgagaccagcgggguagcggccaaguggggaccuacggacugaauacguuuaccaacauggaagcacaguugaucagacagauggagggcgaaggugucuucaaaaauauucagcaccucacagugacugaggagguugccgugcaaaacuggcuggcuagggucgggcgcgaaagacuaucucggauggccauaucaggagaugacugcgugguaaagccacuugaugacagguucgcaaacgcucugaccgcccucaaugauaugggcaagauccguaaagacauucagcagugggagcccaguaagggcuggaacgauuggacacagguuccuuuuugcucccaucacuuccaugaacugaucaugaaagacgggcgaguguuggucgugccaugucgcaaucaagaugaguuaauuggacgggcucggaucagccagggugccggcuggucucugagggaaacugcaugccucgggaagucguaugcgcagauguggucacuuauguacuuucaccgcagagaccugcggcuagccgcuaacgccauauguagcgcagugccgucccacuggguccccaccaguaggacgacauggucuauccaugcuaaacacgaguggaugaccacugaggacaugcugacaguuuggaaucgaguguggauucgugaaaacccuuggauggaggauaagaccccaguagaaagcugggaggaaauccccuaucucggaaagagagaggaccaguggugcggcuccuugauuggucugacuucacgcgccaccugggccaaaaauauccaagccgcgauaaaccaggugcggagucuuauugggaaugaggaauacacagauuacaugccuucuaugaagagguucagacgcgaggaagaggaagcuggaguccugugguga

SEQ ID NO: 14617 - RNA, 9876 nt, Artificial Sequence
  derived and/or modified CDS sequence (opt3) from DENV-2__GQ868591__SS-prME
agcgcaggcaugaucauuaugcugauaccaaccgugauggcuuuccaccucacuacuagaaauggggaaccucauaugaucgucuccaggcaggaaaagggaaaaucucuucuguuuaagacggaggacgguguuaauaugugcaccuugauggcaauggauuuaggcgaacugugugaggacacgauuacuuacaaaugcccacuucuccggcaaaacgaaccggaggauaucgacuguuggugcaauucaaccaguacaugggugaccuaugggacuuguacaaccaugggagagcaccgccgagaaaagcguagcguagcacuggugccccaugucggcaugggucuugagacgcggacugaaaccuggauguccucugagggggcguggaaacacgugcagaggauugagacauggauccugcggcauccuggauucacuaugauggcugccauauuggcauacaccaucggcacaacccacuuucagcgcgcccucauuuucauccugcugacggcuguuacuccaucgaugacaaugagaugcauuggcaugucaaacagggauuuuguggaaggggucagcggagguaguuggguggacaucguacucgagcacggcuccuguguuaccacuauggcaaagaauaagcccacauuagauuucgaacugauaaaaaccgaggccaagcagccugcuacgcuucggaaauauugcauugaagccaaguugaccaacacaacuaccgagucucgcuguccaacacaaggggagcccagccugaaugaggaacaggacaaacgauuugugugcaagcauuccauggucgauagaggauggggcaacgguugugggcuauucggaaagggcggcaucgugacuugcgcgauguuuaggugcaaaaagaauauggaagggaaagugguccagccugagaaccucgaauacaccauuguuaucacaccacacucaggagaggagcaugcaguggguaaugacaccggcaagcacgggaaagaaaucaagauuacuccgcagaguagcauaacggaggccgaacugacaggauauggcaccguaacuauggaguguucuccccggaccggucuugauuucaacgaaauggugcuguugcaaauggagaauaaggcuuggcucguccaccgucagugguuucuggacuuaccucugccauggcuccccggggccgauacacagggcuccaacuggauccagaaggagacccuugugacuuucaagaauccucaugccaagaagcaagacguugugguccugggaucacaggaaggcgcuaugcacacagccuugacgggggcgaccgagauucagaugagcaguggaaaccuacuguuuacuggucaucucaaaugccgccugagaauggacaaacuucaacugaaaggcaugucuuacuccauguguacagggaaguucaaggugguaaaagaaaucgccgagacccagcacggaacaauaguuauuagggugcaguaugagggcgaugguagcccaugcaagauccccuucgaaaucauggacuuggagaaacggcauguccucgggcgacugauuacugugaacccgaucgucaccgaaaaggauucgccugugaauauugaggcagaacccccauuuggcgacucuuacauaaucauuggaguugagccuggccaguuaaaacugaacugguucaagaagggguccucaaucggacaaauguuugagacgaccaugcgcggugcuaaaagaauggccauccuaggcgauacagcuugggacuucgggagucucggaggcguguuuacuagcauugguaaggcccugcaccagguauucggggcaauauacggcgccgcuuuuuccggagucucuuggaccaugaaaauccuuauuggcgugaucauuacauggaucgggaugaauagcaggucaacaaguuuguccguuacccuggugcucgucggaauagugacgcuguaucuuggcguaauggugcaggcggauagcgguuguguugucucuuggaagaacaaagaacugaagugcgggucaggaaucuucauuacagacaaugugcacaccuggacugagcaguacaaguuucaacccgaaaguccaagcaaauuggcauccgccauccagaaggcucaugaggaaggcauuugugguauccggucugugacacgccucgagaaccugauguggaaacagauaacccccgaguuaaaucacauucugucggaaaacgaggucaagcuaacuaucaugaccggcgauauuaaagggaucaugcaggccggaaagagaagccucaggccucaaccaacagaacugaaauauuccuggaagacguggggcaaggcaaaaaugcuuucaaccgagagucauaaucagacuuucuugauagacgggccggaaacagccgagugccccaacaccaaucgugcuuggaacucucuggagguugaagauuacggauuuggcguguucacaacuaauaucuggcucaagcugaaagagaagcaggacguguuuugugacagcaaauuaauguccgccgcaauuaaggauaaccgggcgguacacgcugacauggguuauuggaucgaaucagcccugaaugauaccuggaagauugagaaagccagcuucaucgaggucaagaacugccacuggccuaaaucucauacgcuuugguccaacgggguguuggaaagugagaugauaauuccaaagaaucucgccggacccguuagccagcacaacuaccgaccuggcuaucauacacaaaucaccgguccauggcaccugggcaaacuagaaauggacuucgauuuuugugacgggacuaccguggucgugacagaggauugcggaaauagaggccccucucugaggacuaccacagcuuccgggaagcucaucacggaauggugcugucgcucaugcacccugccgccucuucgguacagaggagaggacggcuguugguacgguauggagauuaggccauugaaggaaaaagaggaaaaccugguuaauaguuuagugacugccgggcauggacagguagauaacuucagccucggcguccuggguauggcacuuuuucuggaggaaauguugcgcacacgagugggcaccaagcacgcuauccuccugguggccgucucguucguuacucuaauuacagggaauauguccuuucgggaccugggacgugugaugguaauggugggcgcgaccaugacggaugacauagggaugggagucacuuaucucgcccugcuugcugcauucaaagugagacccaccuuugccgcuggcuugcuguuaaggaagcucacaucuaaagagcugaugaugaccacuaucgguauuguucuucugagccagucaacaaucccugagaccauucuagaacucacagaugcccuggcauuggggaugauggugcugaagaugguccgcaacauggagaaguaccaauuagcggugacuaucauggccauacucugcguucccaaugcugugauccugcagaacgccuggaaagucaguuguaccauucuugcaguaguguccguuucuccacuguugcucacgagcucccagcagaagacagacuggaucccucuggcucuaaccauuaaaggacugaaucccacugccaucuuccuuaccacacucucacggacuagcaagaaaagaaguuggccacugaacgaagcaauaauggccgugggcauggucucuauuuuggcuuccagccuguuaaagaaugacaucccgaugaccggcccucucguggccgggggacugcuuacgguaugcuaugugcugacagguaggucggcggauuuggagcucgaacgagcagcugacgucaaaugggaggaucaagccgagaucucaggcucuagucccauucuguccauaaccaucagcgaagacgggucuaugagcauuaagaacgaggaagaggagcagacucuaacaauccugauucgcaccggacuucucguuaucuccggccuguuuccagugucaauacccaucacugccgcugcaugguacuugugggaagugaagaaacagcgggccggugucuuaugggaugugccuaguccacccccuauggggaaggcggagcuggaagacggagcuuauagaauuaaacagaagggcauccucggcuacagccaaauuggggccggaguuuauaaagaggguacauuccacaccauguggcauguaacgaggggcgcagugcugaugcacaaggggaagcguaucgaaccgucuugggccgaugucaaaaaggaccuuauauccuacggaggcgguuggaaacuggagggggaguggaaggaaggagaggaagugcagguuuuggcucuagagccaggcaaaaauccccgcgcagugcagacuaagccuggccuguuuaagaccaacgccgggacaauuggagcggucucacucgauuucaguccagguaccagcggcucccccaucaucgacaaaaaggggaaagugguaggacuguacggcaacggugucgugacacggucuggggcuuauguuucggccauugcacagacugaaaagagcaucgaggauaauccugagauagaagacgauauuuuuagaaaaaggcgacuuaccaucauggacuuacauccgggagccggcaagacgaagcgguaccugcccgcuauugugcgcgaggccaucaaaagaggccucaggacauugauacuggcaccaacucgggucguggcugccgaaauggaggaagcgcuccgagggcugccuauuagauaucaaacccccgccauccgcgcagagcacacaggaagggagaucguugaccuuaugugucaugcuaccuucacuaugcgucuguugucaccagugcgggucccuaacuacaaucuaauuaucauggaugaagcccacuucaccgaccccgcuuccauugcagccagagguuauauaaguacaaggguggagaugggcgaagccgcugggaucuuuaugacggcgacuccaccgggaucucgcgauccuuucccccagagcaacgcaccaauuaucgacgaggagcgagaaauccccgagagauccuggaacucaggccacgaauggguaaccgauuuuaaggguaaaacagugugguucguuccuucuauuaaggccgggaacgacauagcugccugccugcggaaaaauggaaagaaggucauccagcucagcaggaaaaccuuugauagugaguacgugaagacucgcacaaacgacugggauuucguggucaccacggacauuuccgaaaugggcgcaaauuuuaaagccgagcguguaaucgauccaagacgguguaugaagcccgugauuuuaacugacggcgaggaaaggguuauccuggcugggccuaugccggugacacauagcucugcggcccaacgccgaggaagaauaggucggaaccccaagaaugagaacgaccaguauaucuacaugggcgaaccccuugagaaugaugaagacugcgcacacuggaaggaggcuaaaaugcugcucgauaacauuaauaccccugaggggaucauucccucaauguucgaaccagagagggaaaaggucgacgccaucgauggagaguaccgcuugagaggcgaagcaaggaagaccuuuguggaccugaugcggcguggugaucucccuguuuggcuggccuaucgcguggcugccgaggggauaaacuacgcggaccgaagaugguguuucgauggcgucaaaaacaaucagauucuugaggaaaacguggagguagaaaucuggacuaaggagggagagaggaaaaagcuaaaaccccgguggcuggacgcacgcauuuauuccgauccauuggccuuaaaggaauuuaaggaguucgcugccggcagaaaaagucugacacucaaucugaucaccgaaauggggaggcuuccuacauucaugacucagaaggcucgggacgcacuggauaaccucgccguguugcauacggcugaggccggaggucgagcauacaaucacgcgcugagcgaacuaccggagacccuggagacacuccuucuguuaacuuugcuggccaccguuacaggcgggauauuucucuuccugaugucgggaagaggcaucgguaaaaugacccuugggaugugcugcauuaucacugcuucuauucugcucugguaugcccaaauccagccccacuggauagcagcuuccauuaucuuggaauuuuuccugaucgucuuacuaauuccagagccugaaaagcagcgcacgccccaggacaaccaacugaccuacguggugaucgccauacucacagucguugcagccacuauggcuaaugagaugggcuuucuugagaaaaccaagaaggaccugggauugggcagcauugcgacacagcagccagagucaaacauccuggauauugaccucaggccugccagugcauggacccuguaugcuguggccacuacauucguaacgcccaugcuucggcauucuaucgaaaauuccagcgugaacgucucacucaccgccauagcaaaucaggcuacugugcugaugggguugggaaaagguuggccgcugaguaagauggauaucggcguuccauuacuagccauuggguguuacagccaagugaacccuaucacacugaccgcggcucucuuucuucuggucgcccacuacgcaauuaucggacccggcuugcaggccaaagcuacccgugaagcacagaagagagccgcggcugguauuaugaaaaauccaacaguagacgggaucacugugauagaucuggaccccauuccuuaugauccgaaguucgagaagcagcucggccaaguuaugcugcuuguguuaugcgucacacaggugcugaugaugaggaccacaugggcccucugugaagcauugacucuggccaccggacccaucuccacacuaugggagggcaacccagggcgcuuuuggaauaccacuaucgcugucucuauggccaacauuuuccggggaagcuaccuggcaggcgcuggucuccuauuuuccauaaugaaaaauacgacaaacacccgaagagggacuggaaacaucggcgaaacccugggugagaaguggaaaucaagguugaaugcccugggcaagucugaguuccagauuuauaaaaagagugggauccaagaaguggaccgcacacucgcgaaagagggaauuaagcggggcgaaacugaucaucacgccguuucgagagggagcgcaaagcugcguugguuuguggagaggaacaugguaaccccugagggaaaaguggucgacuuaggcugcgguagagggggaugguccuacuauuguggcggucuuaagaauguucgcgaagugaaaggccugacaaaagggggacccggccaugaggaaccuaucccaaugucuacguacggguggaaccucguccgacuacagucaggaguggauguauucuucauacccccugagaaaugcgacacccuguugugugauaucggcgaaagcuccccaaaucccacuguggaggcugguagaacacugaggguucucaaccuuguggagaauuggcugaacaauaacacccaguuuugcauuaaggucuugaauccguauaugccuagugugaucgaaaagauggaggcccugcagcggaaauacgggggagcacucguccgcaacccauuaucuagaaauagcacucacgaaauguacugggugucaaacgcuuccggcaauauuguuaguagcguaaacaugaucucuaggaugcugauaaaccgauucacaaugcgguauaagaaagccaccuacgagcccgacguggaccuuggcuccgggacgcguaauauuggaaucgaaucagagaucccuaaccuggauauuauagguaagagaaucgagaaaauuaagcaagaacacgagaccagcuggcauuaugaccaggaucacccauacaagacaugggccuaucauggcucguacgaaacuaaacagaccgggucugcgaguuccauggucaauggagugguucgccuacucacaaagcccugggacguggucccgauggugacucagauggcuaugaccgauacaaccccuuuuggccaacagaggguauucaaagagaagguggacacucggacgcaggaacccaaagaggguacaaagaagcugaugaaaaucaccgcagagugguuguggaaggaacuggggaaaaagaaaacuccaagaauguguacccgcgaggaauuuacaaggaagguucgaagcaacgccgcucucggagccauuuucgcagaugagaauaaauggaagucagcccgggaggcugucgaagacuccagauuuugggagcuuguggauaaggaaaggaaccugcacuuagagggcaaaugcgaaacguguguguauaauaugaugggcaagcgcgagaaaaagcugggggaguucggaaaagcgaaggguucucgugccaucugguacaugugguugggcgcacgguuucucgaguucgaggcucugggguuucuaaacgaagaccacugguucagcagagagaauagucuuuccggagucgaaggcgagggucugcauaagcucggguacauacugagggauguuagcaaaaaggagggaggcgccauguaugcagacgacaccgccggcugggauacucgcaucacauuggaagaccugaaaaacgaggaaauggugaccaaucacauggagggggaacauaagaaacucgcugaggccauuuuuaaacuuacuuaccagaacaagguagugcgaguccaacggccuacacccagaggaaccgugauggauaucauuucuaggcgcgaccagagagguucaggccagguugggacauauggacugaauacuuucaccaacauggaggcgcaauuaauccggcagauggaaggcgaggguguguucaaaaguauucagcaccugacgauaaccgaagagaucgcaguccagaauugguuggccaggguggggcgugagcgacucucccgcauggcuauuagcggagaugacugcguaguuaagccacuggaugacagauuugccucugcacuaacagcucuuaacgauaugggcaaaauccggaaggacauccaacagugggaacccucgaggggcuggaacgauuggacucaggugccuuucugcucacaucacuuucacgagcugauuaugaaagacgggcgcguccucguggugccauguagaaaucaggaugaacugauaggacgggccaggaucagccaaggugcuggcugguccuugcgagagaccgccugcuuagggaagaguuacgcacagauguggucucugauguauuuccaucguagagaccuccgccuugcggccaacgcuauuuguagcgccgucccgucccacuggguucccacaucacggacuaccuggaguauccaugcaaagcacgaauggaugacgacagaggacaugcugaccguguggaauaggguauggauucaggagaacccuuggauggaagauaaaacuccaguggagucuugggaagagauccccuaccuaggaaagagagaagaccaguggugcggcagccugauaggucucacaucccgcgcuaccugggccaaaaauauccaagcagccauuaaccagguccggucauugaucgggaaugaggaguauacugauuacaugccuagcaugaagagguuucgaagagaagaggaagaggcgggagugcugugguga

SEQ ID NO: 14618 - RNA, 9876 nt, Artificial Sequence
  derived and/or modified CDS sequence (opt3) from DENV-2__GQ868542__SS-prME
agcgcaggaaugaucauuaugcugauaccaaccgugauggcuuuccaccucacgacuagaaauggggaaccucauaugaucgucuccauucaggaaaagggaaaaucucuucuguuuaagacggaggacgguguuaauaugugcaccuugauggcaauggauuuaggcgaacugugugaggacacaaucacuuacaaaugcccacuacucaggcaaaacgaaccggaggauauugacuguuggugcaauucaaccaguacaugggugaccuaugggacuuguacaaccacgggagagcaccggcgcgaaaagcgaagcguagcccuggugccacaugucggcaugggucuugagacucguaccgaaacauggauguccucugagggggcguggaaacacgcucagagaaucgagacuuggauacugaggcauccuggauucaccaucauggccgcaauuuuggccuacacaaucggcaccacgcacuuucagcgggcucucauuuucauccugcugacugcaguggccccaucgaugacaaugcgcugcauaggcauuucaaacagagauuuuguugaaggggugagcggagguaguugggucgacaucgugcucgagcacggcuccuguguaaccacuauggcuaagaauaagcccacauuagauuucgaacugauuaaaaccgaggccaagcagccugcgacgcuuaggaaauauugcaucgaagcaaaguugaccaacacaacuaccgagucucgguguccaacacaaggggagcccagccugaaagaagaacaagacaagcgcuuuguuugcaagcauuccaugguggaucgaggauggggcaaugguugugggcuauucggaaaaggcggcaucgucacuugcgccauguuuaccugcaagaaaaacauggaagggaagauugugcagccugagaaucucgaauacacaauaguggucaccccacacucaggagaggagcaugcuguugguaacgacacuggcaaacacgggaaggaaaucaaagugacgccgcagaguagcauuacagaggccgaacugaccggauauggcacuguaaccauggaguguucucccagaacaggucuugauuucaaugaaauggugcuguugcaaauggagaacaaggcauggcucguccacaggcagugguuucuggacuuaccucugccauggcuccccggggcugauacccagggcuccaauuggauccagaaggagacucuugugacauucaaaaacccucaugccaagaaacaagacguugugguccugggaucacaggaaggcgcgaugcacacggccuugaccggggcaacugagauacagaugagcaguggaaaucuacuguuuacaggucaucucaagugccggcugcguauggacaaacuucaacugaagggcaugucuuacuccauguguaccgggaaguucaaagugguaaaggaaauugcugagacacagcacggaacuaucguuauccgcgugcaguaugagggcgaugguagcccaugcaaaauucccuucgaaaucauggacuuggagaagagauacguccucgggaggcugauuaccgugaacccgauagucacggaaaaagauucgccugugaacaucgaggccgaacccccauuuggcgacucuuacauuaucaucggaguugagccuggccaguuaaagcugaauugguucaagaaaggguccucaauuggacaaauguuugagaccacaaugcggggugcuaagcgaauggccauacuaggcgauacugcaugggacuucgggagucucggaggcguguuuaccagcaucgguaaagcccugcaucagguauucggggcuauuuauggcgcggcauuuuccggagucucuuggacaaugaagauccuuauuggcgugaucauaacuuggaucgggaugaacagccgcucaaccaguuuguccguuagccuggugcucgucggaauugugacgcuguaccuuggcguaauggugcaggccgauucugguuguguugucucauggaaaaauaaggaacugaagugcgggaguggaaucuucauuacagacaacgugcacaccuggacugagcaguauaaauuucaacccgaaagcccauccaaguuggcuucugccauccagaaagcacaggaggaaggcauaugugguauuagaucggugacaaggcucgagaaucugauguggaagcagaucacccccgaguuaaaccacauucuggccgaaaaugaggucaaacuaacuaucaugaccggcgauauaaaggggaucaugcaagcuggaaaacggagccuccgcccucagccaacagaacugaaguacuccuggaagacguggggcaaagccaagaugcuuucaaccgagagucauaaccagacuuucuugauugacgggccggaaacagcagagugccccaauaccaacagagcguggaacucucuggagguugaagauuauggauuuggcguguucacaacuaacaucuggcucaaacugaaggagaaacaggacgcuuuuugugacagcaaguuaauguccgccgcaauuaaggauaauagggccgugcacgcugacauggguuacuggaucgaaucagcccugaacgauaccuggaaaauagagaaggccagcuucauugaggucaagaauugccauuggccuaagucucacacgcuuugguccaacggggucuuggaaagugagaugaucauccccaaaaaucucgcuggacccgugagccaacacaauuaucguccuggcuaccauacacagauugccgguccauggcaccugggcaagcuagaaauggacuucgauuuuugugacgggaccacuguuguggucaccgaggauugcggaaaccggggccccucucugcgaacaacuaccgcguccgggaagcucaucacagaauggugcuguagaucaugcacgcugccgccucuuagguaccgcggagaggacggcuguugguaugguauggagauucggccauugaaagaaaaggaggaaaaucuggugaacaguuuaguuaccgccgggcauggacagguggauaauuucagccucggcguacuggguauggcucuuuuucuggaggaaauguugagaacuagggucggcacaaaacacgcaauacuccugguggccgugucguucgucacccuaaucacugggaacauguccuuuaaggaccugggacgcguugugguaauggugggcgcuacaaugaccgaugacauugggaugggagucacguaccucgcccugcuugcagcguucaaagugcgacccacuuuugccgcuggcuugcuguuacggaagcucaccucuaaggagcugaugaugacaaccaucgguauuguucuucugagccaaucaacuaucccugagacaauacuagaacucaccgaugcccuggcauuggggaugauggugcugaaaaucguccguaauauggagaaguaucaguuagcugugacaauuauggccauccucugcguucccaacgcagugauucugcagaaugccuggaaagucaguuguacuauccuugcuguaguguccguuucuccacuguugcucaccagcucccagcaaaagacggacuggauaccucuggcgcuaacaauuaaaggacugaaccccaccgccaucuuccuuacuacccucucaagaacaaauaagaaaaggagcuggccacugaacgaagcaaucauggcugugggcauggucaguauuuuggccucuucccuguuaaagaaugacauaccgaugacuggcccucucguggccgggggacugcuuaccguaugcuacgugcugacgggucgcagcgcugauuuggagcucgaacgggcaacagacgucaagugggaggaucaggccgagaucucgggcucaucucccauucugaguaucaccauuuccgaagacgggagcaugucuaucaaaaacgaggaagaggagcagacucuaacaauacugaucagaaccggacuucucguuauuagcggccuguuuccaguguccauccccauuacugcggcugccugguauuugugggaagugaagaaacagagggccgguguauuaugggaugugccuucaccacccccuauggggaaggcagagcuggaagacggagcuuaccgaaucaaacaaaagggcauacucggcuauagucagauuggggcaggaguuuacaaggaggguacauuccauaccauguggcacguaacgcgcggcgccgugcugaugcacaaagggaagcggaucgaaccgagcugggcggaugucaaaaaggaccuuaucucuuacggaggcgguuggaaacuggagggggaguggaaggaaggagaggaagugcagguuuuggcucuagagccaggcaagaaucccagagccgugcagacuaaaccuggccuguuuaagaccaacacagggaccauuggagcagucucccucgauuucucaccagguacaaguggcagccccaucauagacaaaaaggggaaagugguaggacuguauggcaacggugucgugacuagguccggggccuacguuucugcuauugcccaaaccgaaaagucgaucgaggauaauccugagauugaagacgauaucuuucguaagcgccggcuuacgauaauggacuuacauccgggagcaggcaaaacaaagagauaucugcccgcuauugugagggaggccaucaaacgaggccuccggacuuugauccuggcgccaacccgcgucguggccgcagaaauggaggaagcucucagagggcugccuauuagguaccagacacccgccauccgggcugagcacaccggacgagagauuguugaccuuaugugucaugcaacuuucaccaugagacuguugagcccagugcgcgucccuaacuauaaucuaauaaucauggaugaagcccacuucacagaccccgccucaauugcugcgagggguuacaucuccacgcguguggagaugggcgaagcagccgggaucuuuaugacugcuaccccaccgggaagucgggauccuuucccccagucuaacgccccaauuauagacgaggagagagaaauccccgagaggagcuggaacuccggccaugaauggguaacagauuuuaaggguaaaaccgugugguucguuccuucaauuaaggcagggaacgacaucgccgcuugccugcgcaagaauggcaaaaaggucauucaacucucucgaaaaacuuuugauagcgaguaugugaagacaagaaccaacgacugggauuucguggucacgacugacaucagugaaaugggcgcgaauuuuaaagccgagcggguaauagauccaaggcgcuguaugaagcccgugaucuuaacagacggcgaggaacguguuauucuggcagggccuaugccggugacccacuccagcgcugcccagagacggggaaggaucggucgcaaccccaaaaaugagaacgaccaguacauuuacaugggcgaaccccuugagaaugaugaagacugcgcacacuggaaggaggccaagaugcugcucgauaacaucaauaccccugaggggauaauucccucuauguucgaaccagagcgagaaaaagucgacgcuaucgauggagaguauagauugcggggcgaagccaggaagacuuuuguggaccugaugcgcagaggugaucucccuguuuggcuggcguacaaaguggcagccgaggggauuaacuaugcugacaggcggugguguuucgauggcaucaagaacaaucagauacuugaggaaaacgucgagguggaaaucuggacaaaagagggagagcguaagaagcuaaaaccccgcuggcuggacgcccgaauuuacucagauccauuggcuuuaaaggaauuuaaagaguucgcagccggcagaaagucccugacccucaaucugaucacagaaauggggaggcuuccuacuuucaugacgcagaaaacccgggacgcucuggauaaccucgccguauugcauacagcagaggcgggaggucgcgccuauaaucacgcucugagugaacuaccggagacucuggagacccuccuucuguuaacauugcuggccaccgugacuggcgggauuuuucucuuccugaugagcggaagaggcaucgguaagaugacgcuugggaugugcugcauaauuaccgcaucgauccugcucugguacgcucagauccagccccauuggauugccgcaucuaucauauuggaauuuuuccugauuguuuuacuaaucccagagccugaaaagcagaggacaccccaagacaaccagcugacuuaugucgugauugccauccucaccguggucgcugcgacaauggccaaugagaugggcuuucuugagaaaaccaagaaagaccugggauugggcgggauagcaacucagcagccagaguccaacauccuggauauugaccuccggccugcuagcgccuggacacuguacgccguugcaacgaccuucgugacucccaugcuucgacacucaaucgagaauaguucuguaaacgugucccucacagcuauugccaaucaagcgaccguccugaugggauuggguaagggcuggccgcugagcaaaauggauaucggggugccauuacuagcuauuggauguuacucacagguuaacccuaucacccugacagccgcacuccuucuguugguggcccacuaugcuauaauuggccccggucugcaggcaaaggccacuagagaagcgcagaagcgcgcugccgcagggaucaugaaaaauccaacggucgacggcaucaccguaauugaucucgaccccauaccuuacgauccgaaguuugagaaacaacugggacaggugaugcuuuuaguucugugcgugacacagguccucaugaugaggacuaccugggccuugugugaagcucugacacuagccaccggccccaucaguacucugugggaggggaacccaggacgguucuggaauacgacaauugcagugagcauggcuaacaucuuucguggcuccuaucucgccggugcggggcuucuguucucuauuaugaagaauaccacuaacaccagaaggggaacaggcaacaucggugaaacuuugggcgagaaauggaaaagccgccugaaugcccucgggaaauccgaguuucaaauauacaagaagucaggaauccaggaagucgaccggacccuggcaaaagagggcauuaagcgaggggaaacagaucaucacgcugugucuagaggaagugccaaauuaaggugguucguugagcgcaacauggugacgccugagggcaagguaguggaccuugguugcgggcggggaggcuggucguauuacugugguggccugaaaaaugucagagaaguuaaggggcucaccaagggaggccccgggcaugaggaaccuaucccaaugagcacuuauggauggaaccuagugcgucugcaguccggcgucgauguguuuuucauucccccugagaaaugcgacacauugcugugugauaucggugaaucuucaccaaaucccaccguagaggcagggaggacucuccgggugcuuaaccugguugagaauugguugaacaauaacacacaguucugcauaaaggugcugaauccguacaugccuagcgucauugagaaaauggaggcucuccaacgcaaguacggaggcgccuuagugcgaaacccacuguccagaaauaguacccacgaaauguauugggucucuaacgccagcggcaauaucgugucauccguuaacaugaucaguaggaugcuuauuaaccgguuuacgaugcgccauaaaaaggcgaccuacgagcccgacguagaccuggggagcggaacaagaaauauagguaucgaaucugaggugccuaaccuagauauuaucggcaagaggauugagaaaaucaagcaggaacacgagacuuccuggcacuaugaccaggaucauccauacaaaaccugggcuuaucacgggucauacgaaacaaagcagacuggaagcgcaucgucuauggucaauggcgugguucgacuccugaccaaacccugggacguguugccgacagucacccaaauggccaugacugauacgacaccuuucggucagcagcggguguuuaaggagaagguagacacccguacucaggaacccaaagaggggaccaagaaacugaugaagauaacagcugaguggcucuggaaagaacuuggaaagaaaaagacgccaagaauguguacccgcgaggaguucacuaggaaggugcggaguaacgccgcacugggcgccaucuuuacagaugagaauaaauggaaguccgcuagagaggcgguugaagacagccgcuucugggaguuagucgauaaagaaaggaaccugcauuuggagggcaagugcgaaaccuguguguauaauaugauggggaaacgagagaagaagcucggagaguuugguaaagccaagggcucacgggcaauuugguacauguggcugggggcuagauuccuagaauuugaggcccuuggauuccugaacgaagaccacugguuuuccagggaaaauucucucagcggcguggaaggugaggggcugcacaaauugggauacauccugcgcgaugucaguaagaaagagggcggcacuauguaugcagacgacacagccgggugggauacccguauuacacucgaagaccuuaagaacgaggaaaugguuacuaaucauauggagggagaacacaagaaacuggcugaggccaucuucaaguuaaccuaccaaaacaaagugguacgggugcagagaccuacgcccagggguaccgucauggauauuauaucccgccgagaccagcggggcagcgggcaagugggaacauauggccugaauacuuuuaccaacauggaggcgcaguugaucagacagauggaaggugaggggguuuucaagaauauucagcaucucacagugacugaagagaucgcaguccaaaacuggcuggccagggugggacgcgagagacuaucucggauggcuaucucaggcgaugacugcguaguuaaaccacuugaugacagguucgccagugcacugaccgcucucaacgauaugggcaagauucguaaggacauacagcagugggaacccucccgaggguggaaugauuggacacaggugccuuuuugcagccaccauuuccacgagcugaucaugaaagacggacgcgucuugguggugccauguagaaaccaagaugaauuaauuggucgggccaggaucucucagggcgcuggguggucgcugcgcgagacagccugccucggaaagucauacgcacagauguggagccuuauguauuuucacagacgggaccugaggcuagcggccaaugcuauuuguuccgccgucccgagucauuggguucccaccucucgaacuacauggagcauccacgcaaaacaugaauggaugaccacugaggacaugcugaccguguggaaccguguauggauacaggagaauccuuggauggaagauaagacaccaguggacuccugggaggaaauccccuaccucggcaaaagagaggaucaauggugcgguucauugauugggcugacgagucgcgcuaccugggccaagaacauccaggcagccauuaaucagguccggucucuuaucggaaacgaagaguauacugacuacaugccuagcaugaagagguucagacgcgaggaagaggaagcgggcgugcugugguga

SEQ ID NO: 14619 - RNA, 9876 nt, Artificial Sequence
  derived and/or modified CDS sequence (opt3) from DENV-2__GQ868544__SS-prME
agcgugggaaugaucauuaugcugauaccaaccgucauggccuuccaccucacaacuagaaacggggagccucauaugaucguuuccauucaggaaaagggaaaaucucuucuguuuaagacggaggacggugugaauaugugcaccuugauggcuauggauuuaggcgaacugugugaggacacaaucacuuacaaaugcccacuacucaggcaaaacgaaccggaggauauugacuguuggugcaauucaaccaguacauggguaaccuaugggacuuguacaaccacgggagagcaccggcgcgaaaagcgaagcguggcacuggucccccaugugggcaugggucuugagacucguaccgaaacauggauguccucugagggggccuggaaacacgcgcagagaaucgagacuuggauacugaggcauccuggauucaccaucauggcugccauuuuggcauacacaaucggcaccacgcacuuucagcgggcccucauuuucauccugcugacugcuguugcaccaucgaugacaaugcgcugcauaggcauuucaaacagagauuuuguggaaggggucagcggagguaguuggguggacaucguacucgagcacggcuccuguguuaccacuauggccaagaauaagcccacauuagauuucgaacugauuaaaaccgaggcuaagcagccugccacgcuuaggaaauauugcaucgaagcgaaguugaccaacacaacuaccgagucucgguguccaacacaaggggagcccagccugaaagaagaacaggacaagcgcuuugugugcaagcauuccauggucgaucgaggauggggcaaugguugugggcuauucggaaaaggcggcaucgugacuugcgcaauguuuaccugcaagaaaaacauggaagggaagauugugcagccugagaaucucgaauacacaauagucguuaccccacacucaggagaggagcaugccguggguaacgacacuggcaaacacgggaaggaaaucaaaguaacgccgcagaguagcauuacagaggcugaacugaccggauauggcacugugaccauggaguguucucccagaacaggucuugauuucaaugaaaugguccuguugcaaauggagaacaaggccuggcucgugcacaggcagugguuucuggacuuaccucugccauggcuccccggggcagauacccagggcuccaauuggauccagaaggagacucuuguuacauucaaaaacccucaugcuaagaaacaagacguggucgugcugggaucacaggaaggcgccaugcacacggcguugaccggggccacugagauacagaugagcaguggaaaucuacuguuuacaggucaucucaagugccggcugcguauggacaaacuucaacugaagggcaugucuuacuccauguguaccgggaaguucaaaguaguuaaggaaauugcagagacacagcacggaacuaucgugauccgcguccaguaugagggcgaugguagcccaugcaaagugcccuucgaaauuauggacuuggagaagagauacguccucgggaggcugaucaccgugaacccgauuguuacggaaaaagauucgccugugaacauagaggcugaacccccauuuggcgacucuuacaucauuaucggaguagagccuggccaguuaaagcugaauugguucaagaaaggguccucaaucggacaaauguuugagaccacaaugcggggugccaagcgaauggcuauucuaggcgauacugccugggacuucgggagucucggaggcgucuuuaccagcauagguaaagcacugcaucagguguucggggccaucuauggcgcugcguuuuccggaguuucuuggacaaugaagauucuuaucggcgugauuaucacuuggauagggaugaacagccgcucaaccaguuuguccgucagccuggugcucguaggaaucgugacgcuguaccuuggcguuaugguccaggcagauucugguuguguggugucauggaaaaauaaggaacugaagugcgggaguggaauuuucaucacagacaacguccacaccuggacugagcaguauaaauuucaacccgaaagcccauccaaguuggccucugcuauucagaaagcccaggaggaaggcaucugugguauaagaucgguuacaaggcucgagaaucugauguggaagcagauuacccccgaguuaaaccacauccuggcagaaaaugaggugaaacuaacuauuaugaccggcgauaucaaggggauaaugcaagccggaaaacggagccuccgcccucagccaacagaacugaaguacuccuggaagacguggggcaaagcuaagaugcuuucaaccgagagucauaaccagacuuucuugaucgacgggccggaaacagccgagugccccaauaccaacagagcauggaacucucuggagguggaagauuauggauuuggcguauucacaacuaacauuuggcucaaacugaaggagaaacaggacgcguuuugugacagcaaguuaauguccgcugccaucaaggauaauagggcaguccacgccgacauggguuacuggauugaaucagcucugaacgauaccuggaaaaucgagaaggccagcuucauagaggugaaaaauugccauuggccuaagucucacacgcuuugguccaacgggguuuuggaaagugagaugauuauccccaagaaucucgcaggacccgugagccaacacaauuaucguccuggcuaccauacacagaucgcugguccauggcaccugggcaagcuagaaauggacuucgauuuuugugacgggaccacugucgugguuaccgaggauugcggaaaccggggccccucucugcgaacaacuaccgccuccgggaagcucauuacagaauggugcuguagaucaugcacgcugccgccucuuagguaccgcggagaggacggcuguugguaugguauggagauccggccauugaaagaaaaggaggaaaaucuggugaacaguuuaguaaccgcggggcagggacaaauugauaauuucagccucggcguccuggguauggcccuuuuucuggaggaaauguugagaacuagggugggcacaaaacaugcuauacuccugguggcagucucguucguuacccuaaucacugggaacauguccuuuaaggaccugggacgcgugguagugauggucggcgccacaaugaccgaugacauugggaugggagugacguaccucgcucugcuugccgcauucaaaguucgacccacuuuugcggccggcuugcuguuacggaagcucaccucuaaggagcugaugaugacaaccaucgguauugugcuucugagccagucaacuaucccugagacaauacuagaacucaccgaugcucuggccuuggggaugaugguccugaaaaucgugcgugacauggagaaguaucaguuagcaguuacaauuauggcuauccucugcgugcccaaugccgucauucugcagaacgcauggaaaguaaguuguacuauccuugccgugguuuccgugucuccacuguugcucaccagcucccaacagaagacggacuggauaccucuggcucuaacaauuaaaggacugaaucccaccgcgaucuuccuuacuacccucucaagaacaaacaagaaaaggagcuggccacugaaugaagccaucauggcagucggcauggugaguauuuuggcuucuucccuguuaaagaacgauauaccgaugacuggcccucucguagccgggggacugcuuaccgugugcuacguccugacgggucgcagcgccgacuuggagcucgaacgggcuacagauguuaagugggaggaccaggcagagaucucgggcucaucucccauucugaguaucaccauuuccgaagaugggagcaugucuaucaaaaaugaggaagaggagcagacucuaacaauacugaucagaaccggacuucucgugauuagcggccuguuuccaguguccauccccauuacugccgcggcuugguauuugugggaagucaagaaacaaagggccgguguguuaugggacguuccuucaccacccccuauggggaaggcagagcuggaagauggagccuaccgaaucaaacagaagggcauacucggcuauagucagauuggggcuggaguauacaaggaggguacauuccacaccauguggcaugugacgcgcggcgcaguccugaugcacaaagggaagcggaucgaaccgagcugggccgacgugaaaaaggaucuuaucucuuacggaggcgguuggaaacuggagggggaguggaaggaaggagaggaaguucagguguuggcgcuagagccaggcaagaaccccagagcuguccaaacuaaaccuggccuguuuaagaccaauacagggaccauuggagccgugucccucgacuucucaccagguacaaguggcagccccaucauagauaaaaaggggaaaguagucggacuguauggcaacggugugguuacuagguccggggcauacgugucugccauugcucagaccgaaaagucgaucgaggacaacccugauauugaggacgacaucuuucguaagcgccggcuuacgauaauggauuuacacccgggagccggcaaaacaaagagauaucugcccgcaauugucagggaagcuaucaaacgaggccuccggacuuugauccuggccccaacccgcgugguugcggccgagauggaagaggcacucagagggcugccuauuagguaccagacacccgcuauccgggccgaacauaccggacgagagauuguggaccuuaugugucacgcuacuuucaccaugagacuguugagcccaguccgcgugccuaauuauaaccuaauaaucauggaugaggcacauuucacagaccccgccucaauugccgcuagggguuacaucuccacgcguguagaaaugggcgaggcggcagggaucuuuaugacugccaccccaccgggaagucgggauccuuucccccaaucuaaugcuccaauuauagacgaagagagagagauccccgaaaggagcuggaacuccggccacgagugggugacagauuuuaaggguaaaaccguuugguucgucccuucaauuaaggccgggaaugacaucgcagccugccugcgcaagaacggcaagaaggugauucagcucucucgaaaaacuuuugauagcgaauaugugaagacaagaaccaaugacugggauuucgucguaacgacugacaucagugagaugggcgcuaacuuuaaagcggaacgggugauagacccaaggcgcuguaugaagcccguuaucuuaacagauggcgaggagcgugugauucuggccgggccuaugccggucacccauuccagcgcagcucagagacggggaaggaucggucgcaaucccaaaaacgaaaaugaccaguacauuuacaugggcgagccccuugaaaacgaugaggacugcgcccacuggaaggaagcaaagaugcugcucgauaauaucaacaccccugaggggauaauucccucuauguucgagccagaacgagagaaaguggacgccaucgauggagaauauagauugcggggcgaggcuaggaagacuuuuguugaccugaugcgcagaggugaucucccuguguggcuggccuacaaagucgcggcagaagggauuaauuaugccgacaggcggugguguuucgauggcaucaagaacaaccaaauacuugaggagaauguggaaguagagaucuggacaaaagaaggagagcguaagaagcuaaaaccccgcuggcuggacgcucgaauuuacucagauccauuggccuuaaaggaguuuaaagaguucgcugcaggcagaaagucccugacccucaaccugaucacagagauggggaggcuuccuacuuucaugacgcagaaaacccgggacgcccuggacaaucucgcuguguugcacacagccgaagcaggaggucgcgcguauaaccaugcccugagugagcuaccggaaacucuggagacccuccuucuguuaacauugcuggcuaccguuacuggcgggauuuuucucuuccugaugagcggaagaggcaucgguaagaugacgcuugggaugugcugcauagucaccgccucgauucugcucugguacgcacagauccagccccacuggaucgcugccucuauuaucuuggaguuuuuccugauaguguuacuaauuccagaaccugagaagcaaaggacaccccaggauaaucagcugacuuauguggucaucgcaauucucaccguuguggccgcuacaauggcgaacgaaaugggcuuucuugagaaaaccaagaaagaccugggauugggcuccaucgccacucagcaaccagaaagcaauauacuggauaucgaccuccggccugcaucagcuuggacacuguacgccguagccacgaccuucgugacucccaugcuucgacauaguauugagaacucuuccgucaaugugagccucacagcaaucgcuaaccaggccaccguucugaugggguugggaaaggguuggccgcugucaaaaauggauauuggcgugccauuacuagcgaucggguguuacagucaggucaauccuauuacccugacagcugcccuccuucuguugguagcacacuaugccaucauaggacccggccugcaggcuaaggcaacuagagaggcccaaaagcgcgcggcugccgguauuaugaaaaacccaacgguggacgggaucaccguuaucgaucucgaccccauuccuuacgauccgaaguuugaaaaacagcugggccaggugaugcuuuuaguccugugcgugacacaaguccucaugaugaggacuaccugggcauugugugaggcccugacacuagcuaccggacccauaagcacucugugggaaggcaauccagggcgguucuggaacacgacaaucgccguguccauggcaaauauuuuucguggaucuuaucucgcuggcgccggucuucuguucagcaucaugaagaacaccacuaauaccagaagggggacaggaaacauuggcgagacuuugggugaaaaauggaagucccgccugaacgcgcucggcaaaucagaguuucagaucuacaagaagucugggauacaggagguugaccggacccuggccaaagaaggaaucaagcgaggcgagacagaucaccaugcagugaguagagggucggcuaaauuaaggugguucguagaacgcaauauggugacgccugagggaaaggucguugaccuuggcugcgguagagggggauggagcuauuacuguggcggucugaaaaacgugcgggaggucaagggccucaccaaaggcgggcccgggcacgaggaaccuauuccaauguccacuuauggguggaaucuagugcgucugcagucuggaguagauguguuuuucaucccaccugaaaaaugcgacacauugcugugugacauuggcgagucaagcccaaaccccaccguugaagccgguaggacucuccgggugcuuaaucuggucgagaacugguugaauaacaauacacaauucugcaucaaggugcugaacccguacaugccuuccgucauagagaaaauggaaacccuccagcgcaaguacgggggagcauuagugcgaaauccacugaguagaaacucuacgcaugagauguauuggguuagcaaugcuucaggcaacauuguauccagugugaauaugaucagcaggaugcuuaucaaccgguuuaccaugcgccacaaaaaggccacauacgaacccgaugucgaccugggcucugggacuagaaacauuggaauagaguccgaaaucccuaaucuagauauuaucgguaagaggauugagaaaaucaagcaggagcaugaaaccucauggcacuaugaccaggaucacccauacaaaacaugggccuaucauggcagcuacgagacuaagcaaaccgggucggcgucuaguauggugaacggaguugugcgacuccugacaaaacccugggacgucuugccgaccgugacucagauggcuaugacggauacaaccccuuucggccagcagcggguauuuaaggaaaagguggacacucguacccaagagcccaaagaagguacaaagaaacugaugaagauaacggcagaguggcucuggaaagagcuugggaagaaaaagaccccaagaauguguacucgcgaagaguucacaaggaagguucgguccaaugccgcucugggagccaucuuuaccgaugaaaacaaauggaaaagcgcaagagaggccgucgaggacucacgcuucugggaauuaguggauaaagagaggaaucugcacuuggaaggcaagugcgagacuuguguguauaacaugaugggcaaacgagaaaagaagcucggggaguuuggaaaagcuaaggguucccgggcgauuugguacauguggcugggcgccagauuccuagaguuugaagcacuuggguuccugaaugaggaccauugguuuucuagggaaaacagccucaguggagucgagggcgaaggucuguacaaauugggguauauccugcgcgacguuuccaagaaagagggaggcgcuauguacgccgaugacacagcaggcugggauacccguauuacacucgaggaccuuaagaaugaagagauggugacuaaccacauggaaggggagcacaagaaacuggccgaagcuaucuucaaguuaaccuaucagaauaaaguagugcggguccagagaccuacgcccaggggaaccgugauggauauuauaagccgccgagaccaacgggguucuggccagguugggacauacggacugaacacuuuuaccaauauggaggcccaguugaucagacagauggagggcgaagguguguucaagaacauucaacaucucacagucacugaggaaaucgcggugcagaauuggcuggcaaggguagggcgcgagagacuaucacggauggccaucaguggagaugacugcguugugaaaccacuugaugacagguucgcuuccgcccugaccgcacucaacgauaugggcaagauucguaaggacauacagcagugggagcccagccgaggcuggaacgauuggacgcaagucccuuuuugcucucaccauuuccacgaacugaucaugaaagacgggcgcguguugguggucccauguagaaaucaggacgaguuaauuggacgggcuaggaucucgcagggugccggcuggucacugcgcgaaacagcuugccucggaaagagcuaugcccagauguggucccuuauguacuuucauagacgggaucugaggcuagcagcgaacgccauuuguagugcuguuccgucucacugggugcccaccagccgaacuacaugguccauccacgccaaacaugaguggaugaccacugaagacaugcugaccguauggaaucguguguggauacaagagaacccuuggauggaggauaagacaccagucgaaucaugggaggaaauccccuaucucggaaaaagagaggaccaguggugcggcaguuugauuggucugacgucucgcgcaaccugggcuaagaauauccaggccgcaauuaaccaggugcggagccuuaucgggaaugaagaguacacugauuacaugccuuccaugaagagguucagacgcgaggaagaggaagccggaguucugugguga

SEQ ID NO: 14620 - RNA, 9876 nt, Artificial Sequence
  derived and/or modified CDS sequence (opt3) from DENV-2__GQ868545__SS-prME
agcgcaggaaugaucauuaugcugauaccaaccgugauggcuuuccaccucacaacuagaaacggggagccucauaugaucgucuccauucaggaaaagggaaaaucucuucuguuuaagacggaggacgguguuaauaugugcaccuugauggcaauggauuuaggcgaacugugugaggacacaaucacuuacaaaugcccacuacucaggcaaaacgaaccggaggauauugacuguuggugcaauucaaccaguacaugggugaccuaugggacuuguacaaccacgggagagcaccggcgcgaaaagcgaagcguagcacuggugccacaugucggcaugggucuugagacucguaccgaaacauggauguccucugagggggcguggaaacacgcucagagaaucgagacuuggauacugaggcauccuggauucaccaucauggccgcaauuuuggccuacacaaucggcaccacgcacuuucagcgggcucucauuuucauccugcugacugcaguggccccaucgaugacaaugcgcugcauaggcauuucaaacagagauuuuguugaaggggugagcggagguaguugggucgacaucgugcucgagcacggcuccuguguaaccacuauggcuaagaauaagcccacauuagauuucgaacugauuaaaaccgaggccaagcagccugcgacgcuuaggaaauauugcaucgaagcaaaguugaccaacacaacuaccgagucucgguguccaacacaaggggagcccagccugaaagaggaacaggacaagcgcuuuguuugcaagcauuccaucguggaucgaggauggggcaaugguugugggcuauucggaaaaggcggcauugucacuugcgccauguuuaccugcaagaaaaacauggaagggaagauagugcagccugagaaucucgaauacacaaucguggucaccccacacucaggagaggagcaugcuguugguaacgacacuggcaaacacgggaaggaaauuaaagugacgccgcagaguagcguaacagaggccgaacugaccggauauggcacugugaccauggaguguucucccagaacaggucuugauuucaaugaaaugguccuguugcaaauggagaacaaggcauggcucgugcacaggcagugguuucuggacuuaccucugccauggcuccccggggcugauacccagggcuccaauuggauccagaaggagacucuuguuacauucaaaaacccucaugccaagaaacaagacguggucgugcugggaucacaggaaggcgcgaugcacacggccuugaccggggcaacugagauacagaugagcaguggaaaucuacuguuuacaggucaucucaagugccggcugcguauggacaaacuucaacugaagggcaugucuuacuccauguguaccgggaaguucaaaguaguuaaggaaauugcugagacacagcacggaacuaucgugauccgcguccaguaugagggcgaugguagcccaugcaaaauucccuucgaaaucauggacuuggagaagagauacgugcucgggaggcugauuaccgucaacccgauagugacggaaaaagauucgccuguuaacaucgaggccgaacccccauuuggcgacucuuacauuaucaucggaguggagccuggccaguuaaagcugaauugguucaagaaaggguccucaauuggacaaauguuugagaccacaaugcggggugcuaagcgaauggccauacuaggcgauacugcaugggacuucgggagucucggaggcguauuuaccagcaucgguaaagcccugcaucaggucuucggggcuauuuauggcgcggcauuuuccggagugucuuggacaaugaagauccuuauuggcguuaucauaacuuggaucgggaugaacagccgcucaaccaguuuguccgugagccugguccucgugggaauuguaacgcuguaccuuggcgugaugguucaggccgauucugguugugucgugucauggaaaaauaaggaacugaagugcgggaguggaaucuucauuacagacaacgugcacaccuggacugagcaguauaaauuucaacccgaaagcccauccaaguuggcuucugccauccagaaagcacaggaggaaggcauaugugguauuagaucggucacaaggcucgagaaucugauguggaagcagaucacccccgaguuaaaccacauucuggccgaaaaugagguuaaacuaacuaucaugaccggcgauauaaaggggaucaugcaagcuggaaaacggagccuccgcccucagccaacagaacugaaguacuccuggaagacguggggcaaagccaagaugcuuucaaccgagagucauaaccagacuuucuugauugacgggccggaaacagcagagugccccaauaccaacagagcguggaacucucuggagguggaagauuauggauuuggcguguucacaacuaacaucuggcucaaacugaaggagaaacaggacgcuuuuugugacagcaaguuaauguccgccgcaauuaaggauaauagggccguacacgcugacauggguuacuggaucgaaucagcccugaacgauaccuggaaaauagagaaggccagcuucauugaggucaaaaauugccauuggccuaagucucacacgcuuugguccaacgggguguuggaaagugagaugaucauccccaagaaucucgcuggacccguuagccaacacaauuaucguccuggcuaccauacacagauugccgguccauggcaccugggcaagcuagaaauggacuucgauuuuugugacgggaccacuguggucgugaccgaggauugcggaaaccggggccccucucugcgaacaacuaccgcguccgggaagcucaucacagaauggugcuguagaucaugcacgcugccgccucuuagguaccgcggagaggacggcuguugguaugguauggagauucggccauugaaagaaaaggaggaaaaucugguuaacaguuuagugaccgccgggcauggacagauagauaauuucagccucggcguacuggguauggcucuuuuucuggaggaaauguugagaacuagggucggcacaaaacacgcaauccuccugguggccgugucguucgucacccuaauuacugggaacauguccuuuaaggaccugggacgcguugugguaauggugggcgcuacaaugaccgaugacaucgggaugggagucacguaccucgcccugcuugcagcguucaaagugcgacccacuuuggccgcuggccuguuacuccggaagcugaccucuaaggagcuuaugaugacaaccauugguaucguucugcuaagccaaucaacuauaccugagacaauccucgaacugaccgaugccuuggcacuggggaugaugguguuaaaaauuguccgugacauggagaaguaucagcucgcugugacaaucauggccacucugugcguucccaaugcagugauucuucagaacgccuggaaagucaguuguaccauccuggcuguaguguccguuucuccauugcuccugacgagcucccagcaaaagacagacuggauaccucuagcgcugaccauuaaaggacuuaaucccacugccaucuuucucaccacacugucaagaacuaacaagaaaaggagcuggccauugaaugaagcaaucauggcugugggcauggucaguauucuggccucuuccuuacucaagaacgauauaccgaugaccggcccucugguggccgggggacuucugacgguaugcuacguguugacaggucgcagcgcugaccucgagcuggaacgggcaaccgaugucaagugggaggaccaggccgagaucucgggcucaucucccauucuaaguaucacuauuuccgaagaugggagcaugucuaucaaaaaugaggaagaggagcagacacugaccauacuuaucagaacuggacuccugguuauuagcggcuuguucccaguguccauccccauuacagcggcugccugguauuuaugggaagugaagaaacagagggccgguguccugugggacgugccuucaccacccccuauggggaaggccgagcucgaagauggagcuuaccgaaucaaacaaaagggcauacugggcuauagucagauuggggcaggaguuuacaaggaggguaccuuucauacgauguggcacguaacucgcggcgccgugcuuaugcacaaagggaagcggaucgaaccgagcugggcggacgucaaaaaggaucugaucucuuacggaggcgguuggaaauuggagggggaguggaaggaaggagaggaagugcagguucuagcucuggagccaggcaagaaccccagagccgugcagaccaaaccuggccucuucaagacaaauaccgggacaauuggagcagucucccuggacuuuucaccagguacaaguggcagccccaucauagauaaaaaggggaaagugguaggacuuuauggcaacggugucgugaccagguccggggccuacguuucugcuauugcccaaacggaaaagucgaucgaggacaacccugauauugaggacgacaucuuccguaagcgccgguuaacaauaauggaucugcauccgggagcaggcaaaacuaagagauaucuccccgcuauugugagggaagccaucaaacgaggcuugcggacccugauccucgcgccaacacgcgucguggccgcagagauggaagaggcucugagagggcuuccuauuagguaccagacccccgccauccgggcugaacacacuggacgagagauuguugaccugaugugucaugcaaccuuuacaaugagauugcuaagcccagugcgcgucccuaauuauaaccugauaaucauggaugaggcccacuucacggaccccgccucaauugcugcgagggguuacaucuccacucguguggaaaugggcgaggcagccgggaucuucaugaccgcuacaccaccgggaagucgggauccuuuuccccagucuaaugccccaauuauagacgaagagagagagauccccgaaaggagcuggaacuccggccaugaguggguaaccgauuucaaggguaaaacugugugguuuguuccuucaauuaaggcagggaaugacaucgccgcuugccuccgcaagaacggcaagaaggucauucaauuaucucgaaaaacauucgauagcgaauaugugaagaccagaacgaaugacugggauuuuguggucacuacagacaucagugagaugggcgcgaacuucaaagccgaacggguaauagacccaaggcgcuguaugaagcccgugauccugaccgauggcgaggagcguguuauucuugcagggccuaugccggugacccacuccagcgcugcccagagacggggaaggaucggucgcaaucccaaaaacgaaaaugaccaguacauuuacaugggcgagccccuggaaaacgaugaggacugcgcacacuggaaggaagccaagaugcucuuggauaauaucaacacuccugaggggauaauucccucuauguuugagccagaacgagagaaagucgacgcuaucgauggagaauauagacugcggggcgaggccaggaagacauucguggaccucaugcgcagaggugaucugccuguuuggcuugcguacaaaguggcagccgaagggauuaauuaugcugacaggcggugguguuuugauggcaucaagaacaaccagauacuagaggagaaugucgaaguggagaucuggaccaaagaaggagagcguaagaagcugaaaccccgcugguuggacgcccgaauuuacucagauccauuagcucugaaggaguucaaagaauuugcagccggcagaaagucccucacacugaaccuuaucacugagauggggaggcugccuacguucaugacccagaaaacucgggacgcucucgacaauuuggccguacugcauacugcagaagcgggaggucgcgccuauaaccacgcucuaagugagcugccggaaacccucgagacacuucuguuauugacccugcucgccacugugacgggcgggauuuuccuguuucuuaugagcggaagaggcaucgguaagaugacccuggggaugugcugcauaauuacagcaucgauccucuugugguacgcucaaauccagccccauuggauugccgcaucuaucauacuggaguucuuuuuaauuguucuacugaucccagaaccugagaagcagaggacuccccaagauaaucagcucaccuaugucgugauugccauccuuacaguggucgcugcgaccauggccaacgaaaugggcuuccuggagaaaacuaagaaagacuugggacugggcuccauagcaacacagcagccagaaagcaauauccucgauauugaccugcggccugcuucagccuggacgcuuuacgccguugcaaccacuuuugugacacccaugcuccgacacaguaucgagaacucuuccguaaaugugagccugaccgcuauugccaaccaagcgaccgucuugauggggcugggaaaggguuggccguuaucaaaaauggauaucggcgugccacuacuggcuauuggguguuacagucagguuaauccuaucacacucacugccgcacuucuguugcugguggcccacuaugcuauaauuggacccggccuccaggcaaaggccacgagagaggcgcagaagcgcgcugccgcagguaucaugaaaaacccaaccgucgacgggaucacaguaauugaucuggaccccauaccuuacgauccgaaguucgaaaaacaacuuggccaggugauguuacugguucucugcgugacucaggucuugaugaugaggaccacaugggcccugugugaggcucuaacccuggccacuggacccaucagcacgcucugggaaggcaauccagggcgguuuuggaacacaaccauugcaguguccauggcuaauaucuuccguggaucuuaucuugccggcgcgggucuguuguuuagcauuaugaagaacacuaccaauacaagaagggggacuggaaacaucggcgagacccugggugaaaaauggaagucccgccucaacgcccugggcaaaucagaguuccaaauauacaagaagucugggauccaggaggucgaccggacauuagcaaaagaaggaauuaagcgaggcgagacggaucaucacgcugugaguagagggucggccaaacuuaggugguuuguugaacgcaauauggugaccccugagggaaagguaguggaccugggcugcgguagagggggauggagcuauuacuguggcggucucaaaaacguccgggagguuaagggccuaacuaaagggggacccggccaugaggaaccuaucccaauguccacauauggguggaaucuggugcguuugcagucuggagucgauguguucuuuauucccccugaaaaaugcgacacccugcucugugacaucggcgagucaagcccaaaccccacuguagaagcagguaggacacuucgggugcugaauuugguugagaacuggcugaauaacaauacccaguucugcauaaaggugcucaacccguacaugccuuccgucauugagaaaauggaaacguuacaacgcaaguacgggggagcucuggugcgaaauccacuuaguagaaacucuacccacgagauguauugggucagcaaugccucaggcaacaucguguccaguguuaauaugaucagcaggaugcugauuaaccgguucacaaugcgccauaaaaaggccacuuacgaacccgauguagaccuaggcucugggaccagaaacauaggaaucgaguccgaaauuccuaaucucgauaucauugguaagaggaucgagaaaauaaagcaggagcacgaaacaucauggcacuaugaccaggaucauccauacaaaacuugggcguaucacggcagcuacgagaccaagcagacagggucggcuucuaguauggugaacggagucgugcgacuguugaccaaacccugggacguucugccgacugugacgcaaauggcaaugacagauaccacuccuuuuggccagcagcgggucuucaaggaaaagguggacacccguacacaggagcccaaagaagguacgaagaaacucaugaagaucaccgccgaguggcuuuggaaagagcuggggaagaaaaagacuccaagaauguguacacgcgaagaguuuaccaggaagguacgguccaaugcugccuuaggagcaauuuucacugaugaaaacaaauggaaaagcgccagagaggcuguggaggacucacgcuuuugggaacugguugauaaagagaggaaguugcaucucgaaggcaaaugcgagacaugugucuauaauaugaugggcaagcgagaaaagaaacugggggaguucggaaaggcgaaagguucccgggccaucugguacauguggcuaggcgcaagauuucuugaguucgaagcucugggguuucucaacgaggaccacugguucucuagggaaaauagccugaguggaguggagggcgaagguuugcacaagcugggguacauucuccgcgacguguccaaaaaggagggaggcgccauguaugcagaugacaccgccggcugggauacacguaucacucuugaggaccugaagaacgaagagauggucaccaaucauauggaaggggagcacaaaaaguuagcugaagccauuuuuaaacugacguaccaaaacaagguugugcggguacagagaccuacccccaggggaacagugauggauauaaucagccgccgagaccagcgggguucuggccaagucgggacuuauggauugaauaccuucacaaacauggaggcgcagcucauuagacagauggagggcgaagguguguuuaaaaauauccagcaucugacuguuaccgaggaaaucgcagugcaaaacuggcuagccagggucgggcgcgagagacuuucacggauggcuauuaguggagaugacugcgugguaaagccacuggaugacagguucgccuccgcacucacggcucugaaugauaugggcaagauacguaaagacauccagcagugggagcccagccgaggcuggaacgauuggacacagguuccuuucugcucucaccauuuucacgaauugauuaugaaggacgggcgcguguuagucgugccauguagaaaccaagacgagcugaucggacgggccaggauuucgcagggugcuggcuggucacuccgcgaaaccgccugccuugggaaaagcuacgcacagauguggucccugauguauuuccacagacgggaucuaaggcuggcggccaaugcuaucuguagugccgugccgucucauuggguccccacuagccgaacaaccugguccauacacgcaaagcaugaguggaugacuaccgaagacaugcucacaguuuggaaccguguguggauccaggagaauccuuggauggaggauaaaacgccaguagaaucaugggaggaaauucccuacuugggaaagagagaggaccaauggugcggcagucugaucggucuuaccucucgcgcuacuugggccaagaacauucaggcagccaucaaucaggugcggagccugauagggaacgaagaguauacagauuacaugccuuccaugaaaagguuuagacgcgaggaagaggaagcgggaguccucugguga

SEQ ID NO: 14621 - RNA, 9876 nt, Artificial Sequence
  derived and/or modified CDS sequence (opt3) from DENV-2__GQ868543__SS-prME
agcgccggaaugaucauuaugcugauccccaccgugauggcuuuccaccucaccacuagaaacggggagccucauaugaucgucgguauucaagaaaaggguaaaucccuucuguuuaagacggaggacggaguuaauaugugcaccuugauggcaauggauuuaggggaacugugugaggacacaaucacuuacaaaugcccacuacucaggcaaaacgaaccggaggauauugacuguuggugcaauucuaccucaacaugggugaccuauggaacuuguacaaccacgggcgagcaccggcgcgaaaagcgaaguguagcccuggugccccaugucgguauggggcuugagacucguaccgaaacauggaugagcuccgagggagcguggaaacacgcucagagaaucgagacuuggauacugaggcauccuggcuucaccaucauggccgcaauuuuggccuacacaaucggcaccacgcacuuucagcgggcucucauuuucauccugcugacugcaguggccccaucuaugacaaugcgcugcauagggauuucgaacagagauuuuguugaaggagugucagguggcagcugggucgacaucgugcucgagcacgggaguuguguaaccacuauggcuaagaauaagcccacauuagauuucgaacugauuaaaaccgaggccaagcagccugcgacgcuuaggaaauauugcaucgaagcaaaguugaccaacacaacuaccgagucccgguguccaacacaaggagagcccucucugaaagaggaacaggacaagcgcuuuguuugcaagcauagcaugguggaucgaggcugggguaauggguguggacuauucggcaaaggcgggaucgucacuugcgccauguuuaccugcaagaaaaacauggaaggaaagauugugcagccugagaaucucgaauacacaauaguggucaccccacacuccggugaggagcaugcuguuggcaacgacacugggaaacacggaaaggaaaucaaagugacgccgcagucaaguauuacagaggccgaacugaccggcuaugguacuguaaccauggaguguagccccagaacagggcuugauuucaaugaaauggugcuguugcaaauggagaacaaggcauggcucguccacaggcagugguuucuggacuuaccucugccauggcuccccggcgcugauaagcagggaucuaauuggauccagaaagagacccuugugacuuucaagaacccucaugccaaaaagcaagacguugugguccugggcucccaggaaggggcgaugcacacagccuugacgggagcaaccgagauacagaugucaagcgguaaucuacuguuuacuggccaucucaaaugccggcugcguauggacaaacuucaacugaaggggaugaguuacucuauguguacaggaaaauucaaggugguaaaagaaauugcugagacccagcacggcacaaucguuauccgcgugcaguaugagggugauggguccccaugcaagauucccuucgaaaucauggacuuggagaaaagauacguccucggcaggcugauuacugugaacccgauagucaccgaaaaggauagcccugugaacaucgaggccgaacccccauuuggagacucguacauuaucaucggcguugagccugggcaguuaaagcugaauugguucaaaaagggaucuuccauuggucaaauguuugagacgaccaugcggggcgcuaaacgaauggccauacuaggggauacagcaugggacuucggaucacucggcgguauguuuacaaguaucgggaaggcccugcaucagguguucggcgcuauuuauggagcggcauuuagcggcguauccuggaccaugaaaauccuuauuggggucaucauaacauggaucggaaugaacucucgcagcacuucauugagugugucccugguucucgugggcauugucacccuguaccuuggugugaugguacaggccgauagcgggugugugguuucuuggaagaauaaggaacugaaaugcggaucaggcaucuucauuacggacaacguccacacauggaccgagcaguauaaguuucaacccgaaaguccaagcaaauuggcuuccgccauccagaaggcacaggaggaagguauauguggcauuagaucugugacuaggcucgagaaucugauguggaaacagaucacacccgaguuaaaccacauucuggccgaaaaugaggugaagcuaaccaucaugacuggggauauaaaaggaaucaugcaagcuggcaagcggucgcuccgcccucagccaaccgaacugaaguacagcuggaaaacaugggggaaggccaaaaugcuuuccacggagucacauaaccagaccuucuugauugacggaccggaaacugcagagugccccaauacaaacagagcguggaauagucuggaggucgaagauuauggcuuugguguuuucaccacaaacaucuggcucaagcugaaagagaagcaggacgcuuuuugugacucuaaguuaaugagcgccgcaauuaaagauaauagggccgugcacgcugacaugggguacuggaucgaauccgcccugaacgauacuuggaagauagagaaagcaucauucauugaggugaagaauugccauuggccuaaaagccacacccuuuggucuaacggaguauuggaauccgagaugaucaucccaaagaaccucgcuggccccgucagucaacacaauuaucguccugguuaccauacgcagauugccggcccauggcaccuggggaagcuagaaauggacuucgauuuuugugacggaacaaccgugguugugacugaggauugcggcaaccgggggcccagccugcgaaccacaacugcgucuggaaaacucaucaccgaauggugcuguagauccugcacacugccgccucuuagguaccgcggcgaggacgguuguugguaugggauggagauucggccauugaaggaaaaagaggaaaaucuggucaacucauuagugacggccggacauggccagguugauaauuucagucucggugugcugggcauggcucuuuuucuggaggaaauguugagaaccaggguagggacuaagcacgcaauacuccuggucgccgugagcuucgugacacuaaucaccggaaacaugucguuuaaagaccugggccgcgucguugugaugguaggggcuacuaugacagaugacauuggaaugggcgugaccuaccucgcccugcuugcagcguucaagguccgacccacguuugccgcugguuugcuguuacggaagcucacuuccaaagagcugaugaugaccacaaucgggauugugcuucugucucaaagcaccaucccugagacuauacuagaacucacagaugcccuggcauugggaaugaugguucugaagaucgugcguaauauggagaaauaucaguuagcugucaccauuauggccauccucugcgugcccaacgcaguuauucugcagaaugccuggaaggugucauguacaauccuugcugucguaaguguguccccacuguugcucacuucuagccagcagaagaccgacuggauaccucuggcgcuaacgauuaagggccugaaccccacagccaucuuccuuaccacucucuccagaaccaauaaaaagaggucauggccacugaacgaagcaaucauggcuguuggcauggugagcauuuuggccaguucucuguuaaagaaugacauaccgaugacagggccucucgucgccggaggucugcuuacugugugcuacguacugaccggccgcuccgcugauuuggagcucgaacgggcaacggacgugaaaugggaggaucaggccgagaucagcgggucgucacccauucugucuaucacaauuagugaagacggauccaugagcaucaagaacgaggaagaggagcagacccuaacuauacugaucagaacaggccuucucgucauuucuggucuguuuccaguuagcauccccauuaccgcggcugccugguauuugugggaagugaaaaagcagagggcagggguguuaugggaugucccuuccccacccccuaugggaaaagccgagcuggaagacggcgcuuaccgaaucaagcaaaagggcauacucggguauucacagauuggagcaggaguguacaaagagggcacuuuccauacaauguggcacguuacccgcggggccguacugaugcacaagggaaaacggaucgaaccgaguugggcggaugugaagaaagaccuuaucagcuacggcgguggguggaagcuggagggagaguggaaggaaggcgaggaaguccagguguuggcucuagagccaggcaaaaaucccagagccguucagacgaagccugggcuguuuaaaacuaacaccggaacaauuggugcagugucucucgauuucuccccaggcaccucagggagucccaucauagacaagaaaggaaaggucgugggccuguaugguaacgggguagucacaaggagcggagccuacguguccgcuauugcccaaacugaaaagucuaucgaggauaauccugagauugaagacgauaucuuucguaaacgccggcuuaccauaauggacuuacauccgggcgcaggcaagacgaaaagauaucugcccgcuauuguuagggaggccaucaagcgagggcuccggacauugauccuggcgccaacucgcguggucgccgcagaaauggaggaagcucucagaggacugccuauuagguaccagacccccgccauccgggcugagcacacaggucgagagauuguggaccuuaugugucaugcaaccuucacuaugagacuguugucgccaguucgcgugccuaacuauaaucuaauaaucauggaugaagcccacuucaccgaccccgccagcauugcugcgaggggcuacaucucaacacgugucgagaugggggaagcagccggaaucuuuaugacggcuacuccaccgggcucccgggauccuuucccccagaguaacgccccaauuauagacgaggagagagaaauccccgagaggucuuggaauagcggucaugaaugggugaccgauuuuaaagggaagacaguaugguucgugccuuccauuaaggcaggaaacgacaucgccgcuugccugcgcaaaaauggcaagaaaguuauucaacucucacgaaagaccuuugauucugaguaugucaaaacuagaacaaacgacugggauuucguggugaccacggacaucagcgaaaugggcgcgaauuuuaaggccgagcgggucauagauccaaggcgcuguaugaaacccguaaucuuaacugacggggaggaacgugugauucuggcaggaccuaugccgguuacacacaguuccgcugcccagagacgggguaggaucggccgcaacccaaagaaugagaacgaccaguacauuuacaugggggaaccccuugagaaugaugaagacugcgcacacuggaaggaggccaaaaugcugcucgauaacaucaauaccccugagggaauaauucccagcauguucgaaccagagcgagaaaagguggacgcuaucgauggcgaguauagauugcggggugaagccaggaaaaccuuugucgaccugaugcgcagaggggaucucccuguguggcuggcguacaagguugcagccgagggcauuaacuaugcugacaggcggugguguuucgauggaaucaaaaacaaucagauacuugaggaaaacguggaggucgaaaucuggacuaaggagggcgagcguaagaaacuaaagccccgcuggcuggacgcccgaauuuacucugauccauuggcuuuaaaagaauuuaaggaguucgcagccgggagaaaaucacugacacucaaucugaucaccgaaaugggaaggcuuccuacauucaugacucaaaagacgcgggacgcucuggauaaccucgccguguugcauaccgcagaggcggguggccgcgccuauaaucacgcucuguccgaacuaccggagacacuggagacucuccuucuguuaaccuugcuggccacaguaaccgggggaauuuuucucuuccugaugaguggcagagguaucgggaagaugacucuuggcaugugcugcauaauuacggcaagcauccugcucugguacgcucagauccagccccauuggauugccgcaucgaucauauuggaauuuuuccugauuguguuacuaaucccagagccugaaaaacagaggacaccccaagacaaccagcugacauauguugucauugccauccucacugugguggcugcgaccauggccaaugagaugggauuucuugaaaagacuaaaaaggaccugggcuuggggucuauagcaacccagcagccagaguccaacauccuggauauugaccuccggccugcuagcgccuggacucuguacgccgucgcaacaacguucguuacccccaugcuucgacacucaaucgagaauaguucugugaacguaucccucacugcuauugccaaucaagcgacagugcugaugggauuggguaaaggcuggccgcugagcaagauggauaucggggucccauuacuagcuauuggauguuacucacaggugaacccuaucacccugaccgccgcacuccuucuguugguugcccacuaugcuauaauuggccccggucugcaggcaaaggccacaagagaagcgcagaaacgcgcugccgcagggaucaugaagaauccaacuguggacggcaucacggucauugaucucgaccccauaccuuacgauccgaaauuugagaagcaacugggacagguaaugcuuuuaauccugugcgugacccagguucucaugaugaggacaacuugggccuugugugaagcucugacccuagugacaggccccauuaguacccugugggaggggaacccaggacgguucuggaauacuacgaucgccgucagcauggcaaacauuuuucguggcuccuaucucgcuggugccgggcuucuguucucuaucaugaaaaauacaaccaacacuagaaggggaaccggcaacauaggugaaacauugggcgagaaguggaaaagccgccugaaugcgcucgggaaguccgaguuucaaaucuacaagaaaucaggcauucaggaaguggaccggacucuggccaaggagggcaucaaacgaggggaaaccgaucaucacgcagucucuagaggaagugcuaaguuaaggugguucguggagcgcaacaugguuacaccugagggcaaagugguagaccuugguugcgggcggggaggcuggucguauuacugugguggccugaagaaugugagagaagucaaggggcucacgaaaggaggccccgggcaugaggaaccuauuccaaugagcaccuauggauggaaccuaguucgucugcaguccggcguggaugucuuuuucauacccccugagaagugcgacacuuugcugugugauauaggugaaucuucaccaaaucccacaguggaggccgggaggacccuccggguacuuaaccugguggagaauugguugaacaauaacacucaguucugcauuaaaguucugaauccguacaugccuagcgugaucgaaaagauggaggcacuccaacgcaaauacggaggcgcuuuaguccgaaacccacuguccagaaauaguacacacgaaauguauugggugucuaacgccagcggcaauaucgucucauccgugaacaugauuaguaggaugcuuauaaaccgguuuaccaugcgccauaagaaggccacguacgagcccgacguugaccuggggagcggaaccagaaauaucgguauugaaucugagaucccuaaccuagauauuaucggcaaaaggauagagaagaucaaacaggaacacgagacauccuggcacuaugaccaggaucauccauacaagacuugggcguaucacgggucauacgaaaccaaacagacaggaagcgcuucgucuaugguaaauggcgugguccgacuccugacuaagcccugggacguguugccgaccguuacacaaauggcaaugaccgauacuacgccuuucggucagcagcggguguuuaaggagaaagucgacacacguacccaggaacccaaggaggggacuaaaaagcugaugaaaauuaccgccgaguggcucuggaaggaacuuggcaaaaagaagacaccaagaauguguacgcgcgaggaguucaccaggaaagugcggaguaacgcugcccugggcgcaaucuuuacugaugagaauaaguggaaauccgccagagaggcuguagaagacagccgcuucugggaguuaguggauaaggaaaggaaccugcauuuggagggcaaaugcgaaacauguguuuauaauaugauggggaagcgagagaagaaacucggagaguuugguaaggcgaaaggcucacgggccauuugguacauguggcugggggcaagauuccuagaauuugaggcucuuggauuccugaacgaagaccacugguuuuccagggaaaauucucucagcggcgucgaaggugaggggcugcacaaguugggauacauccugcgcgaugugaguaaaaaggagggcggcgccauguaugcagacgacaccgccgggugggauacucguauuacacucgaagaccuuaagaacgaggaaauggugaccaaucauauggagggagaacacaaaaagcuggcugaggccauauucaaauuaacauaccaaaacaaggucguucgggugcagagaccuacucccagggguaccguaauggauaucauuucccgccgagaccagcggggcagcgggcaagugggaacguauggccugaauaccuuuacaaacauggaggcgcaguugaucagacagauggaaggugagggggucuucaaaaauauccagcaucucacugugaccgaagagguugcagugcaaaacuggcuggccagggucggacgcgagagacuaucucggauggcuauuucaggcgaugacugcgugguaaagccacuugaugacagguucgccaacgcacugacagcucucaaugauaugggcaagauacguaaagacauccagcagugggaacccaguaagggguggaacgauuggacucagguuccuuuuugcucccaccauuuccacgagcugauuaugaaagacggacgaguguuggucgugccaugucgcaaucaagaugaauuaaucgguagagcccggauuagccagggcgcuggguggucucugagggagaccgccugccucggaaagucguacgcacagauguggucacuuauguauuuucaccgcagagaccugcggcuagcggccaacgcuaucuguagcgccgugccgucccauuggguccccacgaguaggacaaccuggucuauacacgcaaaacaugaauggaugacuacagaggacaugcugaccguuuggaaucgaguguggauccaggagaacccuuggauggaagauaagacuccaguagagagcugggaagagauucccuaccucggcaagcgugaagaccaauggugcgguuccuugaucgggcugaccucaagagcuacaugggccaaaaauauucaggcagccaucaaccaggugcgcagucuuauaggaaaugaggaguauacggauuacaugccuucuaugaagcgguucaggagagaagaggaagaggcgggcguccugugguga

SEQ ID NO: 14622 - RNA, 9876 nt, Artificial Sequence
  derived and/or modified CDS sequence (opt3) from DENV-2__EU482544__SS-prME
accgccggcgugaucauuaugcugauacccacagucauggcuuuccaccucacuacgagaaacggggagccucauaugaucguuggaaggcaggaaaaggguaaaagccuucuguuuaagaccgaggacggcgugaauaugugcacauugauggcaauugauuuaggggaacugugugaggacacuaucaccuacaaaugcccacuacuccggcaaaacgaaccggaggauauugacuguuggugcaauuccacaucuaccuggguaacuuauggaacauguaccacgacuggcgagcaccgccgagaaaagcguucaguggcccuggucccccauguggguauggggcuugagaccagaacagaaacuuggaugaguagcgagggagcguggaaacacguucagaggaucgagaccuggauacugcggcauccuggcuucacaaucauggcugccauuuuggcauacaccaucggcacgacucacuuucagcgcgcccucauuuucauccugcugacagcuguggcaccauccaugaccaugagaugcauagggauuucuaacagggauuuugucgaaggagugucggguggcucauggguagacaucguucucgagcacgggagcugugugacuacaauggccaagaauaagcccaccuuagauuucgaacugauuaaaacggaggcuaagcagccugccacccuucggaaauauugcaucgaagcgaaguugacaaacacuaccacagagagucgcuguccaacucaaggagagcccucccugaaugaagagcaggacaaacgauuuaucugcaagcauucuauggucgauagaggcugggguaacggguguggacuauucggcaagggcgggauugugaccugcgcaauguuuacaugcaaaaagaauauggaaggaaaagugguccucccugagaaccuggaauacaccauaguuaucacuccacacagcggugaggagcaugccgugggcaaugacacggggaagcacggaaaagaaauuaagaucacaccgcaguccucaauaaccgaggcugaacuuacuggcuaugguaccguaacaauggaguguagucccaggaccgggcuggauuucaacgaaaugguguugcuccagauggaggacaaagccuggcugguccaccggcaaugguuuuuagaucugccucucccauggcuucccggcgcagacacucagggaagcaauuggauucagaaggagacacuggugacguucaagaacccucaugcuaaaaagcaggacguuguggucuugggcucucaagaaggggccaugcacaccgcgcuaacuggagccacagagauccagauguccucagguaaucugcucuuuaccggccaucugaaaugccgucuucgcauggauaagcugcaguugaaagggaugagcuacaguauguguacaggaaaguucaagaucgugaaagaaauugcagagacucaacacggcaccaucguaauuagaguucaguaugagggugacgggucuccaugcaagauacccuucgaaaucauggaucucgagaaaaggcaugugcugggccgguuaauuacggucaacccgaucgugaccgaaaaggacuccccugucaacaucgaggcugaacccccauuuggagauagcuacauuauaaucggcguggagccugggcagcugaaacuaaauugguucaagaagggaucgucuauuggucagauguuugagacaacuaugcgaggcgccaaacgcauggcuauccucggggacaccgccugggauuucggaucccugggcgguguuuuuacaucaauugggaaggcacuucaccaaguguucggcgccaucuacggagcugcguuuaguggcguaagcuggacuaugaaaauauugaucggggucauuaucaccuggauuggaaugaacuccagaucuacgagccugucagugagucucguucuggugggcgucgugacacuuuaucuggguguaauggugcaggcagacaccggguguguugucuccuggaagaauaaagaauugaagugcggaagcggcaucuucauaacugauaacgugcacacauggaccgagcaguacaaguuucagcccgaaucuccaucaaaacucgccagugcuauucaaaaggcccaugaggaagguaucuguggcauuaggagcgugacucggcuggagaauuuaauguggaaacagaucacccccgagcugaaccacauacuauccgaaaaugaggucaagcucacaaucaugacgggggacauuaaaggaaucaugcaggcaggcaagcgcucucugagaccucagccaaccgaacuuaaauauucguggaagacuugggggaaggccaaaauguugagcacagagucccauaaccaaaccuuccugauugauggaccggaaacagcugagugccccaauacuaacagggccuggaauucacucgagguugaagacuacggcuuugguguguucaguaccaacaucuggcugaaguuacgugagaaacaggacguguuuugugauucuaagcugaugagcgcagcgauaaaagacaaucgggcuguacacgccgauaugggguauuggauugaauccgcacuuaacgacacguggaagauggagaaggccucauucaucgagaucaaaagcugccacuggccuaagucucauacauugugguccaauggaguccucgaaagugagaugauuaucccaaaaaacuucgcuggccccgugagccagcacaacuaccgaccugguuaucauacccagacugccggcccauggcaccuggggaagcuagaaauggauuuugacuucugugagggaaccacaguuguggucacugaagauugcggcaauagagggcccucucugaggaccacaacggcauccggaaaacucauuaccgaguggugcugucgcucaugcacucugccgccucuucgguacagaggcgaggacgguuguugguacgggauggaaauaaggccauugaaggagaaggaagagaaccuggugaauaguuuaguuacagcuggacauggccaaaucgauaacuuuagccucggugugcugggcauggcccuuuuccuggaagagauguugcgcacccgaguagggacuaaacacgcgauucuccuggucgccgugucguuugugacacuaaucaccggaaauauguccuuccgggaccugggccgugucaugguuauggugggggcuacgaugacugaugacauuggaaugggcguaaccuaucucgcacugcuugccgcuuuuaaggugagacccacauucgccgcagguuugcuguuaaggaaacucaccucuaaggagcugaugauggcgacuaucgggauagcccuucugagccagucaacaaucccugaaaccauucuagagcucacagaugcucuggccuugggaaugaugguccugaaaaucgugcgcaacauggaaaaguaccaguuagcaguuacuauuauggcuaucaguugcgugcccaaugccgucauacuccaaaacgcauggaagguguccuguaccauucuggccgcuguuucugugagcccacuucuguugacguccucacagcagaaagcggacuggaucccucucgcccugacaaucaagggccuaaaucccaccgcaauuuuucugacuacccuuagccggacaaguaaaaagagaucuuggccacucaacgaggcugucauggccguaggcaugguguccauacuggccagcucguugcugaaaaaugacaucccgaugacugggccuuuaguugcuggaggucuccugaccgugugcuauguccuuacgggcaggucagcagaucuggaauuggagcgagccgcggacgugaagugggaggaucaggcugaaauuucugggaguucccccauccucagcauuacaaucucugaggacggaagcauguccauaaaaaacgaagaggaggaacacacccugacuauccuaauucgcacaggccugcuuguaaucucagguguguucccagucaguauucccaucaccgccgcagccugguaccucugggagguuaagaagcaacgggcuggggugcugugggaugugccuagcccacccccugucggaaaagcagaauuggaggacggcgccuauagaauaaagcagaggggcauuuuuggguacucucagaucggagcggguguguauaaagaaggcacuuuccauacaauguggcacguuacccguggggcuguauuaaugcaucgcggaaagcggaucgagccguccugggccgaugugaaaaaggaccugauuucauacggcgguggguggaagcucgagggagaauggaaagagggcgaagagguccaggugcuggcacuugaaccaggcaagaaucccagagccguucaaacgaaaccugggcuguuuaagacuaacaccggaacaaucggugcugugaguuuggauuucagcccaggcaccuccgggucucccauagucgacaggaaaggaaaggugguaggccuauacgguaauggggucgugacacgaucgggagccuauguuagcgcaauugcucagacugagaagucaaucgaggauaacccugaaauugaggacgauaucuuccggaaaaagcgccugaccauaauggaccuccacccgggcgccggcaaaacgaagagauaccugcccgcgauugugagggaagccaucaaacgggggcuucgaacauuaauccuggcaccaacuagagucguggcugccgagauggaagaggcucuccgcggauugccuauuagguaucagacccccgcaauccgugccgagcauacaggucgggaaauuguugaccugaugugucacgccaccuuuacuaugagacuccuguccccagugagggucccuaacuacaaucuuauaaucauggaugaggcucacuucaccgaccccgcgaguauugcagcccgcggcuauaucucuacacgaguggaaaugggggaggcugccggaaucuuuaugacggcaacuccaccgggcagcagagauccuuucccccaguccaacgccccaauuauggacgaggaacgggagauacccgaaaggucauggaauucuggucaugaguggguaaccgauuuuaaggggaagacagugugguucguuccuagcaucaaagcuggaaacgacauugcggccugccugcgcaagaauggcaaaaaggucauccaauugagucguaaaaccuuugauuccgaauacgugaagacuagagcaaacgacugggauuucguggucacaaccgacauuagcgagaugggcgcuaauuuucgggccgagaggguaaucgauccacgccgauguaugaagcccgugauacuaacggacggggaagagagaguuauccuggcaggaccuaugccggugacucacucuucagccgcucagcggaggggucgcauuggcagaaacccaaaaaaugaaaacgaccaguauaucuacaugggggagccccucgaaaaugaugaggacugcgcccauuggaaggaggcgaaaauguuacuggauaacauuaauacaccugaaggaaucauacccuccauguucgagccagaaagggagaaggucgacgcaauugauggcgaauaccggcuucguggugaggcccgcaaaaccuuuguggaccugaugcgaagaggggaucucccuguuugguuggcuuauaggguggccgcugagggcaucaacuacgcagaccggcgcugguguuucgauggaauuaagaauaaccaaauccuggaagagaacgucgaaguggagauauggaccaaagagggcgaaagaaagaagcucaaacccagguggcuggacgcccggaucuauagugauccacuugcucuaaaggaguucaaagaauuugccgcagggcgaaagagccugacuuugaauuuaauuacagagaugggaagacugccuaccuucaugacacagaaagcgcgcgacgcccucgauaaccuggcuguacuucacacugccgaaguggguggcagggcauacaaucacgcucugucggagcucccggagacguuggaaacccugcuacugcucacacuucuggccacuguuaccgggggaaucuuuuuauucuugaugucuggcaaggguauugggaagaugacacugggcaugugcugcaucauaaccgcauccauucuccugugguaugcccagauccagccccauuggaucgcugcgagcauuauccuugaguuuuuccugauaguccucuugauuccagaaccugagaaacaacggacuccccaggacaaccagcugacguacguggugaucgccauuuuaaccgucguugcagcuacaauggccaaugaaaugggauuucuagagaagacuaaaaaggaccugggccucgggucaaucaccacacaggagagugaaucuaacauacuugauaucgaccugcguccagccuccgcauggaccuuguaugcuguggccacuacauucguaacgccuaugcugagacacagcauugagaauucaagugugaacgucagccucaccgcgaucgcuaaucaagccacugugcugaugggacuugguaggggcuggccccucuccaaaauggauauugggguuccgcuguuggcaaucggauguuacucucaggugaacccaauuacacugaccgccgcuuuacuacugcucgucgcacauuacgccaucauaggcccuggucuucaggcgaaggcuacccgcgaagcccagaagcggacagcagccgggauuaugaaaaaucccacuguagacggcaucacggugaucgaucuggagccaauucccuaugacccuaaguuugaaaaacaauugggacagguuaugcugcucgugcugugcgucacccaggugcuuaugaugcgaacaacuugggcuuuaugugaggcccugacccucgcaacaggcccgauaagcaccuugugggaggggaaccccggaagauucuggaauacuacgaucgcugucuccauggccaacauuuuuaggggcucauaccuggcgggugccgggcuacuguucucuaucaugaagaauacaaccaacacucgccggggaaccggcaauauuggugaaacacucggcgagaaauggaagaguagacuuaacgcacuggggaagucggaauuucagaucuauaaaaagagcggaauacaagagguggaucguacuuuggcuaaagagggcaucaagaggggggaaaccgaccaccaugccguuucccggggaucugcaaaacugcgcugguucguggagcgaaacaugguaacaccagaaggcaagguggucgaucucgguugcgggagaggaggcuggucauacuauugugguggccugaaaaauguuagggaggugaagggguuaacgaagggaggcccugggcacgaagagcccauuccuaugagcaccuacggauggaaccuuguccggcugcaguccggcguggacguauucuuuacuccacccgagaaaugcgauacacuccuaugugacaucggugaaaguucuccuaauccaaccauugaggcugggcgcacucugagaguguugaaccugguugaaaauuggcucaacaauaacacacaguucugcgugaagguccuuaaucccuauaugccgagcgugaucgagaaaauggaaacccugcaaaggaaguacggaggcgccuugguccgaaacccucugucacggaauuccacgcacgagauguacugggugaguaacgccaccggcaauauaguuagcucuguaaacaugauuucccguaugcucaucaauagauuuacaaugaaacauaagaaggcgacuuaugagccagauguggacuuagggucaggaacccgcaacaucgguauugaaaacgagauacccaaucuggacaucauuggcaaaaggaucgaaaagauuaaacaggagcacgaaacaagcuggcauuacgaucaggaccacccuuauaagacuugggcuuaccacgggucguaugagaccaaacagacaggaucugcaaguuccauggucaacggcgugguuaagcuucugaccaagccaugggaugugguccccauggugacucaaauggccaugacggacacaaccccguucggucagcagcggguauuuaaagagaagguggauacuagaacccaggaaccuaaagaggggacaaagaaacuaaugcgcaucacggcugaauggcucuggaaggagcugggaaagaaaaagacccccaggauguguacucgagaggaauucacacggaaaguuagaagcaaugccgcauugggcgccauauuuaccgacgagaacaaguggaaaucagcuagggaagcggucgaggauucccgcuucugggaacugguggaccgugagcggaaucuccaucuugagggcaagugcgaaacuuguguguacaacaugauggggaaaagagagaagaagcugggagaauuugguaaagccaagggcucuagggcaaucugguauaugugguuaggggcucgcuuccuggaguuugaagccuugggauuccucaaugaggaucacugguuuagccgaggcaacagucuguccggugucgagggggaaggacuacauaaacuuggcuacauucugcgggacguuagcaagaaagagggcggggcaauguacgccgaugacacagcuggaugggacaccagaaucacacucgaagaucugaagaaugaggaaauggugacuaaccacaugaagggugagcauaaaaaguuggccgaggcgauuuucaaacugaccuaucaaaauaagguagugaggguccagcgcccaacgccuagaggcaccgugauggacaucauuucucggaaagaucagagggggucaggacagguuggcacauacggucucaacacuuucaccaauauggaagcacaacuuauacgucagauggagggggaaggaaucuuuaagaguauucagcgacugacagugacugaggagaucgccguccaaaacugguuagcucgcgugggcagagaacggcuguccaggauggccaucagcggcgacgauugcguaguuaagcccuuggacgaucgcuucgcaucugcucucaccgcccugaaugacauggggaaagugagaaaggauauucagcagugggagccaucgcggggauggaacgacuggacgcagguccccuuuugcucacaccacuuccaugaacuagugaugaaagaugguagggugcuugucguuccuugucgaaaccaagacgagcugauaggccgugcuagaaucagccagggggccggauggucccucaaggaaacagcaugccugggcaaaaguuaugcgcagauguggaccuugauguacuuucaccgccgggauuuaaggcuggccgcuaaugccauuuguucugcagugccaagccauuggguaccgacuuccagaacaaccuggucaauccacgcuaagcacgaguggaugacuaccgaggacaugcucgccguguggaaccgcgucuggauucaggaaaaucccuggauggaggacaagacaccuguggaaaguugggaggaaguuccauaucuugguaaacgggaggaucaauggugcgggucucugaucggacuaacgagcagggcaaccugggccaagaacauacagacugcgaucaaucaggugcgaucccugauuggcaacgaggaauacacagacuauaugcccucaaugaaaagauuccggaaggaggaagaggaagcuggcguccucugguga

SEQ ID NO: 14623 - RNA, 9876 nt, Artificial Sequence
  derived and/or modified CDS sequence (opt3) from DENV-2__EU482545__SS-prME
accgcaggcgugaucgucaugcugauucccacagcuauggcauuccaccucacuacgcguaacggggagccucauaugauaguuggaaggcaggaaaaggguaagagccuucuguuuaagaccgaggacggcgugaauaugugcacauugauggcaaucgauuuaggggaacugugugaggacacuauuaccuacaaaugcccacuacuccggcaaaacgaaccggaggauaucgacuguuggugcaauuccacaucuaccuggguuacuuauggaacauguaccacgacuggcgagcaccgccgagaaaagcguucaguggcgcuggucccccauguggguauggggcuugagaccaggacagaaacuuggaugaguagcgagggagcuuggaaacacguucagaggauugagaccuggauccugcggcauccuggcuucacaauaauggccgcaaucuuggccuacaccauuggcacgacucacuuucagcgcgcucucaucuucauucugcugacagcaguggccccauccaugaccaugagaugcaucgggauaucuaacagggauuuugucgaaggagugucggguggcucauggguagacauuguucucgagcacgggagcugugugacuacaauggcuaagaauaagcccaccuuagauuucgaacugaucaaaacggaggccaagcagccugcgacccuucggaaauauugcauugaagcaaaguugacaaacacuaccacagagagucgcuguccaacucaaggagagcccucccugaaugaggaacaggacaaacgauuuaucugcaagcauucuauggucgauagaggcugggguaacggguguggacuauucggcaagggcgggaucgugaccugcgccauguuuacaugcaaaaagaauauggaaggaaaaauugugcagccugagaaccucgaauacaccauaaugaucacuccacacagcggugaggagcaugcugucggcaaugacacggggaagcacggaaaagaaauuaagaucacaccgcaguccucaauaaccgaggccgaacugacuggcuaugguaccguuacaauggaguguagucccaggaccgggcuugauuucaacgaaauggugcuguugcaaauggaggacaaagcauggcucguacaccggcagugguuucuggauuuaccucugccauggcuccccggcgcugacacucagggaagcaauuggauucagaaggagacacuugugacguucaagaacccucaugccaaaaagcaagacgucgugguucugggcucucaggaaggggcgaugcacaccgccuugacuggagcaacagagauccagauguccucagguaaucuacuguuuaccggccaucucaaaugccgucugcgcauggauaaacuucaacugaaagggaugagcuacaguauguguacaggaaaguucaagaucgugaaagaaauugcugagacucagcacggcaccaucgucauuagagugcaguaugagggugacgggucuccaugcaagauacccuucgaaaucauggauuuggagaaaaggcauguacucggccggcugauuacgguuaacccgaucgugaccgaaaaggacuccccugucaacaucgaggccgaacccccauuuggagauagcuacauuauaaucggcguggagccugggcaguuaaaacugaauugguucaagaagggaucgucuauuggucaaauguuugagacaacuaugcgaggcgcuaaacgcauggccauccuaggggacaccgcaugggauuucggaucccucggcggugucuuuacaucaguggggaaggcccugcaccagguuuucggcgcuauuuacggagcggcauuuaguggcgugagcuggacuaugaaaauccuuauagggguaaucauuaccuggaucggaaugaacuccagaucuacgagcuugucagucagucuggugcucguuggcguggucacacuguaucuuggugccauggugcaggcugacuccggguguguagugagcuggaagaauaaagaacugaagugcggaucuggcauuuucaucaccgauaacguucacacuuggacagagcaguacaaguuucaacccgaaucaccaaguaaauuggccagcgcaauacagaaggcccaugaggaagguauuuguggcaucagguccgucacccggcucgagaaucugauguggaaacagauuacucccgaguuaaaccacauccugucugaaaaugaggugaagcuaaccauaaugacaggggacaucaaaggaauuaugcaggcuggcaagcgcucgcucagaccucaaccaacggaacugaaauauagcuggaagaccugggggaaggccaaaaugcuuuccacugagucacauaaccagacauucuugaucgauggaccggaaaccgcagagugccccaauacaaacagggcguggaauagucuggagguggaagacuacggcuuuggugucuucacuaccaacauuuggcucaagcugcgugagaaacaggacguauuuugugauucuaaguuaaugagcgcugccaucaaagacaaucgggcagugcacgccgauaugggguauuggauagaauccgcucugaacgacacguggaagauggagaaggccucauucauugaggugaaaagcugccacuggccuaagucucauacacuuugguccaauggaguauuggaaagugagaugaucauccccaagaauuucgcaggccccgucagccagcacaacuaccgaccugguuaucauacccaaacugcuggcccauggcaccucgggaagcuggaaauggauuuugacuucugugagggaaccacagugguugugacugaagauugcggcaauagagggcccucucuaaggaccacaacggccuccggaaaacugauuaccgaguggugcugucgcucaugcacucucccgccucugcgguacagaggcgaggacgguuguugguacgggauggaaaucaggccacuuaaggagaaggaagagaacuuggucaauagucuggugacagcgggacauggccagauugauaacuuuagcuuagguguucucggcauggcccuguuccuugaagagaugcugcgcacccgaguggggacuaaacacgcuauauugcucguagcagucucguuugugacacugaucaccggaaauauguccuuccgggaccuaggccgugugauggucaugguuggggccacgaugacugaugacauuggaaugggcgugaccuaucuggcucuccuggccgcauuuaagguaagacccacauucgcggccggucuuuugcugaggaaauuaaccucuaaggagcucaugauggcuacuaucgggauugcccugcuuagccagucaacaaucccugaaaccauacuggagcuaacagaugcacucgcucugggaaugauggccuugaaaaucgugaagaacauggaaaaguaccaacuggcagucacuauuauggccaucaguugcgugcccaaugcuguuauuuuacagaacgcguggaaaguguccuguaccauccucgccgcagucucugugagcccacugcuucugacguccucacagcagaaggcugacuggauaccuuuggcccucacaauuaaaggccugaaucccaccgccaucuuucuaacuacccugagccgcacaaguaagaaacggucuuggccacuuaacgaggcuaucauggcaguuggcaugguguccauucucgccagcucgcuguugaagaaugacauaccgaugacugggccucuggucgcgggagguuuacucaccguaugcuaugugcugacgggcagaucagcugaucuugaacuggagagggccgcagacguuaaaugggaggaucaagccgaaaucucugggaguucccccauuuugagcaucacaauuucugaggacggaagcauguccauccgaaacgaagaggaggaacagacccucacuauacugauccgcacaggccuacuggugauuucaggugucuucccagugaguauccccguaaccgcugcagccugguaccuuugggaggugaagaagcagcgggcggggguccucugggauguuccuagcccacccccugugggaaaagcugaacuggaggacggcgccuauagaauuaagcagaggggcaucuugggguacucucaaauaggagccgguguguauaaagaaggcacuuuucacacaauguggcaugucacccguggggcaguguuaaugcaccgcggaaagcggauugagccguccugggcugauguuaaaaaggaccugguaucauacggcgguggguggaagcucgagggagaauggaaagagggcgaagaggugcagguccuggcccuugaaccaggcaagaaucccagagcagugcagacgaaaccugggaucuucaagacuaacaccggaacaaucggugcuguuagucuggauuuuagcccaggcaccuccgggucucccauuguggacaggaaaggaaaggucgugggcuuguacgguaaugggguagucacacgaucgggagccuaugugagcgcgaucgcccagacugagaagucaauagaggauaacccugaaauugaggacgauaucuuccggaaaaagcgccuaaccauuauggaccugcauccgggcgcaggcaaaacgaagagauaccuccccgcuaucguuagggaagccauaaaacgggggcugcgaacacuuauuuuagcuccaacuagaguggucgcagccgagauggaagaggcccugcgcggacucccuaucagguaucaaacccccgcuauccgugcggagcacacaggucgggaaauuguggacuugaugugucaugcaaccuucacuaugagacugcucuccccaguuagggugccuaacuacaaucugaucauuauggaugaggcccacuuuaccgaccccgcuaguauagccgcacgcggcuauaucucuacacgagucgaaaugggggaggccgcuggaauuuucaugacggcgacuccaccgggcagcagagauccuuuuccccaguccaacgccccaaucauggacgaggaacgggagauccccgaaaggucauggaacucuggucacgagugggugaccgauuucaaggggaagacaguaugguuugugccuagcauuaaagcaggaaacgacauagcugccugccuucgcaagaauggcaaaaagguuauccagcugagucguaaaaccuucgauuccgaauacgucaagacuagagcaaacgacugggauuuuguggugacaaccgacauuagcgagaugggcgccaauuucaaggcugagcgggucaucgauccaaggcgcuguaugaaacccguaauuuugacggacggggaagaacgagugauccuagccggaccuaugccgguuacucauucuucagcggcacaaagacgggguaggauaggccgcaacccaaagaaugaaaacgaccaguauaucuacaugggggagccccuggaaaaugaugaggacugcgcccacuggaaagaggcuaagaugcucuuagauaacauuaauacaccugaaggaaucauucccuccauguuugagccagaaagagagaaaguggacgccaucgauggcgaauacaggcugcggggugaggcucguaagaccuucgucgaccuuaugcgccgaggggaucugccuguguggcucgcauauaaaguugccgcugagggcauaaacuacgccgacagaaggugguguuuugauggaauuaagaauaaccagaucuuggaagagaacguggaagucgagauuuggaccaaggagggcgaacggaaaaagcugaaaccccgcuggcucgacgcaagaaucuauagugauccacuggcgcuuaaggaguucaaagaguucgccgcugggagaaagagccuaacucugaauuugauaacagagaugggacgguuaccuaccuuuaugacacagaaggcccgaaacgcacuggacaaucucgcugugcugcauacugccgaagccgguggcaaagccuacaaccacgcucuuucggagcugccggagacgcucgaaaccuugcugcuacugacacuccuugcgacuguaaccgggggaaucuuccuguuuuuaaugucuggcaaggguauugggaaaaugacauugggcaugugcugcaucauuaccgccuccauccugcucugguaugcacaaauacagccccacuggauugcugccagcaucauccuggaguucuuucuuauugugcugcucaucccagaaccugagaagcagagaacuccccaggauaaucaauugacguacguugucauagccauucugaccgugguggcagcuacaauggccaacgaaaugggauucuuagagaaaacuaagaaggaccuaggccuggggucaaucaccacacaggagagugaaucuaauauucucgacaucgaucuucgcccagcguccgcuuggacccuguaugccgucgcaacuacauuuguuacgccuauguugaggcauagcauagagaacucaagugugaauguaagccugaccgccaucgcuaaccaggcaacugugcucaugggacuggguaaaggcuggccccuuuccaagauggacauuggggucccgcuccuggccaucggauguuacucucaggugaauccaauuacauugaccgcggcucuguuacuacugguugcccacuacgcaaucauuggcccuggucuccaagccaaagcuacccgggaagcccagaagcgugcagcugccgggaucaugaaaaaccccacaguggauggcauaacugucauugaccuugagccaauccccuaugauccuaaguucgaaaagcagcugggacagguaauguugcugauccucugcgugacgcaaguucugaugaugagaaccacaugggcgcuuugugaggccuuaacucuggcaaccggcccgauuagcacacucugggaggggaaucccggaagguuuuggaacaccacuauagcuguguccauggccaauaucuuccgcggcucauacuuggccggugcugggcugcuauuuucuauuaugaaaaacacgacaaauacccggcgaggaacuggcaacaucggugaaacccugggcgagaaguggaaaaguagacucaacgcccuugggaagucggaguuccagauuuauaaaaagagcggaauccaggaggucgacaggacacuggccaaagagggcauaaagcgcggggaaacugaucaucacgcggugucccggggaucugcuaaguugagaugguuugucgagcguaauauggugaccccagaaggcaaaguuguggaccuggguugcgggaggggaggcuggucauacuauugugguggccucaagaacguacgggaggugaaagggcugacaaagggaggcccugggcaugaagaaccaaucccuaugagcacguacggauggaauuuaguccgccuucaauccggcguugauguguucuucaccccacccgagaaaugcgacacucugcucugugauauuggugaaaguucuccuaacccaacaaucgaggcagggcgaacccuaagaguccugaauuugguggaaaacuggcugaauaacaauacucaguuuugcauuaagguacucaaccccuauaugccgagcgugaucgagaagauggaaacacuucagaggaaauacggaggcgcccugguucggaauccuuugucacgcaacuccacccacgagauguacugggugaguaaugcuacgggcaacauagucagcucugugaauaugauuuccagaaugcugaucaacagguucaccaugaagcacaaaaaggccacauaugagccagacgucgaucucgggucaggaacucgaaacaucgguauugaaagcgagauacccaauuuagacaucauuggcaaacggaucgaaaagauuaagcaggagcaugaaaccucguggcacuacgaccaagaucauccuuauaaaacaugggcauaccacgggucuuaugagacuaagcagaccggaagugccuccagcauggugaacggcguuguacgucugcuuacaaaaccaugggacgugguccccauggugacccagauggcuaugacugauacgacaccguuuggucagcaaagaguuuucaaggagaaaguggacacccgcacucaggaaccuaaggaggggaccaagaaacugaugaagaucacagcggaauggcuauggaaagagcucggaaagaaaaagacgcccaggauguguacccgggaggaauuuacuagaaaaguccgcucaaaugccgcacugggcgcuauauucacagaugagaacaaguggaaguccgccagggaagcaguggaggacggccgauuuugggaauugguagaucgggagagaaaucugcaccucgaggggaaaugcgaaaccuguguguacaacaugaugggaaagagggagaagaaacuuggugaguucggcaaagccaaagggucucgcgcuaucugguauauguggcugggagccagauuuuuagaguucgaagcgcugggcuuuuugaaugaggaccauugguucagccgggguaacagucucuccgggguugagggagaaggccugcacagacuaggcuacauucuuagggaugucagcaagaaagaagggggagcaauguacgccgacgauacugcugguugggacacacgcaucacccuggaagaccucaagaaugaggaaauggugacaaaccauaugaaaggcgagcacaagaaacuggccgaggcaauuuuuaaguugacuuaucagaauaaggugguccgaguucagcggccaaccccuagagggacggugauggauaucauuucuaggcgcgaccaaagaggaucaggccagguagguaccuacgggcugaacacauucacuaauauggaagcucagcucauacggcaaauggagggagaaggcaucuucaaaaguauucagcaucuuaccgugacagaggagaucgccguccagaacuggcuggcuagggugggccgugaacgauuaucccgcauggccaucagcggggaugacugcguugugaagcccauugaugacagauuugcaucugcgcugacugccuugaaugauaugggaaaaguccggaaggacauacagcaaugggagccaucgagggguuggaacgauuggacccaggugcccuucugcucacaccacuuucaugaacucguaaugaaagacggccgcguucugguggucccuuguagaaaccaggaugagcuaaucgggcgggcuaggauuagccagggagccggcuggucccuuaaggaaacggcaugccuggguaagaguuaugcucaaauguggacacucauguacuuccaccgacgugaccugagauuggccgcaaaugccaucuguucugcggugccaagccauugggugccgaccucccgcacuacauggucaauucacgcuaaacacgaguggaugaccacugaggauauguuagccgucuggaaccggguuuggauccaggaaaaucccuggauggaggacaagaccccuguggaaaguugggaggaaguaccauaucuggggaaaagggaggaccaguggugcggaucucucauaggccuuacaagcagagcaacgugggccaagaacauccagaccgcuauuaaucaagugcgcucccugaucggcaacgaggaauacacugauuauaugcccucaaugaaacgguuuaggcgagaggaagaggaagccgggguccuaugguga

SEQ ID NO: 14624 - RNA, 9876 nt, Artificial Sequence
  derived and/or modified CDS sequence (opt3) from DENV-2__EU482546__SS-prME
accgccggagugaucgucaugcugauucccacaguuauggcuuuccaccucacuacgaggaauggggagccucauaugauagugggaaggcaggaaaaggguaaaagccuucuguuuaagaccgaggacggcaucaauaugugcacauugauggcaauugauuuaggggaacugugugaggacacuaucaccuacaaaugcccacuacucaagcaaaacgaaccggaggauauugacuguuggugcaauuccacaucuaccugggugacuuauggaacauguaccacgacuggcgagcaccggcgcgaaaaacgaucaguggcccuggucccccauguggguauggggcuugagacccguacagaaacuuggaugaguagcgagggagcguggaagcacguucagagaaucgagaccuggauacugaggcauccuggcuucacaaucauggcugccauuuuggcauacaccaucggcacgacucacuuucagcgggcccucauuuucauccugcugacagcuguggcaccauccaugaccaugcgcugcauagggauuucuaacagagauuuugucgaaggagugucggguggcucauggguagacaucguucucgagcacgggagcugugugacuacaauggccaagaauaaacccaccuuagauuucgaacugauuaagacggaggcuaaacagccugccacccuuaggaaguauugcaucgaagcgaaauugacaaacacuaccacagagagucgguguccaacucaaggagagcccucccugaaugaagaacaggacaagcgcuuuaucugcaagcauucuauggucgaucgaggcugggguaacggguguggacuauucggcaaaggcgggauugugaccugcgcaauguuuacaugcaagaaaaauauggaaggaaaggugguccagccugagaaccucgaauacaccauaguuaucacuccacacagcggugaggagcaugccgugggcaaugacacggggaaacacggaaaggaaauuaaaaucacaccgcaguccucaauaaccgaggcugaacugacuggcuaugguaccguaacaauggaguguagucccagaaccgggcuugauuucaacgaaauggugcuguugcaaauggaggacaaggccuggcucguccacaggcagugguuucuggauuuaccucugccauggcuccccggcgcagacacucagggaagcaauuggauucagaaggagacacuugugacguucaaaaacccucaugcuaagaaacaagacguugugguccugggcucucaggaaggggccaugcacaccgcguugacuggagccacagagauccagauguccucagguaaucuacuguuuaccggccaucucaagugccggcugcguauggauaaacuucaacugaaggggaugagcuacaguauguguacaggaaaguucaaaaucgugaaggaaauugcagagacucagcacggcaccaucguaauucgcguucaguaugagggugacgggucuccaugcaaaauacccuucgaaaucacggauuuggagaagagacaugugcucggcaggcugauuaccgucaacccgaucgugacagaaaaagacuccccugucaacaucgaggcugaacccccauuuggagauagcuacauuauaaucggcguggagccugggcaguuaaagcugaauugguucaagaaaggaucgucuauuggucaaauguuugagacuaccaugcggggcgccaagcgaauggcuauccuaggggacacagccugggauuucggaucccucggcgguguuuuuacuucaauugggaaagcacugcaccagguguucggcgccaucuacggagcugcguuuaguggcguaagcuggaccaugaagauacuuaucggggucauuaucacguggauuggaaugaacucccgcucuacuagcuugucagugagucugguucucgugggcgucgugacccuguaucuuggugcaaugguacaggccgacuccgggugugugguuagcuggaaaaauaaggaacugaagugcggaucuggcaucuucauaacugauaacguccacacauggaccgagcaguacaaauuucaacccgaaucaccaaguaaguuggcuagcgccauucagaaagcacaugaggaagguaucuguggcauuagauccgugacuaggcucgagaaucugauguggaagcagaucacccccgaguuaaaccacauacugucugaaaaugaggugaaacuaacaaucaugacgggggacauuaagggaaucaugcaggccggcaaacggucgcuccgcccucaaccaaccgaacugaaguauagcuggaagacuugggggaaagcuaagaugcuuuccacagagucacauaaccagaccuucuugauugauggaccggaaacagccgagugccccaauacuaacagagcauggaauagucuggaggucgaagacuacggcuuugguguuuucaccacgaacaucuggcucaaacugagggagaagcaggacgcguuuugugauucuaaauuaaugagcgcugccauaaaggacaaucgugcagugcacgccgauaugggguauuggauugaauccgcucugaacgacacauggaagauggagaaagccucauucaucgagguaaagagcugccacuggccuaaaucucauacccuuugguccaauggaguauuggaaagugagaugaucauuccaaagaacuucgcaggccccgucagccagcacaaccaucggccugguuaccacacucaaaccgcuggcccauggcaucucgggaaacuggaaauggauuuugacuucugugagggaacaacugugguugugaccgaagauugcggcaaucgagggcccucucuaagaacaacgaccgccuccggaaagcugaucacugaguggugcuguaggucaugcacacucccgccucugcgcuaucggggcgaggacgguuguugguacgggauggaaauuagaccacuuaaggagaaagaagagaacuuggucaauagucuggugaccgcgggacacggccagauagauaacuuuagcuuagguguucucggcauggcccuguuccuugaagagaugcugaggacucgcguggggacaaagcacgcuaucuugcucguagcagucucguuugugacccugauuacgggaaauauguccuuccgagaccuaggccgggugauggucaugguuggggccacuaugaccgaugacaucggaaugggcgugacauaccuggcucuccuggccgcauuuaaaguacgucccaccuucgcggccggucuuuugcugagaaaguuaacuucuaaagagcucaugauggcuacaauugggaucgcccugcuuagccagucaaccauaccugaaacaauccuggagcuaacugaugcacucgcucugggaaugaugguguugaagauugucaggaacauggaaaaguaucaacuggccgugaccaucauggcaauuaguugcguucccaaugccgugaucuuacagaacgcuuggaaagucuccuguacgauacucgcggccgugucuguuagcccacugcuucugacauccucacagcagaaggcagacuggauuccuuuggcucucaccaucaaaggccugaaucccacugccaucuuucuaaccacacugagccgcacaaguaagaaacggucuuggccacuuaacgaggccauuauggcugugggcauggucuccauacucgcaagcucgcuguugaagaaugacaucccgaugaccgggccucugguagccggagguuuacucacggugugcuacguucugacaggcagaucagcggaucuugaacuggagagggcugccgacgugaaaugggaggaucaagcagaaauuucugggaguucccccaucuugagcauuaccaucucugaggacggaagcauguccauaaagaacgaagaggaggaacagacucucacaauccugauucgaaccggccuacuggucaucucagguguguucccaguaaguauucccaucacugccgcugcaugguaucuuugggaggugaagaaacagcgcgccgggguccucugggauguuccuagcccacccccugugggaaaggcggaacuggaggacggcgcuuaccggauaaaacagagaggcuuuuugggguauucucaaauuggagccgguguguacaaggaaggcacauuccauaccauguggcacgucacgagaggggcaguguuaaugcaucguggaaaacgcaucgagccguccugggccgauguuaagaaggaccugaucucauauggcgguggguggaaacucgagggagaauggaaggagggcgaagagguacaggugcuggcucuugaaccaggcaaaaauccccgggccguccagacuaagccugggauuuuuaaaaccaacacaggaaccaucggugcagugagucuggauuucagcccaggcacauccgggucucccauaguugacagaaagggaaagguggucggcuuguacgguaauggggugguaacuaggucgggagcuuacgucagcgccauugcgcagaccgagaaaucaaucgaggauaacccugaaauugaggacgauaucuuccgaaagaaacggcuaacgauaauggaccugcacccgggcgccggcaagacaaaacgcuaucuccccgcaauugugagagaagcuaucaagagggggcugcggacucuuaucuuagccccaacccgaguuguggcugcagagauggaagaggcccugagaggacucccuauucgcuaccaaacacccgccaucagggcugagcauaccggucgugaaauugucgacuugaugugucacgcgacuuuuaccaugcggcugcucuccccagugagaguuccuaacuauaaucugauaaucauggaugaggcacacuucacagaccccgccaguauugcugccaggggcuacaucucuacgcgcguggaaaugggggaggcagccggaaucuuuaugacugcuaccccaccgggcagccgagauccuuucccccaguccaacgcgccaauuauggacgaggaaagagagauacccgaacggucauggaacucuggucaugagugggucacagauuuuaaggggaaaaccgugugguucguaccuagcaucaaggccggaaacgacauugcagcuugccuuaggaaaaauggcaagaaagugauccagcugagucgcaagacuuuugauuccgaauauguuaagacacgugccaacgacugggauuucgucgugaccacggacauuagcgagaugggcgcaaauuuuaaagccgagagagugaucgauccacggagguguaugaagcccgucauauugacugacggggaggaacgcguaauccuagcuggaccuaugccggugacacacucuucagccgcgcaacgaagaggucggauuggcaggaaccccaaaaaugaaaacgaccaguacaucuauaugggggagccccuggaaaaugaugaggacugcgcacauuggaaggaggccaaaaugcucuuagauaacauuaauaccccugaaggaaucauacccuccauguucgagccagaacgcgagaagguugacgcuauugauggcgaauacagacugaggggugaggcccggaaaaccuuuguggaccuuaugcgucgcggggaucugccugucuggcucgcuuacaagguggcagccgagggcaucaacuaugcugaccgaaagugguguuucgauggaauuaaaaauaaccagaucuuggaagagaacguugaaguggagauauggacuaaggagggcgaaaggaaaaagcugaaacccagauggcucgacgcccggaucuacagugauccacuggcacuuaaggaguucaaggaauuugcggccgggcgcaaaagccuaacacugaauuugauuaccgagaugggaagauuaccuacauucaugacucagaaggcuaggaacgcccuggacaaucucgcaguccugcacacggcugaagccgguggccgggcauauaaccacgcccuuucggagcugccggagacccucgaaacauugcugcuacugacucuccuugcuaccgugacagggggaaucuuucuguucuuaaugucuggcaaagguauugggaagaugaccuugggcaugugcugcaucauaacugcguccauucugcucugguacgcccaaauccagccccauuggaucgcagcuagcauuauccuggaguuuuuccuuauaguacugcucauuccagaaccugagaaacagcgaacgccccaggauaaucaauugaccuaugugguuaucgccauucugacagucguggccgcaacuauggcuaacgaaaugggauuuuuagagaagaccaagaaagaccuaggccuggggucaaucacaacccaggagagugaaucuaauauacucgacaucgaucuuagaccagccuccgcguggacucuguacgcuguggccacaacguucgucaccccuauguugcgccacagcauugagaacucaaguguuaaugugagccugacugcaaucgccaaccaggcuacaguacucaugggacuggguaagggcuggccccuuuccaaaauggacauuggggugccgcuccuggcaaucggauguuauucucaggucaauccaauuaccuugaccgccgcgcuguuacuacugguggcucauuacgccaucauaggcccuggucuccaagcaaaggccacaagggaagcucagaaacgggccgcagcugggauuaugaagaaccccacuguugauggcaucacggugaucgaccuugagccaauucccuacgauccuaaguuugaaaaacagcugggacaggucauguugcugauacucugcguaacccaagugcugaugaugcguacaacuugggcccuuugugaggcguuaacccuggccacaggcccgaucagcacccucugggaggggaaucccggaagauucuggaacacuacgauugcaguuuccauggcuaauaucuuuaggggcucauauuuggccggugcagggcugcuauucucuauuaugaagaacacaaccaauacucgccggggaaccggcaacaucggugaaacacugggcgagaaauggaagagucgacucaacgcucuugggaaaucggaauuucagauauacaagaaaagcggaauccaggagguggacagaacucuggccaaggagggcauuaagagaggggaaaccgaucaccaugccgucucccgcggaucugcgaaauugcggugguucguggagagaaauauggucacaccagaaggcaaggugguugaccuggguugcgggcguggaggcuggucauauuacugugguggccucaaaaacgugagggagguaaaggggcugacgaaaggaggcccugggcacgaggaaccaaucccuaugagcaccuauggauggaauuuagugcggcuucaauccggcgucgauguuuucuuuacuccacccgagaagugcgacacacugcucugugauauuggugaaaguucuccuaacccaaccaucgaggcugggcgcacucuacgagugcugaauuuggucgaaaacuggcugaauaacaauacacaguucugcauaaaggugcucaaccccuacaugccgagcguaauugagaaaauggaaacccuucagagaaaguauggaggcgcacuggugaggaauccuuugucacggaacuccacgcacgagauguacuggguuaguaaugccaccggcaacaucgugagcucugucaauaugaucucccgcaugcugauuaacagauuuacaaugaaacauaagaaagcuacuuacgagccagacguggaucucgggucaggaaccaggaacauagguaucgaaagcgagauucccaauuuagacaucauuggcaagcgaaucgaaaagauaaaacaggagcacgaaacaucguggcauuaugaccaagaucacccuuacaagacuugggccuaucacgggucuuacgagaccaaacagacaggaagugcauccagcauggucaacggcgugguucggcugcuuaccaagccaugggacguagugcccauggucacucagauggccaugacggauacaaccccguucggucagcaacguguguuuaaagagaagguugacacuagaacccaggaaccuaaggaggggaccaaaaagcugaugaaaaucacggcugaauggcuauggaaggagcucggcaaaaagaaaacaccccgcguguguacuagggaggaguucacacggaaggucagaucaaaugcggcccugggcgcaauuuuuaccgaugagaacaaguggaaauccgcucgcgaagccguggaggacggcagguucugggaauugguagaucgagagcggaaucugcaucucgaggggaagugcgaaacuuguguguauaacaugaugggaaaaagagagaagaaacuuggugaauuuggcaaggcaaaggggucuagggccaucugguacauguggcugggagcucgcuucuuagaguuugaagcccugggcuucuugaaugaggaccacugguuuagccgugguaacagucucuccgggguugagggagaaggccugcaucggcuaggcuauauucuuagagaugucgggaaaaaggagggaggugcgauguacgcagacgauacagccggcugggacaccaggaucacacuggaagaccucaaaaaugaggaaauggugacuaaccacaugaagggggagcauaaaaagcuggcugaggccauuuucaaguugaccuaccagaauaaagugguccgcguucagcgaccaacgccucggggaaccgugauggauauaaucagcagaagggaccaacgcggcucuggucagguagggacauauggacugaacacuuucaccaauauggaagcacagcucauuagacaaauggagggcgaaggcaucuuuaagucaauccagcaccuuacagcuacugaggagauugccgugcagaacuggcuggcucgggucgggagggaacguuuaagucgaauggccauauccggagaugacugcgugguuaaacccaucgaugaccgcuucgcaagcgcgcugaccgccuugaaugauauggguaaggugagaaaagacauucagcaaugggagccaucucggggcuggaacgauuggacgcagguccccuuuugcucgcaccauuuccacgaacucgugaugaaggacgggaggguacugguugugccuugucgcaaccaggaugagcuaaucggaagggcucggauuucacagggcgccgguuggagccuuaaggaaacagcaugccuggggaaauccuacgcucaaauguggacccucauguauuuucauaggcgagaccugcguuuggccgcaaaugccaucuguagugcggucccaucucacugggugccgacuagcagaacaaccugguccauacacgcuaagcaugaguggaugacuaccgaggauauguuagccguguggaaccgcgucuggauccaggaaaaucccuggauggaggacaaaacaccuguugaaucaugggaggaagugccauaccugggaaagcgggaggaccaguggugcggcagucucauuggccuuacgucuagggcaaccugggccaaaaacauccagacugcuauuagccaaguaagaucccugaucgggaaugaggaauauacagauuacaugcccucaaugaagcgcuuccggagggaggaagaggaagccggagugcuaugguga
